United States Patent 8,067,671 (METHODS FOR GENETIC CONTROL OF PLANT PEST INFESTATION AND COMPOSITIONS THEREOF) - sequence listing, part 5

SEQ ID NO: 3300 - DNA, 5021 bp, Heterodera glycines
acatccacaaaacactaattaaacgtaattaattttttctatttaaaactttaattatttaatttttaggcattcctccatttttgcacattacaaattcacatatttgcttggacatctgttaatttgtgtaatttacggtgcatttacactgaattatgtgctcgcttatgcattcgaaaatgcgggaaagtatggcgcaattataattaaaaataaattaattataaaattttaaatttattcagtccaaccaccggtgttgtggcccccaacccttgcctacgcccttgctatcggcaccagggctgggaccgcgccgacaatgcgcgatccgcggtcgcggcaaaatggccgcgccaaagtgggtggttcccaatgggagccccccccccatactattcagtcccatcgcaaattttgtatatgcaggattttaactaatttaaacaaaattgagtattgaaatgcttggaggcatttatagcaattaccaaatggatagatgatactttgttgtattgtctatttttattttattttttaattttctgtaaaaaatgttgatatttaatcaactgagacgcagttggccttttactactaagacgcagttggcccgtttcgtattttggcgctagttaaaaagtcaccacttttgaaaattttttcaaacattttttttcatgcaatttttttgtttgtttattttcaatcatcctcagctaattttggataaacatttaactctcaattttagtcaaggttaaaatattaagaaaaaatttaaaaattgaaataaaattaaatgataaaacaattaaatatcttcagctagctatcgatttttttttcaaaatttttggcttttattattacttaaatttgtaattaattatatacaattttgttcagaactgctggacggaatcacttggtcttcaaagacttgactgattccaacaattttaaatatattttcttttttaataaaatcccttcttttttatgatttatttggaatagagaaaatgcttgccgaaaataaggaaatgctttttttttatggacccagtcaccaaaaaggacaaatgggcaacaagcgccatcgtatcggacaaatatagtacggtacagcgtagtccgtcctctgtggtgtgccattttaattcactgaaaaccatccgccgatgccgacgagaatggccacaactctcattagcaattaattatacccaaagacaaattcaaattattgaggcacaaagggcgtagaaagaaagaagatgacatatgttttcaataacaatgctcacgaaaacaccacccttatagggggagatgaattcattaataatttcattattttttttttttgtttgccgcgcactttacgcgaaaccatcgcttttttcggaataaaatagtcaaaaaaatttaggaagtaaatttaattttcaacattttttaaattagaaatgagaatttttaaaatgtgtaggggtgttttggcgcccacgtttcagcgccaaccctagtttttggactataactttttttttgtcaaccaaatctaacaatcttggtatcattcgaaagcttttcatgtttggaagctctttctaagctattgctctgcgattagacaattaacaaagaagttgtaacatgaaagttgcaaaaaagtcgaaattttagaagtttttttcttaataacttttttttacaggctagaaaatttttttcattttttgtaaggctaatagagcatgtgaaggggctttcgtatgatgctaagaatgctcgattggttgacaaagaaaacagttatagtccaaaaatttggcctggcgccgaaacgtgggcgccgaaacgaccctttcccctaatgatatatttttggtatttttatttttatttaatatttcaaatggcttagagagaagcaaaagtcaatagttttgcgttacattacacaaaaatgtcgtcaaatggcatcatcacaattgtggcgctattccttgtgttgtttggcactcacataacaacacaaattggggcaatgaatcgtcatcgccagcagcgctcacttggccatccgtttacggtggataagcagcagcatacggtaggagacaaagtcagtcagtcaattagaaacaattaagcgtaaaactaattgatccatccggattagaaaggaaaattaattttaaatataaatcttttttgattttaattggttttgcgaaagttttcgtttttttttgtcccattttcatataatccgttgaagggattagcaaaagttgcctctgtctgatgtcatcatcaccatgtgactttaaaatttagcggaagtttaattttaagacaatgggaattaattagtgaaataaactgagaatgacgtcaattaagaaagggaaaacaaaaattgattaaaaaaattcaaaactaattaatttatgaatattttaatttgttattcatttaatttgcacttttataggcacagaacgaaaatttggtcggcgcttatttgtctcggggaatgttcagctgtggcgccaaatatgttggcacattgcaaagactgaaaagaatcattgaggtaaaaaggaggcggaaaatgacagaaatttgaaaacaaaatgccaaataaatttaaaatatttaaaatataatttaaaatgttattgaatataaaggaagtgcatgccgactattcggaatgccaaaaatcgatgaagcaaatggacgaggacgagcaaatggcattcggaaaagggcacggcacagagcgatttgcggtgattgacgaactgatcaattgagcccaggggggcaatttgtggcaaaatcacaaaattcgaagcataaccatttgaaaaacattgaaatgatttttcattgtttgtgataaagcgaaacagcaatttgttaataaaatgccaaaatttgtgccaatttattcgctgtccaacaaaaattaattaatttttttcacaattcgtccccataattcgtttttgtttttgttttgttcgtcgtttcgccttttttctccatcattttgccctcatcagaaaatgcatctgcgcacttcgcctgcttcggtttggctttgagaaaatgctcaaacactttttgaaggttggcgtggaaaagcaatcggacctaaaaatgaaaaggaattaaaaataaaataaatatgaattaaattaaggctaattaattaatttttaaaatatctggcaataagcaaaggttctcgaacctgcacaggtatcttgtgtttggatgaatgtgggagaagaatccgtgacaagtttctgaataaaaaataaattaaaataatgcaaattttggatttaaaaacgaaaaaaactgaccgcataattggtccacgaaagctgaataattaagcaaaattattttcaaataatgaatcaatttattttttatttagtccgcttttcatccagtttgatccattgtccatttttgtgacttttaatagtccatattttttagccttctttcatagtcaatttggccttattggacaaatattccatttttttgccattttgtcactcgtttttttccgttgtccaaatgtccctcttttggtcattatgtccccacttttatctcgaatttgtccattttctcaccttgcagagctcttcgtttgacaatcaatttgcactgtttttactcttttgttccgtattttttttcatttagtccttcttttttccattgtctactatcgcttatttaaagctgtttacgctatcagagattgaaaaactgaagtttgaatccgattttggacatagtcgcaaatgtctggggcgcaaatgtacggtaacttccaattgtccacttttgtgtccacttgtccccttcccattttctcaccatgtaactcttcgttggcgtgaaattggcactgtatttgttgtccactttctgctgccccgtcgtcttcctcctctattggcacgtgccgtcctcttccctctcctcctcctcttcctcctgccccattttcgtcatcgtcaacgtcggccggtgccatttcttccgcctcacttttttgttgtttttgtcgctgtaaaaccattgcaattgttggccctcgtctcattattttgctgctggcaaatcgttcattttcatccgccaaagtgcgcacgacggacggcaaaatgaagaggaaaagcgaactgagggaggaaaagcgggggaaatttgaaaaataaaagtttaaaatttaaaaaatgactaacccaaaaaagaatgcattaatgtgagcggaatattggcgcatttcagcagcaggaatgcccaaatttggaaaagcgtaatgctcgtaaaatttggccgcgaatggcaaatgaatggcgcggaaagggacaaatgactgaatgaaaatgagagtgacaaaagcaaaacaatcgctggcggcgttctgaaaagcaattaattaaatagataaatgggtggtggtggtggcaattctcgcgttggcacttaatttattcgccaattgggcaaaaaaagggcaggtgaaatttgatcaaacgggggacaaatgggacggaagtgggcgaaggagtgcgtcaaaaatgacaaattgacaggcgaatgatttgattaatatgccaacggaaagcaaattaaattgggacactaaatttaacaaatcaaaaaagggagtgccaatgaaaatgaaatggaaaaaggaaattaggaaaaagagaaaaagcggaagaaaatggcacttttaaatgggcgatcagcagcagaggattaattgaataaaataagccaatgtgttgctctgtttcttaattgggcaacgaaatgactaaattgctaagtaaaaatcagtttaagtaagtaattactaattacatttaatttttaaatcttttcctgctccgaattttttttttacaaattccggtccctaagataattaattggtcatttatagaattagtagt

SEQ ID NO: 3301 - DNA, 3728 bp, Heterodera glycines
attgtgtagggggctgaaggaaacgaatgtccatagaagtatgaaattgaaacaaggtggctgtttcccggacatagatttatcttttaaataatttataactatttttttatttcgtcttaattcctatttttggcatttaaatgtaattgcctggattaatctcccggtagttggctatgccgtacgcatcgacgatggactggaagccctggttgaatttgtttgtccggttgtaagtgggcggcgactcggcggtgtccattctgttcaaaattgacggcactgtgctgccgctttcatcctgaaaatgcaaaagtacacaccaaaaaccacatgattggattaagttctcaaaagcgtacacttcctgtcttcagcgcccgttggattcggtcaagttccgaaacggggcaccaacactcggcgacaaagcatttctggtccaggttgaacaggttcagcgtgtggtaaatggccttgattttggtgacctttgccaaccacatgcgcacattcttcgccgcagaaacctatgggttttagtgaagtaaaccctggtgtccagttccacccgcccggccgtcgttgggtaaaataccagcactcggtgcctgtggtcctgcgtttgtcccagcaccgtcttcaggtcctcaatccgtgtcatcactccgatggacatctcccgacgttcctgcggcgtttctgggcatggataaatggaggcacgaaagctgaatttgcaaaatttgaccggatggaaaatgttggtgtcgtacccttcgcaaatttttttaatccgacttttcaactgatccccttggaagaaaatgatgaacaccgccttttggacagcaaggccctgaattgatacaatcatggtcaattggccactttcgggacaaaacgttttcgtaatttctaaaacaaattctctgttgtaattgttttttttttgtaaaagggtcattttatgaaagatttaggtagtacaataatcagagtctcgggttcctcatggccaacaattaaataactaatctgaaacggccaggggaaatgaactgctccctaccgtcacagtgtcactgagtgcctcggtgatctccgcctgtctcaagaacacattgccacggcacgcgcgccacagcaaacgttcaaatgttggcagacgttcacggagaatcacgccggcgatgaatctcaaattaaatgttgttctttcaattcaattaaatataaattcggctatttgctaattcaattaaaaattccattttcaaatgacagtgatttgtcctatttctcgtgacagtgcggtgaaaggtgctcaagtgtgcgtgtgttgtttcatttactaactctctatctatcccagtcattcactcacttcaaatggccctttgttgggatgggttcggtggcccggccttcggtcgggattaggctagagccgtcatccgtaaacagttcttcttgggcgagggtatttagggcctgctgttcgccttcattctgtccgtggggaacagacacaatcaaaatttgacacaaattcaaattgcgaaattagaaaacccctctaattcaaaaaatgtgttgttaaaaaggctgattataaagaaattagaagagcataaaaagaaacaaacaactgtactaattaatcaaagacaaaaaaagaaagggaagcaataaaaaaaagaatttcccgaggcaattaattaattaagacaaaattaaacaaaatcgagggggggggtaattaacactccgacactttaacaagaaatggacaattcactttgagcataaatcaccacactgtcacgccacaacgtttaataagtgaaaaataaatcgacaaaaaataattgggaccaaccgaaaacgcaaacgggaaccaccggtgtccacgaattcggcagggccgagcagcggctgttccgcgtcgaagtccacgcgcgtttcctggacggcggtcgaccgtttgtggaccgacgtggaatacaaccaggaacgacgctcggactcgaccttgggcaagcgaatgtgacgagacggaggagaggaggaggtcattgaacagagggagaacagaaaaaggaacaaacgcaacatggtcagcggaggagggacgacaaataaattacacggccgggttttatgacacgaaatttcggcaattttccattaccctcccccgaaaggttcttttttgaatttaattgtaatttttagcgaaaaaaagaaaaacgatttaggggatgggaaaggaaaagcaacgaaatatcggacatcaagaggaggcacaaagcccgacaacaacaaacaccgtgaaagtcagaagcggaacaaagggaataaacaggggaagagtcgaaaatatttaattacataggacgaaagcattgagacagctaattaaagtagaaatataagcaaagaagcattgccaaggggggaaggattagaacagaaacagcgaaccagaaaaaaagacaaccccaaaagccaaaaaatgggaaaaattactgctataaaaccttgaagaagacaaacttttaaagccaaaagcccctcccaatgattagaggccgtttgaacggtacctcgtcgaagaattgctgcgtctttctgagaatgtgtttcagctccgtcaactcggcaaaattcttcttcaacatttcctcgttttggttcacttctctgagttcgttttcgagtttctcaaaaattgcctggaaatttaattttatgaccggtgttttcccggagttatttgaaaaagtgtgcctccaagtcgaacatttctcgcggtgccggcgcttccgggttttcccctgtgtcgagcatcggaataccatcctttttgatctccgtctcaagaaacccttggcaaagtgaaattaggcaaatccaggaacacaactgattcaaaattactcaatttgcgctccatttcatcacaacgacgcacttccgtcacaaattttcgttgaaaaatgttcactttttcattgagctaaattgagattcaaataatttgccaaaagatttgctaaaaatcacatcacgaaattgcacaagtccaagttcgcccaactcggcaacgcatgagtaagcagcctctttttgcagaaaaagttgtgtcaagcacctaaacgaatttaaatgctcaaattgtgtggtgcccaatcggcgaatgtctctcacatttcttcacttcgatggatggaatccatgccttcttcctttgggaggaacaaacaatgggtgaaaatgcaacaagttaatgcacagaaaacagaaaaagcaaatttagttaattcaaatctaaatatatgtaaatgaatattggcaaatggacggccaaacgattaattattaattacaaaaaagaaatgaagcaaatattaatttgtactaatcgaatttttgccgtttaaaaacaaaaacaataagtcaatttgatggccaaacaaacgaaatgtgagtaattgtctcaccttcccatgcattaggtcgtttaggaaaaatccaataataatttataatttatttactcaaacgatttcctgcattttctgcctctctgaccttacatgtctctctctgtctgcgcacattccgcttcaacttttaattgcctttttcaattttggctgtcaattttaccatttgtctgcattttttgtctgtgtctgttcgtttgttcgtcccattcc

SEQ ID NO: 3302 - DNA, 1878 bp, Heterodera glycines
cgagttaatattcccaattaggtaattgtgttcagcgcctgaagctaattatataaaagcattgagcaaaagccgatattagtaaaaataaaattattggacaaagattttaggacaaagatcaatttaaccttaataaactgtttattttgtttacgatattgaaatttccgaatttatcccatgttgtttgttattaaattagagcttttgtttactttgatgtaaaatcacaatttttaaacctttaattaaacattaacctgtttagatttgttacaaacgcttggaacttgcagtgagaacaacaattgcaacaatttttggccttgagccaacacaccatcagttattctgttcaacacttagtacgaccaaagaagacccctttcaattgcatgtgaacatggccgagaaaaggaagcttctgaacgaaattgataaatgttataaaaaggtgttttaattgaaacatcatattaaccaaaagtttatttcgttgttagatcgacgaaggctttgaaattttcgatgacatcatggagaaaatgaacgaagcaaacagcgacaatcaacgagagaaattccaggacgacctgaaaaaggagataaagaagctccaaaggttaagggatcagatcaaaggatggcaaaactcttcggagatcaaggttttcaagtatttctttcacttaaatttgattacccttttctctgttattgaaggacaaggactctctgtcaaagtttcgaaaactgattgaacaaaggatggaaatattcaaggacgtggagcgagaaaataagacgaagccgcacagcaaacagggactgtcagcggaggacaagttggacccgagggagaaggaaaagtgcgagaccattgaatggctgaatgtgaggagagcgaaaacgcgagccataccgacatcatctcccgtcctttatagtgccaaattcggagaatacaggacgaaattgacaggacggagtctaaactggaaacaatgtcatccatggccgactcaaataggaaacggggcaagaaggacgaagcgaaaaagaatgagaaagaggtgtgcggaagagggtgatggccgactgtttttgaatatagtaaagttatatttttcaaaaaatttagaagtcggaagagctgaggaaacatctggagagggtaaaattccatctgcttaacttggaagtgtgcatgagaatgatcaacaatgaaaagctcgagatcaaggttgtgcttggaaagttgaaggagccgttggagatgtacatagatgcgctggacccggagaatgacgacgatcccgagagtttggaccctgaaggttgcttgaatcacggcagcttttgtacacacacactgctggttttcagacatttacgaggaacttaactttggcacatacctctcgcaacttggcggaatcattacgacgacgagtgtggacgaagagaaggggccattgccaaatgacaacggctgttcttccggatctccccaaatttccggcaaggagaagcagccacagttgaacctgtcttcgcctaccatcgctgctgcgccgattgtaacctctccggaatcggctagtgccgacataacaacatcagtgggcaccgcatcggcaacgaccgcgcaggaagacgtgttccttttcaatggaaccgaggcacaaccgcgtaaaagcaaggaaccgcaagaggtgatttatttacaaacggaaaattatataaacctgagtgcaatttaacacccaaaaattgcgattttgagtttttttagggtaagttggagtttaaggaccgaaccggcggcgtcacttaggacgccagtattttggaatttttaatgaattgtaaaaa

SEQ ID NO: 3303 - DNA, 1032 bp, Heterodera glycines
  misc_feature (17)..(17): n is a, c, g, or t
  misc_feature (25)..(25): n is a, c, g, or t
  misc_feature (102)..(102): n is a, c, g, or t
  misc_feature (107)..(107): n is a, c, g, or t
atttacaaacggaaaanttatatanacctgagtgcaatttaacaccccaaaaaaatgcgattttgagtttttttagggtaagttggagtttaaggaccgaanccggngcgcgtccttggtgtcgccagtattttggaatttttaatgaattgttaaaaatttgtttaaatttaaaaattttattctcccaccttcgccggagaccaacccacccccggaattttcgttttgggcctacgttacctcaaaaatgtcaaaaagggcgcgctggctggataattttttttaccattctcatatcataaattagcgtaaaagactttttcagtttttgcgcatgaattattgaagtttaggcccaaaaagtacccccactccatctcttacaccccccccttcggttcagaattttaaaacgtttcaatgatccctaaatttttaggtgcggagtgcttggggaagtacgtacccgcgtaccccctcctgtctccgtccctgtacatcgagtctggacctctcgcaacctggcggaatcatcacgacgacgagtgcggacgaagagaaggggcctctgttaaatgacaacggctgttcttccggatctctccaaatttccggcaaggagaagcagccacagctgaacctgtcgtctcctaagtcgcctaccatcgctgctgcgccggttgcaacctcaccggaatcagccagtgccggctcaactacatcagtgggcactgcaagcggaatcattacgacgacaagtgtggaagaagagaatgggccaccacaaaatgacaacggttgttcttccggatctccccaaatttccggcaatgagaaacagcggcagctgaacctgtcgtcgcctaccatcgctgctgcgccggttgcaacttctccggaaccggccagtgtcgactcaacaacatcagtgggcaccgcatcggcaacgaccgcgcaggaagacgtgttccttttcaatggaaccgagtcacaaccgcataaaagcaaggaaccgcaagaggtgattta

SEQ ID NO: 3304 - DNA, 3759 bp, Heterodera glycines
  misc_feature (3681)..(3681): n is a, c, g, or t
  misc_feature (3716)..(3716): n is a, c, g, or t
gaggagctgttttcgggtgcacaaaatgaagagcagcggaggccatggcacaaaaagcagcaaaaagcgaattttcggggccaaaaagacaaagggcggcggcggaaaggaagggggacgagtgggcaaaatggtcgactggtggatgggacgaggagaccaatggccgaacgaagcggaggaggaggagggagaaaagcgggacaagcaacagatggtcacgctggccaagaccaccattcagttgagtccatcgtgggaaagggacggcacaaaaatggcggagaacggcatggacagggacacgacggtgaggggataaagcatgggaggagggggaagagtgagcgaaaagcagcatttaaaggggataaattactgtaaagagggggtacggtaagaggatgaaaagggaaggaggaaaagccgagtaagcaaggcatcatcccttcagcagaagttcaacattagcaacaacaccaacagttgcacaatgccaacacctttcattgttggcaaaagtcggacgattccattgaaaaacggatggaatacgacaaaagcaattgagaagactgatcagtcgaaaagcgaagacagagggaacgaaggtgatcggaattgaccatttgtgggcgggggagagagaaaaaagagatattggtggaggagcggttaaaaatggtcttaaagcccaaacatttgctagttgctgtgaaagctttcacctgagctactgtagcagtactgtaaaagcaaaaacattttgcggtatctttccgacaatataatttctccttttcgactcatccagtgagcgtctctttgcaagttgtccgggaacacaatgtgaccatttcggcatcgtgctgttttggtggtgtcgctgagaaaaaattcccgccactttttgcgacaacgacggcacaccgcggaatgccattgtcattttgtagaaatgaaaaaggcagcaaaagcgtcaacagaacgccaatgggggcggaagtgcgggcgaatggcgccgccggtgacgtggtgagaaaattggaactccgaatggtcgacattgagctggaagagggggaggacgaagaggacggcatggaggaggagaagcgcaaatggcgacggagggaatggcacgacggaatgagtgggaagagagtgagtgctttccgaagttcgaagtttcggactctcgcttatttgaaaatctaatccaaaaatttgttctaattttggcaaatttatttgtcagagtcggcaagaagaagaagacaaaggcggagcagcaccaactgcagcacaacccaaacagacaacgacggggtggacacaattcaaacggaacagagagcagcagcaaagagagaggagggaggacggaggtgaaaaaaaggggcggtggtttgggcatgctttgattagctatgcccgagagtctcgagtcaattaaacctaacctgactttttgcgtctcgactcgagagtgccccccgccgggcagccaataaaaataattccgacaattttgtttttggttttaaatgtttcgaattattaaacggcgaaggattagaagcgcatttgcataattattgaaaaacattttatgtttgcaacattttccccttttgctcatcagtgtttctccccattcgtcgcctttgtccaccccaaaaatattcgtcgccttattcgtccccaacttttgtgccttttcctcccaattgctccaccgcccaaagtgccgtggccacaaacttcgcccgtgccaattccgccctgccacttctgtccccattgtgctcccctcaaacggcaccgctttggttgaacatcagcaacgggtcgagcagcggagttggctcaagcggtgagcacgggaaaaaataatcggcttattacccattttaaaatttaaaatgtgccaatatttctcttttgtcttctcagtttcgtcagtttcgcccaaatcgaccgacggtgagggcgaaagggataacggcaaaaacaacggccacaaaatggagcagttccagcagcagttccgtcgcacaacaaactcctggacgagtcgtcgtccccactgcactccgtgcggcggcactgctgctgcttctgctgactatcgcgtcatttcgttggacatgcgcccggagccgggtcgactggacgactttgtgcccgaggtgaaattaatgatattaaattgaaaacttaggaagtgctaatgatattattaattgtctatccccgcttattaaaaaggtggagagagagagaagcaaaaaagcgatggatagaacaattggagaatttgacaattgcactgacacaatcaaagcaaagaaaacgacgactggggaatacggtaagggtaactgtaagaacggaaccaagaccaaataaattcgagagaaaaccgacaaataaaacattttgaggccaagaaatcacagcgaaccgagtcgaaactctagaatgtatgtacaaaaagattggggaatggtctcttccatggcaccgactgatctttgcccccccccccccatcttcagcagctgcgtcgttcaccaatgccaaaacggtggtccgcgagaatcgcaattacgacttgcaaagcgtcgactgctggcgacggtggtcatcgcttcgccgaatgccaacgacggcaaatgccgcaaaaggaggaggaggagggactttgccagcaaagaaaagggaggcgaagcggacggaggagagtcaaaatgacggagaagaagaagatgaagcattgcgcagagatgagtggggccgactgattgtggttggttggagacggatgaccaaatgtgtgggggggggggggggacgggggagactttcccggcttaaccgaatcgagcctcttactaatttcagatggggtcccgaatgtaaatatttacttggatcttttgtcgctaatagccactttttttgcctaggatcgaagagagtggcgtcaattcttagcggaacagcgaacgcccagcagccgacgcgtggagagccgaattcgtttgctcgacgcatgcaacgacagcaacaacaacagcgagacggacgacggattagagcagtaccggtatagactaatggcgttcgcaaccgaaaatttctcgagactcaagaccaaaaaccgggacttttctcagtcgagatcctgggtcagctctcgttcgaaccgaggaagtccgggttttaccttgggattcagactcaacaaccaagctaattctccatctcgagtcgatcgggtttttaaggtttcagtctcgggctaaattctcggccttaaaaaaggaacccatacacttatcgaaacaccaaattgttggcatttaacagaaaaattggcacacgcaaaaagccaatggtcgtagttcttgacggaggagggaaagaagggcagcagcagcaaaagttggcatacgatgaagacaaaaaactgctgaggagcgcgacgatgaacaacggcaattgtaatggcaacggaaggacgacgacgacggcacttttaatgagaatgaaaaaagaaaacggcgacaaaaagtggagacaacggaaggaggacgaagaaatttgggagggataaaagggatgagagagaagcagaagcggaaataatgatatgataaatgataaggggagaanagcgatgggaaaatttaaaaataataaaggatagntaatgaatagaacccgtgcgacgcgacgaatatgcaaatcata

SEQ ID NO: 3305 - DNA, 1967 bp, Heterodera glycines
ggtttctaccatataaatcgacgagcttttttttttacttttttaaacagcttttttttgcggcacgcttttttcaaaaaaaatttgggaacaggggggtccggcgctgccgataggcgtcgccgggaaaaattttgagaatttcgttcagatttcttagcaggttttcacaaaaaatggccaatttttgcgactttgagcgccgtcgaaaaaatttgtaatttttaaagcgatttattaacaatttttgcgcttttgggttaattctttaagaaaaatggggctttgggtgccggcggttcaatacttttcctctttttccccttcgttacaaacccccccccccctcgtcaacccccttcctttctctcgcccgaccccgattacgaaggcccacttcctcgctcccggtaaattcgacactattgaatataaaaataaataatttaaaataaataaatccatttacacacacaaattatttttcaacctatccaaaattacgacggcgtccaattttctggtgtccaatttacaggtcccactttgttggtggctagaccaccccaaggttaaactatttggcggctgctagaaaatcaacattactccagtatttatgtgtttcggctgcagaatcgccggttccatatacatatgctgatcatctataaaaaataattaccaattaacattaatacagtggtggaaaaaagtctagacgcaaaatgataaaatttgtaaaatttaaaaattttgcttgtttaagtcgacttattatttttattttggtataattaccagggctgccaaaagcaaattcaataaaaaaattttattcatcataaattttatcggttgtttttgcaatagcaaatcaaaaatttctcaagattttcggcactaaagatcatcctattgtctgccaaaatattcttataaattgaaaatgaacgctccacttcggaagattgaattggagcatgtttgtacttgcaatcacttcgggtagcaaatgcatttgaacattttcataatagtttttttctaagggttattcaaatcggaaaatatttgacgaaaaatggcaaaatatgcacgaaatatgcagaaaaagccaaaatatgcaaatatgcaaaaaaaaatctcgaaacatgcaaaaatatgcaaataaaagtcccgatttttattcgcaaacacaaaaaagaaagtgtttttcctactatttagagcatggagaagccaggaaaaaaaatatgcatttacatacttttggcagccctgataattaccctcaatataggactcttttatacacaataagaaaatttattcgacttattcattcccgagattgattcacttgatcagacttgactgaaaaaagggcggaaaaaagtcttgactcaaacatgaaaaaccacgttatagttcattaaaaatctgaaataattcatgcttgcttagcttttgatgctgatcaaaaaagtcttttacaccaacttgatcagatcaccactccttcatggtgacctggaaagacaaagtacaattttcagaccaagtataactttttatgtacaagtcgtaaccctaccattcagaaggcaattcggtagagaattttgtgctctttctggtagccctatccaaaattgcttgtatttgaatttatggctattaagcttttaaaatcttctttatgtcccataaatataaataatctaaaggtaatttttaaatattattggttttaaaattaaagatgtagcgaatattttaactaatttattttttattaaataaaggaaattatcaattaaaataattaaatttagttatttggataatattttgggactgaaacggcccctcccttctaaaccagcccacccatacttttgtcacttcgcccacacttatacttttgtcacttcggcatagcaccgaaggaggggggggggggg

SEQ ID NO: 3306 - DNA, 1833 bp, Heterodera glycines
ggagaaatttacaaaaattttacttagattaaatttaatttaggaaaaatttacaaaaaattatttttaagaaaaaaaattattaataaaaaaattttttactttatttaatttgtaagtcagtgctaatgagtaaataaatgcaccccttttttcttttcaaagaatttggtcaaattacaaaaaaaactcgtatgaaaataagttatgccctaacttgtattatttattatattattttccaaagttgtgggttttacgaaacggcctgggcaaccccatttttctatgcgaatgaattgtcagaaaattgaaaaatgtaaaaaacttttattacatgcactttttgttttaaattttatcaaaattcaaatctttctaagattaaattttagattattttcattcttcaaaacaacgaaacatttacctaaaacggaacaaatttaatataaaaaaattttccataaattatttttccaacaattaaaaatatttaaatgattttaataatttaaatgattaatagatgggttttttgcgaatgtttccattttttaaaatttcatttcacctatgagtcagaaatttatttgaatatgtaaaattatttttgacaattttatttacatatttttgaatttattataatacaaattttccatcaaataattaaaaactttaaataaaataaaaattgattaccttttttaatatctgtgatttaatcactcgcatttaatttgatggggttccgtgtgtttcatcgagcagaaaataataatgacaaatgttgcgtttgggattttggcgcgtgacgggccaatgccacacaaacaaaagcataaataaaagatgtaaaatgtgattgatatatacccaaattggtcaaaagaaataaagtgggcattttagccatttgaccgatggattttcatacaaaatcaaacatccagcatttattcttggcacaatttttttcgcttggattggtcacttattgttgctgccgtacgaagatttatgtggcaaaatgcaccatcaaattcatcgccgacagcgccaaaatggcactaatgaggcggctaatttattaattaacgcagtccaagcaaatgaatgtttacgcctaactgacactaatgaggcggaaacgatactactaattgacgcaatcaaagaaaatggcactgtaccactgaagccaccggcacaacctgccaaagccatgcactttgtggtcatttcagcggtgtacagtacaaaaagcaaactgtaaatgccgtggccaaactgtaaatgctttggctgacgattggtctcgcattccgtcattaaatacttaaaaaaaaatgaaaagcataataatgaatacaaaaaatgcatgcgaaatgcgtcggttgtggaaaaacggattcttatatgaattaggggcttaaaaatgcctgaaaatccagcaattactaatctttccataaatctaattatactaattaaaaaagaaaagctgctaatttgttttaagttactctgacaatcaaatcgttttgttggttgatgcacaatttgatgatgcaattgtgcaacaaatttttgttgctaaaacgtccaatgggacaaatgagcaacaaacaaattttacactgcataaagcttcaagacgtactgacgtatgcttatggagttcttatatgtctgtgtttgattcggttgatcaaccagaaatgcttcaagttggccaagccgaaaatatggcacaaattgaggtattttttattgtatctgcaattagattgggcccgtatcatacattaaataggagggggggggggg

SEQ ID NO: 3307 - DNA, 2248 bp, Heterodera glycines
  misc_feature (319)..(319): n is a, c, g, or t
  misc_feature (2199)..(2199): n is a, c, g, or t
  misc_feature (2213)..(2214): n is a, c, g, or t
  misc_feature (2222)..(2222): n is a, c, g, or t
tagtgtaatatttgtatggtcagcaaacaatgtaaggtaatttaaatgtatgaaaattgttcaaacatcaaattaatttacacccggcaattgatatgaaaagatagcacaaagattctctcccgtaatacctatgggtcattcattcttatcaaaatgcattcctcctcatcttctgaagagggggaaatccacgaaccccagcaaaatattcaggctcaagagcaaaatcacgaccttgacaattatgaaaaacgtttctttcttggtgaacctatccgtcaaaaaacacataggcatgggcggtcgacccccgccntaaaaaatgtacggccaattaagtcgggacacttttagtctgtatagtcagttggcatcaaaatagaatgtattttgaatattttgaatttaaactaactttttgcgaaagaattggcaaaattatggcctttcggtgccattttgagctttttttcgcggttgacggtaaattcataaaaaataaacataattaagccattaattatttcattaagttcaattaaaattgaattttcttacactacttttaaggtgaagcggtcgtacgataagaagcgctttgaagttggcacttgttttagtccacttttctttgccgaacattggcaattggttgtgttgaccatcgaaatttatcgccattttggcagtgctcttcaaatcatttatttaatgagcgcaatcgaaggcattttcgatattttaaaggtggatgggttacgaattaattaacattaattaattcattatttatttgtttaattattattatttaatttattagctgtatcaagcagccgatgttgtccaaattgagcattggtattcaattcaaatcgaaggggaaaagtacaagggccttgcacagaccataaacacgaatcaagactggaggaatcaaatatcggcgcataccgattgtctgataaaatatggggtaaatttaactaattaaaacggacgggagaacaattattggaatttaattttgataaaatgcaaaaagaaaattataaaatttgtgaaattcttaaataatcactaattgcctaaatgtcctaaagaatgcagccgaatttctgattattggagacattgacgatgttttggtgccaaaccatggcttttattatgacgaattcattcgaaatgatttgcaaaatgccgccgctttgttgtacgaccgcttttatgttgatacaacgaccagtgggtgccatgggccaaggccttaaatttgaaaaaatggccaaaaatcagcttaaaatttttcaagcagtaaaaagcggaggattggaaaggatttgtgctgttcgagtccgagatttaccgagactttttttacaaaattttttgttcacttaaaatctttaaaaaacaaatctttgaaggttttcctcacaaatttttgctttccttatttcaccttcgtctatttaatacccatataaaaatgtacgaaaactcgttaaataaaacaaaactactaacataagctaagaaaaatgtaaaacacagagcattagaaattggcaacctatagcaataagtgatagcaaaagttgcaagaaatataaaaatttcttaaacgaattatttttttaagttcattaaaagccaatctttagaggtgcaaaaaatctcggtcttggtctcgagtcccgaaaatttagaccgaaactgaaatttttggagtttctcgatgtacactttatttgaacaaatccttcttttctctaagatacaacaaattaaattagtccgatttcgtttccggcatcttcgtgtcgatatccagtggtcacccaaccggtgcccgcactttaaaattttttaatatttatctttaattaattttttaaatggtaatgaaattggtacgggttgaaaagttccgcgcagctgctgagagtaaattaagacttagctcgttcttttggggcccaccaccaccgatgctcgtattttttaaaaatcttcttttaattatttttggctcccgctttggtcacgaactcactcacaaatcattgcccttaagctagggacccggagcgcttctcgctgttcaacattgtcatgtcggcaaaggtggacttgcacaagtcgcatgtgtccaaatatgtggtgaacacgtcactcacagagtcgctgtgngtccattggccggnncacacaangccaaacacaacgctacggacagtgc

SEQ ID NO: 3308 - DNA, 5002 bp, Heterodera glycines
atccattagcactatgctcggctctgttctgatttctcagaaatgttctggttataagaaatattcagattttggggtagcgactagagaccggaaatttcaaatttgcggatcccgctgcgggattggaatccaaaatttttttgcggactgggatcccgcaaaatcccgcatttccaaaaaatgcggactgggaccccgcaaaatcccgtgtggaatccgtcccgcgccggtctctactagcgaccaaattttttattatgatttcttaaaaaatttataattttggcgttttgtttcgttatttttggtcttatctcaaaattttatttatttgggacttctggactttggtttttttttgttttgtgattttggatatttttgtttctcaaatcgcctcccattttttctttattatgtgcttcacttttaataaatttgtctgtgttttggactttcaattcgtttgtgtttgctgtgcctaattgctggtcttcaagtgtcaatttgtgtgaagcggattaattgaaaaattttactccggggcatcacacagagtaagcaggagacaaatacgctcattgtattccatgcaattttatttatttattttttataaaaattaaaaaaatgtcatcagaagggcgaaaaccacttactctgacgactgttcagataaaagtgtcgtgagtaagtgacaaattatatggatgacaacaggggaaaaaacacaaaatatgtgaaaaaaaaatttgcccttttaaatgcatttttatcttaaaaatctgcgcttaatacagtaaaaattgttatcatgatctgctgttgtttaagtcacctttgtgaagcacaaaaacattcaaaaaacgaccaattaaacgccacagaaaatggggttaagaaatttcttgtttgtaataaattcaccacggtatatggcactaagacctataatagggtgagaccatagttattattgcacaaactgcgaatgtaaggcaggtcaaaaattttccagagtacggaattcaatcctctaaaaaatttgaggaacccggaattacaatctataaaaaaactttccgtagccataattttagttttttttaattattattattttccatcatttaaatttgattttatccatttccaatgcaaaataaaatcttgatttggctttttaaaagagcgtcaaaacgaaaatctcacccaaattttccaaaaaattttgttaaattttcataaaaaccagaaaacaaccaatttttccgaagatttttttcaatgaaaatctgctaaaaatacgttcttttcttaaaaatatgctcaaatcgcaaaatttggccatttttatagacaaatctgttaataaatcgcattaaaaattacaaaaatattcccggcggcgcctattggcaccgccggccccccttgttcccaaaaatttttgtaaaaagctccacaaaaatatcaacttcgatttttcatgctcagaattttacaaaatgcttatttctaagaaaaagttgaaaatacatacaatatatgaatattttaaacatgttttaaaaaatttgtaaaaatgagactttttgacacaaaagaggtttttttgcatgccaaatgaggcttttgaaaattttaatctggctaccctggttgaaactcaagaaaattttttttaaagataaacaaagtttcttagggtgatcgaatatatcaattaagtttggctcaatatttattttatttatttattcgtaaaaataaaaaagtcatcagaagggcgaaaaccacttactttttttcatcgcaaaatttcggttaaatatcaaatttatcaattgacagaactgctagagaccaaccaacccctttcgataaataaatataatgaactttttgagcaatatattttgtaatttttataatttttataattcttagaatattcacggtttttgagtcaatttaaaaaataaagggaaattttttaaatttgagtgtcaacaaaaaatgaccaaattttgcgactttgagctacttttttaaataaaatagaggatttttagggtccggcggtgccgataggcgccgccggtaaaaattttgaaatttttagtgcactttgttaacagatttagtccaaaaatgaaaacattttgcgattttaattgttaaattttattgaatttactttgaaaaaaaaggaatatttttgaaaaattagaagaaaaacaactacttggatgggaactgacccaaaggaaacataatgaaacgagctgagagcactccactcgaccatgcttctgaacaaacacttaaaagcaaaaagtttataaatataattaattttaagtttaccaaaagccaatcattaggggtgcattttcacattgaaaactcaatcctttaggggtgtatttttcccgaaacttcgggtaaaatagccgaagccgaagcacgaagttcgaagctcaaaaaacccgaagttttcgaagccgaagtttcgcctagccctgcctataatgggcaatttgcccatttactcactttgaaaatgcatgcacctgtcaatttgttaatgcatttgtccgaatttctcaatattaattcataaaattgtttgccgaagaatttaatgttgaagagtaacaaaattctcgataaccttttcaagaaaaagaaagtcataaaatttttatataatattaaacacctaaataacggcaagaacaaatttatggttaaatttcctttttaattaaattttgaagcaaaaattaattagtattgaatatggttcttttcaatattttagttgttttttttgctcattttcaagggcatcttgaattcaagggtattttcaaattttcatgtgaggggcccagtttcaaggacgtccttgccattcaaggcatataggagcattgttcaaaaagtattatccttattttaagcctaagctggtttgatgatttttcttaaaaactccccccacgtcctcgccagttttattaattaccctcaacgcgtttttgtcttccttccttccaagatttgttgcttttgttcctcatttgcttaatgctttttcttatctgattgtgctttcccttacgttgaattcaacaaaatctctgcactttttcattaacttttgcttaaatgcaacaatttgtttcctttttatgtgcaagaaatatcgcattttgtgtgttattaatttcctcgttaatatggtaccatccttttttttaaaaattttcatttaaaaatcatgaagaattttccgggcttttcgaggtcactattcacgaatccggtatccatttcggcaaattccaaagcccgaagccaaacttgaacaaaaagtcgaaagtccaaattttcgagtttcgcatttttggttcaaaaccggcctaaacaaacggaaacaaactgaaagccaccaaccctgcaataaaagataacttaaactattagatataaaaatgcgaaatttgaaagtttggattttcgaccttctgtacaaattgggctctgggtttagtaattggtcgaaatgtacgccaggtgattgatcattgatcagcgaccccgaaaccccctgctggaaacatattttcatgatttttaaaatcaaaattatttttccctaaagggataacatcggcagtaattaccatttcctcaattaaatgcttttcaatattcaaatttagaaataatttccttgaataaaatatatatattacatttaaattgctctctcatgcaaattctgaatgttacggatgattgggttgtcggagtgatccgtcgcctcatcgaagtgacccatcggataataacccatgagaaaatgcaacgattttacaccgattttatccattggctctgttttgcactccgttggatgaacgccaaaaactcagtgctcaacaaaaaattaaaattttccacattaatcggcacatttttctgtgtttatgttgtccaacaattgctgcccataattttcccaattcgtccgccgcctgcgcctgtttttaagccgatcacccgcgatgtgatcatttatgccaccttttcatacaaaaacagcaccaggtacatatctctttagacggacaattttcggtaataaactgctggagaattggatctcctgatggaaaattaagttaaaatttttgattcccaattaatttaggggtaaaaaaaaggttgctgctcgctaattttaaaaatcatagcttttgtatatgattttttaccaagtacgtgatttttacaaaaattttgagaaaactaatcggccgtaaaaaaaactcttacacagtgttgtagagctcaacaagaacttttgaatgaactatgctaatgttcggagaagtcaagtttttagtttttttataattttttggaatttaattattcatcccttaggggtcatataagacgggggtcaccggttcgagtccgcttggctgcggtttattttttttatgataggtgatgaaaatcatggacacaaaatccatgatttttcaacacctaagttcagattcttgatcgaactacacatatttccccccccccccccaggttcattgggaagaaaatttttaactttcttttccatcgggaaaccaattctccagtacactacccaatccaattttcggcatctaatttctaaactcttcaaaaagtcgcctctcggtctattaattattttgttcatttgcaaatttggttaattctttttcctccacagtttcggcgtttcctctcacgacacctttgtgctgttaatgatcgccgatcgttccgacaattttccatttatgcgctgcgcacgcgaaaagaccgattcggagcccatccaggcccaggttgagcactacgattacaccggactgtgcaatctgatcatgttcatcgccgtttgcaatttcccatcgccgtccgcggcggacgaacg

SEQ ID NO: 3309 - DNA, 1847 bp, Heterodera glycines
ggcgacgagaaggcgggtcaactcccgcctactgcacgatatggaaagggactgggaccaatcaaagcaagaagaatgagggacgtgctcggagacggtcggggcgaatcccgattcatcaactcattcaaaattgatcagtcctaatgtttgccttttttcataaaatctcttattccaatttttatttgcatttttgttccatttcgtaccattcacattttgcccgttccttagtcccatttttgccccatcacatcccttcacaattcaaattcatttctcatcggctggttcatcttcggccaactttgtctcagcaaatttcctttcacaatttctcactttccacatctgccaatttacattttatttttgtgcgccatttcctttgtgctcatttttcacatcacaattttctgtccgatttgttgtcctattttccatttcattcacgtgccgtctgtcactccgcccatttttcaaaattatctatttaagcggccccgaccaaggggtcgctctcttccttctcttccttccagcccagggggcttctcttcgcttccttcaccctccaaccattcgaatttattcgatttgctggacttttcgatcaattttcaccatttacgcatttttaattcgtcgatcgcttcgttaataaattttgtgtcggaatcggagtctcggattcgttttcgggggacactagaaggagggaaaaagaccctcctcactccatcacgttcgtcaaattatcgtgcggggccaaacgagggcgcccattcctgacctgatcccttcctttcccggcagcttacgtcgtctctcccaaccctcccgatccaattcccttcccgtcgcaattgggggaagttcgggagtgcccgaagcagcggcaaattcgagcagttcggtctcccaccagtcggagcagccgaagagacgggtgtgaactcccgtcgtcgtcaagtccaagcagggcagtgaaggaaggaagagccgagcggtgccaaatcgtccgacgagggacagggccgttcgtcagcgcaactcccaccagccggagaagcgcgtacagatcaaagcggactcccaccagccggagtgtccgttgcagcgagcgggagtcgaaacccgtgttcgtcaagtcaaaggggtccgacaagcccttctccaaatcttgccggtggtgccgttaagcaagcagcaaatcgctgcacacaatccatcaagctccagtcaaatttgtcacccctcccccctcccattctcgtccccctttggcgccgatcggatcggtcggcagcatcagacccatcagagcgaacggcaaaaaagggcgcaattccctttacggcatcgcgagcggagtgaacggaaagagaagggacgagagcggtgaagaggagcgggaaccaatcccgcctcagctgggcgaagccgcatttggccaaaccccgccgcggaagaaaagattggcgacaattatattgtatttacggataatgctagaatcaccattttttcacctatctgagctccctaaggtttgaaacacgcgaaaacaacttttggttgttaagctacttttcgagtcatgcaaaagcctggctgtaaataaagaagttgaactgtcactaaaaaacagttgctttccgaccgatttgtttttgatcacattgatcagagttctctgatcagcagtccgatcacagcagaatgacgaggccagcgatcgcaactgccaatgcgaaataagacgggcctccatctccctgtgggcctcgccagcagaagccgtggtcgaccccctttttgtaggacacgcatttgtagccttc

SEQ ID NO: 3310 - DNA, 2736 bp, Heterodera glycines
  misc_feature (2710)..(2710): n is a, c, g, or t
ttaatttttttttgtttttatgaattatcctattaaatttcataaaaacgaaaaaaattaatgggtcgaagcaagaaacatttcgcgtgtttcaaaccttagggagctcagataggtgaaaaaatggtaaccctagtcattatccgtaaatacaatataatcaaatattttgggcactttataaaaaagattttttaatattttggcatttttagcaatacacggcgaagcctaacggcaccgcaggcccctttccttattcctgaatttttttttgaacaaagcccactgctaacattgagcgaaaagcaacaaaaaaaaagtcgaactttattggttgacctcattgacaattaattaccttcgaccactctccgatacctggaacattcgaaaaaacttggtcgatccaccaccctttttccatgtatgcgaaagccaaaatatgcgaaaatgcgaaaagcgaaatgcgatttttttttaaattttaccaatagcttttgaggttgtgatgcaaaaaaaaatctgcattttccggttcgatctttttctcagataaaaaaatgacaaattctacccatttggtggttaaaatttcaaaaattaaggtaaaatgaaggtccggcggtgccgataatcgccgccggaaaattttttggaaattgtaataaaatatggtaggaaaagttgcaaaattttcaaaaaatttactgtatttcaaaaaaataaatcgcaaaaaaggcaaaaaaatgcaccaaaaagtttaagataaaagcttcaaaccaagttaaaaactcgttttcgtgcatattaggctatagcaagttagcaaaaaaggtaatattagagttgcacgggaccgggaattttgacaaaaaccgggaccgggacttaccgggaccagaaaagtcgggaccgggacctcgattttcgtccgggactgggaccaaccgggaattttcccaagtgaaattttttgaaaaaaaaatttgaaaatttgagtgcactttgttacgaaaaattgcctatatttaaatgtgtttgtggggagaaattcgaagaatttttccattttaacagaaaataataaactgaagcattcgttttaaaaattaaattttcaaatatattcatttcttaggggtggaaatttcgcatttcgcgccaaaaagcgaaatgcgaaacgccaaaaaatgcgaataatgcgaaaggcgaaatgcgaaaagcgaaacctcggcccatcccttgtaaatacatatgtacgaaaaatttgccaaaattttggattttttttgaggatttccaaaaatttaatttaaaaaatcctcaaaacatgtaagaaaaaaatgaaaaatgttagaaaaaattccaaaataagtaccaaatatgtataaaatcacgaaatgtgtaaaataaaaattccgaatatgtaaaaatatataaataaaagtcccgatttttgttcgcaaacacaaaaaagaaagtgtttttcctaccattcagagcatggagaagtcaggaaaaaatatgtatttaaattaaattgaaatgcttagagtgcttttaaatgacacgaaaatgtggttgtttttttttttgaaattgacagaattatgcacaaaaaaccaagacagttgaagggactcaaaaaatttgaatggaattaaagtgcaatgaattcgttttttcagttttcctcgacgccgcttctccctggccgcgtggtcagcagcagaaatgaattaattaatcaattgattgatgtaatttgtgatcgaaatgattttggcactttggaatttcacattggaaattaggagaaactgggccataaattgggaaaataatacccaaatttggctggaaaagcatgaagaaaagtgcgaaaatgattgaaaaataataattcaaatattcgctttaattaaaaacgataagtaaaaacagtcatttaaattttgcattttttgttttcaaatccaaaaataagcacaaatcttagaaatatgcacacttggccactctgcgataacaccaaaaatagaaaacttcttttcaatttactttcttagaggaaaatgccaattgctctaacataattgaagaaaaatgatggaaaaataaaggaaaaaagaaaattaagcacaaaaaggtaccaaaaaaatggagaaggaaaacaaaatgtttggaagccgatttttaacaatttacgataaagtaaaagcccgaatgtgaaaaaaagaggttgaactgtccctaaaaaacagttgccttccgatcgattggcctgtgatcacattgatcagtgttctctgatcagcagtccgatcacagcagaataaccatgccagcgatcgcaatagccaatgcgaaataggacgggcctccatctccctgtgggcctcgccagcagaagccgtggtcgtccccctttttgtaggccacgcatttgtaaccttctttacacggattgcccttagaacagccttaaaagaggttaaacgtatcatttcgatcatttcaattgtttcttatttctaccgcttaattgattttcgcggatttaaatgttaccctacaaaatggcatcattattttgggaatggcactttttcgccattttttgccaatgatactttttgtactcattgaaataatcaccagcttttgccctatgctaggcctcacccaaaatttgcttactttaaanatagttttgtttcgcattttctaatt

SEQ ID NO: 3311 - DNA, 1754 bp, Heterodera glycines
tcagtttttaaggacctctaattgtatcatctaatataaattcatggaaaagtattgcttttttatttgaatttttatttttatttttaaaaaatataaaaattattttaaaataaatgcgtcaacaatagtttttattaccaaatataattgcaagaatattatggttgcggtaacatttacgcagaacattgccaattgcatttcactttaaaatgatatttttaaataattttgccggaaaaaaaagaatttataatattattatgacgataattttaaataataaatatacaaattggaatttaatttcttaataattagcttagaattttattttaaaaactttaatttgagtaaatgatatgcattgcgattttgcggtgcgcttaaataatgccaaaaataagctaaacaaacaaaagtcgttcattcattccttttcataattaaggaattgaatttctaataatagcaattttatggtttcgcgttcaaatttgtttgttcttaaggtgaatggtgagctttttatttagggccaaaattaatttacttttttggaagtttttttaatttgctataaatcgctataatttataaaaacaaaaattggcgtttaaaatgaataactttgagcaggtgtgcaatttgaaggacaatttgtaaatgaattggattcatattatttttgttcgtttcttaatcttcattgttaagaattacggctgaatcttgtttcatattttgtggctttttaaataaaattaaagcaaaaactgcgtgccatcgcggttactctccgccaatcattcgtttaacaatgccaatttagtagggtcgtagccgggcgagggggatgaccccggttaagccggggaacggggagagcggggatgacgaaacgggcgatcgccgaaaatggcgactcataaaccggaggacgagaatttcgtgtttcgttttcgtgaaaaataaatattgaattttaaaaagaaaaaaaaatttcacaaatgcactttttaaaggggaccgacgatgccgaaaacgggaccagtaaattgggcaccagacaccaagcggaaaactggacaccaccagaattttgtacaacaaaggaaaattggacaccaaattactctttttaaaaaaaataaacccatgaattaggtgaaatataaatttagtaggataaatgattaatgaattaaggcacttagagtcgatcaggcatttagtaggcacgatcattggacaatgtgccaaaagctcacgaaaaatggcaactctatattcatttttatatccaattgtccaatttatttattttaattttccctgcgatttaaatggaaattttaattactttaaccttcaacttttcctaaataccttaattataatgaattcaattaacaaatgttcaaaatgattttttccgctttattttttctgaaggcgccaattgtaccggcggtaggcgtcgcccctgaatataaaagtaagttggcccgatttcttaacaaaattgcatcaaaatttataaatttttagtttgattttcacatttattaagcacaaaagaccggcggacgggatcgatcgggatcccgctcgattttctcgggatcccgcggtgattaaattctggatcccgacttcgggatccgtcccgaacctttttttaaatttatcggaattgatcgagagatctctccctaccattgggcaaatcccacaggacccaaaaacaa

SEQ ID NO: 3312 - DNA, 1513 bp, Heterodera glycines
  misc_feature (63)..(63): n is a, c, g, or t
  misc_feature (67)..(69): n is a, c, g, or t
  misc_feature (76)..(76): n is a, c, g, or t
  misc_feature (92)..(96): n is a, c, g, or t
  misc_feature (100)..(101): n is a, c, g, or t
  misc_feature (104)..(108): n is a, c, g, or t
  misc_feature (112)..(113): n is a, c, g, or t
  misc_feature (116)..(117): n is a, c, g, or t
  misc_feature (143)..(143): n is a, c, g, or t
  misc_feature (149)..(149): n is a, c, g, or t
  misc_feature (160)..(162): n is a, c, g, or t
  misc_feature (164)..(164): n is a, c, g, or t
  misc_feature (170)..(170): n is a, c, g, or t
  misc_feature (181)..(182): n is a, c, g, or t
  misc_feature (186)..(187): n is a, c, g, or t
  misc_feature (193)..(193): n is a, c, g, or t
  misc_feature (201)..(201): n is a, c, g, or t
  misc_feature (207)..(207): n is a, c, g, or t
  misc_feature (211)..(211): n is a, c, g, or t
  misc_feature (221)..(225): n is a, c, g, or t
  misc_feature (228)..(229): n is a, c, g, or t
  misc_feature (232)..(232): n is a, c, g, or t
  misc_feature (238)..(238): n is a, c, g, or t
  misc_feature (242)..(243): n is a, c, g, or t
  misc_feature (251)..(251): n is a, c, g, or t
  misc_feature (255)..(255): n is a, c, g, or t
  misc_feature (264)..(267): n is a, c, g, or t
  misc_feature (273)..(273): n is a, c, g, or t
  misc_feature (283)..(283): n is a, c, g, or t
  misc_feature (291)..(291): n is a, c, g, or t
  misc_feature (305)..(305): n is a, c, g, or t
  misc_feature (309)..(309): n is a, c, g, or t
  misc_feature (314)..(314): n is a, c, g, or t
  misc_feature (319)..(319): n is a, c, g, or t
  misc_feature (325)..(327): n is a, c, g, or t
  misc_feature (332)..(333): n is a, c, g, or t
  misc_feature (336)..(336): n is a, c, g, or t
  misc_feature (347)..(347): n is a, c, g, or t
  misc_feature (350)..(351): n is a, c, g, or t
  misc_feature (355)..(355): n is a, c, g, or t
  misc_feature (357)..(357): n is a, c, g, or t
  misc_feature (359)..(359): n is a, c, g, or t
  misc_feature (362)..(362): n is a, c, g, or t
  misc_feature (371)..(371): n is a, c, g, or t
  misc_feature (386)..(387): n is a, c, g, or t
  misc_feature (393)..(394): n is a, c, g, or t
  misc_feature (402)..(402): n is a, c, g, or t
  misc_feature (410)..(410): n is a, c, g, or t
  misc_feature (412)..(412): n is a, c, g, or t
  misc_feature (416)..(417): n is a, c, g, or t
  misc_feature (420)..(424): n is a, c, g, or t
  misc_feature (426)..(426): n is a, c, g, or t
  misc_feature (434)..(435): n is a, c, g, or t
  misc_feature (437)..(438): n is a, c, g, or t
  misc_feature (446)..(447): n is a, c, g, or t
  misc_feature (450)..(452): n is a, c, g, or t
  misc_feature (455)..(455): n is a, c, g, or t
cgtttcgttttctaaattttttttttggttttcgctatacaatgggcctgacccctcgatttnttannngggttgnttcctccagaagaaannnnnaggnngannnnnacanngannaagcacaaaagcccggcggacgggancgggancccgctggagnnncncggaancccgcggggannaaanncgggancccgacancggggnccgncccgaacccnnnnnaanncancgggangganngaaaagancccncccgaccannnngccaancccacggaancccgaagncaaagccccggganggancgaangggancgggannnggggnnccnacgaacccagnggnncggncncnaanaaccaccanataaaaaaaagcatnnccgagnnaacaacgnaacgcatngngcgnnatnnnnngnaaaaaaanncnnaaaccagnnaannnatnaaaaacttcccctatgtccagttttataataatcaagactttgtcactttattaatttgtctgaattattttgggtatttatttatactcgtgctaattctgatgaacatcatttacataatttatggaaattatcgcgcttaattggtctaaacattcgttttctctcgcttctatttttcccattctattttcaattttttttttctctggcttctcttttcccattcattttaaatttcgttttctcttgcttctctacttcccattctattttcaatgtctttttctgcctcttcgtcttttcttctcatcattgctctgcttgtctcgactatggcttttctcactccgcctctctttttctctgccattgtgatagtttcgctccttctcgctatttcttcgtctgttttcatcttttgccatttccatgtttatgctctctctatccatcccttcccagtctatgtcttctctgccccattctatttcaccttcgctcatttcttttattcccccctgtcgccgttcatttcgccgtctttttctctcttcccgtgctattttcctgtccaatgacaatctctcatggaattggttccactttctctgttctctctctgtgaatgcttctccttctaatgggcgtttgcgttttcgtaatttgcaacgattagcttaaaaatatttttaaaattaaaatttaattttttacaacccaattttcaattgtctaaacattggtctaaaccaatttcttaaatatttaaatattaattgaattttaccatataaatatgatccttttcttgggtccacccccaatgcttcttcgtcatccgtgtcaagaaattttgtgcgctttgggtgttttggtatcgaagttggttttggaagtttaaaatatttttaaaaattaataaatttattttacaaaatacataacttttattaagcttcactttttcccttttcatcatcattttatagtcttcaccagcaaaattaacatttttggcatcttctaattgagtcccttcagctttttttctttt

SEQ ID NO: 3313 - DNA, 907 bp, Heterodera glycines
ccgctctctatcataaaatgaccaaagcatggattaattgttcaaaatgagttagatcacgaattgaaatcaattaatgagacatgctgataatttaaatgattagtgttttggatcactcactcattaaacgcgtgaaatgaatcgattagtgatatcaattcagtgattgattgagacaaattaataagtaactaactaagcgattgattgaaacaaattaataataattgatcaaggtttgactcactcaaacgctttccgttgagcgtgaaaatgatttgtcgcgtttccaagttcatgccgcagccgatcacgtcgccgatgccaaacaaagacggtgacagctcgacaaaaacattgaatgaatcattctcgtcgatggggccataaaaagtgccataattgtgatatccgtatgagttatggtggggtttagcaaatgtgtccaatggcatttgccgggttgaaagcccaatgtaaaaaaggcttaaatgaaaaaataaatattataaatttgaaattttcacttacaattagttcaaacggcaatcgtgctgggtcctttcgtaaaatccgccattttagcgattttttcgacaaaacatggcctaactctgcttaaaagcaaccaaaatttacaacattcttggtatcattcgatatccaagcgttttctctataagcatgcaaaattttaaataaaaatatcaaattcaaaaataagttatggcagaattattgtacttgattgcaaagttgatcaatttttttttaaattttgtaaactaattgagaaaaagcttggctatcgaatgataccaagaatgttgtaaattttggttgttgcatttaagcaatgttatgccatgttttgtcgagaaaatcgctcaaatgccggatttta

SEQ ID NO: 3314 - DNA, 2533 bp, Heterodera glycines
aataaaataattatgacaattttagatctttttatatattaaaaatacgatagaaaaagtctatatattaaaataccgaactaacaagataaagtttaaatgtaaaatatgcataaaatcattatggaataggaagtaaaagtgccaatgcatttaaatcataacgcttctgcactttttcataggccctaaaaatttataaataaaaaagaaaagcgtcatcgatcattttattgattaaattacaaaatttatttatttatttatcgagcaaaccaaaggcacatgagtgctcttatatggtgccaaaaagaaaacaacaaataaagttggtcaaataaaaaatacaaaatgaatatcgtaataaaaaaaatgaataaaaataaatcaatcaaatgttaaaaattcacaggtgataaaaatatagtgtaaatatggcaacatggaaaatgtccaggcggatgccgaacagactgatcggcaccgatcaaaagttccccttgacaatcggccaaattccatccatttgttggctgctcgacaaaaaagagctaaagaagcgcattgtttgaatattttaaatcaaatttagccactgctgacacctcaattcccctaaaaaaattttaaaaattcctgccaaaattttttgatcgaaattttgatgaaaattttgtcttatgtatattagggatggtttcgaatgccggttctttttttgaaccggaattacggagatatttcgggcctccggaaccgcccctgctccgaaatcattgaaaaacaaatgaaattttcaaccaaatgccatgccatgcctcgggaattttgtagctgaagttgagggaagtgccaccgaagttggccacaacagacgcattccatttaagggaaacggttgggtaaagatcagtcgcactgacaaacaagccagaagtgtcttaattgaattggaattttaaattttaaaaaaaacgaatttttaaatttcgagacgcttagagaggcaaagcgccagaaatttttcaaatttgaacgagtgaatattcattggccaaagacaacggctgcatccaacaaaaggcacaacagctcagctgatcgcaaccaagtaacttttttcctttttgatcaatcaataatcaagtgattggacgcaaccagggaaatctttcgtttccaataaatcaataaccaataaagttagggttcgatcgcttgattagtttgctaccctttttgaccaataaacaatcattaataaattattggtccatcgattgtttggacgtaaccgaaattccgatcaatcaataacgaataaagttattgctcggtcgcttgattggacgcaacccatttttgatcaatcaataaacattaatagtaattgccgaagattgaatggagacaacctactgaaattctgatcaatcaataactaataataaatacatattatttgctcggtggcttggttggttgcaaccctttttgatcaatcaataatatttattgatttaaccgattggttagacagacagactcaaacgttttccgttgagcgtgtaaatgatttggcgagttgccaaattgacgccacagccgaccacgtcgcccgtgtaaaatgacgcatttgcaacagcgatccgacgattgccctgatccggcacacttccctcaacattgtggccccaaaaaccagctagtttttttctgaacacatatgcgtacgtttggccataagttggaagccatttacgggttagtggaaaatcgcgggtggacagaccaagcgaaacttggctgtacctgtaaaaatggcaaaaattttgattgggaattaaatggcaatgtcccggggattggggtggcacgctaaaaatgccaaaatagtgacgaataagtgacataattttcagccaaaaattgaacaaaactatttttttttcactagttcagttgccaatgaggtaaatttcccttataaaattcttctagcaaatattttaactttttaaattaaaaattttgtcaaaaaaaaaaattcgggggaaaaatttttgagaaaatttttacatttcataggagtgtattttttttttaaattttcagtcgtttcttaggggtatatttttctgaaattttggagtcgatttttattggtgtattttccgtttttattgcatttttgctgacaaatttttcaaaaaatgtcgaaatagtgtcagaatcaaaaaattttaacgcagaaatgcgttttttgagctcctttcttcaaaacaattgagcaaaaaaaaagaaaagttttttcactaaaaattgcttccctactgatcaagccaaaggtaatagtagtgtactttatgattggccgacatttgcggcgcccagtcaaagcgacacttgcggcgccgacacttgcggcgccgacacttgcggcgccgacacttgcggcgccgacacttgcggcgcccagtcaaaaggacatttgcggcggcgcaaaattcaacgaccccaaaaatattatcaa

SEQ ID NO: 3315 - DNA, 2133 bp, Heterodera glycines
ggagtttcgataaatcccattaggtgagcagcatcaatagcagtcgcttttatagaaaaataaaaccaataattaattttagaccattgtcgccaccagcggaagaataagaagaagcggatcaaagcaatgaaaatgtcgtctgattaagtgtacggaaatgaataattgaataattctatttgagaaatgatcgatctcaatttgttgtgcttattttctctcagaaatgcttttttaattgtttcgttccaattatataaaaatatgcttttttgttgagcaatttattaataattagggtttgtaatcgagaccggataagagggtcggtcgaacggtttcggtttttttgaatttttttatcttttcccaaaaaaaaacaataaaccatttttatcaatagaaaaagcgaaagatcacctctgagtaaaattgtagagctattgaaactctattgaatggtgtactacagggatggagttccgaggcactaaaaattttcggaagtcggaattccgaggctccaaaaattttcggaagtcggaagtcggaattccgatgccccaaaaattttcggaagtcggaagtcggaattccgatgccccaaaaattttcggaagtcggaattccgaccccaaaaatgtcggaagtcggaatttttcaaaaaaaaatataataaatttttaaaaaaatatttaataggctaaatttttaaatttttaaccatgtaaaaggtaatttcaaactgtttttagtttatttctatattttttaaaaagatcaaaatattttaagtaattttacattattttggattttttttttgggaaagttacaccctttttttgcggcgcgcttatccaaagagaatttgagaaactgtggggaaggaagggtccggcggtgccgatatgcgccgccgggaaaaattttgtaatttttaatgtaaattgttaacaaatttgtccaaaaaatggaaaatttagcgattttgagcaaattttcaagaaaattaagtttttttttgagtccggcggtgccgataggtgccgtcggaaaaaaattgaaaatttctatgcaatttattaacataaattgtacaaaaattgctaattttttgaaaaaaaaactcaaaaaaattccgaaaaattccgacttttcatcaaaaatttcggaagtcggaagtcgggattccgaggccccaaaaattttcggaagtcggaagtcggaattccgaccccaaaaatgtcggaagtcggaagtcggaattccgtgccatccctggtggggactacaaacctgcgcgaagtcacagctcataatcatttgccgaattatgacaaaacaatagtcggtttttatcattagggtcgctttaagaaagtacagaaaatggtcagcggatgggacttttaaaggtcataaatagggttgtaaattatatggactaaaaaacgcgaaatatggacattaaatatggactaaaaaagcctgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagtcat

SEQ ID NO: 3316 - DNA, 1034 bp, Heterodera glycines
gtactgaaaattctttgcgggacgggatcccgcgggattaatcccgcaaatcccgcatttaaaatttgcgggatcccgcgcgggattgcgggattttggaaaattcgaaaaaatttcaattaaattcaaaaaatttccaaaaatcaaaaaatgctgaaaaatcaatttttaagggctggcgggatgcattaaaaggggctgatgggtcgactaagatttttcgattggatccgacggtaaaaagttgatcggaaatcaaattattaacggttcataaatttgactattttttcttttcaaaaccacttttttgcggtgcaatttttcaaaaaactaggaaattccggtccttatcagggatggcattccgaggccccaaaaattttcggaagtcggaattccgaccccaaaaacgtcggaaatcggaaatttttcaaaaaatatacaatataataaaaaatttctaaatattttaataggctaaattttttaattcttaaccaagtaaaaggtatttcacaaatgtttttagtatacgcttgaaaaaattattcaatattttatcaaattttttttttgtcatttttcattattttagaacatttttgggaaaaggagtgactatttacacgttttttacagcgcgattttttcaaaaactttttgggaacttggaggagggtacgggggtgccgataggcgcagccgggaaaattttattaacagattttgtccaaaaaattacaaaattttgcgattttgagcaaattttgcaagaaaaatagggatttttagggtacggcggtgccgataaacgccgccgggaaatttttaaaaatttcagttcaatttattaacagaaattgtacaaaacttgctagtttttgaaaagaaaaattaaaaaaatttccgacttttcatcaaaaatttcggaagtcggaattccgatgccccaaaaattttcaaaatgtcggaaagtcggaagtctttatgccccaaaacttttgcctatcgacatctgcgagaaattttat

SEQ ID NO: 3317 - DNA, 895 bp, Heterodera glycines
  misc_feature (202)..(202): n is a, c, g, or t
  misc_feature (219)..(219): n is a, c, g, or t
  misc_feature (225)..(225): n is a, c, g, or t
  misc_feature (253)..(253): n is a, c, g, or t
aatttatttaaaaatatttggcattgtcttagaaaaattttcaaaaaaatcaataaaatcccgcataatcccgcacaaaaaatcaaatttgcggatcccgctgcgggattggaactcaaaattctttgcgggacgggatcccgcgggattaatcccgcaaatcccgcaatcccgcattttccaaaaaatgcgggattgcggnactgggatcccgcaaanatcccngcgcgggatccccgtttccccgccccgnggcttatttcttcctgccttttttttcatttttggcttggcgccaaaacgtcggcgccaaaacgagctggtcccctgagagagtcattatcaatgtttttaatggaaataaattgttgaaatatttttggggtcgttgaattttgcgccgccgcaaatgtccttttgactgggcgccgcaagtgtcgtcgccgcaagtgtcggcgccgcaagtgtcggcgccgcaagtgtcgtcgccgcaagtgtcggcgccgcaagtgtcggcgccgcaagtgtcgtcgccgcaagtgtcggcgccgcaagtgtcggcgccgcaagtgtcgtcgccgcaagtgtcggcgccgcaagtgtcgtcgccgcaagtgtcggcgccgcaagtgtcgtcgccgcaagtgtcggcgccgcaagtgtcgtcgccgcaagtgtcgcatcaccgtactttatttggtttcatattttgaattttttcgaaaattgaattttcgaatttttgttcgaatccgggtcaggggttcgaaatgggccaaaatagatataagaatcgaattcttcgactcagaaaacccataaaacaactttatttcgaaaaaatttttttaaattttcttttccaaaaaggggggggggggggctacaaagtaca

SEQ ID NO: 3318 - DNA, 3081 bp, Heterodera glycines
tgtccgtggaggctggccgtggcgaagaaggaagaaacgatcagttgaatcatatcttaaagaaaatgttttaatttgtcattttattttatgtattaaagttctacacaatgtttcatctcctaactctgctgacatcattttgagtggtcaatgatgtttgtttttttgagattctgatttttgagaaaaatctctcaaaatggccattttatgtaaaaattctacaaaaactcccaaattttcaattttatgggtgataacattaatttttctgtgtgtgactttttattcctttgaaattttatgcttatcttgtttattaactatgtgattaggtttctgtgcccgcccctaaatttcacctaaaattaacaaaattagaactataaattgccaattttcagtgaaaatcggtttaaaatggttaagaattccagttttccctcggcggcacctatcggcactgcatgacaccttttctttcttaaaaacgctcaaaataacaaaattcgatattaagttgcaccaatttcaaaatttttcccgacggcgcctatcgccaccaccgccccctgttcccagaaagttttcggaaaagcgcgccgcaaaaaactaaccctttttattgattttttaataaggggttttgagggcaaattaaaggtctactaaagtcataaaaatttatttcaagcaaacaaattttcaattatgctagccactgttgcttgcctttgacttttggtcaatggtattgactctcttttcagatagtcaataagaattaatttaaatatttaatttatttaaattaaatttattttattggatttcccaatacttcaattatatttcacactttattagtgaattttgatcgaacaaatatatttattaatgaactattgaacgataaaaaaatggtgattttacaatggtttaaatacggcaattttacataggcgggctgacagaaatttaaatgtaaacaatgctgactaataaaaaggcttaaaatcacaaaggttatgaatttggcgtaaaattattttaaacagatgaatcataaaattttaaattttcgtcgctaaggatgaaattagcgacaaatggtttagaaaaatatttcaaacaaaaaatttctagatttgaattttttaatttccggtgggcgcgaaacaatacggggcggggagggagggcgaggaaacgaatgcatccattttgaaaatggtttggttttgttaagtaaaaaaagttttgaaaaattttcggaggaaatgttacactttaaaattattaaagaaataaaagaatcaaattattaaaaaaaaaactcaacaataattgggctctgaatttacagatttacaccttttaatgacaatttaagttggtcgtgtcttctttaaggtcgttaaacaagaccttttttgtttaaaattgaaaaaattacgtcatagattagggttaccaaacatgaaaaagcattgttacaacactaataaatttaggtaaagatttttattcccacaatcaaaaagtacagagttcaatttagtacaatagaaattgattgttttaaattaaaaaagatgaaagatatacaatacaataattactaatttaatattaaaaggaaaaataaattattaaaaggattaaaaataaattattaaaaaaaattcaggggattttggggcttcggatttgcacactttttgcttccatcatcttcaattcttaattaagctgatcaccaaattcggaagaattcacgagcactaaactcaattaaatatattaattaataaaattttaattaaaatgtttttaccataaaccagtgaatgcttgctctttttctgcatcagatgatcaaatctcggcttctgatactaaagaaaattaaatttttattgagtcagcaaaaacagtttatttaagaaaaagcaaaaattaattgattaattaattaaaattacccataaaatattttaaaaatgtgcttacaaattcataattttcaaaaaagtattaattaatagttttagtcaattgattttattgtttttatttaaattaactattctattataaataaaaaaagacttttatttaattattaaaaattgtttaattaaaaaataaaggaaattaaaaaatatatattaaaacttaattttgtttaggtcataaattatctgttttaaaacttactttcatattttcgcatgattcggtgaagctcggcgtgcattttgcattgttcttaaaaatataaatgttaaaataaaatgaatagttataagtttcatctattttaaataaataaaaattattttaaaaatcatttcgcgcatttttcacaactttagcgctatgcaaacttagggggctttaatccaattgtttagcagaccttaatgccttaaaactttcaaaaaatttccggcgtggcgacgcctagcgatgccaccaaaatgcaattaatttttggtgccacctgcatacaggcgcaaaatttgtcggtgcatttggccatggcatcgccgccctgagggcaccccattgacatgcacggcactccggcttccttcgcaaagcatcttttattggaaatttggggaaaacaaaggcataacaacattttgtctactttgaaaagctaaggcagcaactgtccatttcgtctgaatatacggtactgtactgaatgtagttacggtattatgtaagcgaaaaaacgggcaggtaatgatgctatttaaagcacggtaataaatcaagaccaaattttaattttgcggatcccgacgcggaatagggattcaaaatttgcgggacgaaatcccgctggcttaatcacgcaaatcctgtaatttgcaaaaaaaaatcccagtttttcttggccaaccagaagcaggatgaatgaatttttggaaaatttgggggaatttccaagaatttttcaaaaataaaactggaccaaaaatgttttatgaaaataagaaaaaatttttttagcctacttagcagttaaagctcaacttttcttaaaaaacgattgcttgataa

SEQ ID NO: 3319 - DNA, 1726 bp, Heterodera glycines
  misc_feature (1715)..(1715): n is a, c, g, or t
ttgataatttaatttgccgtgataatctcgtgcaattcgcaaatccacgtgccgtgatgtggcgccggaaatgccgtggtcgtcgtcgtcgttttcagcttcggtggcaccatttgttgcgtggtcgtgttcgcttggcagctttctgcctgaaaattggagcgatgaaaaaaaaaatcgaagaaaagattttcaaggaaagcagaaataaaaaaaatcattaaatcgttttcaaattgaaaaatttttcttagaaaaataatttttagaaactgtactccttaaaattcttttttaattttttttttattatgtattaaacattattctaacagtattatgccgtttttatggcatttttgccctatttggtattgtactttctaggaatttttgtccaaaaaatcagaaaaatttttttaaatatttttatacatatttttttgctatttttcttacatctaattcccatccctattaattaatacgaaaaaatatatttttttgaaaacatttcaaattatagtaattttaaaagatgtgaatcctttcattttttaaaataaatatagtgattttgtattgatttttaaataataattttaaataatcattttaattttataaaatccaacatttccactttaagatgcacaaaaatgaattagaagctcgatttaaattaaaatgttaatgtatttaaattttatgttttgcattttgcttctttctacctgcgctgcgtcgaatgcttttttgccagcccattggacggaataacaaaacgaattggccaatggtccacactcgctgaattgtgtgcgtcgcttaaaattattattattttttgggcaaactgtacttaaaattccaaatatttttaattaaaaagaataattacgcttaagcaattgcaaaaaatgtcgtcacaatttttttgcgattcgccacacatggaatagcaactgaaaaaagcggactcgctcagttcggccgtcacgattcggccctcacagttcggccccaacgtgtttttccactatagctttttatttgtaatccaaatccaataatcttggtgtcatccgaaagctcttcacatgctctattagccttacaaaaagcgaaaagatttcaagcctggaaaaaatttttattatgaaaaacccaaaatttcgactttttcgcaattttcatgtataacttttttggtaattgtctaatcgcgaagcaatagcttagaaaaagtcttctaaacatgttaagcattcgaatgatgccaaaaatgttggattttgataataaagaaaaaagttatagaaagttatagtgaaaagcatgctggggcccaaagtgccggcccaactgaggtgtgtacctcttaaagcacaaaattatattttttgcgttattttttaaacatgtatcatttaatcaacaaaatttaatcttcttttttttctctttttaaatttatttttaccaaattcatttttccattgttttatttccctacgactaatccccaaattatgcataatttccttttcaatttttgctctttttcttccgtcataattaaagccataaattttttcttttttcatttcatcaaactctctgatcagctccatttttgtgaccatattaatgtcgtccttattttgcgagaagaagctcgggggaacgtgtttgtccccaatttttgcttcaantttaaaaatat

SEQ ID NO: 3320 - DNA, 6165 bp, Heterodera glycines
aaaaaaaaattttttttttttttaaaagaaaatttttgaacccttttctttaaaaaaatgcgaaaaaaagtcaaaaaagtaattcggacgttttggggtcgcggatattcaaatttaatttaaattttttcatacaaaaaaataaataattcactcaactttaggttaatttttggcagacatattggcacctaaagaaatacatggtagttaatttatcgcgaggttttgaccaaaactgacttggtgatcaccttgcatgagattcgttttatgacattcaattagattctgaaatttttagttgtttttttttgttgaaaatttagaattttttttattatttaccacaattgtgttgaaatctggcgcgtccaagttcagttttttcatgcgtactaatgtgacgagttgacggtgggcgatgagcagtccaaatgcaattatctattgaaaaattaaaaaaaaaaaatccggtattttttttttgtagaattacatttggacataattcattgatacctgtgcccattgtttgtacaagaaagtctctgtccgcctgatggagtggcaaaattcgaaagcccaaacattcagcaatttttttcgttttagtaataaatcagttaaaacattgcatgttttatcttccatacagccacatcggacattcgtggtataccttgactcatcacaccaattctctatataccatgccatatttcaatattaaaataacaaataaagacataagttgtggcagaaatagtgcttatattcatacaactttttctaaagttgacctaatttttttaaattgttaggctaatagagaaaaaacttggctatcgaatgataccaaaaatgtaaaatttggttgctttttaagttataccatgttttttgtcgaaaaatcgttaaaatggcggattttacgaaacgacccagcggggagaagacccaaaaaatttagggatcagagatgggaagctcgggaattcggtgaggaacgtccttataaatttgaaaattgccttgaaataaacaaattattaataaagaaaaaataaaataaaacaaatttatattaaaggatggagataataataataataataataataataatttaaatttaatatttttgccaataaacaacttgcttctcatttgcaggcaacccaaactgtttgcgacgagctctttcgccatcaccttaagaaaagccaaaaaatttttgcatagacaagtacaggctcgtaaccagaaaaattttttgggaggagggaacgcgaaaaaattttttgccattaatttttgcaaaatttttagtgtcgaagagaaaaaaaaacaggaatttttagccgtttttttcgcaaagatttaccaattcgtccattttggtgtcatattttcaaaatttgttaaaatggaggtcgggcaatgactacagatagggtaacatcggtaaaattttttggaaattttatgcgattgtttaagaaaatttagtaaaattttcaacaaaaaaaaggtcctccgtttgcccctaattccgcccataccccataccaagtttagaagcgaagaagcttgcaatcttttttctttaaaacgcagcaaggcaaaattaagtttcggagtctcagtctcggggccgagcccccggcctcgagtcccggtgtcaaattatctgtcttggcctctagcctcacggtgttaagtctcgggatcgagcctaggccacgagtctagtggtcggttttcaactcgagaaaactcggattttttttttggtctcggtctcgtgtctcggggtcgaagctcggtctcgagtctcggaattgagttttgtcatgccccggtcttaagtctgatcgaatctcgagtcgagttcttggtcacggtctcggggtaaagtctcgcgttttttcggaaaattttcggcgactcgagcaattagtgctaattgatctcacctcactggcaccggctgcaccgcaagcaaatggctcattggtagcgttcgggtactgaatttgttccaccaaatgcatgatcattccgaggggcattgtgtgcacataaacaacgctgctcattgcggcaacaacattgaccactttttccaacgtttcaacaaccacatggccattgtcccaaatcgattttgctgtctgcaaaaacgaggacagacatgcaccaaattagtgccacctgattaattatatttgcgactaattagtgcaatttatattaattagtgtcattcacaattaattagttccttttggcactaattagcgcaggttactaattagtgatgtttgcagcaaattagtgtcattgtcattcgctacaaagaagtaccattccatttgaaactaattagcgcaggttattaattagtgcaatttgcagctaattagtgcaatttgcagctaattagtgtcatttgctaattaatgccacccaattcatttatttgacctttgcttttcgaactattttaacaaaaatcagttttatttgtttgaaatttcttctttttccaggcggtgtctatcgctacggcgcccccacaaagtgtccaagccacgaaatgtccaaaagagtaaaaacccacgaaatgtccaaaatttttcaaaatttataaaaacaaaatgagtctaatttaggatttttagggtttcggggtcgctgaatacgaatataccctttatattaccccttgcctaaccttaggcccatctgaataataaaaaactcaaattcgagacttggacatttgtgggtcagcgatcgctactactgtaatttcattttgccagaaaaaaaggttgcatataaatgttttcggttttcggcattctgtttttggcttatgtgtctaaatttttttcattttcattggtttgaaaatttgaattccaacttaaataaaaatttagtgccaaaaattttttccattttctgcactttaacggtgttattttggcttttcgtcaatttccactcacatttgcaataaaacttccaatagagtcgaggaattcccatccgcctccgtatccaatgttaaggctaataaccaaaataaacagcaaaattttgtggcacatttttacggggggatttaaaaaagaataattacctaaaaaaggaattatgtaattaactaattaattgaatttcttttacttttattttgcttcgaattatacaatttaaaaaatgaacaaatgagaaaatggaataaatgaaagtgaaaatgaatccatcccactgttttttttgctttattaacatcatttttctgctgattcatcaacgaaagcgcttttcccataaaaatggcataatttattttattttaatttttttttttgtatttgataattattcaccataaatgtaactgtttttgctgttaatcctcatcctcaatcatttcgaacaaattgtcgcatcactcgcggaaacggacattacgggtactcacttttaaaaattaaaaatccaattaaacattaatgaatttgggggcggctaccttcaaaacgtcaaatttattggacacggcaagacgatatttgccaatggcattttcaacggcttcatggatcaattaaaaaacaactaattattttaaaatcagtagtttaagcagtatgtgtcaagagatttatttgtcccgttaattttcttggcgttgtgcttcgcaatggaacaatttcacagttggcgcaaacgcacggaaatattttgtgtaaatccaatcgttcaaaaataaagaaattaactttaaaaaccgggctcgtgaccaaggattatgattattcagatttatctttttgctgaaagttagacggttttctatcaattagtcgtgactgaaataatttaaaaaatattggctaaattcaatttaacataggttaaaatttctcaaaaaatgagttttgagatcactgatcacccaatttgacattggttcttaaatgatacaaaattgcagagatatcgacgacaattttctgcttgctgctcaaattcagcaaaaaatttgacgcaaattatgatcaaaatagagggatttgcacttaaacatatccctctaatcccatttgctggcacattttcataattagcaacgatttgttcccaccgctgaaccattttaagtcgttttaacaaatgtttatggatgcaattatgaaaataatgtaaaatataaaacaaaacaaaaaaatcacttttttgtagaaatcgtttactgtataaaaacaattggtatatttctaaacattttttccatttttacatatattttttataaattttctacccgtcccgaaaatgccttccttatttggcacaatgccatcccgtccatcaattgtccaagttatcatttgccattaatgagcgtcttcttggctaccctcatttgctaatgggggcgagtgaatggctttcttattgattgccctctgttccccgcggggtcattttgccactcatttcattttccgtgccgaggcttgcccatttttagtgctgtggagggcatcaaaaatatttatttattgtttttttaatattatttttacaattttaaagcccatggaattcggatttgaattagattttttagttcaaatttaacgggttttctttttcttttatgtaccaattatgtcttccttataaaattgggattttattttttagtaaaattggctttaaaaattaattatcctttttcaagcctttcaaaaccaaatttaatctgaaaaagcaacaaactttggaccccgcattaaataagattggcaaaaattcaattaaaaaattttggtcgaaaatttataagtttcaaatggaattttgagaaactttttcttttgaaaaataaaaatttaaccattttcgtccctaaaactcaaataaattattaaaaacattcaaaaattttttaaaaatatataaataattaaaatctttaaggatttttttcattttacttattttaagaaattcacaaaatcatttcttacaatctcaaatgtctgatcacacgcaagaagaagaaatgccaaaactgaagaaaaggtaaatgccgaattattagtgaggaataatttcttccatctctgaagatatgaaattttcttttgtaatacagtaagaatctgtcaaataccgtattactctcaatttgttttattaacagaatatcacttctcttaattgaaaatcatgactgaaaccaaaactttttaatgaattttaataagtttaaaaagtttaaaaaatgtatgtttgaaaaagtgacaaattttaagtttttaaatgcgcgaatcgcggaatttttaaatatttttgcttcacttttcgttccaaaaattcttccgccttttaccgtacctttttacagtacacatttgtttgtatttgccacctttttcaggtgctttctctgcaacgatgtgctgttcaatgtgttcactttggttagtaataagttcattcttggcacgcgattagctcttgtcaatggccaatttaatacgattgtggacaaattgttgttgcgtaaaagccgagaatggtcacttggcattttggaattgcgatgtgccgaacagcagcagggggaaggaaaagtgccacaaatttacaaggaattcgtttggaatttgatgaatcatatgccaccgtgtagagaatacgctcaaatcttgaaggaagtgccaattgcgacagtgccggtccatcaaagtgttaccggcttccaaggcctgacaattcggttggaaacacttgcatttttggctaaaatggatttgctaataaaacaatagaccacaaattggaaagtaccgggcccttggacattactgagcttggacaattggccgtgacggaccgaacgttgattaattataataataaaaatagggcaggaaattttttatgaattagaaattaggtataattagagttcacatcatacattaattaacacgggagggggttggtctggccgtttacaaacgaatgacagtgagggaggggtgggcggcagggatggcacggaatttcgatttccgacatttttggggtcggaattccgatttccgacttcagaaaaattttgtg

SEQ ID NO: 3321 - DNA, 1484 bp, Heterodera glycines
tgaagtcaatgggtcgcaaaatggtggtttgttcagcttcgtagatgtatgtcaacggcctgtcgttgatgattttttccacttcgatgagagtcgtcatcaattgttcgtagtcgaccaattttttgcccaacgttttgcgtaagggctccttgaccaaatgaaccattttttcgaagaatcctccggtccatggtgctctttcaatgttgaatctccatttgattcctttgtctgccactgatttttgtactgttggctgattgaagagctgcgcggcattcggtgtctgacaaatttgttgtgccgcttttgagccgagtttgaaagtcttagcgttgtcggagacaatcaatttggggaccttcctcctggcacagaatcgtgatagtgcgttaaggaaggcttctgctgtcaggtcattcaccagttcgatgtgaatgccacgagtgacggcgcaagtgaagatgcatccccatactttcatcttttttccattgctttttgtaagcattggaccgaagtagtcaaggccaatgttgagaaatggtcgacttgtgtgtccatcaacgcgaaattggggaagaggaggcattgtcacctgaccgaatggttttgttttgaacttatggcaggtgtgacaaaagtgtcggctccttccgttttgaaggacatgtctgatggtccgtcgggcctgagagacccaaaagttttgccttatttcggacaaaacattgttggcgccggcatggagtttgtcgtgaatatgccggatgaggagggccgttaattcagctttgcatggcaggaagattgggtccttggcggtttctgcgatgtcccctttttgaattcttcctttgcttctcaaaattcccctttcgtcctcgtacaattgtaaattttgtaccagttgaggatcggctgggtgccgttgttgagcatttttgattaaaatttgctctgcttttagcaattcttcagcagttgttggcggaattgcttccaatttttccttcaaattgccctttttgggctccgcttttctcggctgaaggaagcgaaggactaatgccatagtccttttaagtttgatgaaagacgagaagcgattttcatcgatgagtgccttttgcggtggatgctccatcgttggcagtgtcatttccattattggcagttcgtcgatgactgtgtgtcgttcgacttccggatcaaatattatttgatccattggccattcctcttctttgagagttagccaatttggcccaaattgccatagattgttgtccaacaattccgttgcttttgctcctcgagaggcaatgtctgctgtattggaagtgccggaaacgaatccgaccatgtaccttctgattttgttcagtcggttttccacgtatcggtcctgctttttgcccgatcttgcccattcaaggtcatccctggagtctgcccagataataatttttgtaacttca

SEQ ID NO: 3322 - DNA, 7391 bp, Heterodera glycines
  misc_feature (7307)..(7307): n is a, c, g, or t
  misc_feature (7329)..(7329): n is a, c, g, or t
tttacctgaagcatcagcaaaaatgtgaattgctttttccctcggcgatggcactgttgccatccttggcattttgaagcagaccgtgggccaatcctgaattgtgttggcccattcagatgagagttgttcggacaactcgtcgtcccatccgtacttttcgtgccacaattttgaaagcagaattttgccaggcaggatgattggagacagcaggccgagtgggtcgaacacactggccaaatgtgacagaattgtccgttttgttacccgcgttgcttggaagtgcggcagatggaattccaattggtccttaaatggattccatttaatccccagaattttcattctgtgaggattggtcagccagtcttccgggaggtccatgatgcctctgtgatttgcgccaaattcccgcaaattcatgctggctttttgaaaaattttccgcatttcatggcagactttggcgatgtccttggagctgtcagtgcacagaagtatgttgtctacatacaagttttgcgcgatgtccttggccattggatgatccgtttggccgagggcttgagcgttactgataagtgcgcggggctgcttatcagtccaaatggcacgcgacggaagcggtaggtcctgacttgcccgtcagtgttgacccacaaaaagcgtagtgcatcacagtcctcttcttttattaggatttgcaaaaacgctttttcgatgtccgcgcaaatcaaaatttcggacatgcggcaccgcatgacgatgccgatcagatcgttcagcaactgtggtcctttgtcgaggcattggttgagtgagggagtgtccttggtgtgggcagacccatcgtagacgatccttaactttgtcgtttgatgatcatcctttattaccgcttggtgcggtaaatagtgcagtttgccagtccatgccttaggatccggcaccatttccacaatgcctttgctgagttgctcttggatgatctgatcgtaaagttggaacttttctttgtccagctttttcaaattgttgtccagtcttcctcgtgccaatccataattgggctgtagctcttcagccctgttgttccatggaagcgcgacttcgtagcgtttctcttccatgttgaagtggagctccttattgaaatggtccaaccattgctcattttcggttggatgggcagcatcggccataccagcagcttcgaggtcaaagaactgtttgaccattgaattcagtccgtcgtcgtcgttttgaagctgcacttccactgcctcttgagagatggcggttgaagtgacctttttcgccatctttggctttgaaaggtttcctttgccgaaaattaatctgcccacttttgagttgccaacccaaaagcctgatgggagtcgcttctctgttttgatgtcaaaatcggcaaagtagtcagtgccaattaggaccagtggctgcagtgactctgtttggcgttgcagttgcgttgcttcaaaatcagagtcgtacagatcggcgaattcgacgtgagccatctcacgcagcacccgagtcgttatctccggctcgattgttttctctcccatcgctgttttcatgcacaattttgtcatgtgcatggtgtaggtgcctaagtcgacacctgcaaacccggtcagggttatctctgctggatttttggcttccagtttgagaaatgaggccagtgccttttcgacgtaggagcgttcagatccgctgtcgaagaataccaaaacttttttggaaagttttgggttttccgggttgtatacatctctgatgccgttcgttttgtactgctgttgttttcctttgcggttgcgttgaactgctggattgatgcatgttgcaccgtgggaggaaattgcttcctcaccccaaattgttgtggacagaacactcggttgtgcccccatttgttgcagtaccagcaatttctgatttttgctgtacactcatttgatgagtggttgatgccaaggcatttgaggcacaattttagctcctttgccttttcctctctggatttggcatccctgaaacagctacagcctgacgtccaatggctttggctgcagagacggcaagaaggggttgcctttgctttgtcatcgcgttgtggcttcttgactcccttcttttgttgcccaaaagtcccattttttggagcaatttttgctttttgctccaccgttgtctgtattgttgtttggaactttttgaatggtgttttttcgaccattctgggttttttgccaatttcccttctttggtgagattggttgtagatctcttcaattgcttcttcggcgatgacgagatccttgaatgatgagaggaacttttccgtgtcccagtccactccagcttttgcctttgcttcttgcagttggcgcaaaactggttttgtgaccttttgttccaaggtcagccaaattgttggcgcatttatgtcttgcgcgttgtttttcagcattcgagtgatgcgttgcacgtcgatgagcaactttctgtcgtcctcgaatgactgactcgctttcagcgagatgagttgtcgatgcaactcgcgaatcatgtggctgttgtcgtcgtacttctcggccaatgctttgattgccaagtcgtagtcggcgtcggtcagttgcagcccataaacgatgtcttttgcttcgcccttaagcaaagacatcaagtcagccattttcagaaactttggctttgatggatccgtgtgtattgccaaattgtataccggccaccaagattgccattcgcatttgccaccagagaaaatctgtggtcttattttggcgatttccacttggtattggacgcgccctgttgtttgtgctccggctgcttgagcggccggcgctccccccgcgttttgttgctggagttgcgcagcttccaatgtcgcctttgccgacgccaagctgatttggcttgttttgaattgtcttgcgcgtgttccggagcttttcactttgtccgcaacttgaagaagcgcaacatggttgtcgtagtcgttgatggccgcgtcttggtctttttgtggtattttgctgatgatttgagtccattctgcgcttatgctttttatttcggcgaccactttgctgattttgtccaggtcatcatctatgagatgaatgcgcagggtgagttcgccgatattcatttgttgagttgcggcggggtggtcgtgcgacaacagctcctccagctgatcagtcgcagtttgaagtcgggtcttcaaaaggcgagccatttggagtgaaataggagtttgctgtcgaaactatccgattttgcgcaaaaaaatgccttttctggtgcaaaatttgagtcgccggtactcagttagtcggtattcaaatttgcttggcgctcagatggcggcgcttagttggctggcgctgaaatggcggtactgagttggcggcgctgaaatggcggcgctgagttggctggcgctgtcttggtcggcggtgaggtggcggcggtgagatgtttggcgcttggagaaagccttaccccctaccccactagcttttcagcttatttggactcaaattagcaaaattttaacgacctttcaccaatttggtacttttgtaccttttgtgtttaccagttttatctgagtcttttcagactattcagattttcctttttaccaaatttgttctgctggtcttttcagacctttacagttaccaatttgatattttgtgacacttttgtgttaacgctttcgcgctttttacacaattgacaattcactttcactctgaattttgacctttttgacttttgtctggtcctttcgaaccgttgacaattttaccgtttttttttcaaatttccaattttcgacttttgaatgaaaaaggcacaaattctacctggttcagctgcagattgccccccaaatgaatcaagcagtctgggcgggatccgcttggttcagtttgaagaaattagaaaatgccgttccaaatccaatttatttgcttcaccaaaaaatacagtgaatagatgattttttgggcggtgtggggtgattggtggctgattatgggcgggttggtaaactgactagtggactgacaaattaagggtgaacgccgtggctttaaatagtgagatttttgaggcgttcgccctttaatcgaaaacagattaaaaacagttgctaagtgctaattgttgccttttgatcggcaattacgtgggcggcaattaaatgggggagggggctgttacatgaaattggtgcgatcaaaatatttgggtgaaatttgggataacaaaaagtgcaaagcaattaatgatcattaatcccttcccgatcgttccccctttgatcacttatcccttgtgatcacttttcctccttgttgctttcaacaatgaaatgaaaggaaaggaagggagagagggtgagagaatggggaaaattttaagggtcatagagagagagcagagaatcagagggggaaagaaacaagagggtcggagaggagagagagagagaggaagagagagataaagagaaagaaagcaaaggaggggatggggataggggacggactattaaaatgatgggaaagtaaacataaagggtggagggggaatgggaaaaaggggtgggggagccctcctaaagaaagatgggaagagggaagggacatttatacactttccatccatcaaaaaatggggatgaaaatgaagacgagaagtaagccaacagtcatcacatcaccatttgctaaaagtgacaaaaaaaagtcggggataaagcggggatttatggacgaggggggcaaaagtgaaattagcgagggataggggggaggggggaagaaaacaaaagcaatgccaacttttaattgaaatgtttaagtcggcggatttgtgtgaggggatgggaagtgatagtagaaggtctgcacgcaattacgggttacggaaactacgccatttttgagccacataattacgcaattccgaaatcaaaagaagagagagagagagagagcagagagagagagagagagagttagatggagagagagaagagagagacaaagcttggaagagagttatacaaattattacctgcgaaatcattcagaatttaatttggcatatttaaatttaactgtttaaaattttttcaagttttaaagcatcaaaaagcaaaaaaacaaaatcgcgaattttcaaaaaaataacgcgggggaaggagcttaacaggtgtgacattcatcattcttccactcactgattcattctcgcaccccaaacgatggagatgaataataatgcatgaaaaaggaacgcaaaagtcaagacccgaaacttttttttttaatttttataattaaaagagcaataaaaatgaaaaattggaaaacattgtgtggcgttccgttgtggtgaatcattcatatgtacaaaattgtcgaacgaacggccggaatgggatggattggatgaatttgtgtcgcgccaatgccgtcgtcaatttctcaatttgatctcgctcgctgctgttccgtttcgttccgccgaatcggacgaacgacggaggacggaggacggaaaatcgggggaaggagcgagcagcggcaaatgggcagcagcaaaagtcacatgcgcatgcacaacaaattgtgcgcgcattttacgcacccattctccacccactcattccattcatatacattcatttctctttgatgattgaccgcccccccccaccccacccattagagggtcagtcagttccgtaccgccaattaagagtatcggccaagcgcgtagggtatgggtacggaacgggccaactcgtcccgccaactccgtcccagccaagtttagagcatcataacttttttctttgttggcaaaatacagcaaacttggtatgagtcaaaagctcttaataagctctattcggtactcaaaactcgtaataattcgcaaggatactgtaaggaagaagctggctgggcggttaaaacgcggaaagcgggggttgataagatccataaaagaaagggcggatgtgcctcggtagcttaatggtagagctgcccacggaaagggtgcatgagtgggttcgattcccacccgaggtttaacattttgcccatttcttattggtagcaccggatggttgccccaccgcgccagcagcaattaactaatggaccgagggaccggtcccgatgaggatggagctgtaaggaagaagctggctgggcggttaaaacgcggaaagcgggggttgataagatccataaaagaaagggcggatgtgcctcggtagcttaatggtagagctgcccacggaaagggtgcatgagtgggttcgattcccacccgaggtttaacattttgcccatttcttattatatttaaaaatgtgtaaataatgcgccaatttaattgaggtaaattactcaagagcatccatcagactttctcaggcaatgaatggacaacgaaaagataatcaaacggagaatgagcttgtatgtaatttactttgggtccccgtcattaaatcttaaatcgacacattttgtaccactccgatgggggggggcggttctcagttaattaaaagataaaaatccaaatgataaaaaagtgagaggggtgaaaaactatttaaaaaaagaaattttaaaattcagaaggaatccgtggcaagggtggaaaaaatggaagaatttgcaaacaaattcaatttcgacgaataattacaattatttatttgcggacagttaattaattttgcaaaacataaatgaaatttcatttcaatttataatgaatagttccgctgaataaagcttttttgaaaactataaaataaaaaatgcagcaaaaaaaaacttttaaagttaacattaataataaaaaatcttttcatttttttttgttataaatgctcatcaacacactttttgaattcctcggccgtttttggcaagagaaagttaaataaataaattttggagatgaatttttgagaatttaaagtcggaaatttctggcttttttggatcttcatataaagctttagtcttgaactgaaaattcagcagtttttaaatttaatttagactagaaatcaatcaaaaataactgaataaataaagtaatattattataataaattttatttttaatagcaattaaatcaaacaaattgcaaagggaaaataaatattacacacaaaaaatgcgaatattanaagatgtgtcatttcgaaccanacgcgcgaaatggaagccgttcagttgaaaaatgacaaaaccaagaatttatctttatttac

SEQ ID NO: 3323 - DNA, 1961 bp, Heterodera glycines
ttgtaggcaaatagagaaaactctaggctatcgaacgatactaagaatgcaacatttggttgctcttaagcaaaaccatgccttattttaccggaaaaatagataaaatggcggattttacgaaacaactcaacaggatttcaccctgctggatttagcattgaatttcaaccaaacataatgccaatcataaaattagtcatcggatatgcattttgaaaattgctttcttcattccttgtaaaatgcggtaattgttgtgcttctgttgagctgagtttgtatacagctgaatctgagccagagttggtgtttatgagcataacatattcagcattcagctaaatttattaaaaattaggaaattaaaattagttcgttcgcatttaaattcaggacagagtgaaactgtgccggcgccggatggtccgtccaactaggcgcgacaccagcgttctcggcgctgatgcgcctagttggaacttaattgtccaaattttaattattttagtgcacatttttgaaaaaattattttttagtcaaatggttttgaatgcaatagcgatcggtattagttctactcggtatgaaatatgaataaattacatttgcatcgaaaatactttcccgaattccaattataggtgcagcaatgccaaaatgtgacaataataatgaaataaaaatagaaaataaaggaaccatttcgaatatagataaaattatccaaaattaaaacacaaatgtttttggaactgattgtttttctttaaattgaatcattttatcaattccacactttcgcttatcattttcatcattattttcatgtattatttgatatgatgtaataaaacccgggggaatgcttttcttcttatcaggcagttttttaatttttgcatgtaaaaatttcaaaattaattactatttttaaaattaattttttgttttgcaccactgaaatatggttagagacttaaaaaaacatatacaataatcataaattaatttattctatttaattaacaaattagtcaaagcattaaattgccttattaaattatgccattagaaaaatttgttaaaactaaaaattattttatggcatttaatttttttattattttctttatctataaaattgaatccggcaaaattagacaaaattttgatgaaatattcggaaatggatgggaaaaaatgaaagaaaaagaaaaaaattaaaaacaaaacaaatgagcaaaatgaatcagcggttgatcaaattgttgtagaaatggggactgacccaaaatgatcagtaaaaaaaataataatttaaaattttggtctaattaatgtataattgagagaaaaaagtaaattccaatggaatggcaacaaaattgcaaaattattaggcgcaaatcgagaaaaaaaatatacacaaatggaaaaaagaattaaatttaaatagtgaactactttattcatctatttgatgatttaaaagtttatatggccaacgtaaacagaaataatttgtgaagaaattgggcatatttcaatcatttaagaaattaacaaacagattgttattttaacaattattccaattaaacaatgcctgcttaacaataattcttacaacctaatcacaaagataaaaggtttgctcgtttgccgttggataatgcttacaccaataggagaaagctttttttggcgtccggcattggtggtgccggataaaccaataggaatttaagtctgtaaaatttttaaaacgtttctcatttttgcttgaaaaaatttgaaattttcattttgaggggggggggggggggaaattcagtacgattaaaattataagactcatgatgatgaactttttagagtgcaaaaatctagcaatttctctgtccttagagacgtatttctttttcataattttataataatcatttgctcactttga

SEQ ID NO: 3324 - DNA, 1215 bp, Heterodera glycines
  misc_feature (1115)..(1115): n is a, c, g, or t
  misc_feature (1155)..(1155): n is a, c, g, or t
  misc_feature (1175)..(1175): n is a, c, g, or t
  misc_feature (1183)..(1183): n is a, c, g, or t
tccaaaaagacccacccgatgaccatcgatgccaaaaaggcgcttttcggcgccacaacggcaacaagctgattgtgagaataacaatcatttaaatgcgcaattctttgctgttgtttttgctgtctctgaatggcattggcaatttgctgggcttgatcaaaaattgtgccggatttgtgagtgatggaagaagctgaggaagaggacgaagaagacaacaattcattgacacggaacgattggtgcacatggaaagaatcgcgggaaaacagcataattttggtggcgaatgggcaactaaaataaaatcttttaaaatttctaaaataaaatttaaaactttaaatttaaataatcattgaaatatgtatttggcacaattccaatataacacataatatgaaaaattggcacaggaaaattggagaaaatttgcactgaaaattcggcaccaaccaactttttttggggcaccataacacctttcctacttgaccaattttcaaaaccttagaatcatttgaagcatttcaacaattagaagctgatattaatttgtaagccaattgctaagctattatacaactcgccaaaaaaaagttcggacaaaaaaacgaacaaaattggcccgattttcgagtttttgtgaattgttcaactgcttagctattgcttaaaatgtaataaattgtttgaattggtctatttccaatcttacggtatccactctcaaaacgagggaacaagcatactgtaattgggcaaaatatacggtactgccgatacatttacagtaatttcaacaaaaaaagaatgtacaatattttacaacaaaaacaataaaagttaacaattttataaaactatcctttcaacaatgcgaaacacgtcaaaatggtgatttatgtggggcgattcttgcagccgccacttggaacagagggcgccaaatttggcattcaaagtgccgaagaacacacgctttgcccgcacatggaccaacgccatggcacctgtgtccggaaaaatttttgaatagtttttttaatttctttgagaaaaaaacaaaggattttttgatttctaattttttcatttttgaaagaaatcanatttgttacgaataatgttagcaatgtcatgttttatttncaatagcgagattctctccnaaatattnttagtggattgctattgtattttcgttttttt

SEQ ID NO: 3325 - DNA, 4229 bp, Heterodera glycines
tgtccgttcgacaatgacaaagagttgtttgatgcgtgcactttcatccgcggtgagcaaagtgccgtcgatcatcgcctccaatttggcatttttatggaatgacatgggccaaattttcctgacaaattgaaattaagaaaataaaataataaaaaaaaatgaaagaaattccccataaactaaataaataaatttaaatatcgcaggggcaaaaaaaaatttaaaaaattgagaaaaatttcaaaaaaataaaaaagtcactaaaatcggcgcggcgagaacggaacaagcccactgggtttcggccaatttgctcagtttttggggtatatttccttttcatagttgtccaaatttaatgaatttactatcattcaatggccttatgtgctttccattagcctgcaaaagttcaaaaaatttcgttaaactaaaaaaaatttatgattcagaaaaccgattttttgaagttttttgtgcataacttttttaaaactaaagaaattttaaaaatgttttgcaagctagtagagagcacttggggctatcgaatggtatcaaattcattcaattcaaacaactctgaacagagttataccccaaaaactgacccggggccttggatttcaaaaaaaaaaatttttttttaattggaaataggggggggggactttgtccacctgtacatctccaactggtgccgactctgaggctttcggcatggaatgtgccgtccgatgaatgttggctccccgccaatcagttggccaatcgccgtccgttcggcggtgccaattgtgccgtcgtcgccattttggctaacactgaccaacaattcggtgccattgacgcgcttcaaatgctcaaattgggccggcaatgggggcaaaatgcgcaacagtgtagagaagaagctaaagcaattgaaaatttaaaaatttttggttaaaatcggtggcttagtcggtaaaatttctgtttttgggcgtcagggttcaattccaccttactgcatgcaatttttcttttgcatattaattttttttgaacatttaatatttgataaacatgcaaaaagaaataattacagaaacaaaacttttcagaaaatttcaaaaaaatcatgaaaaatttggcacaaaaatttcaacaaaaattgactcaattaaccgtccattaaagcatttttatgcaaaaaattgcactgttcgagaaactaaactcaacttttgtttgtaacgttaagcacaaccgcttcagtgagttcaatgtgttctgtgtgaagtgaagaaggaagaattggccgaatttcaaagctaaaaattaaataaaaatttttttgttaattatattttttattactttcgtaatcgttgaatttttgtgcttttttgattttcgtcaagcaaattttcatctttggtgcttaacatctaaaaaaattgaaaaaggaaataatttctaagtttttaaaaaattctgatgtgtaaaacaatttaaaagaacaaattttttgtgcctccggccatttcaaacaaaatgccaaaaggcaaacatttaaatccttttgaaattgtaaccgcaaaatttttgaaaatttgtgaaaattcatgcctaacaataagaggtattcatggtaaaatgtaagtcattagaaattagtaaaaaaatttttcaagaaatcgaagtagggtattaaaaatcgcattatctttataaataatccgatccccagtttttcatttccgtacaaacttgttgaattaatcatcatcattatacataccaccaaccattatcatcatcatcatcagcaaatcagcatcattcaccaaccgagccataattatacatatttagtatgccttaattatgcatttttatcatcatcaatcagcaaacaaacgagttggttggttgctgtgttgattttgtggtggtggtggtgctgttccaacttccattcattccccctcccctcccattccttcagtttttgatcgctttgcacagtcaccggtgcggtgggccccaggaccaattgggccccatctttactctcttctgctgcttacctctaatatatgctccttggtatcattaaagcatttgtccctgtcaattaaagaccggaggaccccaaatggcttgatcacttcgaaaatgaaaaactcaaatttttgctcgatcgatttttttaaagcccgaaaaatattaaagaatgccgatggacgggccggtctcttgtctgtgcataaaaacatggaaaatttaaaaatgagggctaggcactaaactatctgaatactaaaaaattccgaagaaatccaaaaaccgccaaattcttgaaaattgtctagaccgaacccgaagccctgctgctctaacggactatcagcaagtgataccagagagaggaaaccaaacaaaacacaaaacattcaatatgatttcctggaaaatattgtaaaaaattagagttgagcgggaccgggacctgaacacggacaactgagtaccgaagtcccggttttgaccgggaccgggactagtcccggttttttcccggttttcccagccaaaaattcccggtttttcaacccgaaaaggtcccggtcccgggtttgcccaaaattcccggtcccgctcaactctataaaaaatggtagactggaagggaattagaaccctcatcaacctctgtgttgcggcgatcggcttcccaacaattaaatagggtggggggggggtcaaatgccccgggggtacaaaatgctttttgcctttgccatcatcgcttttgatgctcttttttcatttcatttaaaactatgcgtcacacattgaatcgtcgtcattccaattcttccactccccccttccccgccgcgatcatttccaattcttcttgcccattattattcatcatcacatcgcacatccgtccccatccgtcaatttttcaccctttctctccccacccgttttttttctcgacaattctttttaattcattttgatttttctgtttgtttgtattgtgttattgttattgtgttgttgctttccgttctgctgttcttagacaatcacttacaaacacagcgtccaagtggcaaactttttaaaaaaaattttagggtagaaaactaaaggtcagccggtgacgaatagccaatgatataagaaaatggatcaattccgaacctttccggttttaaaactcgaatcggggactttaatagagcctggaatttcaaatttgcggatcccgctgcgcgattgaaactcaaaattttttgcgggacgtgatcccgcaggcataaatcccgcaaatcctgcatttaaaattggcgggatccaacgtgatttgtgctattcctgtttagtggccctgatttgcccaaaaaaggcactcattaaaatgtttttttctttgattataatttttatgtttgagaaattttttgaaatttttcaaatttgcagagagaacgcctagacctatcggatgagcgaaaaataaaaaaaatttgatcgtcccttctaatcagttttcttaaagcattaaattgtgtgcgtcacacttaattgtccccccccccccccctacaccaatggcaccgcctctcttttagcttcgttaattgttttttttttcaatttttccaccaccatcaattaaagcactccaagcacctgtctatataccacacacattacgttttcttaatgccatttactcttggcgttaaaagcattttttacacataattagtcgccttggccccgcttttttctacccccccccctcttatctctgtcgacgattttactcagggttgtcgccttgttgctgatcaagaatgtggctgatccattgactgttgttcaacggaacaattccagcagaagcagcaccagcagcagtagttgggtttggcaaattgtgctgaaaaaacaatgaaaatattaatattgtaagctaaaatttttataatcaaaattgtttatttaatttttaaattaatctctttaggaaaagttcattttagtatcaaattcatatgttaatttttctcatttgatcctcaatgtttttttgaatgattaattatcttctcttattcataaaattttatgtcaataaattcatcactttttttattgacagcaaatttcttcattttggggataattttattttttatgcaaaataatttgaa

SEQ ID NO: 3326 - DNA, 2879 bp, Heterodera glycines
caaaaagtgaaaagtttgtattgttgataaaaaattataaatttaatgaacggataataattatttgtattttttgatatttagaattcaatatacaagtcaaaaattatatctttaataaaggagataataattgtttctatttaaacaataaaaattttcaatagtaagaatgaaaataaataattactgtgacctttttaaattgctataaaatatatttgcaaaataaatatatcattatataaaatttatattcataaaaatgaagaatcggaaatgaatgaaataaacttcttataccattaaaaaaaggactttttatattatgacaaatttttgtcaatgattcatatcttagcattctaaagtctttactggctttatctcttctactgcacccgatgcttcaaatgtgtgtgatataaccaaacgtcatacagtgtatacatccccccccccccatcaaatcatcatcatcacaattcaccccgccacttgattggaaagataaggaaggaaggaaacgtcgtcacaccgatttagggaggggggggactgtttctgacaaaaaaaagaaattatttgggttcattggaattttagtatatcacaaatttaaaaaaaatgatattccaatttcataaatatttagaaataatttaaaaaaggtccctttcaaaaatgaaaaatgaactatttttggcacatattcttttctagagaccggaatttgaaattcaggaaattttggagccttggctcccacaatcaaaaattcgtatcattcgaaaagtttttcaaattttagtacacattgccaagaaaaatagtacgccaatttttctctagcactctctcctgattagaacagtctctcttatataccgtatattctctaattatcgcccagtctctattaatcccgcagtctccaattacccccccccctttctgaggaggttgaaaaataatcccccagtctccatttctaaaattttttaaaattttaacaaaaattatttaattctaaattgaaacttgtttaaatgtttattaaacatgaaaaaatacagaaaaatcactcagtgattctattttatcgatgtatttgaatggtcattgcagggcccggatttttaggcgctaaaaaccccgaaataggtacctaaatagttgctaaaaagtcactcgaaatcgaaaattgatcgaagaaaatgtgttttttgcgtttatctcaccatatgctatccgcaaaaaaaaaaaggtgaaaacctaaaaatccgggccctggtcatatgcttacaattagcattacaaatttatttaaatcgtttatgataatcttgatcctccaaataaaccaaaaccgggaaaagctaggaatttgtaccggtcttgcgcaaaaaatgacaagatttttgccattttggggtcaaattaaaaaaaatggttcaatggggtccggcggtgtcgataggcgacggaacagctgtggcttcctccataaattgctttacaaacgcagcaaaaagattccattgctaaatatatggaatttttcatgtaaaattaagaaattctgtaacaaaaaatgcaataaaaaattattttttgacgagatgacatttttggcgacatgttcaaaaaaattcaaaaaattttcactaaataaatcagtcgaaaaacgaatttttttttatgtaatttgctttatctaataatttttcaataattgattttggctaattttttgggcttatttcaaaaaattcaatatattaacagagcgcacattttttcatgccaaaaagtccgcgcgcttttattacataaaaaggcaattcaaaatttaatttacaaattaattttaaaagcgtttgtgtccccaaaaaaggaaagtgccgctaattgctctccctaattggctccatttaaattaattaaatttctccttttcctctttttcacagatgttcgccgatagaatgtgttgaacatccccaaacacatatttagcattttccattttcttaatttcttttctcagtggcttctttctcaactgctcaattcttgaggtaaaagcattgatttttttaaaaacggtaaattttaattaaatttaagttttcgtttaggaatttttgcattttctaaccctttaatttttatttttagacatttttcgttgaatttctcagtatactcttattttcggactgtttcccctaattttcaattgccaaaacccaaaaaagggtcataaaccgaaaatttaggccccaaaacggaaaagtgccaaaaaaatttggcaaattttgccgcaaaatataaaatttcattgctttttagggccattattaatttcgctatttttttgcagcattttattatgacactgagccccaacttgaaatatgccacacacatcatctttttcatctcgtggattttgtttgtcgaaatcctttacggcgtaatcccgtttcttgacaatgcaaaaagtgccgtggcattttccatcgacgaatcattcagcccaattgaaaggtgattggaaaaacaaatttattagctccaattgaaattttggcttattgcagttttcacgggactagctggtttcggagcgagcccaagtttttggttacaagttttttcttggccaaccaaatccaacaatcttggtatcattcgatagccctaagtgtcctctattagtatgcaaaattgcgaaaaatttcgttaaggttcaaaaaagttacggccagaagaataaaaaaaccagattttccaacttttttggccataacttttttgaaccttaacaaaacatatcgaaattttgcatgctaatagaggacacttatggcttt

SEQ ID NO: 3327 - DNA, 2567 bp, Heterodera glycines
agttggatttggtcggcaaagaaaaaacttatagccaacaacttgggctcgcgccggaaaaccaacagacttcgttttcacgaccataaaaaaagacatgaatcataaaataatttaatgaacatatctttttgtagaagcatatgaattaaacatttttggacatcattcgatagccccgagagtcctctatttgtatgcaaaatttcaaaaatggtttcaaaaaaatatttgccaaaaaactaaaaattaacttttcatgcatttgtggccataactttttttaatataatgaaattcgttgaatttttgcatgccaacagaggacatttggggttatcgaataacaccaagactatgcttttacaaaaagttatggtgcattaaaattgtcaaattattttatggcccagtaaactgcaatagagccggaaatttatgcctcagccatttaggaaattgtaaaacttacaaaacgataaaccgatgcaaaaaaaattttttttaacataaactctttcgctgctggaagaatttttttttcaaattttagcaaaattcgttttgccgatttagtcccaaaaatgactcattttggtgagggttttcgggtccaaccaattaggcattttggcaatttttaggaaaaataaaactgaaaattttcaggtatggcgttgtgaacacatttctactttacgtactccgtttcctgtctttgctagtacgttttgcgcaacattttttgctgtttggcattttgcggttttggctttttaccctaactggacaaatttttcattttttttttcaaatttttctggggttggatgccttatttagcccagaaaaaaatttacaggaataatttctgttcattatgagcgggtggctcccaaatgtttttggctatttttaaaatttttccggtacgccctgacgccttttatctcaggtttttttagaaatttttaaaattatcattaggcctatgaattgttttttcaaaattttcacgggctgctttcctctccccccgggtcccaaacccgtaaaatttgtgccatttttctctctttttaaattattttttcaatttttgccccccttttttgcccaggtgcttccccagtgcatttgcaactcgttgggtctgattttgttcaacagtttcaaggaccgcatcaagctgaagaccacgccgttgttggcgccgttcatttgcttccgcgtggtcaccaagggcgactacccggacctggtcaaggtcttcgcattatccagcaaaattttacaaaaatttgtcgggaaaataggcacatcttaaatttggggaaaaatcgttgaaaaacaaaatggaattttacaaataaatttaaaatgagtcggtgggctggacaaatgtgcgccgccatgggccaaattttttttttttttttggctataatttcttttaatttgtccgaattgaaccatttttggtattatttgatcgcccatatattctcctaaacggctttttattgtcaaaatcgaaaagttttttttttgaaaaaaaattttcattcgaaaaatgtttattgttagcaaaattagaaaaagcaaaaatgcattctattttttgagccaattattcaaacaacagaatgagtgcttaagctatcaggaaaatttttcaaaaatatattttttactgaaacattctaattgtaagtttgaaaacttaaacagaaaaatgaagttcatccccctccaccctctccaacaacggttttcaatttttcaacccctctctcgcaaaaaaaaaaatttaaaaattttctaattcagcccctcccctcatccatcacacacacaaaaaagattttgtgtttttttttgcaggtaaacctggagaagaacttgcaaatgtgctacgaggcgggcctggagagcttcatcttcgaggtggtcacggacaaggccatccatttgccccactgcagcaaccgcgtgcgcgaaattgtcgtcccccacgcgtacaagtgggttttgttgttggttgtttgggttggtggacttcctcacaatcaatcccccccccccccccccctccgagaattttttttttaatttctaaaaattacctagaaattttttaagaaaaaaccttaggaaattttttataagaaaatttcaagaaaaattttttttttttttttcgacgattttttcaaacttttatgatgagttactaagttttccttaaaaactttcctaagattcgctgaaaacaattaaaaaaaaatgttttcttaacaaatttctaggttagagaaatttattaaaaattattaatttaacttaaaaattttttgatttggaagaaaaatgggttggttttgaaaaacgaccaaaaaaaaagactaaaaaagcgtgtatttcgcccataatataaaatttggaacacaattttaaatggtcgctgaaaaattttcaaaaaaatatatttttttttcttgaatcccctaataaaattttcgagaggaacataggcagtggcatttatttttttttttttgttatta

SEQ ID NO: 3328 - DNA, 3076 bp, Heterodera glycines
  misc_feature (1076)..(1076): n is a, c, g, or t
  misc_feature (1089)..(1089): n is a, c, g, or t
tttctaaaaaagtgaaaaaattttcaaaagagggcttctttaaactagcgccaacttttgtgtttattaaagcattttttatatttcttcagctacattgaccattccgtcattgaatttctccgttcaaacaagcacatttgggacagaagtggcaccaaattggagttgactgtgtattcatacaaaactaatgatgtccagcagatttgggatgctttgaccagtgaaatttggccaatttttgcaacaaacattcgcaatttgggctttaccagtgccaatggtttggacaattttcgtcgccacacttcaccgacaattctcaccgatctcaatcatctgaattcaatcaattccaattttctgttgcctgatgcaattgctgatgatggaccggatgcaactgctggccaagtgttgtccaaatggctgcacattccaacaactgatggtcaaccaaagcgattgtattgccatggttattatgatgaatcaaatttggaatggatcaacaatttgaaggaggtggccggtcatattttgactgatttgattgccttcgatttgcgttttctttttgtttaggcatttccccgtgccacttcttccgccagtttcattattcgaattgatcgtgagagagcaatgtcaaatgctgagccatttgaattggagaacgaacgaaccaaggaaaagctgacattggagaaagagccacgttctgctggttattggctgttgaagcgatgcccaattagtgaaaaggcggcggcgattcaatttgaaaattgggatgccaatttgaacaaaatcaaatttcatttgtggggtgacatcaacaaattcattgggtgagcagcgacagcaatttttgattttgtcgaaaaaatatattaattttaggccattatcgccaccaacggaagaaaaagcggacgaatgaaagcacgggaaattaattatatttgttaaatggtcgacgatctcatcaattggaatttgatttgatgcgctcattttctttttgttttgctaatgtcacttattttgaatacaacaatttctgaaaaatntagttaattcttnaacaaaattacaaccccaaaatattttcataacatattcaatctaaattttcataattaagaatggtccaaatcccttttttcatttaggcgcttttgagcaaccaaatttttgggtgtaataattagagctcggataaaaaggcaccaaaaatcgcgaaaaaggcacgaaaatcgcgaaaaaggcatgaaaaaaggcatttaaaaaaatttttctaaggttttttagggagcaaaacacgtaaaacttaaccaaaaacttaattttggtcatttaaatggttattaaatattttataatgtttttcgaataaggaaaatttttaaaccgagaattttttatcaagaaaaaaaatgaattttggcgatcaatttttgagaaaatttttcaattcttaggggtgtattttctgaaattttttcaattcttagggatgttttttctgaaaatttttcaagtcatttcttaaaggtgtattttcccgatttattctatttttgatggaattttcggaaaaaacgccaaaggcactaaaatcggaaaaaaacgtcaaaaaggcaccaaaacggcaaaatgccaaaaaacctcaaaccaagtggaaaatgcgctttttatgcttaatatatcgaaactagtgcgcagaaaaaaaaggcaaatgcctcaaaatccgagctctagtaataatataaaattcgatagaaagaaaaaaatttccatttacacatatttcttcaatttgattttatttatttgtgtcaattataaatcaaagctggtggatgggatgaagaaagaatgcatgaacggatgggatgacagatcaaaattagaaaaattgaatgaaaaaacgcacaaaaattggaataataattaaaaaaacattcgcacaaaaatgggatgaatgaaaagcggaagaaaaagagagagtcactatcatcagagtcatcgtcatcatcaacagtttggtcctcctcacatacataatacagtatattctccacaccgtatcccatcagcaatcgtaccgtgtgctgtacatattgagggaaattttttaaaataaaattataacaattttcaagttttatccggtgtcaccagttgtacctctaatttccaatggattttaatggaaatttgaatcacataaatccgcaaattggcatttttgtggcataaagtctaactaagatcaccgttgaaaatatcggtgcaaaaaaattttgacaattagacggttcatgaaataaatacccatcacatatcgttttaagttccttaaaccaaatttcgtttcttttttcaatttaccgctttgccgatggctccggtccgatgatggcacagcctccgctgcccgagctgccgtttgctggaagagaacaaaaaaaaattagtgatgagtgaattttttttacctaattgttttttggagcatatggagggacatagaaattaaaaattatacgtagacaactgagcataggtggacaggggggggggtaatttggtaaattgtacggggattcgaggcaatttcctaaaatattcggcgaaaatcgaatagcacagctaaagacggaaatttttttttatgaaattgggaaaaaaaatttaatttttgttccgaaaaaacacattatttttaagatgcatttcattttgtccaatactgtgatcactgatcagtcacttcttcaggctgatcgtgagtgatcaaaactgtagcaccaccctatgtgatttttggctgtgctaacaattgttcatcatggtaaaaaatgcacccaaataatatgattaatcatatacataatatatatacagactatcctattaccatttacagtagtttagcactaaaaatgttaatgtgattgaatgttgtctttttcaaataaaaaatgttcataggatgtcgtttgtgtatgattaatcatgttaattgaatgatttttaccatgtggacaattggtagcgcaaccaa

SEQ ID NO: 3329 - DNA, 1343 bp, Heterodera glycines
tgttcataggatgtcgtttgtgtatgattaatcatcgctccttgggttcatttttaccatgttggacaattggtagcgcaaccaaagtcccttggatgggaaacagcttcctctccacccctcggggtgttaaaattttgatcactcccccgatcaacctgaaggagttaactctgattcatggcgttgcaattgttttgtttataatcagcatcgaaataccaatagattttgccgaaaaaatgataaattaaaaaataactcattcattctggtttctttgtacaaaattgttacaaaatcgtttttttttaatttcgcaagttgatctatccttttttggggttcgccgaagattttgtgaaattatctcgcagaaacccgtgtgcgaaatggcatacccattggccacttttagaaatgagttagacacaacagcaacaacacaaaaaatggtgccaatggaccaccacaacaaatttgccaatgtaagtgcacaacaaaatgccaaaaaattgtgtgtgaaaaaaagacattttaaatatattttatttattttacgcgtgcgctggtcagtcatatatcagtcaaaaatgtggtgaaagttgccaattaaaatagattaatatatagagcactaatgaggtaattaatggacagactaagaaataattaattaagaaattaagcaacaccgccaaatttgtgccacagggtggtgaacagggcgtggaaaaagcaaaacaaaatgaaaaacgcgtagaaaatggacaacaaaaatgtgttgagaacaccaccgggaacagcagcaattgggtgttcaccaccaccaccgtcaacaatcggaaattgctgatgatgcggaggaggaggagaagccgacgatttggagcagggcggaggagggacaccaccaatgccaatgccaacaaaacaacactcacagaggcgcgactgctcctgggacatggcggcgaccacctcggtgacgagtcgcgggtgctccttgaccatctcggcccagccgtcggtctaaaaattttaaagaaatccatgggaaattggaaaggtgctaggtcgttatttaaaaaaccatcattatgattttatgagccccggggtcgtttgggccccaacccaaaaatagaaaaaggtacttttttaaaaattaagattctaaaaactaagcctgagggatccctcgccacttgtacactttctgtcgtcttctccgctagatgggaaggaagaattaagtgctcgacagaactcaattgacattcggatcagtgaaaacggaaacggcgacgggcgaacaattaaaaaatgcttaatcattttat

SEQ ID NO: 3330 - DNA, 2552 bp, Heterodera glycines
aagctaagttataaataatttttcataaaatcataatgattgttttttaaataacggctccgccccattggaaagaaaaaaaattttttttttttttgaggtggaggggggggggagagaaagagagagttgaggttgaaggagacgccccatcccatgaaaaatttcaataaaaatcattaagaaatttcaatttaatttgctggggagatgtaaagggggagaagtatttagcgggaatcagaaccgtagccaaacaaaaaaatttttcggagggaggaatcgaagatttttttggcctaaaaatcttttcaccaatgctatatttaaattggcagcgagccgtttttcgccaaaaattactaattttggccattttgggggtttaaattttccaaaaacaaaaaagataaataggggtccagcggcgcaggaagttttttttgggaatttaatgcaatatgaaaagaaatcattaaaattttcaagaatttcctgttttgtgatttttttttaaattaggggccctcaccatgatgacattgttggagtattgcgcgatgaagcgcagcgcgtccgccttcaagtcgagcgcgttgtgcatgtcggccaacacaaggttacggcacacattgtcagtggacagtccggcacggagcacctggggaaatgggtaaaaggagcatatgccaaaaaatagtcaatcaaccaaaatataaatatttttttttgttgtttaaaaccccctttgatagtgttattctcaaatctttgtaagaaattgataaactgtaaaagggactttgaaaaagttatttaatttcttgaaaacccattgtgcgtatgaacctcattagcttaaaaatttaaataaaaaaaaaatttccccaaattttcatagaaaaaattaaaaaactaaaattttctgtagtttttgacgacaaaatttgaaaaaaatggtttggcgttaaataatgtccattgccaacctgatcagccatctccttgagtccgatcagttgaaaacggtcggcaaccgccagcaaatcgagcgccatttgctgcagcaacggcgaacgaccgctgtacatatagaagagcatttcgcgcataacctaaaagcgtgagggaaaatttaaaaaaaggattcaatttacaagtaaatttcaagaagaaaaaaattttcatcagaatttccgggcgatttttggaatgattttttgaaaaaacgcagtaattaacagtaaaattttgaaaatcgctaggaaaatctttcttaatttttttaaaatattttcggggaggggcgaataaaaggcaaaaataaaataaaatgaacggcccgaaatacgggatgcacttcatttccctccgtcgtttctcctccgtctaaaatttttaaatttcttttcaagaaaaaaaattattgaaagattttcagcgattaaaattttttgaaaaacttagtagttcatcaaaaaatcgcccgcaaaatttttcatttttttcttgaaatcttcttgctaagaaatttcctaagaattttttctggaaaatttctgttagttttttagggggggggggcgatgtggaggggaaacgacccgctccgcgaaattcgggctcaaagactgctgctccgccggaattcggccccaccctatggccaatggtccaagcccactaaaaaatcttttttttttccttgaaaatttttttgcggtgacgttttgggatttacccacaagtccaccacccggcaccacccacctcaaagtcgatgtcttcatagaacacctccgacttctgtgcctcctccgtgtgcggttccaacatggcactgaacacgggagaacgtgccgccagcaccaccttgtgcgcactcagctcatgcatctccttgccttcgccacgacagacgatcttgaagtctgtatgcctggaaaatggggaaattttttttttttgaaaaatcatttccgatggttaattatgagtaattagtaaattaatcatcattacctgttctggccaaacatcacttccaagtccttggccagctgaacaatgaaaaagtaattaataaagacaaaaaaaaacccatggttcgctagactctcgcccacatggctttttttaaatttaaatttttgttttcagcgtctaaaaataccctggaaaaatgaaaaaaaatttttttttgagcgtgggtcacaaaagggataaataatgattttttcttccaattcccaaaaattgtggtgttttttcaagttctccctcccgtccttttacttcgcatggccgtggctcgggcatggcctggttgatggtgttctgactgttcttggtgatggtgtccgacacgatggtcaggttgagcagcagttggatttcgtcctgtggcatgatgtggttgatcagcaaatcccggcggatgtactcgaaatagccgttcaactggaaaatttgaaaaaatatatatacatacatataaatttgggaggatttccaaaatgcagaaaatagtggtcgagcaatcgaggtttaag

SEQ ID NO: 3331 - DNA, 3883 bp, Heterodera glycines
  misc_feature (22)..(23): n is a, c, g, or t
  misc_feature (58)..(58): n is a, c, g, or t
tcgtttcttagccgtaggtacnnggtttaattttgcaaaaaaaaaaaaaaattttttnttgctcatttggctacatgtatccaaaaccatgtcccacctgctgtgtgcccgtgtacaccgtggccggcacttcctcactgcgcgtgttgtacaccgaaaactttgccttgaacttgacattggtgcaggagaacaccttggatagaaatggtggtgaaaatgtaaaaaaatgaggaacaaagaaaaaacaaataaaattggcccggaaattaaaaaaaaattaggaccctgcaaaatcaaaagttcttaaaattttatttaaacaaaaaaatttcaactttaagcagaaaagagcgtacatgtacaattaggtattatttcatttagaataacaaattcttaaatttgaacgcggttttcctacgagtaaatttttcaaaaaaaaaaaaaaaaatttttttcaatgggtggagagggagacctgagaaaacgaagtgtgtggaggattaaatatatccccttggctcactcactggatatgtacgaggagcccctccaggcgcacttcatttactcctggcatcgcttcccgcggtattttttttaaataccaaaaactaatttttcaaaaaaaaatttgtttttttttgaaaatttttgtttggaaatgaacctgaaagaagcagaagtccttgttcgactccttgttgccctggggatggagacgtattttgaactgcaaatagttcgcgttgtccgccgcagcggcagccgctgccgcggcaccgccgcccatcagtccgccgccggcactgccgccaaccaacgaattggactgggacgagcaaccgcttgacgtgtgctgtaaaagaaaatggagaagtaacatgcgatattgtacactggaaaatgggagataaggcccaaaaaaaattgagaaatcggccgtgccgatccccgaaaatgtcggagatcggaatttcggcgccactcagaaatagagggtgaaagtctagacggaagcggggcccgtaacgagatttttcccctgaatccgggttccgaaattggaattttacaccgtaaatcccgtcccggttccgttctgaacactaatactggtccgggccaccgaagatacacccgaaaaattagagaagaaaatttgatggttgagaatggttgagagaactggaggacgagccgctgccgattaaattccgaggtttccgatattttaattggcgaaaaagaaaacatagattttttgaatgatttgtgaagtcgagatgtacgaaggatgaagagtgatggcaaaccgagtctttgatgcggacggacgtttccaagtagcgcacttcgcattgaccgaagcccttgatggtccctaaaaaatttggatttattttcgaaatacctagatattttccttttttgttggtaaaacttacacacgtgagtgtgttggagacttcgaacttccgtggaggacctgaaaatgttatgcaattagtccatggaaaccgaaaaaaaaatttagacagtttcgcaatgaaagcatcggaaaattttttttatgggattttcgtgaaattttccgcaaattcgggccaatttcacgttccataaagatcccgaatacctagataaattttcaataaccatgtgcagcttaggattgggagtgaattggacatgttaaaatttcagttttcatacaaattctgggggacccaggggagtcaatgtgaaattttgcaattttcaactcccaaaaaattaaatttccgatgaatttatattagttcgtctaccaaccagctgtccgatgggcgcatcggagttccgcacagatcagccatgtcagtgtcctcgggtggctgttgatttaaagcaaaaaaataataatttgggtttctgaaggttgtataaatgttagagttggacatggggccatggatttttctaaaatttgtccacaaaacccaggttcatgaccagttttttttccacaaaatgccgaactctaacattgtttctatgctatttaataaacaatttcttttttgtttgttgatttacaatagaatttggtggaagtctggggaaaaacattaaaattcgatgaaaacaaaaaaaaatcaattctgtaagttaaagggattgtaaattgatgaaggggaaatggaaggaatttggggcaaaatgtctcaattttaaatttgcaaaaaaacactaacacaaatctttggatttttggcaccaattcaaaaaataaacacttgtatacaaattatgttcgttttttaggcataaaaaatcgcgaaataggcactaatttgtaagttaataccacagaattgtgttccctacggaaaataaatttaaaattttgttttgatttttcctgtggtatgtaaaaaagtgtacggattacgaatctgagcaagaaatgagatttgttttgcaatgctaattttagtgcatattttaaatttctcgagttattagggcatcttttgaccattttaatgcttacaacgcgtaaccattctgatcatgaatctggctggcatctctattccggccaattatcaaatcaccgactaagaaaaccaataaaatggttttgagcaattttgagttttggggcctccgataaaaatttatccaaattccaattgaccaactcaaaaatgatcgaccatttctcaagtatattgaacaaaaattctaataaaacaagcaaatgttgaagaagcaacaaaagcatttttgagagaaaataagcatcaaatccatttgtaatttgtgagatcgtcgaccatttctcaaatataattaattcacttccgcgcactcagacgagattttggttgctttgacccgctttttcttctgttgacggtggagacaatggcctaaaattaagtgtttacatttttaacaaaatcaaattccgttggttgttgctgctcacccaatggaacgactgccacgcatcagctcaatttgcacatagttcaatttgtcgtccaatttttcgtcgttttcccattgaatcgccgccttttcatcaattgggtatcgcttcaacaacaaattaacaacattataacgtggctctttctccaatgtcagcttttccttggttcgttcgttcaccaattcaaatggctcagcatttgacattgctctcacacgatcaattcgaataatgaaactggcggaagaagtggcacggagaaatgcctaagcaaaaagaaaacgcaaatcaaaggcaatcaaatcagtcaaaatatgaccggccacctccttcaaattgttgatccattccaaatttgattcatcataataaccatggcaatacaatcgctttggttgaccatcagttgttggaatgtgcagccatttggacaacacttggcgagcagttgcatccggtccatcatcagcaattgcatcaggcaacagaaaattggaattgattgaattcagatgattgagatcggtgagaattgtcggtgaagtgtggcgacgaaaattgtccaaaccattggcactggtaaagcccaaattgcgaatgtttgttgcaaaaattggccaaatttcactggtcaaagcatcccaaatctgctggacatcattagttttgtatgaatacacagtcaactccaatttggtgccacttctgtcccaaattggcttgttggaacggagaaattcaatgacggaatggtcaatgtagctgacgaaatataaaaaatgctttaataaacacaaaagttggcgctagtttaaagaagccctcttttgaaaattttttcactttttttagaaaaatttttttttttgtatttttatacaaaatttgcttttttac

SEQ ID NO: 3332 - DNA, 339 bp, Heterodera glycines
caaaaaaactttatttatgtcgtgaacaaaataagcaaaatgataaaataatttttgatcgccataaaagggacaccggtaatactttggtttgtcccccctattggtaatagtaccgatgggtaccccccctttttcgaaaaatgaaattttcaaaatgatgatgctttctttcatttatgggatcatattcgtactatttatccgtgtcaataattgctcattcgtttagaactgtgaatttgttgtttttttctatcttccatgcatttgaattgattttgagagataaatgtgaattttagtgaaaaataaattttagatttttgttcgaatttg

SEQ ID NO: 3333 - DNA, 2369 bp, Heterodera glycines
  misc_feature (1256)..(1256): n is a, c, g, or t
  misc_feature (1280)..(1280): n is a, c, g, or t
  misc_feature (1306)..(1306): n is a, c, g, or t
atcacaccgtacattaaaaagcatggcataaatccggtgacgggcaagaaaatgagcagcaaagatctgacggtgctaaattttgccaaggacaaagacggtcttttagaaaagacaaaagcccattttacaatgaaatccaatttagacaattttcggtgtcctgtcacttatcgaatgttcacacagacgaggtccatcctttccaatcagaatttaattactttattcttcagcataatcgtggcaatcagaacaacgggcaatgtgtactcaatggaggcggtcgaagagctgaatttgaagcggaatcatctgaaggatttgttgacggacacgcccttccagaaaaaagttccataataaggaaaaagctttattttttcaattacccttttcaggacattattacactgcaggacccgcaggacttggacaagttcaacatcgaacagttttaccatgtccaattcgacaccaaaacaaaggcacaaattgcggaggaaaagcgcgcgatgcaaagcccaaattactttttgaaccgactgaacaacgaggcaaaagaggcactgcaacagttggagaagcaatatgtcaaggaggtggaaattatttaacaaatggaatgagtcacgtttaaatgcatttagggaacgaaaaaggcggatgatcaaacggcggacgaagtgaacgccgcccatttttcgcagggaaaagtcgcggccggactcacttcgacaacgatggaaccggtgactctgaacaaagcggcggtgttggaagaagacgtggtcaagttcgtttgtccaaaacattttgacaattgtatggcactgactttcgtatgttttttcaaggtattcacgcgtaacaaagaatggttatgtacgaattgtgacgaaccacggaccccttaacttggaattgttctgccgacacgcgccgcgcgcgtgcgaaaactttattgtgcactgccgcaatggatattttaatggcacgaaattctatcggctgatcaaaggatttattgtaagttgtcatatctctcccaatggaaaatcgttgaaatttcctttacttttttgttgtagatttttcaaattttaggataaaaacattcagacaatcaagaattttattgttgtgttgtaacaattattgcacagtttttagttaacaaatttaaagattgtctcgagctgttttttgaaatttttcgggtgaatttttaaaaacaataaattgacatattgggnggggggggatgggcttttatattngtaggtgaaaaaaagctgattgtgangtcattcgatgtgggtttcttttggtactgggtttaattacccgggacacttgttttaacactgacacaaaacgggtttaaattttctcaataattttgaaagctgatcaaaacttgtaagttataacacaaaaacagctttttcttcaacccttatagagatttttggacaacaactcaataatttacttggtaaaatttttatattcagctccaaggcggagatccgaccggaacaggcaaaggcggtgagtccatctggggcaaaacgttcaaggacgagatccagggcacgtacaaacatggcgagcgtgggatgttgagtatggccaaccgcggaagcgacactaacaattcccaattgtaagtgcagaagagaaccatttgcattttccaagagaatacagtttcatcactttcgccgcgtgccctcacctcgacggaaaacacacggtgttcggccgtttggtcggcggtgcgcaaacgttgtgcaatattgagaatttggagacagacgaagaggaccaaccgttgcggactgtgctgttcatgcaagccgaagtatttgtggacccatttgatgaggcaatggaaaaagtgcgcagagagagagaaacagcggcaaaagcgaaaagggaatcgcaaaacggtaaaaacaattcaataagaagcttaggtggacagggggtccgaggtaatttcgtagaatttttggccaaaatcgaaaaagcacttgtaaagatgggaaaattttacttgaaaaaatcaaaattttgtgccaaaagctcaaaatttttacgatttttgaattgcatttcgttaatcttttcacaaaattctattttatcttttcctactcgttaaaatttttacgaaattgaattcgctttactgtttcgtaaatttttacgaaattaacaccttttttttagtgttaacttgttaataaaaattcatgaaatcgactaaaaagcgcaaaaattctgtcgtttttttacaattattaacaaattgcactgaaattcaaaaaattttcccggcggtgcctatcggcaccgccgga

SEQ ID NO: 3334 - DNA, 3554 bp, Heterodera glycines
atgaaaaggagccgaaacaaacaaagcctaaggcgtccttctagggagtggggaatacataagcccggaggtgaaaccctcactgaagaggatagcaatgacagagaaagtaaagagggacaaagaaacgaaaacaatttcatttaatattttaggaagacaaaattacagcggatgaagcgaagagaaagccgacataaaccaaatggtcattcgaagtcattcatcgcagtccaattccatcgtcctttcctctatgatggcagtgttcacatgtttttctgaatctagattttaaaaagttagtttctatcgtaaaacaacctttttcctttgtctcttgtcttggcccaataatacaaaatgcacctgtaaaattcggcctcataaaaccctttccccagcggtacactcacagtctgaccgttcgccaacccttacattggaaaacaatattgaatttttaaccgatgcactaaagtgagaacgaagtggtgattcgccaattaggactaaccctttgccgacaatcactccgtccattagcacgcaattatccactttagagccatcgccaaaaacacaaccgtcaccaaatactgtccttttaagttgacattttgaaccaattttgggcgcattcataggtgaaaagagcggagcgggcaataatttgagaagctaacaataataaaagtgaattctttcctctttttttgtattaccgttttattcgcttcgaagtatgagccgacattgttgcactgagcaattattgtgaagtccgactctgtgggaacccaagcgaagcaattggcacgctgcacaatccgtggcaccaaatcggctttgacagaggaaaaggaagcagcggttgaccttgaaaatcgaggaatacctaattgagaaagctagacaaatgcaatcacttttttgataacaaaatgtccaatgccttccgttggacgaggtacaaatgcacgtccttatattttgcggttgcttttgccttggggcatctgaaagaagaatttgtcacgtgagagtcaataacaataacaattttatgacagtgcctgtcaaacaatgaaattgggattccttcctcctccgcaaaatcgtcctcgtccaccaaaaagagcaattgtccgttcggacccaaaatgacaaaatctctgtctaaaaatacaaaattcaaccaatcttcttttcccatcatttacactttttaacgcgatctttaggcccggggataggcccacccaaagccgaatcggtgagcagacaggacaggacagcgttgttctccatgtactgcttgaacatgtcacgcagccggacatcactgaccaagtcaccgctaatcaacaaaatgtgatcactctaaaaggatggtaattaattggattgattgactcattaccccctccttttacatgcataaattagttttgacccccctattaggaaatgcctttattcgtcccatttgcttttgccttcaatttcccgagcagtcttttgagtacgtccgctgttccccagtcatccacgtcctcctccaaactgtcaatggccaccacttcgatgtccattcccttaagtgttggccatcgtccaccgccgtccgttttcagcgcattttcaatttgcaatttttgccccaggggaacaatcaaaaggcaatctgatgaagaaaatgagtacatcaaaatgaacggaaaaccattaaggaaagcctaaaggcattgtttgacctctgacgcgattcagtcgaagtaaattaagcgaaaaccaataaagtggcatattggccatgggcaacaacgccttcggcatttgattggtcaaagacggcattcgacttccacgacctccggcaaaaacgacagcttggcaatcgctgagagaaaccatcaacaaaggccaaaagtaaaattaagaaagcaaatgacattttattaattagaattatagggacatttttattaaccataatgaaacaagccgaatttttatgaaaagatttatccaaaaaataattaaatagacacagaaaatattgttcttttttggtttcaccccttccccacctcaagatattctgaaattgtatcaattatctgaaggcgcacataccaattttttttaaattgtagaagcaggatatttattattgtatttttcgaaaattaaggaccaaggggtgcggagggtaaaagaacgaatagtacacaaaaagatttacaatccgagatcaggtgatgaacgcggaagtcccttcttgctggcgttctgtcgttctcctcccgctttggctatgccgaaccggcaagtacagcttgaattccaccggcaactcatcctcagtataaaggcgatcagcaaaataaacacgacgcaaacgacaatttgcatggatctgtaggaaataatgctggttgttagacaaatgatatattttgaaaaatatacttgtattcggagtgtttccacataagtgctgccgtaagctcgtttgacgaaatcggcgagattgaactgaacttgattccatccctcgtccagtcttagtggcatcgtacaaatgaaaggcttcacgcgggtcgtcgattggaagttagaagcgcgaaagcgtcgcttcatgcctttgtcgtccaaaatcttaaatcatttttataaacgatttttagttaacaaaggtatttcagcttttacgacctgaacttcaaaagtgaaatatttgttcaggttcttgacagtcatcacaaaataaggcaatttaattccaagatttttcttagggtcgagagggcaagtgatgaaagttgtgcttaaaatattaatgataataatgtatgtgagcattgttcaatgtcccacctgacattgtttccaagcagttcgataacggaggattgaatgtctaataataaatgggaaattaataaattcaataataagtttttaattcaccttcatcggtgattcttttgatatgaccattccgtacattctaaaaatcaaatacctaatcataaattaattatgaaaaaagcaaaaagaccttattccaaatttgcaaaggtttacttccaatgctatacaaaactgacaataatccactttgaaatgtgttgtgaaacatactatctttgttctaaaaaacaaaaaccaaatttagtttggtaaataaagaaaggaatagcttaatcctagggaatcattttcattgccatggaaacagaatcccactaaaacaacactaaataagtgcattcaattgcaaaaattaataaattttttttaatacataaaattttattttattttccatctcgactgaccttaactgattaaaccgttttagcgttctctcctcagttttcatctgttctttctaacacatacaatacaaaacttggtatttttgcagtttaggtggcccgatgaaaaaccaaaggcgggggggggggatttacagggtcactacaatcaaggaagacccataaactatagtttaattttaaagattaattccttgaagctataat

SEQ ID NO: 3335 - DNA, 1466 bp, Heterodera glycines
gatgccggacgtatcattccattgggaagcggcgagagcgtgccaaagaggacattgagagccaacgacaaaggcttgaggaagagcggcgaaattgtgatgcctttcaatttatgtgttggtaattcgttttttacagtggcggcgagcatcaaagcgaaattcactacaaatattgacgaacaagaagagaaattcaaagaacgaacggttggattggtaacacttgacgaagtgaaggagagacagaacgaaatattttacaggtgaaaaccattctttttatttaattttaggaaatttagtgggccatctttaaaattttcaaacgaagaccgacccaaatttgagaaagccattcaaaaaagagtgctttcgtttggcgcttttgacgacgacgacgacgaggaggacgaggcactgattccaatcaccaaaaagagacacggaatggacccaacggtggacacttcttttctgcctgaccgcgaaagggacgaacaattgcaacggtaatgaataggaaggctcattattaattgtatgaaattaaaattcccatttttagtgagcgcgaacggatcgctaaagaatggcaagaaatgcaggagagggaaaagaatgaggagataaccgtggcattttgctattgggacgggtccagccatcggaaggactcaaaaacaaaggtcaactgtcaaaaaacaacaacaattattcttggcatggatttatttgttaatcattcagaaagggacgacaattgctcaatttctgcagaaggcattggacgtgggcgaaagtttactaccacaagatttattttttgtttttagacatttcgcaaagaattcctcgaattgaaattggcaacagtggataatctgatgttcgtgaaggaggacttaatcatcccgcacttttacacgtaaatttattatattctcattcatttgatgacaaaaccctgatttcttatgaaaattttgctttttttttttaaaaagagaaataacaaacagtgaaaaatagaagaattattagggtggaataaagggattccaaattgacattttagtcacaaataccgaaacagccaaaaattggcatataaagccaagctatttgctactgcgaatttctcactttccataataattgctttttcagttttcaagacttcatcaaaacgcgtcaaatgggcaaaacgggtccgctgtggcagttcgaagctgttggcgaaattcgcgtgcggcaagatgccgcgttggacattggcgaatcgcacccggtgaaggtgacaaacaaagcgtaggaacgcaactcacaaatcaacattttaacaccatcaaggtcattttgcgcagttggtatgagaaaaacaagcacatttacccggcttcgcgttgggagccatttgtgccggggaaagtgtacaaacggacaattgacgacttatccacgat

SEQ ID NO: 3336 - DNA, 1256 bp, Heterodera glycines
tgcattaacgaagtaataataataaattactcggtttcctttaaaggccatggcaatgacgggcccgtaacaggcggacagaaaggcatcggaaagtgcaagcaaaccgaggaagaaaaaattggagttgcggggacggagcagtacacaagcgatcagagcattgcataccaaagaaatgacactgaaggtgccggggcattttgcaaccgaatgttttttagaccttaacgaagtgccgagcacagccaccaaatacctttaaaatggccgaaaatatttaattaaaaagaaataattattttaatagaaattcaaatttctctccactcgacaacagtggctacttcagaatcctttattgcaatacattgtctccggtcctttgacaaattattattaatggtcacttattttgcttggattgtctccgattagcccaacttaccatcgtcggtccgcaaaaatgtccaattcgcagttgccgtcttctgattctcccaccacttgcgcgggcgttgttattggcgtggtgccgtagagaagatggctgcttccgtcagcttctattgccatcgcctttggcattcccaggaattcgtccgccatttagcggcaataattaatttggaaacggccttcactcacttattgaagaaaatgggtgaaagagaaatcatgggaaagctgacaaaattctaagggttcgtaaaaagtaaattcgaaaaacaaattgaaataggcaaagtcgcagtttcctgaggaatttcgcccaaaaacccataatttatttgtccatttgcgcaaaaggcaaaaaaagtaatgcgtcgaccacgaaatgcctaatgcaccaaccaacacagggacactttcactcatttttcatttcctcgtgggaagggcaaagatatgaacgaatctcggggggggggggggggggtggatttgattagcggaatatgtgtggcaggcgaagggtgggaaattaaggaaggtggcgaggggaaggagataaggtagggagcaagagttgttgttgtttccaggggggggggcaaattcaattagcccacacttccgttgttgggccaactgatgactaacggacggaatttggtcggacagtgccagcaaagagcgcaccaatcgcaacccaacaaaatggcgataattattaaaaagaaaaatgacaaaataacttttggaactactaaataaaaacgaatgaatgctctttaaaccgacggagaaacgat

SEQ ID NO: 3337 - DNA, 4117 bp, Heterodera glycines
  misc_feature (34)..(34): n is a, c, g, or t
  misc_feature (67)..(67): n is a, c, g, or t
  misc_feature (70)..(70): n is a, c, g, or t
  misc_feature (102)..(102): n is a, c, g, or t
  misc_feature (4039)..(4039): n is a, c, g, or t
tttctcattatatttctgctgttaattattattnattggcatttctataaatgtgaaattgaacccncanagtgaatgaatttaaatgggggcggtataatntaatcacctaatcatatgtaaagaaataaacagttcaacaaacgaggaatacaataatatgtcgaagaaaacttattaaattgtggcaaaaaaaaattcagagcgataaagcgaaaattaagtcgaaccaagcaaaatgcgtgaaaggctctaaaaaataaattaatttatcatcggtcgcacttcgatagatttccatggcatttgccaaactttgaaatcatttacataaaacagacaattaattacatatgtatgtatgttaatcaatttaaatgagaaaaaagcatttaattttcgttttaattaagaaaaatgagaaagtgataaaatggcggcacgcaatcggacggaattcaaagaaatgggaaaatgcacacggagaaaagacaaagaaaacgaacgatgaatgaacgaacacctgtccaaaacgccacacgcaaatgcaaaaaaggaattatgccgaaatgaaccaattcagcagaggaaaaggcgggagaagtcaaaatggcatttggaaagaaatgttagaattactgtaataagaagaaaggaaaagcacagaatcaaacggaaaaagaagcaatttgcaaatatgagaagagaaatgaattaaatgagaaaagaaagaaaaacgaattccatggccaaaacaatgggccaaaaaaattggaaattgtgccgagaaaggaaatgacaagcgaagcttttgaagttgaatgttttttggaaattagcaaattgatgggaattgcgtgggacagagcgaaggaattgcaaaggaatgcctttcccaccgacggaagaaacattcccccgccgacgataagcggcgaagggaaggccgacttcgttttggaagcggagggcggacgagctgcaatttgataggaagagccgaccaattaaagacggaaagtcatggccaaggatggcgaggggggacgaaacatttaaggggggagaggagggatgataattactcaattaattatccgcttaatccaagctaattatggagggagaggcgctctaagcgaattgaaatgacggaatggaaaaatgcttttataggtgatgaatggatgaactatgttgctctgaatggggaacgttttgcgttgtcgcgaaaaatgccattcccgtggagagaagcaattgagtggatgatggcattgcggggggggggggggggggtcatcaactctcaaggatgggatgtgacacacatagctcggcagagaaatgaatattcgcgtaattagcccaggcgagaaagggaagcacccgctaaacgtggcacattattttggcggaatgccatccatcttaagggtatttggacaagtggacgaagcagtaggacgggcaatgggagtgccaattccatccgactcattaaaccccgggcgaatgcatcgcccattattgggtcacgacgggaggagcagtgaaaggaaggaaatgataatggagggcaaaggaaaggggtagggcattatattcgaacaaaccctttccacgcgtgtccgtccttttctgtttacactattaacaatgaggacacaaaattaattaatgaattaatccccccatgaataaatatcacatatcaatgcttctccattgcatttccgccccttctcttccatccaactcattcttccgcttcgtatcatccgaccacagcaattgtggcagtcccattgttgttcaacgcgtttgggtggtcaccgtggaaagacgccgttggcacctgcggcgtggtggtgagaaatttagaggacgagtcaaaaggaaccggtggttgggcagggcgagaaatggcctcgtcaagaaaaaattccttgaaaattcacaataaaagaacgaacagtcaccccaacactcaaatttacttttaaacaaagtgccaaaagagcgtgtgccaaaaagacagcaaaaacgaagccaaaagcggtctaaaatttggaaatgaattttattgtgccatggaatattttgttgtgcagaatgttcaaatatgtcatccaaaatgctcactaatctgtttgggtcttctctgacagttggccataacgaaaggatcttaaaacagaaaaatcacgaaaatattaaatatttaaaaaaccaaccaaaactgaaccggtgagtacaacggcactgactgccaaagtccaccgagccaacgtaaatgggaagagaagccaaagagcggtgacgggaatgaacggagccaaggaatagccaaaggcacacagcaaatcgaagaaggaatattggagactgagcggacgatggtaccacagaaaggcatagaccaaagaaggcattgtcagcacgtaaccgaacacgagggaagtggcaccagtgactgaaagggaggagggacaattggaaagtgagagggaaaaagagagaaagcagaggggagagagagtgggaagggagagggaacggcgggccaaaacaaaccaaagctgaagtcgctgataaacaattcgtcggagccgaaggtatgcaaaaaacgcgacagattgccaacaatcgcaatagaaaatacgagcgaaacactaacctaaacaaaaagggaaaattggattaataatatgcaattgttggcactcaaaaaatacccaaaatggtccccacaaatcggggttcggctgcacaaaatcggagatgaaattgcccgtccggcgaggcatcgcactgttcaacaaacgggcaaaaacctgcaatttgcatagaaacacaaattcatgatggaatgcacctgttcttcgtctatatcaaagaagcgacggtaaaaactcagagaaagaaaatgcacttttgaggagtcatccctttgcgattcgctggacgaataaacatccaaaagattgccagaaggaaaggccttaaaccaaagcagagaattgaaaggaatttaaagtcaaagcaacttaccgggtcaggaggaggtttattattgacggagtcggaattgaaaaattcggacgaagcaccgccaccagaggaagggaaatctgaagggaaatggaagaagaaagtataaaacaggaacaatggatacccctgaactccaagcggtccattcttgttgccaatgtcagtaaaacggctatgaaaagtcggagattgacaatgagagcataaaattgtaatatagcgcatcaaacactttaataataaaactgacacttaaaacggatactatgctctttaaaaccaaataataaccacaaagggatgtcaattaaaattaattccgacattccaaaacccattctgatcaaatgtgtctcatcggtctcggctccttcgatgcgccccgttgcgctcttctcggcccctctcttcgcgctcgcggctgtcctggcgatggtcccgtcggtggtgccgcggctccttggcctcgccccttctgccctctctctctctgtctccctccctccctctctctctgcctccctctctctccctgtctctgccgccctccctctctctgctgcgtgcgcttcgtccgctgctttctcgactcctcgccctttcgcgctgtctgcctcccccatgccctgctgttctgtcatgttcgcgccgttcatttcgctctttttcccgtggcggcttttttccgtcggttctgtgcgtagcaaaaaatcaaaacggaaacacaaaatttgaaatgcaaattgaaaaagatgaacaattcgaatgttttggctttgtcctgagactcactgttcgccttcctcctcaactttgggccgtttcaccgcttcggccatcgctttttcctcttcactgtcttcgcaagaacactcgccaccagaacatgaacaagaacagctgcaaatgagaaaacgcatcgaaaattgagagcaaattacaattaaatgtttctggctcaatttttgtatttattacaaanaaggttttctattcgattggacaaaaaacaaaaaatgacaatggaaaaactaaaattttttattgaatttgcatcaca

SEQ ID NO: 3338 - DNA, 1432 bp, Heterodera glycines
ccgccgggggaaaaatttgaaaatttgagtgtaatttgttaacagattttcaacaaaaaaggctggttttcgggattaataggctcaataatttgtacggattttcattttaaaaaatgataaaaatgtgacaattaaaataaaactatgagtaatcatattttgtcgataggaaagccatgagtatacaaaaagaacattcaaaatatgttagtttctgtagagggattgaaccaggggaaagaagacgaaaagtcaaggagactagccactaggcaatccacacaattgtcgtcgtcacttttaaagaatatatttcatattttttttatttttccttttcattaatttttcactcagacccccattcttaccagtgcttgtttttcccgtttcccggttgccctaccgggaccgggacctgagcttttcaaaatccgggaccgggaaccgggacctcggatgaccgggaattccagcccggttccgctgcactctagtttttattttagtaaaggcattttggtaaaattattattttgaaaaaataaaaattatgaaattttcaataccggttttaccgggtacccgttttcagtacccgctaatacccaggcccggtttttgcccaaatacccgggcccgtgcagccctaatataaacagataataatcaaagtttgtctaaattcgaatcacaaattcttgcgttattaaattttatttttataaaagtgagagaaattgagttttataattggaaaataaaaaaaattgaaaaaatagatgaaattttaggaggattcgtctgctcttttttttaaattgccgggaggagaaaattcggcccaaagtttgcctcaatttggtcgccagggttttgcaaggaaatgaatggaaacaattggtcaattgggaccgaaatgaacaaatcgggagtaactgaaattcaaaatttttaattttaattgcatttaaattacaacccaaacggtatccatttttcgtgaaaaacatttgacgcgttgccaaatgaacgccaaaaccgaatacatcgccacgagaaaatgtgagtccgactaaagtctgctgctggtaaccgttggcccaaaaaatgccattgctttggagggcaaaagtgccataacggttcacaatggataaatatggcttctgtttgatggcgaatccgacaacaatattggcgtagctgaatgtaaaaaaatgaaaaagaaagtcaacaaaaataaaaaagagaatttaaaaaattcattttctggctttatacaaaggggtggggttgatccaattttagctttatccctgggggtgagttggaggagtcagcggccaaattgcgagatttagtacattttcccctcactgtgacccccgcccctcggtgagaaaggaccctctattttagcaactct

SEQ ID NO: 3339 - DNA, 1812 bp, Heterodera glycines
  misc_feature (23)..(23): n is a, c, g, or t
gggtgggcattttttgccaatgnaggcacattgaccgtttgctgatgagtcatctgacaaaggacagagtgattgattgattaaggacaaatttgagaaaaatatttcttctataccaaaaaataaattcttgaattttttaatccgaaaaatgaatcgctttttgttcacccccccccccccccccttcccaattgaccatttgttgctgcttttgctccaattggctaattctccccaaaattgcattctgatcattttgcaactgtgttaattgaccaactgaaacagagtgaatcattaaaatttaccgcaaaatattctttcattaaaaaataaataattacatgagagaaataattaacaaaataattatcaaatttgcccacctatggattcacacgttttcataagctgatcaaaatgccatgtttgctgctgatttttcttctccaattcaccagtccgttcaaaaattggtgtgaattgatccacagaaactgtgggagggataaattaattaattaaaatgaggctaataataaaattaaattaattttttataagttctagaggtcggcatttaaaaaaagcctgtacctgaattccatattggacctggataaaagataaccactcggaataagcaattttaaaatataaggcaggaaatccaaattttcgtgccaaatatggacaggaattttttcataatcgatatggacatggacttcctggaccaaaacccaggtagatgcacgtccaaaaaaacacaggtcatctaaaaatggtctggacctggatccaagaaaagccaggcctgtatcaaggaaaatccacacatggatcaaggaaaatccaagctaggctccaaggtccaggccgatctctcataattttcccaccgtattgtctctgctgctgttcgtccttttctttttgctgtttctccaattcaccgatccgtcccaaaagtacaatttgttcgttttgcaaccttgaaagctggccaatcaatgcttaatgagacagattgtgattattaggattttaatccttttcaaaagaattgcgcgaactacagtattccaaagttttggtaccgtttttctcattttccttctcgtcctcttcttgtttattctgcagcacgaaaagctcggcctgtagcatgacaagatgttcagaggtcatctgcttttgtttttcgaattctgcttgaagattgttctgaaaaaaggcttttttaaaaaacattccatcttttatgaataaattcatttaaatattatttatcattatttttaaatttaagtgttacagttaaactcacattatctgctctgagttccccaatcatggacagttgctgcgatgaattcaattccaacgaggcaaacttttcacaaaaatcctataaaaaataaaataaattatcagaaatttccatttttaagcacaagaaattgcaaaatatgcgcctaaataggcactaaaagcctaaattaggtataaaacgaaaaggcataagaataggcacacaaaaatttaatcaaggctttttaagcgataaaatgatattgttttttatagatgcatttttggtttttattgtgtttttgttataaaatatttgaaattcctaaaaatagtcttcaaacaatggtcaaataggcaaaaaatattccttttaaatttattaggtacgaaatgttgaaataagcaaaagtaggcattataaaagtttcccaaaaacatctagcaaaaatgcttaatgaaattataaaaggatttggcattcttttctgctcc

SEQ ID NO: 3340 - DNA, 2261 bp, Heterodera glycines
atttggcattcttttctgctccagctgtaatttcctcccttttaatcgaaaatttaaactaattaccgcatttattgagctaataatactccccccccccttgtaacagtaatccacgcccctatttagtgcaataattagtttcaggaaacgattaaacgaatagtttactaaataaaatattttagccgcaattttttgtttcttaaatttgagggtcgccccatggtcactccgccaataggcaccgcctgagaaatgttttggaatacaagtggtgagatttgatcacagtttaccaaaaaaaaaacaacaaaattttggctaaataaaaaaataattagagaatttaaggttaaattaaataaaatagaaaataagccatcttttttatgatttcgataataaaagataagcaaatgattttgcttcataaattcagagattttttaatttaaaggaaaaagcaattggccccggggggaatcgaaccttcaaaatgttttgctgttgcggatcactggctgatgatgattcagcattggtggccccctcattctgacccaaacaaatcacatcggcagaatttcctttaaacttaaatatatttttttgattttccataaaaatatttacatttgtgtccattttctactttgtttaccttctgctgctgggtctttggtcgaattttgcattttatttcaaaacttttgagtgaattgaattcaatcggttttcctgtaaaatttaagtgtttttttaattgtacgaaagtttttgaattttttaagatgtgtgttataaatttaacatagtatccgtggtatcaaattataatgaatattctcaattaatgtgctaattggaggaggagagacagataaaagcccattgattgaaaattggaatggacatagggcgagggaatgcagctgaagaaatagcggaagaaagtgagtgagtgaccatcagacagatgggcagagagagagggtcactcgcggaccaaagaccaaaaaatagctttgccgaatgaattttttcttgcaaagtcaacaaaaaaattgttaattattttgtatattatttaaaaagttttaattaactttgttgccaaaatcaattgaaataaatgaaatgtacatacatatcaggggtgggacaaccctcgcctctcgtctttcgccaactctcgccatttttgggactctcgcctctcacctctcgttttttgggacgagaggtgaaaatgcacgcctaaagactgaactttcgagcagtcagaaaaatataaatatttaacctttcttcatacggcatgggaacaaggccacttttttgaatgcttttcttgtaaaatttttggactgcttcaattttgcgtgcatttttctttttttaatagattccaagtttctttggcgtattttaactatggtctgctatagcttttatatgccgaaattaaagtttcaagcttcgagtttttaacgctcggtgaagctgataacaagaaaaatatggaattttttaaaattttattaatatggttagaaaaggatttgattgattaaaatgcccaaatccttttgtttctgcaatggttcgccatcaagaaaataaataaattttgtgttattttcacccagataaaggaccattgtattttctaatcggcaaacatcttaataccaacattcttaggcaaattatttcggaagatcattaatagggttgtaaattatatggattaacatattttttctgcgcatgtgctatgaagaaagaggctcaaaaatagcatttctgcgttaaattttttgatttggtgaaggtttttagtccatataaatccatatttagggggttttcgggaataaatccatatttcgacatttttgccatttttgccattttagtccatatttcggccattcttggcaaatttacataagaaaaattcaaaaaaagcaaaaaatacacctctaaatctcgactttttgaaaatttaaaaaattacacccccaaaaatatgaaaaatttgggttttcgtcgtcattttggcatttttaataaatattttcaccattttttgcgaacttttctttttttaaatgcaaatttttttttgaaattgccaaactggaggtgtttttttatacaacggacgacaataaaaaatttgcatttttaaattttaaattcattttttggttgtttattgtatttttaagtttatttaagcaaatattgaatag

SEQ ID NO: 3341 - DNA, 2543 bp, Heterodera glycines
  misc_feature (15)..(15): n is a, c, g, or t
  misc_feature (27)..(28): n is a, c, g, or t
tgcaggtcgaatttntgtttatatcannatcgatttgggctgtaaaatctgtatttttctgctttttcttcaatacgggtcttaggttcaaaatggaccgaaactgttgccggattcctggtgatcgctgtttctctttttcacaggttttcccccctacccccctttgatgagacccgaaaattttactgatttctccctatgctctatgactctcactcctttgcatatggatgggtttattcagcattgaccaaataagcaattgtgaggcataatttgaaaaatccccattatccaacatcctataagcatccgaaatttctcatccagcgcgatggcttggaagcctttgcggacgaacaaaaaattcaccaaaacgcgaacgttctgccgttaccatcttcgaaaggatgtattcgtgcctaaattcatttaaaattacttaaatatcagaaacaataattttttgagatgaaaaatgctttattaaaaatttttagaagaaaaaaaacttaattctaaaaaatgttcgtgagaaaattttatttacaattttttttcgaaattttcatttctttggggctcaaaagagaaaaagcatatagctgactatggactcgaccctccccttgtctcactatggcctttgtccacccatgtattttaatgaaatccttccaccactgcgcccctgtccccttacaagcttcaaatgtgcctccgctgccaccaagttgatgtcctccaccgtctcctttcattcagccacgcaacaaattcggccattctttcttctatgtcctcgggcagtacatcaaccggttcagttcccacgtaaacgtcagttacgcggtagactccagctgcatcttcttgtacattggagtacacctcctcatggaggcgtttgatggtctaaacataacatttagaatgaatgtaatcaaaaaattcatttatcagtgttaaaaggaaaggtgcataaagtagtacggatcgtttttgggaaaaatcaggatcaggattcagagtcaaaaatataaaaacttaacatttattgcttttagtatgggttaaaaatggacgacttgaaattttagccctaaatccgttaataatgggacaccgagggttcgaaaacaagaataagcccacagtaccgaattaaataaattaataaacacgcaaaaaataatatttttaccaagttcttaatatgttgcttttcgcataattttttacggcgcattattttttaaaaaaattctgaaaccgaggggtctggcggggaagataggcgcctccggcaaaattttgaaaaatttgttcgtcttttgaacagatttggtcaaaaaaatgacaaaggtggcaggtgtcaattttttggtaacagtaataaggtgaagcgcggtccagcgggctataggcaccaacgggaaaattttcacaattttcgggtgaaatttgcgattcaaatggcttaatttaattgaaatttatttaaaaatctttcggaaaatatttggcattctatccttgaaattttcaaaaaatgcatgcgagtcccgtgggatcacgcacaaaaaatcaaattttggatttcgctgtgggattagaacaaaataaaaagagtaaaaaaattttagtgcggatttcgaaattagtcgaaacaatgatatattcgtgatcagcgtcccacgtaaacggtagtctttatataaaaccatcaaaaagggcgttgtataaaaaagattaaatgaaaattttcaacaaaaaactacccaccataatttttgtcaaagtcaaccaaattaaactcttgatatcatcgataaccctatagagagagtactctattagctcacctaaattaaaaaaaaattcgtcaagtttgaacacaattatggccaaaagtacgccaggaactaggttttcaaaagtttttggtcattaattttttgaacttgacataatttttaaattttgcaggctagttgaaacctatgttaaagaatgatattcagaaattactttattctaaagaatgtttggagtcagaatttttgatgagcaaaattattttatgtctactgaaaaaattttcgttataaatattttagatattttattttcttgatattattcgatagctcttattgttttcaaatagtttgctaaatttaaaaaaagttatgaccaaaaatgtctgaaaccctgtttcattgagtacttttggtcataactttgttcaaccttaataaatattgtttttaattttgaaggctaatagagaactcttatgactatcgaaagatatcaagcatgtttactttggttgactttgacaaaaggttttttgtcgtaaatttttcatttgatggttttttatacacgatatagcaccccgtaaaccactgaaaacacaacaaaactgatcaagaccatcttttttgtctctttttatgggatcagtaaaaccgatgattgtcccctaaaatcgtaaaaaagagccaataactgaccggcgggtaaaaaataaa

SEQ ID NO: 3342 - DNA, 1099 bp, Heterodera glycines
ttactttctacttcaatccttgatcagacttaagaaaattctatttacctaaataaccataaaattattttttttattgctgctaaagccatttaaatagtaaaaaagttcactcgctgtcgtaatgtccactgtccaaatgtccccaaatgtccgggagccctgactgactactacctactaaaataaaaagaaaaggaacaacaacaaaatatttaaatgggaaaatgacgcgaaaacaatcgtcacaaagaattagtaaggataaatgccttatttgagataggatattggccataccagtatacttgtttttacgggcccgtaacccgtactttttcgggctgatactggcttttccttagtaggggtcggggaccccgagcgttgtaaaatgtaaaagttaaaaagttaacgcaataaaatatttatttatgggtttacgaatttttttagggtgtaaaattgaaaatgttctttaaagatcaacaaaattatgccaaatcattatgagatacataattttagaaatcaaaaattataaattttggattagaattttgagaattttttcatttcttaagggtgcatttttaaacattttatggccgattcttagggctatatatatttttttttaattttaggttgattcttaggggggggggggggggggtaattaatcagattttattttatcagtagcatcgccaacttaccgaaaaaataataattttgctggtgaaatcgtaccaaaaactaaaccaccatcatgttactaataaaaaattcactatttaatcaagttaataattaaatgataaaaaatttcagtttgttttgacttaactaaccaaaaagtttctctctagccaattccgcgaactttcaattaaagataattagtaagtcttcttcatgttaatgatgttcaccaactgaaaattaattagttaactaattaagggaaatctatgtattaaaagtgttcaaaatattatgcaccaataaatggtgaccaccactaatattgtgcttccgaaaatattccaaatggatgattttcacaaccattacttacttttgtgtgggggggtgt

SEQ ID NO: 3343 - DNA, 544 bp, Heterodera glycines
gcggcattagggcttaacttggtaagccaaacaagattttttttttttgaatttctccgccagattttcgccaaatttcagcgtaaagcatccaaatttgtgttgttcggcgcattggccaccggtggcagtgtgttgctgtactcgttggagaatagcggtgcgcgtgcctacgactttgttgtgcacccgagccatttgccatggtcccacggcggactgatggacgcaattgacatgcgatcgtccgttttttttcttgtcccacatttaacatctttattttaatgtgccaagttttcaaccgtaatgtctccaattgcctaaacaaaatttggatttggcccgatttaaaaaaaaaataatttttttttaatcaacgcctgaaattaaaaaaaacttgtcgtccaagaaaccgttgaaaccaatcctttctatttacctcgcaataaaaagggcacttttctatttagtttggtggatatatgcaaagcaaatcattcatggatggaagttttttggtccctcaaataatacccaaaat

SEQ ID NO: 3344 - DNA, 5180 bp, Heterodera glycines
  misc_feature (5136)..(5136): n is a, c, g, or t
atttttcagaaaaatataccctaagaaatgaaaaatctctcaaaaaatctatcttaaaatttattttttgtaatttttgacaagaatttttgattttaaaatatttataacgagcacagcgaatgggagatgtcatgccgtttttgctttcttttgtaaattaccaagttttaccctttgccaatcttccctccactaccgccaaatgaattttttctctctttctaatgcaattcatcgatcgattctttcatttctttttgccgttcttcttccattttcattaaattgattttgtttactcagcattagtcattttgaagaaaatgaatgttacctaagtaaaatcaggaaaaggaagagaatttatcaaatgaacttttatatgaatttatctaactccatttcacataccattttgtcggaaaaaaccttaccataaacaccatacacatccaataaaagataaaatttagaaaaatgctttcacaagaagaaatttttcgaaatacacgaactgttgcccaaggattggatgcattgagggaagaaaatgaggccatcaagaacaaattgttggtcgggatggacgtgttgacacctgatgaacgtcaactcatcgatgagaaggcgtcaattgtggaaaaaaatcttgaaaacatccaactcggactggaagaatcgcaggttctttttcccattaaaattctttgaagttttttaaacttttcaaggtgatgttggcattggcatcgcatttacaaaatttggaggcggaaaaacaaaaatataaggcgcaagtgcgtcgtctttgtcaggaaaatgcgtggattcgggacgagctgaactcaacgcaacaacagcttcgccaatgcgaacaagtacaataaatgaatttttcattgaaattgacgaattatttacttcctaggacaaggcacaactcgaggaagagaacaagcacttgaaatttatgaacagtatcaagaagttcgacgaggatttgccggacagatcggagaacgaagaaaacacatcggagcaactgcgatccaacgaagtgaacacgtcgacgactttgcaagagcttggttttggaccggacgaggacgacgatttgcacagtgagttgggagaaattgttttgctaagtgatgagttaagattagaaaacggttcaatcggattttatacaaccataaaaatatacgcttcccacatttgtgcctgtgctctcctatttttttttcaatttttattaacatcttgtaccatattaaaattaaaaaagtcttaatctactttcactttaaaatagagtttatttgaattagcagatgccagtcacttttcacaaccgactccggcgaatgcgatggctgccagtaccagcgcgggttacgatattccgcagcgtttgaaaacgctccacaatttggtaagtttgtctgctgttctctgttcttgactatttaactgttaattaggtcattcaatacgctgcccaggggcgttacgaagttgccgttccgttgtgcaagcaggccctggaggacctggagaagaacaacggccacgaccaccccgacgttgccaccatgctgaacattctcgcattggtttatcggtttgtcccgcggttctttctttacgctatgtttcccattcagtgaccagcgcaagtacaaagaggctgccgccctcctcaacgaggccttggccattcgcgagcgatgcctcggcgaggaccacccggcggttgccgcaactctgaacaatttggccgtcctttatgggaagaggggcaagtacaaagaggcggagccactttgcaagagagcgttggaaatccgagagaaagttttgggcaacgaccatcccgacgtggccaaacagctgaacaacctggccttgatttgtcaaaaccaggcaattatcaacaaatgaatcacccattcattgtccatttttagggaatgtacgatgaagttgaaaaatattatcgtcgagcgctggaaatttacgagtcgaaattgggaccggacgattcgaatgtggcgaagacaaagaacaatctttcgtcggcatttctgaagcaaggcaaatacaaggtaaatagtcaaaagtgggaaaagggcgagcaagcagtctcttaattttgcaaattttggtgatttgttaaattaaggaggcggaaatgttgtacaaacaaattctgacacgggcgcacgaacgacagtacggccgagtgaccgatgagaacaaaccgatttggatgatagcggaagaccgggaggacagtaaacaagcggacagcggaatttaccacgagaatttgcaagtgtcgatgaaagttgacaagtgagtgatgcaataagacacttaagaaaaaataggttttggagggccggcgtgccgataggggcgaattttaaatttatttctaacagatattcacaaaaaataagattttttcgataaatttttgtttttttcatgatttactcaagcaaattggaactcagattttaaaaattttttcttgcggcacattttgcaaaaaaaacttggtgaatgtgcgagggtggaggtccggcggtgccgttaggcgccgccgggaaaatttttagaaaatttgaatgcaattttttaacaaatttttgtaaattttgttagaaattagcaaaattttccagaatttccctcttttgggtgaaaatacgcccccaaatcagaacatatcttagaaatacgaatataaagaaaccaaatcagataaaaataattaaaaagaaaacgtcaaccggtattgaacccataataaaaaatactgttagttgtgaagcacaaaccactaaaccaaaatatattgggaattcaaagcaaaatttactttatttcataaaaatttgtcaaagatgattaaaaaaattcaaaatgtataaatttttgcattttatcccacaaatatgccattcttaggggggggtattttcgcccccgcgggggcgaaggtcgcgggggcgggggtgaggccaaaaaacctgccccgcccccggcgggggtgacgggggcggggtccgaaccctagttataacttatcttatcagctatcacttaacaaacaaaaatcgaaataaaaggtttgaattttttagcttcgtgaatttgttgacggagctgacttcatggagaggattcagcagattatccgagaagacgtgttcgctcaattggccttcttttctttaaaaataattcaggtgaaagcattgcaagtgaaagcgaaacgagtggacaagcgcgaaattgaggaggaaagggcgagcccggccttctcttttagactgcacatgaattttacaaagttattcggcttttgatcactctcgcggagatattatgaaattttaaaattcattgatgtttatttctcttattcatgcgtaaagcttttgcgattgactctttgtcttaacattcattcctcggcacattaagtgccttaaacacaatgactaattatgggaagtcagtgaaaacatatgaatggggtgggtgggacacattcgtaaattgaaatattgaagtcccaaattccttggaatttcttcaaatctgctacgcaactgatgcaaatttcatgctcactttttttcttccaatacttaacatgaattacaatgtaattaattttatttatttaaaagaaaatgagcctgattaatgatgaatgaaaaatgcatttgcttgggagattgctttgtgagtattgtttttcatatccgtgtttgttatttttgcgtgacaaaatcaattttgaactgtttcaaacggaaataaggttcactttctgatggaaatcctcggcttcagggaatgctccttccatttgtggcttctcacactcaatttcctcttcgaacatttttggctttttgtttgatgtcgcgtgcgtcaaattgtctaattttccgagaacaacacgcataacatccttctttctgctggtgttaatttcagaatttgaaaaagaatgaacagacgacgatgaaggtgcgttttctgctgctgaagaattcgtgcattttttattgtttcggttcacatcgatttaattcttaaacttacgctttgtgtgattctgttctacgctccatcttgaacagaaatcaagcagtccattcatcagctgattgtttccatcttcggcaggaggactaaaaaattctcattcctaacatcaaatttaattattatttttttttaatttatgtaaaatgctaccaaatttttttgcgagcagcagaaattaaatgaaatttttcggtttttgaactgttaaaagaggaagacagagactgaggccacgaattttccttgttccaattaattaaatccgtgtccaccggcatttaataaaaattgaattaattcttaaatttgtgattacctattttacaattacaaaatttgtgctgtaaaataatgaaataattttgaaattataaaccagttaagaaatgaattcctccgagtggacggaccatcggatgaataaatgggaaaggacgggcgaaggaaaagtgggttgggaatggctttggatgagggtgggtggcctgtgtccgtttctctgttcattctttacttccggtccgaagacgttccgagaaaagtggactatttcgaggccaaaaataacttcggtgtttttgtgggaatttcttaggaatcggtgagtaaagccgacaatgagcaattacaaatcgaatcgttgaccgttcaaaatgacgcgcaaatttaaatgagaatggcgccactgcctgttggaccttcggttccccgaggtttttacattcattcgtctgctgccccttcccatcgttactccgccgcccctttccttccctcctccttttcctcttcgacctttcactagcagcacaaacaaaacatcagcagatggaggatgaccaccactgaaaaaggcagtaagtaacggcggagaaaatggagataactcagtaagaagatgagactcgaaaggaggagaaaatgatggaaaaagcgatgccaacgaacgaatttgacaaaataggcaattattactttaagaatgagcgactccggatncaattatgaaaaattagaatttgagtggataactaagtatttta

SEQ ID NO: 3345 - DNA, 4576 bp, Heterodera glycines
  misc_feature (73)..(73): n is a, c, g, or t
  misc_feature (79)..(79): n is a, c, g, or t
agcttttgcgatgacttctttgtctacccatcattccctcggcacattaagtgccttaaacacaaatgactantatggnaagtcagtgaaaacatatgaatggggtgggtgggacacattcgtaaaatgaaatatgaagtcccaaattccttggaatttcttcaaatctgctacgcaactgatgcaaatttcatgctcactttttttcttccaatacttaacatgaattacataataaaaaactcaatttcgagacttggacaattcgtggcttggacaatttgtgggtcagcgactgtaactcattcccaatattcggacgaaatgctgtcccgattagtgaattaaagtaaattccattttcgcaaaatttggaggtgccttatcaaaaacagcacttctcagacttggaatttctcattcgtcacgttgattttgcgctggatttgtttctgtttcgtttcgtccttcttccgttttcttccgtttctttctttgtccgattctttggctttaaattgcccatcatttcgtcatcgcttcgcaatttccaaaaaagggtttacacaattatttattttattgtgaattgaatcgccaaaacattgtcattgtccgtgtttggcgggggaggggcggcggcgactgtttaagcgtttgatcgatgcccccggcgctctccgattcaattcgtcgtcgttccttaatcgatcttcccaaaattctcgccattaatggccctctcgacctcaactttccgccattaattggtgaaaccgcaccactttcactttttgttcgataaacacacttttaattgtgcgtacactttctttcattttccactttctaaatttcttcttttccatcacaaaatttgggcatttaatgaacaaaaggaaaagtgtcgctggtaagtgaaattcatcttttctaattaacatttagcaaaataatccaatgtttcccacatgttttttatggcttattattatcactttttccaatttgttttatcatttggcctttggcggcggaattcccacggaaaagaaaaagataaaaaaatgttcaaagtgtcagcaaagaattaataaatggaggtgctttaacacacaaataaaatcaattccattgctatctccgaataatttggctttcttttccatattttttgcccatttttgtgctttttaagtgtccgccgatggcgggacggcagctaccggcagaagcagtccgttgcactgcggggtccaagccattcaatgcgtgggcttcggccggaagaaagtgtggccggccaaagacgcggcaaagtcgcagctacgagacagtctcagttcggtaaagagacggacaaaacggaaaatgaacggaaaagaaaatggcaataaatggaaaaaatggaaaaacggcaaaggcgattctttgtccttcttcgttttagtcgccggagttatttccctttttttctgttcagtcgtacgttgaacatcatctgaccctcgacgaacttcgcgacgttcaccccgattcgttcattgacgtaatcagcccggagaagagcgacggactgtccagcgaggaggccaagtcagacacactttttataccgtaccctttcgttacggtaggaagcgccttttggacggaggggcaaatgttctggcgccgcccaagcgcatttccaacttgcagttgtttgccaaacagtttctgtacaagttttggcttctcctgatgggtaattagctttttctcatccctccctaattaattcccattaattgctcattaattatttgtcaggtgccgctctgtgcaccattttcacttatttgatcaatttgtaccacgggacggaagagttgctcaatttgtactgtgccttcattctgatcgtcatcgtcgtggtgatgtcgttcatgtcattttggcaggaacgcaaggccattcaggtgaaaaagagacgaacggaattggaaattcgaaattcaaatgcacaattattctcagattctttatgattttgggcttcacatgccatccaatataagtgccatttattagcaattaatccattcattaatcaactaattatttgttcactttactgctcggtgattcgagactgtgaggagaagagtctgcagccggacaatctcgtcgtgggtgacgtcataatcatacggtaagcggagaagcacagtccgtatacggtggatgaccctgggaggacggacatttcgccattgaaacaaaattaaacaaaatgtaaatgttttttcaaacagatcaggacaacaagtgcctgctgatattcggtaaggcttctctctttatcttaaattatctttcattttgtatataatttaaatttccctaaattgaaattcttaagcattctccagtccacaggggtcaaaattgaatcctccgcaattaccggcgaaccccaacccgtcgactacactcacgaacccgctgctgctcacatttcgctgtttgatgcacggaatgtcgcactgaggggatgttactgtacggaaggagaagctgtgggattggtgatacgagcgggaaagtatacggtgggcaactgtaatcctcctgtctgatcacttctcacttctgctcaccaatttggttttacctctctctttgcattacttttcctgtctctcactttttttgtccgatcattcttttctttctgttcactctttctcttcttttttcctttctgatcacttcttcttctcctctgctgctgatcattccttctcttctcagatgctcggcaatttcactcacctccaatcgaccgttaagctgaccgagactcttctgcagaaggaaattgccaagttcgtgcagttcgtttccatcgtcgccttgtcaatgggtgtcattttctttctgatcggttgcatcgttacaaagttagcagtcatttcgcttttcttactcagtcattgctcaatttttggtttgaaaatgtgctctaccatttcgtcaccggctttctcatcattatgtaaattgatggctaattgaaagaaggcaaacccaaactttcctccttcgacagagttgccaatgtcccccaggggcttccggcgatgctaatctcccaaatggcaatcatcgcaagaagattagccaaaaagaatgtgttcattaagaagttaagttataacagaatgccactaaaaccaaagtaagaagtgatcattttagttggacataatcgacgaattgggcgccgctacggtaaatcaaacacaaactgatcaactgatcagtatcactttcattcacctggaggtgatcgctgccgacaaaacgggcactttgactcagaacttgatgattctgacggacatgtggtcggttctgcacatcaagcattaattaattaattgttcccccttttccattttatgtataatcgtcgcttcttttctggtgcgtttttccctcttttggtgcttttcctttcgtcttttcagtccatggtgaacttaaacaagcacacattaaaatgatgaagcaaagtgcacagcgaagagagttggagaagcctttgcccgatttgttggcagtgatgtgcatgtgcaacaaagtgagggagaatggcaaatagccaattgaaaagggcaaatgtcggcaccaaaatgactcttggcaaaagttaccacttaaatgacccttggaaactgtcggcaccctaatgatccttggaaattgtcggcaccctcatgacctttggcaaatgttgccacttaaatgacccttggaaactgtcggcaccctaatgacccttggaaattgtcggcaccctaatgacccttggcaatgttggcaaccaaatgacccttctcccatgccaaaggcccatttcgaacggacgcgtcgttcgatgcgtcgtgtcagcactcagcgtgcgttggaacgtcaattgcgcgagtttaaaatcgcttctcgtcagacaaagacgttcactgtggtgtgagtattaggggggaatgatcagaaggtgccattggccacccgcagcaatcagtcgggccacgagtcggtccgcgtcccctccaacaacaatttgtcacaaatggaggccacggtgaccggcgaatggcccagcgatgacccggaacggtggccgacctcacgcaaaaggaccaacgatctgatcggcagcccattagaggtggcacttctccgttacgttgaaatggtcgccagcgttgagggcattcggaaccgatacaaagtcagactccggaaattgcgagactgtcctttttcatttttttgtttttctctttttcggtgtgcgtggaaatcccttttaattcggtccgtcgttggcaattagtcgtcgtgcgctgcttggcaactttgagtagtcaaagtcagtcaaaagatgcaaaaaggcctaaatttggccaatttcttacgccgtcttcatccttcgaacggagtttcgatgagagagcggccaaaaaagagacgacagacacagcaacagaagaaagcggcgaatttgtggtgatgatcaaaggggcgc

SEQ ID NO: 3346 - DNA, 1295 bp, Heterodera glycines
acgattcgtcaactcacccaaaatgcgccgactagtcaactcagcctaatgtaaacgattcgtcaactcgacgattcgtcaactcagccaaaatgcgacaattcgtcaattctatcaaaaaattatttcaaaaagcagtttccatagcttttcatggcgcttaacaaaatcaattataatactaattagactaatttagaaccaagaatacataaaatcacgacccttctgaacaaaaatttattcaaaaacttgcataaaactaattttactaaacaaaaatcaaaacaacaaaacgaatcaatatggtgatcatcgcgagattagagtaaacaaatttaaccggtattatgagtaatgaatgaaaaaatagcgactgggccaaatgctggtcgcgcaatcttgtccttaaaacggtccaaagtggcgaagtcaattgaaaaaatgaaggaggaatctaaggtgtaaaagggaaaataaaggctttgccaaatccggtttccttttgggtcactgacttttcgtttagttcgagtcttccgttgcaattgtcgccaggaaagacatatcgcgttgccgtaaatctatcagttaatcggttactaaataaaccgaagcattgttaagcaatccgaccattgtgccattgtttgattcttcttaccgcgtgtcggtgttcgaatcagaaattgaacggcctttggtcctgccaacggctttcgtacgcctccaacagatagttgagtccgagtctttgttggctgggaagggatccgcgagcggaaccaccgccctctaaagcgagtgaagcggaaccctgcaaaaaaatcaaaaaattttcatccaaaaacttaatcaccgaccttgattgcttttttaagtaaattttggatgagttgacgaatcgtcacattttggctgagttgacgaatctttgagttgacgaatcgttggcatttggctgagttgacgaatcgtcgcattttggctgagttgacgaatcgtcgagttgacgaatcgtcgagttgacgaatcgttgagttgaagaatcgaggcgaggcgtttatttaatatcgatatttcggtaatttttgaaattttaaagcaattttttttcaatgatttggcggaaaaataaactggggagagtgatacagtggcggaaaaaagtcttgactcaagatgataaaatttgtaaaattttaaatttcgactggaaatttagctgattattttttgtttatgtatatttattttaccccgatatatggggcctttcatataccacaaaatca

SEQ ID NO: 3347 - DNA, 2572 bp, Heterodera glycines
tttttttctgtttttttttgcattttacgtctttttagcctttggttgccgacttctacaaattcgtgcatgcagaggcagaagcagaacgtctttttcgctacatctgtcccagctgtggacatgtagggaaacactgggtgacagactgcccccgtcacaagggtattgaaaataattaaaaattttgaaataatattgaaacacaggagttgttgcctttcgtggtgaaatggaagtcgaaaagggcgtggtcgagactcgctggatgattggccttccgcttacgaatgaaacttgcttggcttgtcgccttcatggacatacgccaattgactgtggcatattgaagaaatggcgtaagtttccaaaggacaagaaaatttattttccacaaattatattataggtgagcagttggtgaacaaaatgcgcacggcatctgccattgtcccccgctttccgtcgcaaaatacagcggaaatgtgtttcgcttgccaaacaattggtcacatactgcaaaaatgtccgaacaaggttattgaaaatgatgtatagggacgtgaattttagtgaagaaaaatcccgaaatagtaaactaaaatagtgagtaaaaatgccaaaatagtgaagaaatagtgacaaaaagtccgaaatagtgacgaatagtgacacaattttcagccaaaaattgagcaaaactaatttttattcactgattgcattgcaaatgagtagggctgggatttttaagggcaaaaaaacaaaataggtacataaaaaaataatttttaaaattaaaattcttgccacgaaaatacctttttgagaaaatttttttcatttcttaggagtgttttttgaattttttttttttttttgtcgattcttaggggtgtattttttgaaaaaatttttaggtcgattcttaggggtgtattttttggttttattgcatttttgttaaggaattttgcccaaaaatgtcaaaatagtgaaaaaatagtgacaaaatcccaaaatagtgatttctagtgaccgataatgacatcagaatcgaaaaatttttatgcggaaatgcgttttttgagctcctttcttcaaatcaattgagcaaaaaaaatagttaaaacctaaaattcacgtccctaatgatgtattgataagattttatgtattaaagaaattggctgaagaatttcgtcagtaccgctacaacatgagtccgccgaatgtcgaaccgaattcgccatggctgtggaatgtccacacggagcgcttgattccattgaagcaccctgtggcgggcgttcaggcgtgccgcagggcagaatacggtattttgaattttggacatttctgctcacttggtgatttcaaaaactccagaaggcaaaaatgttggccgacaaaggcaagcggcatctgccagagctgaaatggatgagttgaaatatttaaccgaagaccaactcagcgagcgtgtcgctggtggccataaagtggaactaaactccaactactggctggtgcgcgcgcttcaatctgcagaatacgaagatgaatgaacaatgcaattggcatctgcccatgtttaacatttatttgttgtttttttttattcatcacatttacatgggcatttttggtcggacgtttatctccgataactttaactgttttttatctacgccttggtaaatatatcaataagtcttgttttgacccaagcggtattatctgccgacagatttttttgttcaatttaagttttttagaaaggcatttcattgttttttcctttctcacccgtcaatgccgacttttgcgaggcgagcttcaaaaagttcggacggagcgggagagaggggggggggagagattatgttcagccaagggtctgcagacataaattgcaaaattatttcataattcgacatgatgatgccaaaccataaagaaagcaacctcttttggcgatcgaaccgctcagatcctatgacgcgggcatcgtcaagggtcgtcgtgtgttggcgcaaattttgtggaacggggagtcggaccatccgccgaacaatctcctaggccgagcagtttgtgaaacgggcggccgaactaggcgattacgaggagagctggacattaagcacttggtagccaatggagagggcaaaataaacatttccaagggggtgaatcattttgattattctcttccagtggcatgggttatcagttccataaaacaaaaatattggattgagttcgaatttgtctaatgcaatgttctttattttaaaatttaaaggtatttgggtgacacggtgaaataccaacgtgaaaagtcggcgccctatggccataaaatgggcgaattgtccaaggacatgcagaacgcgctcatgtagggactcaaagcgtgcgacgagggcgacattttccagcgacttaggtatactcatctcgcggtttagtaaaccacgtttgacgcgttaaccacggtttcgttaatggtttagccttaacgacggttaaaaagggaaggacgagcataccggttaaagattcttaa

SEQ ID NO: 3348 - DNA, 2242 bp, Heterodera glycines
gcattttctgcgctgccatttgtttcattctttcggccgccatttctttcacgttcggtctgaacaatggttgcgatggtgaaagtgtgagagtgccattccttaaagtgtctttctttgcattcgtaattgggtcaattagatataccgttttgacttgtcaggaaagtgatgttcctcaaaattcggttccatcggaccaccgcaagccaatggtcggcgaattgtctcaaccacgagcggtgcaaattctcgcgaatgttgtgcattttctcatttatatgacgggatttgtttgctcgaattcggtggacaattgagcaaagaaagttttggcacaatttgatcaagaagtgtctccgactaagaaaatgccatttcgagtgccatccgttgggaaaaaattttgttggcacacaaatggaattggcgagaaacgacgcgttcaatgagttcggataccaatgcattggccattctttgctgctttttcttcgcaacgaatgaaatccatcgacgaatcacttttcgagtgcttaaacaatttactcgaaaaactcatccgaattttaattttttgactaactgcaaattgttgcgaattgtattttcaagtgcaatgccggcaattgctgtcaattccgtcaaaacaactttttcaagcaaatgctcccgcatggacagcaactactgatcagtgttgttattagcgtccagcacggggggaactcctccaatttggccaaacggtttaaggaccgattggaatggctctaaaatacaatgagaaaatgccaatctttagcaaaaatataaaataaataaataaggccctaattcatccaccgaaagacctgacgaatgaaaaactcggcgatgcttcaactcacatatttttgcgtgcagttgcaaaagacgcgccgtgcaattcaatgagctccttcaacacggggtcgttcacatacgcaccgctgtccttggcgaaacaagaaaagagacggcgttcaaatggtcaggtcgaacggcggaaggattgttgcagagaaccttgagcggaaagaatgcaagttaatcgaatattgttgtttcgaaatcattggcatgcctttggaagagtcaaatggtgggccttttgttcaatccaatagcattttgtcctttgaattgactcggcgttcggtgcgtgctgggtaaaaagaaattgggaccatcgcgaacatttatcaaattggggtcggtggcgtccatttccaagttgaattggcgaatgaatttcatcgcctcgtctattgagtcgaaggagagatattcgacaaaagtttcaattgggaaaatgttttaaggcatgcaaatcactttaagagcattggaacggatgagcggaaaaaagtgatgcacagacacgcctaaggcaaaacggagagtaattaattagcaataaataggaggagaagtcagtcaattaggcaacgaacgacctgaagaaaagtggtttgaagacgtacgagacggaagaaacggatgtaattgttattctgaagggcactggagagagagagggcgagttgcacttgcggattggcacggacttaggagagcacttggcttaataggaagggaatgaaccaaaaactcaaaatttgaaaagtagaatttttgaaatcggacaagttcaaaaggatgtcgtaggaacggaattcggactcattgacacagaaaagttgtttttttgccaaatcgtcatacatgtgccgaagtgtttggagacttttcgacaaattctctaaagaatatgcaaaaaatatattaaaactggtagtaataatacccgtgttcattttatggtcaaaaagatccgcttcaagttcaacaagtccaaaaaatgcaaaaaatgtgaagccgagcgcatttctcaaccaaatccaaggccatttcattgtttaacatttgttgcgttatatcctatgagcatccaatgaggtttggtaataaatatggggtacttatgtggtttacagaccataaaaaaaaaatttttttaacacatttctaggtggttttcggggtcgctgatcacgaatctgacatccattgcgacgaattccgaatcccggactcgaattcgaacaaaaagtcgaaaattaaaatttaaaaaaaatcaatttacggtgcgaaaataacaaaagttcaacacaatgccatgacaaacatagacaaaaatcacgctcgcatcgatacaatt

SEQ ID NO: 3349 - DNA, 4143 bp, Heterodera glycines
aagtcgcagaattgtatcgatgcgagcgttgattttgtctatgtttgtcatggcattgtgttgaacttttgttattttcgcaccgtaaattgatttttttttaaattttaattttcgactttttgttcgaattcgagtccgggattcggaattcgtcgcaatggatgtcagattcgtgatcagcgaccccgaaaaccccctagaaatgtgttaaaaaaaatttttttttatggtctgtaaaccacataagtaccaaattttgtcatcatccaacaattacttttctgattgctcttgtcctcgcccaaagaaagccgtaccatcgcgccaaatcattgctcgaagttgtcggaatttcgcccgcgatctgtcattttaaagccaaataatttgggaaatgcaatgcgaacattgaaaatgagataatccattgtcagttgcaatattttcagcggacgaagctcatgggcgagtggagtatcctaaaatggtaaaagtgaagagattggaaatatcactcagtccaaacaccgaattcaatttacaaaaagggcaccggatcagcagccgatcggctgtaatccttgaccatcttttcatggaccatttgtccatgcgcattgcattcgtaaaagtgcactgtcttttttgcatctcgcatatatcgctctttctcaggacacatgtcgggacaggaaccctgaaatagcggaattggttagttaagggttaaaatgataaaagccaggaatgacttgagtaatctgtcggctgcccaattggtcagaagttaagtcacgcaatttgtacaaaatacatctcggtgttgtaaaaggtaaaatttgtcggcatttgttaagcacgttgggccaacaagctctttcagaccgttaactttaaaatttaaacgaaatttaaaaaacttattctgaacacacacttatgtcctgttttgtggaaattgccttcaactttggcaaaagacccacaaaactctctccgccgctatgcaaacgcttctgtcgcttttgaagaacagattgaacgggtctattttgaaaccgcctttagaatttgccgtttaacattttcaccaaattaaattagccttttaacctcgaaagtgtagtcatatccaccacgagatagaagacttttcccgcgatttgttttggtctctgcgaatcggagaagagccatgagccaatgaatttggaaaaaaaacgaatagagggaaaaacggcaaatgatgaacaccagcaattacaactcgagaatgaccatcagcattcgggaatgcaaaacaattcctctccaaattctcttatcaaaatgacctcccaagaaaattgaccacccgagataaagtgaacgaccggtcttatcactacaacggccaaagtaccactgaattttaccacattgaaattaagagaaaaaatgctttatttttactacacgcatttattaattttcattaaacatagtgcattttttaaataaaaatgacttttcggatcagtttgaccctgaggcacggcttgttcatgtgaatatataataataataaaataataattttattctgtcgaaatcggtcactgtcgaaatcagccactgtcgaaatttcctggcacgatttgattgacctggtcatttgaccacgaaatacgagaaaaaggtagcaaaagaaaatggtaaattttctgctggagcaaccagcagcagggatgtgccgagccagacaaaatccgattccgattaaatcgccgattccgattatggccaaaaatccgatacggttttaaaaccgattacgattatggcccaaaatccgattaattgcgattccgattacgattccgatttttttttaataattttttcccaaaaattttattcataatcaaaatcataaattttaagattgtgatgcaaaaataaaagtttgtccacattctcaggcaataaacgttttctcagatctgtcacaatcaacccagcggtggagaatattcccagatatttgacatttttgctaaataacaaaaaacttgattatatcggggagaattaatccggcactgctttgtgagaaaaatttaatttcagtcattatgttaaaataagattaaaacattcgtttcagaaaacattttttcaaaattcattggtattctcgctaaaaaaattccttcaaaaggtcaattcttaggggtgtaataatcggatttcaaggcaaaatccgattacgattatccgattccgattatggaccaaaatccgattaattgcgattccgattacgattacgattccgattcggcacatccctgaccagcagccaccgttttttaaccatcaactatgttcttttgctataccacaaactttaaccacgaattttttatttacataaatattttgcttcttttcatggaaaacaagaagtaatattttgctttgaaaatgatcaatagagaatgatcatgaaataattgttggccgcatttctattttttgttggtcgctaatattgttcgcccatttttcattataaataaaccaatataattttgcatcttcttcttcgtccaaagtcaatatatcctttcgagtaaaaatattcaaaataaacttaataattttatataaaaattattaaagaattattacatattttaatttactaaaaatgtctttgttctccaaacaattgtctgagcaaatcgcaacatcgattaaagacaattacgcaacattcttcccaaacagcaaagaagctaaatttgcccaaaaggcaaatacttttgctggaattcctggcgccgttcaacgcctctcttttccccgacgccatccgcttcatcaagtgttgacgtggatttggaaattcagtccttgactgaagctgggtttgaggtgcctcaaaagaataccatgggttttcattccctttgtagcaagtgccaacgaaaatgatgaacacagagttcggggctccattcaaaaatgttttgggagaaattcaattgcttagccaagcggaaagagatggagaactaataaataaaaagatttcggtaatattaaaataatattatttaaatgtccggcaacatttttgtaggttaaacgaaaacggtataaattttttatgccaattatgccaagaggatttgaacccactgcatggcgcaaaaggagcacccgttccgttacagttgcaaattataatggcactgcagtatttggccagcaacacatttgaaattcatatcggaaggcatatggagtgggccaaacaacagtttcatctgttataaatagagtcttcgcatcaatagcaaataaaagcggtcgctttgttcattttcggaaggaaataatgaattgcgaacaaaaaccgatttttacaattactgccaactgccacacattttgggatctattgattgcacccacataagaattaatgtataaaaattttttataaataattttgttaaaattactaaacatagaatcctggaactgatgatgaacaatcatacgtaaatcgaaaaggattttgttcaattaatattcaggcattttcttattttttttaaatattattatcaattttaagggcatcgttgactcaaaatgtgtatttataaacgtcgatgtttcatggccgggggcaacatatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcattttttggcacaattttgcagtccaaaaattctgaaaaaattcctgctaaggtaactttgagtgctgatcaaaaaagtcttttacagcaacttggtccgatcactctttcctggtgatctgaacaccccaatatacagtgaaaaacggaaaatttttcgaaaaaaattcctagggggttgggaaaatttttctggaaattttaagtgggcccattagaaa

SEQ ID NO: 3350 - DNA, 2346 bp, Heterodera glycines
  misc_feature (10)..(10): n is a, c, g, or t
aggctttatntgggaactgcaaacgctcatattttatgctcccccgcgatttgtcttcatagacatttcgtgttctttcaagaaagaatctcacttggccgccaatagcattgctattgataacacgaccaatgaggcgatcatcgccaagttcttccagaactatgcgtgtgccattgatcagtccttccttatcacttttattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtattcccgcacttgacctggcacattcgccatcatgatctcgttgacttcatcacacgtgtcaatgtgcggagcgagaatcaaacgattgagcagctctttgtcattgccaaggagttgttggaagttaggatagacataatctatcagctcttccttgctcttaacgaggaactgcggaggaatccagaagtgctctccggtttctccgagcccgatttggcggcacatttgcaagtacgcttgctgaccttggcccagtctctggttgatggtcaatttcatcgtggtgaattgaccaaacaacggagacgtttgaaaacaggctgtcacctgagcggttaagccttcatgaggcacgaccggcagcgactgtttgaagtcaccgctgaaaatgaccgtttttcctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagaccttctgttggtcgctgttaagtggcggaggggtatttggctgtggacgaggatttggttgccctggaggcaaattcaaatcatcatcgccaaagaaaaactcttcaattgccgcgtcagtatttttggcaattgaagttggcgggtctggcaggctaaaatgcacacagcttaagttaaagcagctgtgcagccgccaatcaatgtcggctagggcttcaagctctgctactttatgctgtgccagagtaataatgccttgcggattgtacatttggtctttgtacttgttccacaattctatggcattactcggctggccatagaccaggatgctcacaaaaagccatctcatctgatctggccagcgcgacagagctgcctccgccagagttttgtcccaaattttgtcgtcttcaagaagaccatgcattattgcagcctcagtgaatgaggtacaaagcaacccattaaccatcttaagatggtctgggtctccaggaaagtgacgcataagtgaatagagcgcgaacctttccgggtccgatgggggtacaggaacaattcggccgataggtggccttttaatttgctgccttttgtacaggacccatttgtcctttgcccatcggaaccgctctgggactttttcgaaaagaatgtccttaaactttggatcattcttccactcattttgccattgtttccaataggctgaacactgcgtttctggcagttcgccttgctggatttgttgagctttgctcaccagctggaatgccctatatacaatgggctgttggtttggcaaatgaattgccaatttgacaacatgatgcgaaagacgggcaaatggcattgaatgaacaatggcatatgcttccgttgcaccacggaagttcatcttggcatattgagccggctcgtcaattttgattttattgccggactcttctttgcactcgacataacaatgtcctggccctttaaaagggtacttgagtgcgtatttaatatttgctttgttaccatatgcaaacagtacattatggtgtactcggtaacgtagcagaatataaggattatacggcacgacatgcgagttgtcgtatattaagccgtttacctctaattgggcaccaccatcagttggtgaaggccggaaataca

SEQ ID NO: 3351 - DNA, 4190 bp, Heterodera glycines
  misc_feature (24)..(24): n is a, c, g, or t
tcagtaaatacttgaccgttttgntgtaaattctctttgaactcaggccatttccctgttgttcgtgaaagtaatgaagagacgcgctttcttcgcgtcatggcaccgtgcaaaaacggtgttgcaatcttcatacattttcttccaatattggagagaatttacgttgtgttcggaaagccgaacaacactgccaatgtcatcaacagttttctgttgtgcattggggttttgccgtgcttgctgcctgttgtattggttgaccaaatactgcagcagattttttggagtgctgatccgcagatccatgtcaggtctacgcaaaaatgttgctatttgccaatcaatttttgcagcctggtcaaggatccagcgctgaccaagtcctccaccacatgaaaggatgtggtggtattgcaactccacattttcatcccttattgcgagataatacttgcaataatctcgcagggagataaattgtttggatttgtcaatccgccggtgctgcgatgaaacagatgctacagattcagcatctgaatctgcgactgaccccgcatcagatgatgcaattgactgagtctcgcacgactcattatctgactcggcttccgagtcaaataggccagatgcattctgagcaccttttcgcttacgcgatggtggcttagcatatttaatgccagttgtgtatccatcatcgcccattggcttgattaatggatacgtaagactatcagtccacggactgaaaggagcaatttcatttaattgcccttgtttgttctctacccaaattcctttgggcggaggagcaccagtggggtccgcatgaatagcgaacatcccttcacccgtagaaggggtgattatttggtgtgggtgcaattttgggtctttcagaccagctggagccctgcgctcattcaacaaagtcatgcgaaagaagcgaagctcttccggagtttgttgttggagaagctcagtgagctgctcacgcgcctgcttatatgcctgcgcagcaggatgatgcaattggatcatttgttctaagatctcaagagtctgctcatttagctggtgaccctgcacaaactcatcttcgtttgtgattttctccccagtaaacctggggttgtttcgacgctgttccatagcctcgactgggtccagaatgtacaactggccaaagccaggaatctgagttgtaccagcctgcatgctgcttatgcggcgatggaattctccgttaagaataacggccatcggaccgccagcagggcttggtttgttgccagcggaaacgctcgcaaattggaacaggttgttataacgcgacatgtgtcgcacaaattctttcccttcacgggattgcttattccccacaatcagctgtttgagctcatcaggatgcgggttaagcattggcagcacaactcttcccttccggcagcaaatgctactgtcttcatgtgagaagagatgtgcaccgcaatcggcgcattttttgtcaccgagtttcccggagtcacaatattccgggaaatgtttggctgctgctgcagcgcattgccaccccttgtgaaatgcagagcaacgccgtgtgatcggcgttgccactcccagcgaatttgctggcggggggcgtttcggcgccggtgaaggcgaacggctaacagaagctgaaagccttttttgaacgcgcattgatcgccttggtggcgtcttaggtctgatgaaaattacatcatcagcctgcgcgattggttcttgctggacaattgtgtccgcaacaacaccgtgggtgtcagcttgattttcgccgatcactggtgcttgcgcaagaacagcagtatcttccgaggaaggaagtactgctgaatcatccccttcaattggcactatgtgcttggaggaagtttgcgctacatccccattgtgatgagacacaacagcgaaagatgttgaaacaccttcccttggatgaaacggcacaatatcagagccgtaaagctcatttatgtgccataaaatgcgcttcttctcataattgatgttcaagtccggcagaacaaaagtgcaattgttcataagccaggattcagcatacaggcacacaaagtacccgcagctatttccatcgtgttgtaccgtaagatttaccgcattaaaaatcccggtcaacactgctgacggcaaaatgtcagaaatgatctttccaattttatccgtcagttgccaatccaacctgccatagggggtaggcaaagaatcggcaaaatgagtaccccactgaacatcatggacaatcagagtccaatgtccagggaaatgcactggcaaaagtatgacttctgccggaacattagggttgtacccaaatgtcatatttttgtaaggcatgactctgtccaagccatttctccataccattgggtcaacaacgaccacttttcgttgtgaaatgctagccaaatatgctaaatatgtggcagcaaaaccgtcattgagaaactgagtcagatcattccaacaggtctcaatgtatcttgggccagagctcggggcaagcgatgtttcgccatcacgttcgtaaaggccaattgctgcccatctccaaattttacaggcaaaattccgcgtggttgcgaaattaatttgcactgtgctgaaatttattttttcaggcacagtgtgcgaggttgccgaaattggggcatttacaagattgatatccatttcagagcttttgctcatggaatcactgagtctgcctcggcctgggcctccaatttttttggcaggtcgccctgcacgactttgagtcgaaacaggtgttaaagcaatagcttcattggcaaacatgggttggtcaatctcggcgacctttcccctttttttgcacggcgaaccctggtcactttgagtgagcacagtttgatgtatgtcaatgagagacatactttcttgcgtagccaagtttggcttcgctccggctttcgagggcctgcctctttttttacttccaatagaagacgccggcgtgcttatttgcaaagcacttaagcttggggtggtggtgccccggagagatgccgatgcctctccattcccatctgcactcccgtctgagacgggtgagttatcccgactgacagatcgctctgcctgtcgccgatacacatcttgcttcttctttttcaaattgcgttgtttagaaggcatctaaaacaacaaatcagaaagtattacaaatgcggcaaaaatatgaggtaattaaccaataaatgcacacatatgttaaaaatttattaacaaaaaatgcacaaataaaggtcaaagacatcattcttcgctgtggagtgtagtcgtccaatgctgaaatacatcagtcagggctcacacatcccattaagaatgcagatgcaaaaatgtccggtccataacccaaaagggcaggaccagccacaatttttggtgcgaaccacaatcccccttagggataggtccagcgacgacttttggtgcgaaccacaatcccccgaagggttaggtccagcaaccatttttggtgcgacaaatgcctcggagtgccagtcagcaaaccacattggtacgacaatgcctcgaagggccagtcaacgaaccactggtgcgacacattccccgaagggactgtcagcgaaccacattggtgcgacaatgccccgaagggcctgtctgcgaaccacattggtgcgacacaagccccagagggccagtcatcgaaccgtcttggtgcgacacatgccccagaagggccagtcagcgaaccgctttggtgcgacacatgcccgaagggatcgtcagcgaaccacattggtgcgacaaatgccccgaaggcctgtcagcgaaccactggtgcgacacattccccgaagggactgtcagcgaaccacatgggtgcgacaatgccccgaagggcctgtctgcgaaccacattggtgcgacacgtgccacgaagggccagtcagcgaaccacattggtgcgacacgtgcctcgaagggccagtcagcgaaccatatttgcaaaaaataaaatataaatgtcaatcttgggaattaataaaggacagaacaattaaaaatgccaagaatttgcaaaaaagaattattttttaatttggcagttttaattgttcttgagt

SEQ ID NO: 3352 - DNA, 984 bp, Heterodera glycines
  misc_feature (953)..(953): n is a, c, g, or t
ctgaggacggtcaaaaaataggagaatgtccatccaaacatccatgcaaatacaactgaaattttgaaagcaatcaaaaaatataatggaagactaaaaaaaaagaaatttttgttaaaatatggcgatagatcaacaaaatgtttttgcaaaaaaaaaaaaaaataataatttgtgactattttcttaagtaaaaaattttcctgaactccctccctatggtctaaatgcccgaaaaacatgctttttggtgggttaggctaatttttgagtttccatagcacttattttcgaggtttttatagcctaaaatccataacaaatttttaaaaaacataattaacttattttggcgtttttctgaaaattattaacaaaagcaatcaaaacgaaaatacaccctagaaatctagccaaaatttctaaaaattatacccctaaaaatcgactctagaaactaaaaaaaattcccttgtatttttgttaaaatatggcgatagagcaacaaaatgtttttgcaaataaaaaattgaaaaaaaaaaataattgtgactattttcatgagtaaaaaaaaagtggcataaaatcgctaagtaaaaaaaagagtaccctaaaagagcattttttatataaaaagtaaatcaaaaagtgggttgaccagtgccgtgcgcggccaccgaacgtcgtatttagagtatggagaagccagaaaaaatatgtgcccacaattgccctccggcttccgcaacggatcaaaaatcagctgcagaaattcggcaaatgccgccggcgacacattctccagccgggcctcctgctgctcagattcgacaaagccttgccaggtgaacattgtggcgaagatcggggagtacatggacaaatactgaagaaggggggggggggctttaaaataaagaaatattttatttttctggaattgtacaggcccnaaggggtcgaacacgaccctcttacgaagta

SEQ ID NO: 3353 - DNA, 3002 bp, Heterodera glycines
tcgcattatatttacgcgctttttctgttgtaattttctccccaggtgtgtgcttaaaaatgctcataagtcatctaacataagtgggttttttttggctggacaaatagggatttacgaaagaaatatcagtcaaaattgatgttgcaaccggtttattcaattgctgaagctaattaagtcttccggtaacgttgcataaaatttgtgcaatgcaaaaatgagggaaaactgatgcgaaacagatacatttgcagccctgtcgcagtcacgctttccttccgttgcttcactggcgccacccaccgttttgatgatgtccaccgctggtcaaacgcccgtccaccgcagccgacactgtagcgccggctcaaacaatgcgcagcccaacaacagtcacgaagcaatctccagaatggacgtggtttgtgcacaagggaccaaccatttttgagggtggaaaaatgatggaaatggtgccatcctccgacgctcttttaaaatgcctaaataaaatggtttaagctagaggtagagcgggaccgggaccaaaacacggacaactgagtaccgaggtcccggttttgaccgggaccagtcccgggttttttcccggttttcccagccaaaaatccccggtcccgctctactctagtttaagcaacaattcatttggtcttttaattcagttaagtgagcggatccgtgacttccattacaacgaggaccaaacgcacgcacagctcaatcgaaaattgcaattacgcgaccaactttattacgcaatttcaccgattttcccaagtacaatcgaattatttttgataaatgaagcacaaaatgctccgttctgttgttcagtgtgcggactttacattgtcggctcgtcactgaacggattcgggacgaagcggtcggacttggacctttgtctgatgataaccaatcgtgatgtgagtttaggcattaataaagggcagaaaagcaaaggaaatgtccagagaaattgggccccaattctcttttaaattcattttgtcgtccgcagattgaccaacgcactgatgcggttgttgtcctgtcgtcggtgatgcggacattggagagcaatcaaattgtggccgagcagaatctgatcctggccaaagtgccgattctacgcatcaaatttatcggcactttccacgacataacggttgacctgaacgtcaacaactcggtggccattcggaacacgcatttgatgtgttactacagctcttgtgagttatcttcattaaacggctttttgtcaatccccgagaggcctgttttttgaaaaccaagaaattttgctttttcgttggtctaaaattcggttgcctcggacagaccctatggtttttttgtttgtttgttcatccttccattctccgcagttgactggcgtgtccgaccgttggtgatggtggtcaaagagtgggcaaagcgtcacggcatcaacgactcggcctgctcctccttcacatcgtactcgctggtgctgatggtcatccactatttgcagtgcggtgcacagccaccggtgctgcccaatctgcagcaaatgtacccgaaacggttcagcgtacgtgcggatgtgcgcacgctgaacgtgtcgttgccgttcgagccaattccaaccgcgatgggctggcagttcaaggacgacgcgacgctcagcgagttgctgctcggcttcctccgttactacgccttccaattcgagtgggactgattacacgaagggggaactcctcgggaaacttagggctttattgcggatatttgtgccgttgatgatttttagcgcccggttcagtccccgttttccccatcatcaattgttaacaactcattcaatagtgtgttattactgtccattcttttagctttgacgcggacgcgataagcattcgaatgggcaaaaaggtcaacagggcacaggtggcacaaaatcaagttggtttttattttctcatttgtcagtgtgttggggttggtcgaatgtgcctgaatttgcagtcgcccttcaacacgttgtcccaatggcattgcatttgcattgaggagcctttcacactgtcaaatgccgctcactctgtgtacgatgagcgcatcttccaggtaaaccaaaatctaccattttctcatgttcactctttgctcttccaggacatcaaaaaggcctttgtggacagttaccgcgaattggacaagcacagggacttggaccgttttttgggaccgacggttgaggcgtcgacggcgccgttgggccaataattttgtttttgatgaattttatgtctttgttctgtctgcaccccaccacgaattactggcgatcggagaaaatatattttgtcttcattttaaaattgtctatttttgctacggaatgaacattttaaattgatatttcatatcgctttttgttggtcaagctttcagtgcagagagtcaacttacaattagatcaaaaacagtcgaaagtaaataaaaatttaaaaatcagtgtttgattggctattgcgtcatgacggattcaattttttctacataagatgctttttattcatagaccctggatgggaacggagacgcacttgagacttctcggcttagaaattggctgcttaattcagaatggcggcattgctttttctttctctatcatttagctcttcaatttccccgaaaagtgactgagttttggatggccaaacgttcacacgtttatgcggactcggcacgagtgtcggaattcaaacgggtgtgccgtgaagagagattgggaatccaaaattcacgacccccccttgaggttggcgttttatactgaaatggacggtaatactggagaattggtgtcccggcaaaaaataaattaaaaatttttcttttctaaaagtcgttaaaacatgtttagggcggttttctgggtcgctgatcacgaatctgacactaattttgacaaattt

SEQ ID NO: 3354 - DNA, 4232 bp, Heterodera glycines
ctgctcgccagcccagcggacggaagtcaatgcgcaacgcttcgccccgacgcgccaaacattcgcacgccttacggagaatgaatggcacaaaaattgttttttaattcgaaattatgccatttgctcgcctggtccatgccgccgccctccaagccgacaaagcgttccgcgtgggtcgcaatttcggccaattctttctgcaaaaaaacaattcgccaaatttaaaaagagtaacgggcattgttcccaaatttgtagggatgtgcgagaaatgatttttttaccgagaatcgagaccgagacttagaaatgaccccgagggacgagactgagacgcgaaaaacccgagaaatttctcgagtcgagactctcgcacatccctacaaatttgctcaaatttgcgcgtttccttccccgctttggcacaccttcgaaatgtgttcaaaaatttgctgtccaccaccaccaccaaagtcggcactttgcacacaaagcgtggccaatgccgcggcacagaccaatgccgaagagctgctcagtccggcacttggcggaattcgactggccaccaccgcacgcattcctttggcctacgcacaaaaaaacaatgaaattttgattattttcgaagctaaaactctttgtaaggcttctgcctctgtgttgacaccctcccgttgggccaaactctccaaaatgccgcgccaacccgccaaaaaatagtggtgccatttgggcacggcgccattggaggaagcgccggaaaacgaatcggaaatggccaaagtgaagggacttaaaaggaaattaattagtaattgttttagaaatatttaatactttaaaaaattttaaatgcccttattgggatttttgtgcctttgttttaagtcagtgggcggttcagtcccaaaggtatttagccacttcagttccgggtctgtaagtcctcaggaaatgttcgctccaagattattttcaattttacaaatttctgaaaagggggggaggccgagaagtgtctaaatggacaggtgccggctggggaggctgtgccgttgcgctggtggacaaaaacaaaagcgctcagttggaagcgaacggactgaatgtgctgttttggagcgaaccgtgcgaaggcattgaagcttttccattcagtggatgaggcgaaaatgaaattcaattgaacaaacagaaaacgacagaaatgtttctaatagctgtttgactccatttttataatttattgccgtaaaattaacgaaattaacgaaatgaaccgataaatagaaaatgcaaagagatgaactcattttagcgtatattattcacagaggaaagaaaaaacatttaaatgtaacaaatctgcacattcatcacatgacttccatctcaatggacgcgtcttcttcgtccgtcatttgttcgctttggccagcaacgcctccgccttcgctaccatttcctcgtacgcattcttcgccttcaccaatttctgcgcgacaactgcgccctccttcagatcgtcgatgtttttactgacactcttctaaaaggggaataattttggaaagatagcaaaatttaaattttaaaatagtgtcaatggcatggctttttgggggatggatcatttgtcttttggtcgaaatgaaaccccccataatttgtaagaatgtttttatgaccaaatttttaggttttatcaaaaatggagggtgggacagccttacaaaattacccatattttgcccatttccaaaatggtcttaaagccgtacaacgaatgtgccgaattcaatttgccaaattggcaatcattaagaattggtgtcccgacgaaaaaaaatattaaaaatttgtcgggtattttttctaggctaaaaaatgtgctgatcacgaatctgacaatgagctcagattttgaaaatcattgattttatctaagattttttgtcaattacttgattttttccaaaattaagaaaattagtcggacataaaactgatactaaaaacagctttcaaagatctattaaatgtatggagaagtcaagttttgaatttttacgattttttgaaattaattattaatccctaggggtcgtatgagacgggggcctggggttcgagtccgcttggttgcggtttattttttttatgacacttgatgaaaatcagacaaaatgaaggttcatgcatagtcagagcttagattcgtgatcagcgcattttttaacccaaattcattgctaaactttttttaaaaataatttaaaaatagataaaatcaagtaattgacaaaaaatcttagataaaaatcaatgattttcaaaatctgagctcagattcgtgatcagcgcattttttaagcctagaaaaaataccctacaaatttttaacattttttttcgtcgggacaccaattcttaatgattgcctaaagttgggcccaaatgtccgtccccgtccacccacgtacctcgttctcgtcaatttccaactcttcgctggcgggcgcaatggacacgacggtggctcaaacgggtgggggaaacgaaattttggggcccaaccgcaccggcgcacagaaaggagagaggaaagagaccaccaaacacttactgcttatgtagtcgctgatgttgtaaaagcgcttggtccggtcaaatgggacggggacctaaagaaatttatgaaaaacaaaacggaaaaaacggataaaaaggcgtcattttccttaaaaatcttcaaaatcggggcatttggatttgttttaaccgaatgttagcaatttattgagcaaaagccaaaaaataagctcttttctagaatggactgcaaaaatggcttcggttttccattagaaaataataataataatttttttgttttttggttttctcgacacaaaaacaaatagaaaaaacagccaatcaaatgggttgccagatttgcaattatctttgtagctagaacaaatttgcaggaatttcccaaaaattcggagattgcaaagaaaagagaaacgcgcccaccaatcggcccttcataaaggtgagcaaagtgcgccgaaatcggctcaacatgcacaccaactccacgtgaaggacggcaacacccggacgcacaatccgtgccaaaattctgtccaacgggcgaaggtcggcaaaaaatttgcggcattgcaccgcgggcggaagcgcgacggatgccaccaaatcaaacgggggcaaaacgtcgttgtcactgttggaggtggaaaaaaagttggtggcagcgtccaattggggcggtggcaatgtcgcggaatacgactgtggcaactcgttctaaatttgttttgctccacttaaaactgcaaaatttgcagtgattttgcgaaaattccaacgatttccccgtccccactttcgtcccattctgctgctgacctccgtcactgccgctgttttcgcgttgggttccgtgccgagcacatgcgaccgaccgacgatagcgaacagtcgcaagtcgccgtcgcaattattttcgtctttgtgcaccattgacgaacgtctcccaccgccggaatacatttgtaggctgccgatgtaaaaaaaggcttttgagaattaaatttttttcccttttcacagcaagtcaattttggactccgcttcgggtctgtatcgttttggcgccgccgttttggcgccagcccaagttttcggactataacttttttatttgttaaccaaatccaataatcttggtattattcgaaagcttaacatgtttagaagatatttctaagctattgcttcgcgattagacaattaccaaaaaagttataacatgaaattgcaaaaaagtcgaaaattttgaggttttttcctaataacttttttagaaatgaccattcctgttcgttatttgtctcgttcataaaggttgccattcggtgaatgctgacctccgctgacaattgcttctttaaaattaataattattaattctcatttgttggcgctgtgtccaccttttccgctgctgacaatgcctccatccgttggaacagttcggcctaaaacagagaataaaaagcggtaaatctcccaaatttaaaagcaatctcagaggctctggcaggatgaagacattgtgccaattcaaaaaaacacatttgcctcaaccgacggcagtgactcggtcttcttcaaactttgggccattgcgcctccgc

SEQ ID NO: 3355 - DNA, 2883 bp, Heterodera glycines
tgaggttttttcctaataacttttttagaagataaaatttttgtttgttttttgtaaggctactagagcttgtgaaggtctttcgaatgataccaaaattgttagatttggtcaacaagaaaaaaagttataataaaaaaactaaggctggcgccaaaacggcggcgccaaaacgacccgttccctccgcttcagtgtcagacaaaattatatacataacgccaaataaccacttacgtagttttttttcgcgttatttcaaaatttacacaggtaaaagccttttttgtattttttttattttgatcagccataactcgctttttttttattttgatcagccataactcgcttcattcccaaataaactaaacagatttggtatctaaaaaagtttttgaaaaggagaaccttttttctgaacgaatgctaagcaatttgtcatctaaggaaaaaaaagttgagagtttcaattttcatgacgttataactcaagtcataaactgctgatttcaatcaaaacgctaaaactatcatgaaatgcggtcataatcgccacccaagaagaaatatctgaacaagactttatggtcaacgacaacagagcaccatcatcaacaatacgaaattgacgcatgaaaacatcaaaatcaacggtcacttctttttcgtgatgcgaatgcgagatttcacgaagtgctgggacgacggaaacaacctgcgagatcattgtagttcaaagagcggagacgtaagtctaaaggaaaaagtaagaaaaaggtgtattcagcagagttcgtggatttgagtgaccgaagcaaatattgggtatagtttggtttgtccactcccccccccccttttttaaataaaaattttcaaaaaatcgtgttaaacaagtttttatggggttttcgaggtcgatactcatttcgacctattccggaacccgtacctgaattctgttcagattctaacataaaagtgaattttgctgcaaaattaattttgatttttgttcgaattcgggtcatgggttcgcaatgggtattagaatcgtgatcagcgacctcgaaaaacaccataaaaccaaaattaaataacccgctattcggggaggggcatcatttttcagatattttcccatttcactaaaaattttgttttcggtttcggggcattagccccctcccactacgcccttggggataacaataattggggccgcaacgacaaaacttacaacgagtcgcttgcccaaacatttggacgtcccagtgttctgacaccatctcacatagatggtccacccgtttttcaaaaatggctgctggatcggtcagccccaagtcacgaacaatctgaacaccgacgctcgagtccaagccgaaataggcgctcaaagctaaaatttcaactgcagaaattaggcatgtaaagcatagaattgaaatagcgaatcagtcgtctctgcccccttcccctcctctgcccgacaaaaaaagaactgcggccccgatggcttacagctgaaggtaccgtccagtgagtggtttggaagtgccatgacagcacgtttaaactggcccttagctctgccaaagtcagccctctaaattcaatcatatcagattaaaattttgatggtttaaagcttggattatataaaccatctggcgaagggtttcccaggaagtcaattcaacccgaatccaggcgaattgttttttgagcaaaaagtgtcaaaaatttccgaaaactcgacagacgccccaccggacatcgaaacggagtgcgttggtcaattcaaaaagcaattcgaggggtaggattttctttttttgtaccattttgtggatgactaatttatggaagaaaaactgatatttctcaaccccaaccccattaatgggcactttgtgtgcaattaggtcatgggaaaggtgaattgtggtcataatcgccaatttacttagtggaagaatgcatgatactctcatgtttacaattaggcccaaaatcagaccacttaaaactggaaaaacatttacaaaatccaagcctcaattttgccaactctagctaagatacttacagcctctgcaagtgtggtaattggtcgaccgccgctcataatcgttagatgcgtgtacacaaatggcagatacaacttaaatgcacaaaaggataagtggaaaaaatgaaaagcagaaaaattctaattttgaatgttaggtagggggaagaaatgagggaaatgcatggactatagagatgcaattgaaaatgtttagacaaagtaattgagtgagaaattaaaattatgaattttctgagcgagttagcacaaattcattttaatttttacggtttgacgtcctccaaaaagtcaatccataaaaaaataaaaatggcatctctgcccaaaacgacgttgtcgctgtcagcggcgtccaaatgtggcggcgacaattcgctcttaaaattgttctgctccgtaaaaaatttgccgttttttgcataggaatggttatgagaaagtcaactgaaagaatttgatcaccaaaagttggaccaatgcccctacgtccagctcgaatcgacaagggatgtccgctgggaacacgcccgactcatccgcctccaaattcggaaatttgagcggggtttttgtcatcgcgatgtcaaaagcactaatctgtaaaaaaaaaagcaaattttttgttttttggggaattttcggtaccaggggctccgattggtcatccaccaatgccatgttgcgacaaatttgcggcattttagtggtcggagtacggcccaaaacggtgtgccattggccgacaaaaaactgctggtcaatgcacacgcgcatgtcgaagg

SEQ ID NO: 3356 - DNA, 2478 bp, Heterodera glycines
caatttattaaatatttcgaaagttcgatcagcgtagtcatttttggtgtaaatctagttttctaaaaacaacaaatttacgagttttcccagggtgccttcggcactgactaaccttttcccctaagaatcggactaaaaattttcaacctaaaaatcgactttttcaatccttaattatgtttaaattttaattaattattcactttatgttatggcttaaggcatctgctgattggcggccacctcttggttctgtttggaatccatcacatcctttggtaagtttatgaaaagtaccaaaaaatctattttttgagaattttttactttttaaggcaaaatttgaattttgcgaaggaaacccaataagtcaatcttccagagctagataaagatttatgccaaaaaatattgaaatgcttgtaatatgtaataaaaaattaagccaacagcggaagtacaaaaattacgacaattaaaaccccctaagaatggaattaaaaattttcaacctaaaaatcggcttttcaaaaaacctaatgacttttagaagccctaattatgtagaaatttatcactatttaaaatgtacccaaattaattatttatatattttaactagctcgaccggatttttcctggatccaccaggtccaggtcatttttcgacaacctggatttttcatggacctacattttcctggatttttgccaggaaatccaggtccaggcatgaaaaacctggatttcctggataaatttttttctttttatggcgtaatgtatttaaaacgaatataaaatctgcaaaatttttccgccacccttataaatccttatgctcttaaaaattgactcaaaacgaaaaatttggacaaaatttgttagcaattcgcattaaaaattacaaatttttcccggcgacgcctataggcaccgccggactctcctcggttccccctgggaaattttttttaaaaatttttgcaaacagaaatttttcaagaaaaaaatcttagaagttttttaataaggaaattataagaaaaacattttttcaaaaaatttctcgggggggagggaacgagatgctccccatccctcacacattcccaaatagttttttggaaaaatgcgccgaaaaaattgttaaaaatctgatttttgattttgaatgcactgaaatttacaaattgcttattgtttcccaaaattgttaaaatcgatttacctataaacttagaaaaaaatgagaaaattttttatgaaaaaatttcaagattaaattttggaaaaatttttcagcgattttttctgaaagttcgaaaaacttaattcctataaaaaattgaaaacccgtttcaaaattttttcaacttttttttttttacaaatacatattaaaataattttttggtgtgattaattttattatttcaagtgaccgatgttttttcaagttttcaaaaaatgcttaaattggttttaaaatacattctcattataaattagatatttttagacgttcctaagcaattaattgattttttcaagcatttgtttgctttttaaaacaaattttaaaaaatccaggtccaggcctggatccaggtctcgaagagcctggatttttcctggacctggattttcctggatttttgtccaggaaatccaggtccaggtccaacatggaatccaggtccaggtccaggtccaggcttttttcaaaataccgagctctagtaaagactaatcaatttatatatacaaaatgacaaattatattaataaatcattttgatttagtagatggaagcatgagcgaggcaaaaaaattttctgacgacaccatgccaagaaaaattattataataaactatcccaaaatgtcgatgttagaagtcaaacaaatattctttctaataattaataaattaacaaatttaatatttaatcaaaaatttacactaaaatgactaatattatttatatacgtgaactattactttcaatttataaaaacaaaaataaattacaaaactaatcaactgagtaatatgagacatattgttatatttttataaaaatgtaaatattttatgagtgtaaattttaaaagccatgtaaaattttataaagctagacatgacatctttcgatagctcttaatttcaataattaaccaaaacaaaaccatttaaaaagtttgtttacatttaccataaaactttgaactctctatcatctggattttaattttgacactttaaaattttgcattttttttttgaaatatggacaattacaaaagcttttgagggtttgaaaaatgttagatttcaaaaattaaaaaataaatactgttgccatcgacatacaaagccaaacaattagggtattgtttgaatataatatgaatagctagactaattgaaaaaaggataagttaacatttttgccttaaaatgaaatttt

SEQ ID NO: 3357 - DNA, 1562 bp, Heterodera glycines
agatttataatagacaagacatatcattaaattattaaatataaaaaatgccataaaatgatctaattaggccatgcctttttgatctattttgaacacagaatcgtcggtaaatatgtgcgcagatatgaattgtttcaataaaaaattaataaatcaattgtaatgtgattaaattagtcaaaattaatttttattatttaaaatttccttgatgtgcgctaatgcaagttatgaaaaaaaacaatattgtaattgtattcttcattcgtcataaaacaaaattttattttataaggggttgacgcaatttgttcggacacaagaaagctcgataaaaatatttaatggtatgcataaaagcagttaagtaataaaacttgataattcttctaaaaactaatggtatatatgaataataattaataaatgaagaaaaaatagaaactttacgagattctcgacaattgcatataaaatttacttttaaattagttaataaaaactgatattagcaattttaagaattcttcaatttaaccaaaattaatcgttaaatataaatgatacaagcatatattccaaagtttaattgactaacaaagataagcaatgtgcatatcaaaaaagaaaaatgactgtatcacgttggcacagggcatgaatttctttttactcgtcaattatttaaattaagtaaaaattaataatgatttattaaattcaaaaaaaaaactgccatatgaaaatagataaaaatatataaattgagtttcatcaactataattaaaagttaagcgaaatatacatcttatggtggtgccataatattaaaatctttatttattacgcaaaataaatcacaggccaataaaaagtttgtcggttcaaaaacatgaaagcaaaaaataaaaaattaacaaaagttaaaaaatattattaagtcaatttattgtgtattttttgaattgttctacacgccgaagaatgaacgacgggtttttgcttgaaattagctttaatttaaaaagtatatataattaagaatacaacttttaaaaataatatttttttatatgtaattttgttaataaaaacaaagcagcaatatattatgtgaaataataaaactgaaaaatatcatttttctaaattaactttaactagttttaaaaaccatagcaaattcaaataataaattttaaaattttttagtaaaatacataaacgcagaaaaagtaataattttatatatatattatccgtaatttgttctcgtactcatgtaataaaaataaattatataattggagatttaaatataagatgaataataatcataaaaaatctattttcaaataaaaatgatagaagaaattattttatgttaaagtaaagtaattagatactttgaataaaataattttcaatcttaaataaaattttataaaataagaaataaatactattacctagaaaagatttttatatttatttatataatgaaaaaaaaatccttagacggaattagtcatgaaatataattcataaccgcaaatag

SEQ ID NO: 3358 - DNA, 758 bp, Heterodera glycines
  misc_feature (604)..(604): n is a, c, g, or t
tatatatttttatatttatctgataaaaactgactctggaaataataagacaattctaaaccaagtaaaaataatcatttaaataaaatgctgcataacatattagtagtgtaagaccccgttttggtggccatctgagcgccgggacatttcatttccagcgctctggccggccatttgacaatcacttataaggctcatgcttggagataaaggaatcggaaaaaaaaattatctcaacaatcagtcgtgaaacagttcaataattcggaagcagtgccatattgcgaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttagagcaaacccgaaactgataggaaatttanattgatcataatagaagtttaatttttatttgtcccttgcattttctgggaaatcttttcgcgaaaagttgaaaaatttcaaaacggcagacaacagatgcatttcaaacaattcaacaatataatataaaatttaggcaaaaatttttgttcc

SEQ ID NO: 3359 - DNA, 5936 bp, Heterodera glycines
ttttttttagcaaattttatgatcgttgatgttattgtttagctttttactttccctgcccacaatttgtcgtgagaaaacatgaaaaaatgggcagcgaaaataaaaaatgttatgatcgttccgcgctcattgcgcaacccacggaacacaacagagaattgttgcaatatttaagctaaaatgcgctctctccagactcctttcatttaaaaaatttttatttttcattaactttataattaatttgaaatactttaaataaatttaaattatactaatgtatgacaatctcgaccaattttgtaatattgtcgtcaaaaaaattgtaaattctgcaatttatttattaattttttttacaaatgttcgttaaaggaacctttggttgtcaaatcgttctgaacattcaaatccaattatatctgtatttccaaattctcccaattaatggtaaaaagtaaaaaaatcctaaatcacagtattagcaaatggcgagcaaccggctgaaacgcgtgccggcttctcccaccgagtcagctcaagctgatgaacctcccaatcaaggccgaatcattagcgaattaaaaaataaagatgaaaagaatagcaacaacttaatcaattttcagaaaaatgttcccatgcaaagattgtccaaaatggtttctgagtcctgaaaaactgaagacacatcagcgttattcgcacggaagtgcgtattttatatatttttatttcatattttaatttctatacgttaattagttcgtttattaaaaatttcaattttcagaatgtacttttacttgtcacaaatgttcgagagtgttcaccgattcgtcaaattacagggtaataaatgtaaaaaaaataattaattcttaatttttttttttgggtggttttagccctaatttgtgatgttgtatttctgtttattttaaatgtgtttaaaatctatccaagaacagttaccggaccagccagtcaaaatatgattaaattcatttaacattttaaaattctgttaaaaatatgcaattatattttgcctatttctttttgttttgaatattttttccttttcggataagttttagcaaatattctcaacaaatttattaaaatcacatattttccccacgacacctaaattctttttttctataaattggcacaaactgaaataaattacgcatcaaatttaacaaagagagaaatctcgacctgccgaatcaaaaaaataacgtcacttttgaaaaaatgtttaccaactaaattctttgaaaaaatcatgccgcaaaaaaaaaagaaaataggttttggaagtaaaaaaagttttcgtcaataaaaacgatcgaagcattgactaagactggggcaataaaataaatttttaaaatcaaaaataataaaataaaacgatttagaaacattattatcgcgtccactttgggggacacccgttccattgcaaaacttgcgggatggaaatctctaaaattgtaaaaaaaatgtaattaatgtaaattatttttcaaccatttagcgccagcttaagaagcatgaagaacaatgttcacaacaaaattaatcttttgaacatccaaataatattattaaataataaaaaaataaataaatattaaaattactatttgtaataataatattactattaaaaataaaatgtattataattaagaaaaataattaaactaaaatttaaaaaaaataaataaaaaaataaatacataaacatattcatttatttaatcgtattgtaaactattatagctcgaatgtcattgtaaaatataatttaagtgtactctcatttttgtgttggtagttgaagataattccaaatgctctcgccaaaagccatattgatattaaaattaaaaatgttttctcaaaatataaatgatttatcgagtctaaaattttcttaactaatgttactgttaactttagtttaaatagcccaatttcgccgacagcgctttacagcaccatcggaccaatttttaaatttcaataatgtttaaaatggaacattttcgtattagatgtgaattttttcgtagtaatgaatgccaaccaatatttgtttatgaaattcaggctgtctaaacgtgttaaatatttgtgcttatttttgagcagaagttaggctgaatagccactattaccggcattttttagcgcaaatatgttcaccaaacgtgccaatatcgagcacatttcgccgacagcgcttcacagcaccgtcggaccaatttttaaatttgaataatgtttcaaaacggaatttttcaacactaagaaatgatctgaaaaaattttcagaaaatgcgccaccacctatgaattgaaaaatcttctcaaaaattgtcgacaaaatttcatttttcttgataaaaagttttatgtttgaaaattgtcattgttagaaaaacattatataaaaatatttataatatttatttaaatgatcaaaattgtttttttttggtagagtttttctcgtatagccctaaaaacccttaataacaagctgtaaatgcttttttcacgtatttttcggaatttagttccttttcatgctttttttcaattttttttgccaactaattgtaccactttcgcgatttggggcctttttgtttgcgagtcctaataataaacaatgattaattttactcaaaatttattttcgatcagcgatatgctatctcatgggcgtggctttacaaaaaaaaatggcatttaaaagaaagccacgcatttattttcatttcattattcttaaattttatgcatatctaatttcactagttttaatttttaattttgtcaaccgctaaattaattaaatacatatctaatttcactattttaaaattttcaaccgctaaaattaattaattaatttaagtttcaaatttatttgtttttcagataacccttcctattcaatttgtttaattttctatgatgtctttatcgcgtttccagtttgaaacgtctgccattggccaaaaacgtacgagcgagggggttccaaaatgcgctgcgatttttgtggccacaaggccaaaaatccactaaaaaatttatctgtccgtgtcgaattgagagattgtgttgatcctgagatcacacaaagcaccacccgcaccaccctcttctccaatacggccgaaaatttccttcagttgaaggccaaagaaattgtcgaaataggccaaaaggaaccggagaaacttgccagggtttttgaatcgaaactagaccaacaagtgttggtcaagctgaacataaaggtcgatattttttttgttaaaaccagcttaaacaattcatgttatttaaatttaggaatcaaaaggcgattttgagggaagtgactttgattggattgtttccagagtgttcactgaggacaaagttaaggtggaggaggagaaagaaaagaaaaaacttacggaggaaggagaacttgtcgatgacaaaaccaaccatggagaaattcaaattataggcgaaatgttggccggaagtactgagttcgggagtgctttgtggcatttgcaaattgccaattcattatttttaaacttaattatctgatcatttttctttaatatttttgaggaagaaatgaaacgaaaatggaattttcgctcagtaagtttttttgaacaaaaacatccatcggaggacgaagatgatgacgcagaagcggcaggcgtctcctcccctcaaacgtctcaggatcaacgccgtctacaattaggagagggaacaagtagcagagaaacagaaagtgaggaagcacatcggcagagccaaactgctccgatatttgaacaaactgcttaccatgtgcacaaattggaacgatttcccctgtcgcgccatgtcacagaatttgtgctgaacgcaagcgttgaggaacctgaggaaaccttacgatccgcgttcgagttgctaatcagacaggctgttgataacacgcaaaaacaaagtggacgtcctgttgccaagattggcatcagtttgcatggcagaggtgtgcgctattcgttcattcattaattatcatccaaatttcctctgctttacaaggttgtacgagccaattgtgctcccacttcgtccactggaacaaaacacctgcgacgtgcttatggccgagctcgacaaacttggccaaagtgatggagacgatgctggaggtgtcgaagaaggagcgggaatggacaagcgctcacttttgttgagcgaagcagttcaagtcacagtcacttgctttgcgcctcctgttggcgctcgacctcggcattttccccatcaattttgggggtacaacgagaaacatcgtatacagatctgtaactgggatgacaattactgtcttttctacgcattaattggctcacgtgcttatcacgacccggtactgttcaaagaatggacgcaagcccgacaaccgccgcaacaaaatatggcacagctaacattgctgcaagatttttgtgaaagccaagaagcatttcgtctactgttaatcaatcgggcgctgatgcgctcatccgctgagcgtttgttgaatgcagctggcattcgagaagctctgaatgcttacggcattgatcaactccaacctattcaagactattgggtgtgtgtgtatgtgtgtgttctccacagtttgaatggacaattacattacactatacatttttaggaccaacgatttcctggactttatcggattttgttgtttgaagaccggcctgaggtgctgcccaaacccatggaaggggccaactggccgtcgttttgatgtcacattgtttctctcaaatagacattatgatggaatcaaaaaaataaactgcttcttcaaattgtcacggcactactgcgtggattgtgagtgcacatatgccataacgctgaagcacatcccgggtcgatgaaacaggcaaagcttgataagtttgagcaatggtaatgagtttaagcaaaaaaaaatgggatgcaatagattggctcaacaggtacctggaaaactgtcaaactcccttctttttaccggatcaattacgcagctactgtcttaatgacacagaaatcctgatgaaatccgttctacaatttcgccataaccaacggttatgatgtcttgccaatcagttgcacgattgccaggtgagtgttaaaaaacatcatcttcagcagcatcattatttagcgtatgtatgaacatttttcgtgctatgtcatgaaaaaagaccaattggccatcgttcctgaggctggttatgagcgaaatgaccgagccagtattttggtgaatgaaaatgtatttaatttgcgtacacctttgatatgcattaaggctattaaatacctggattagagagccaaaacagaaggagtattcatatagcatgctggaaacggccgtgaaaaagtcataaaaaactttaagcttgatggctggattgaagagcggaataaatgtatcgaagtgttaggatggtaaagataagtcgtctatttagaaaggactatcatcatcgttataattaaagcttttggcacggctgtgaacgttgatatgatccaaatgacaaattcgttgatggacgaacgtgtcgtgaacttaacgagtcaacccaggatcggttgactcaacttcgtgaaccggacgaactgggtcattgtatagaggtggaggaaatttgggtgcgtacacctattttttatttaattttccgtattttaaaaataaataagcaatgaaaaattgtataggagtgtgagatcaattcaatgttgacagaccatcggaacgcagaaatgcgagacttcttagacaatgtcgggaacgagcgcggtccaatcgatccacgcgc

SEQ ID NO: 3360 - DNA, 1203 bp, Heterodera glycines
tggtgatgcggaacatgtacaacatgacgcaccaacggtggcccctaacaaatcaaagatgagaaatttgggtcaaaagaattcaaagttttgaccttatggggcagtggaagtggtaggccgttcattggatgatgaacatggtgatgcggaacaggtacaacaggacgcaacaacggtggcccctaacaaatcaaagatgagaaatgttggtcaagagaaggcgaaaaaaaggtcattttttgacctgatgaggcaatggaagcggtagaccattcggtggaggttggacatggtgatgtggaacaggaacaacatgacgcaacaacagcggtccctaacaaatcaaagatgggaaatgttggtcaagagaaggcgaaaaaaggtcatgagttttgacctgatggggcagtggaagtggtaggccgttcattggatgatggtggtggtgaacaggaacaacattacacagcattggttgtccctaagaactcaaaagtttgagaaatgttggcacaaaatagggtcaaaaaacaatacccaacctgagggggcagcggaagtggcggaacattcacaattggaaaccggatggggtgttgtggggcacggagggcgttgtatggcattggtggaccctaaagcccaaatttgacaatttgtggcaaagcaaaaaaagcgatttcgatttcgacctgacggggcataggaagtggtcggacgtggagaagagggtgttggacatggtggtgcgggactgggaatacacgatgtggcatttgtggaccctaagacccaaagctgtgaatctgggcaaagaaagctcaaaagcctttggtttctgacctgccgtggtagtagaagtggtggaaaggggcggcgaacagggccttgacgaaatgccggcggcacccgggcaattggacgttggacagctcgtgcgccaatgtccagttcctgtctttgcacaatgttttggtgggcggcattgccgtcaccgtcgtcatcgtctgagcttacatcttccgccggccgattgcctaaatttttgggggataaaatggccaaccatgaaaccgtttctctcattgtcaaagcacaaactcaccctccacaacaggaattggtagtccaacgattggtcgcggagttgggccctcattcttttgggagatgttgggtggagttgggtcacgtccgctg

SEQ ID NO: 3361 - DNA, 6080 bp, Heterodera glycines
aggtttccaacattttattataaggtatgtgaaggcctctttacgttatatttttgcaataagctgtcatagattattaatcaattaatgataccaagttcataacgatgggctgactcaaatgaatttttcactgaagaatttgaattcgatcagacggactttgaatgtgcaatgggccggagaaaatttaaaaggcaaacaaaagagcaagagatatatggtttgttactcacagaacacctatttttaattatgtccctaaatatagggatttgggctgaagaagaggacgatcaacgaccgtcgtttcagcacgggaagaaacggccgaacgattctgcaccagtctcttttgtctctgcgggtgttaaagtcggaagcaaaactcaactggcggatgtgagttattttctgactatacatacaattttcgattattccagggcaatcttcaagaagatgaggaagaaagcgaaatttcagctgttgaaactccgcccgaaaagcgtcccactccctcaacatttgtcccttctgtgccttcgaccagcgatgttggcgctcaagtttttgcgggaatgcgttcatccaaatttcaatcaggcggaggaatgaccgacacgacttggataaaagcgggaaaaggaagcgtcgtaatgcaaatgatgcaggtgaatcatacatggatagggggggaaaggggggccattttccttcaaaactggttgataaaatacatttaaaggaatggtttacaaaaaatcagaaacagcctctttgtggaatggcatttggtgattggtttgggatggatcgaacatttggccatagtgttttttaaagtcaaaaacccatgcgttataatacgcggaatagtcgaaatccatttttgaatttggtcagcaaagaattttgaagaatgaacgtggaaatgaatagagccgcattaccccgcttaagtttgctcctccctttgccgtgccattgcgattggctcctccctcagcacggctgtgattggctccaccctcagcccgccacggacagcaaacaataatgtgaatgattgatgggggaaatttgaatatgattttgtctttctgtgccatccctcccccatcatcgccactgttgggagtgggcaaaagaaatttttttctcaatttcgttggatgattgatagggaaatttgaatatgcctttgcatttcggtgcgcttctcccctgccaggcaccactccgttattgcccactgcgatgggagggcaaaaatggactgaaagaaaatgaaatttcttcgcaagtttagttttgattgacagttcagtgtcataaaaaagaaaatttgaaggaccaaacggaattgtcataaaattcaaatgcgaaggacgaaagaattgcgattgcaaaaaaaccaaaaatagtaacgatggacaaaaaatttttgtgtgtttgtgcacaatttacgttgggcaaaaacgaatgagaacaaaaaaacttgttcgtttgtgcacaagctatgttgggcaaaaaatgacgtttgtatatgattgtgttgtgtaaaacataaatgataggaaaaaatttgcgtttatgcacaattgtgaggcaaaaaataacggagcaaaaacttgtggttgtgcattttgtgggagaaaagtgacgaaaaaaaggaataatttgcaggagatgtcaatcaaaaaccgaaatgagaaggttattagtcaaatgagcagtagatttgtgtaaaaacttgtccttggtagtattttttggttttgacgtgtcgtttgtgcggttatttaaagcggttgaaagttgttgtgatcatcattcgagcaaaatggacgtaactcttcccgtcagcaactcggcaggtgaatggatcggagaggaacggagggatggtgttgtgctctatgcgccgtggacggacgagtggcatgtgcaacagcaacagcaacagcagcagcatcaacagcaacaacaccaacaacaacaacaacaacagcagcagcaacagcagtttgtccggcgaacaggcacggggtggacgcggtttccagcatggaacgaaccgctcgttgccaacgattggcgagagaaggaggaaaatcggatccaaaggaagcgactacagcgtgaaaacccggagtattgggcgcaaatattggaggaggaaaagcgagccggtgaggagcgccgcttaagggatttgcggttagagcgcacatgggatggctacaaggaaggccacttcgagcgtcggcacaatgacggctcgttttttgaggccagaaaatttcttggttcaaatcgacagaatgactttttttcattttcagtttgttgctggggtcgggaagacagtggttggaagttctggaggagggctttggtgaatgatgttggcatgggattgaaagtgttaagattaactatgattggggatggtatttggcattaatcgctgataaataaaatttttcgttgagttggaacaatggggaagaggaggggagggttggaataagttggtaaatgttttttcacagaattttgggaacacattaaaatataataaatgctcacgaataatattggtccgcatagtgcatcgactaacattatgccagcgtcaatccccctcccgtgccggcaacataagccacacaaaatagccaccaatccatccccatcccctgccggatgttggcaactaaaaccatacatctggcctatccatctgtgggtgggaggcaacttaagcctcccaatccctcctcaacccctgccgaatgttggcaactaaagccacacacccggcctatccatccgcgggtgggaagcaaagtaagcttcccaatccctcctcatccactggcaggtgttggcaactaaagccacacacccggcctatccatccgcgggtgggaagcaaagtaagcttcccaatccctcctcatccactggcaggtgttggcaactcagaccatacacacggcctaccctttcgagggtgggaagcaacgtaagcttcccaatccctcctcatccccctccggatgtaggcaacttaagcctcacatccgaccttttggggcatttgaatccaacctcttattctcaatccttcactggttgacatcatagccatataaacccatttgattttttgattttaaaaacattaatacaaaatacgtggaaaattaatgataaacaaagaaatgccaatggtcggcgggaaggttaaaaaacttctatgtaattatgggtgtgtgtgtacaaacgtccttgagtgtttcggaaaaaacgagtgacagagagcaaaaattattgcttacgtatgcaaaaaacagccaatcggacaaaaaactcttgtgaatagctcctatttaagtagctagctgctcgctgctgctattcaaaaatggagcacccctttgaaatgcccgtcgatttggatgattcccttctatcattggatgtgtcaccgacgaactccttccctattgatcctcccctggccgacgtagattcgtttgtccctgatttggtgccagaactgggcgacgactcggccgagtatttgtccgactctgaggaattcgaggttgagcgaatatgcggccaaaaaatcgaaaacggccgacagttctttttggtgaagtggaaaggatatccgaaatcccaaaacgattgggaaccggaggaaaatttggtcagctttgatcgttttcgaatatttttgttgcccataccgttaattttagctcggttgtcagcccaaaatattacaatattggcgtcgtcgccaatacgataaggagtaccgggcccggacaaaggacgacgagaaatcggccagaggggggaagaagaagaagagcaaagcgtatgaagaaaaaccaaaggccgccgtggatgtggagccggatccggtggaaaaagcaaaagaagagatgggcgctacccctggggaggtgttggaggaagagaccgaaggtctggaggaggaggatgtgtgtaaaaaagggaaaccggaatcggcagatgcgggaccagaggtcgaacaattgaagaaaatgctacgtgacagtggccaaatgccgatggataatgccccactacccctaccccgctgggtgcggggtagtggggcatttaaaaaaaggtacaaaaaattgtacgacgcaatgactaataatatgggatgatgttggatatttatgtattgcttgttgttgcataataaataataaaaaaatcaaaattgaaatcgaaaaaccaattagaatttaaagaaattgacagtattttgtattttccattgtttttctgtatggtgtgactcactgccccccccacacccgccacaccactgaaaccacacccattaccccacatttggatgatagacatttggaatagtgtgaaaataaaatataaataaaatttggtaaaaattgttatgatttataaattgaaaaataattattagggctaataaatgaataaaaagaatttttggtaaaaataaaatttaaaaaataaaaatgaaattgattaaacgaataaggttaaaattttgaaaattaaattggaaattaaatattaatttaattgtagaaataaataaatatggaaaatggaaattaaaaattggaaacaaataagaatagcggattaattagaattttaaatataaaataaaatttaaaaaaggttgggtttggttttgaaaatttaaaataaaaattaaataagtttagaaaaaatggaaattaaaattgaaaataaattaataataataaataaaattggaatggaatgaaaaaaattaaaaatgaaattaaatggaaaataaaataaactaggaattaaaattggaaataaattaaaataataaataaattggaatggaatgaaaaaattaaaaatgaaattaaattgaaaataaaaataaaacaaaacaggaattaaattggaaataaattaaaaataataaataaattggaatggaatgaaaaaattaaaaatgaaattaaattgaaaataaaaataaaataaaacaggaattaaattggaaataaattaaaaataataaataaattggaatggaatgaaaaaattaaaattaaatagaaaataaaaattaaataaaacaggaattaaattggaaataaattaaaaataataaataaattggaatggaatgaaaaaattaaaattaaatggaaaataaaaattaaataaattttaaaatgaaaattgaacattaacaatttattttttgtgcagacagtcaattaacaacatgcggggggggggggggggtgctttgcatgatctccattgcgtggtcccttcactctcccccgactgtgcataggacaaagagtgaagcgacgccgatcctgagtacttgctcatcgcgtggcacaaatgtgggatcggagaaaccggagagcacttctggattcctcggcagttcctcgttaagagcaaggaagagctgatagactatgtctatcctaacttccaacaactccttggcaatgacaaggagctgctcaatcgtttgattctcgctccgcacattgacacgtgcgacgaagtcaacgacatcatgatggcgaatgtgccaggtcatatgcgggaatacttgtccacggataagccccttgacgaccgcccactggacatcgatgagatcgagtccgaagtggctgcgttgaaccggcgcacagactcgggcatgcccccacacagtctccggcttaaagtcggatgcgtcgtcgtccttcttatcaataaaagtgataaggaaggactgatcaatggcacccgcatagttctggaagaacttggcgatgatcgcctcattggtcgtgttatcaatagcaatgctattggcggccaagtgaagttctttcttgaaagaacacgaaatgtctatgaagacaaatcgcctggcggcataaaatatgagcgtttgcagttcccaataaagcctgcattcgctatgaccattcaaaaacgtcagggccaaacaatccacactgtcggcattg

SEQ ID NO: 3362 - DNA, 963 bp, Heterodera glycines
gacagacatgttcacaaaagaatggttaatggcgctcagttggcttttggtacaacagactccacatttcctaaggggatatttatgacactttcggaggcattagttagaaatgcactcaaaggaatgattaatgaccctccgtaggcttaggcttcggcagaaatgcactcaaaagaattattaaagaccctccgtctgccctgggttggtcgaaaatacacttgaacggggtgattaatgactctctgtagactttgggtactcaataggctttaggtctcgggactgaagtgtcccgtgggcactgggagtgaaatggctaaacttaaaaaataactctggggctcaaatggtggcactgtaaaaataactctggggctcaaatggctgcgctgtaaaaataaatctggggctcaaatggcatacgcgagcgcagaaatggcccacactcgtgcgctcagatggcatgcgtcccttcccttccctataaggcatgacagctgacgcccatcctctgcctccctttccttctctaataggatttggccttgggttttatccttcagatgttttttcaattatttacctcttctgggattggatatatttattataggtgttttttaaaggtttaaatcgggtactgaaatgtccctttccactgggactgaaatggcggggctgaaatacaaccccgaaaatcttggtgagtaactactgctatataagcatgagtaatgcttttgctttttgaattattttttgaaaaattcaatttcgaaaaatctgacgaaatgtttttcaccaaattagcatttaatgtttgctgattttgcagagaattctctaaaaaataaatgaaatgagcagtgaaataaatagagggcaaaatggtattttagaaaagaaagttgcccaaaactgagctaaaaatgggaaaacattaactaaaatttccaa

SEQ ID NO: 3363 - DNA, 2429 bp, Heterodera glycines
  misc_feature (26)..(27): n is a, c, g, or t
  misc_feature (90)..(90): n is a, c, g, or t
  misc_feature (94)..(94): n is a, c, g, or t
tatgattttgatcgctcactttccgnncaattcatggcgtaaaatgcgttgaatttcacaactttgcccatcacatgcaacttgtgtttntatnttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcattcatggccgtaaaatgcgtttgaatttcacaacttttgccatcacatgcaacttgtgtttttattttaaacggcgtg

SEQ ID NO: 3364 - DNA, 961 bp, Heterodera glycines
aatcagatactgtatccatttgcaattaggacaaccctttttctatacaaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagactgtatccatttgcaatttggacaacccttttctatacaaaaaactgggtttacggtcatacagcgaccgccatcgcctttatagaaagtggccataaaatcagttcgtttaaagagcgaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagcgaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcgcatgcaacttgtgt

SEQ ID NO: 3365 - DNA, 9113 bp, Heterodera glycines
tttgtcaacataatcttccattttcttgaaatttcctgcaaaatttttttttttccaattcctgggggcttcaaaaaagtaccgactgcccaacagccccgggctcctatcgtcgcaattttctgtcgctttgccacttcgcttagcgttgcgttcagaaattcggcggcgactgcgtccaccaacggtgtcggttgcctgggggcgtgtagttgagggagtcgggctccgcttctcctgctcgaccgtttccgtaacaattgtcgctgcggctgctgcttctctgtggcgctgttgaagttggagttgtactggttgctttcctcctcggcgagtgctgtctcacaaatgcggtccaactgactccactgaccgagcgcctccaaacagcgcatttggtgcagcaaaagatcggagcgagaagactaaatagtcaggagaatgctttgaaaaataaacataaaatccgtgtgtttgtactccgttttgttgctgcggtgtcgcaattcgattcgtggaagcactggcggaaacggcggcatcatcaccgagtcctgcgtttgcagtgggtttggactggtccaactcctctctgttagtcgggagcaattggggttcactgtgtgacgaaatagatttccatgatagttgttcgtcgggcaaggtggtcatgtcgttctgatacatctccaacgccttttcccattcgcctaatttttcgtaccaacgaccctaaaaacagttgaatcggtgagcaacgaaaaaaggtattaaaacccatgttgagaaaagaaagtcacgacttaccgatatttccatgttgtgacgtttggcatactgaacaatgccggcggcgccttcttccagatttaatttgttgaatagcattatcatcgtttgacagtcatccgcgttcggttctccgttgccgcgggtgctcaaaatttccatttctttgtaacgcagtgcttttgcgtatgcacgtgtcttctccgccgattcgctgagcattcgatgtttaattggaagaggtcccttaaagaataaacaaacaaaaaaaaattttttttttttactgcgctttgtttattgccttctcagaatggtccatgaattcggccaaattcagtatggtctgaatgggttcggcatgggggcagtgcctcaacacatcgatcagctgattggtcagttcgttctgttcccgctccggcagttcagtccaaacggacataaaagcggcattgaataattccctgtaaattatttcattaaaaatagaaaagtaaggggaaaaagaacggactttgagagtgattcgcacatttcggccaacacagcgcaggcgcgaagtgcggacgacggactctgacggatgaattggttgcgcaaagtgccaacccactgaagccaatcctcacgcgagagcagtggttggaccgtccaaaagcgacgcaattggtccaaattgatggccaagcgggaaagatcacggcctaaacccaaccattcgtcccggcattttcctgttcgccttacccgaagacattctgtgcactcgagacatgtccgcactgcttccgccgggcccgggcaaaaaaccgacaattccgttgtttgtgtcgggcaagggcgaagtgtccgttgtcgccccgccgttttgcgtcggcggtaaaaaagacacttgacgcgcgaataatggtgatgaagtgctggcactgaatgtgccctgttgttgttggtaaacgcctccaccactgccaacggcattctgttgttgctgctgctgttggcgtgcgtatgaaggcgcctggagaagtgccaactgttcctggtactcatggcacagcattggttcgacacgacaccgcaccaaggcggcatttacattctctttgtacacagaaaactgagtccatttctgaaaatgaaggggaaatgaactttttccgccgaaaagcttaaatgaagacgaactctgacgatgatgccgagtaactccatcagtcgcggctgttgagacttgatgccaatgcaacgaagccatgtttgcatgacgggcaaagcgtaatcctcgatggaatgtcgacgggccaactcaagcaaagtgtccagtgccgacgtacgcactttctcctccgttttgcggtcgtccaatacggacagaattggcggcagaatcaaatggacatgggagccaagacaagcagaaattgtacgggcgcatgagagagcctgacaaaaggtcatttaacacagcatataaatcaatttgggggcaatagttaacatctaaagcacttaccccgtgcataaacccaaaattaaaaccgaaggcaccattaaaatgggcgttcatgaaaataaaaagcaaattttttatgctaaaagaaaagggtagtaaatgtagcgcaaaaaagttgcgcatcatgatttatttcaaattgatcagtttgcgggtcgcgaaaaagttataaatcgccgatggatgcaaattgctgcattaaatgtcatgcaaaaaatgtatccacggctttttatttaacgcaaacttattgttagacatttttataaaatctgtcaacaaatttaatttacatggctagggaggggtaaacccaatgctagactagcaaatcttggcgggatattgtcagtgctatacaagtcgacgtaaaaaattcattggacgcataaaaattgaatggacgcgtaaaaattaattggacgcataaagtcgattgaacgcataaactgtacttgaaccgggaaagacaccatttaaatagacagaaatgactagagaccggggtaatgggtcggggtcacttcggcgcggaccatttcggcgccgcaaattttgaaatgctataacttttttatttgtcagttagctttagccaatctagcatcatttgaaagctctatgtgtgctctatatttacatgtaaaaatagaaatgaatgattcaaaaataaaaaagttatgccacgcgacgccgaaaaagccaagaaaaagtcaatttttgaggttttttggccataacttttttgtaaactgacgaaattttttgaaattttacaggctaatagagaatctgaagagctatcaagttgttagcaacggcgccgaaaaggccggcgccgaagtgggcggttcccgtttcttcccctaccgtcgtgtgtaatttgttgtcgcgctccgtttgcgccccttcagctgcgtcttctcaattcgtcgtgacagccgacaggtgcccatgccctcgcggatcagacgttcccgctcagaagcaacgcgaaaaattttgaaatacacgaaaagcattaccttaattggggcggaagatttgatttagaaaatttttctgttagcaattcgactcgaaactctacgaaaattgaatttaccctaaaatcgagacccaaaagcccgagaaactcggacttgagacccgatattcgcgagaatccctagtatttagttaaaagcaatatgcgaagatggaataaaaaataattatttgtgatagatcagcaaaatcttgttaactcaaacaagaacaaaaaaaaactcatcagttatagtaattagcgtttttatctttttcacgaaattcaatgtttaaatgggaactaatcatacctaataaaataagctgaaaattgattatgcctttaaaatggaccaattagcatttcactgaccaccaatgggatgtagaaggagacggaagcactgtagatgcggtaagacacactcgtcggataggcacattggtaggttccgtcttcagctagtggtgccgtcctcgccggagttttgtggccatgccgaaccaaatttatggtggaaaatgatgatgatgttggcattttgctgttaaacgctgcccgtcgtggtgttgatgatgacaaattgagtgcagaagcggccaatggtgccgaagaagacggcggtacttttgtgtcaaaggaaatgcgccattcgttgacaaaccacgggggcgagcacacaacgaaagccattccccagacggaaattggagggagagaaagcacgaaattaattttagagaacgaaatatttaggtctgattttgatttttaactttttttttctgcgctttgtttcgataaaaatacccacaaaaaaagttttagccgaataattctacaatttaaagccattattcgtcattacaaataactattttcgcgttcgttaattattgtaatgaaaaaaaaatctttcatttaatcaattgtaatcagtgaattaaattgttttccgcgattttaatttattcccatagaaaaaatatttcaatatataccactattttgtcatttttatcgctatttttcattaattcgacattttataattttcttgcttttttcgatgtaaatctgagaataaaatatttctttataataattactagggtcgcggcttttagtgacgaaaaatcccgaaatagttaactaaaatagtgacgaaaaagtgcaaaaataatgaagaaatagtgaaaaaagtccgaaatatgtcgaatagtgacgtaattttcagccaaaaattaagcaaaaataatttttattcctttataaaattctcttagtaaatattgacattttttatatcaaaaattttgtcaagaaaaaaaatttgggggaagaatttttgaaaaaattttccaattcttagtggtgtatttaaaaaaaaattttttggtcgattcttaggggtgtattttttgaaaaaatttttaggtcgattcttagggggtgtattttttggttttattgcatttttgttaaagaattttccaaaaaatgtcgaaatagtgacaaaatagtgacaaaacgccaaaatagtgatttttaactattttagtgacgaagcgctaaaatagtgatttctagtgacgaaaagtgacgtccaaacgaaaaaattttaatgtagaaatgggttttttgagctcctttcttcaaaacaattgagcaaaaaaaaaagttttttcactagaaatcccgaccctaataattaccaaagctgagaagtgcacaagccatccatcgtctcctacagaaaagttaacttaaaaataaaataattatttcaagatttgcctcgttctcggatagcgcaatgggcttgtgatggccatatacctgcaaaattaatccagataaaaaactattaaaatagacaatattttatttattggtaatttttggcaattcattacaatatgatgattaaaattacctgtcaagtgaaataatgcacaaattaaggatggacgccgtgcagagaagcacatcaaaagttgcccaaattcggcacaatgccctgcccaatggccaattgtggttgtggagcaagtcgaacagtgccaacggcataatcaataagcccacaagcaaatctgttcaataaaaagaattgattcaaatgtgggcattagagctttcataattttctagtgtaaaatggaaaattgaaggaaaatttaaaaaaaaagtttgaatttacaatataaaaaatgaccagctgttgctaaagaagtgagcaaaaaattggtgaaagtgcgcatccgtttgtagaggaacacagaaaggacgaccaaaacattgccaaaaacggtggtgagaatgagcaaaatctgcaaaatttgcatagtcaaagaaagcataacaattagttaaaattaggttggatttaaatatttatcaactacaattttgtaataaaaaatatctggtaaaaattttgatacaaaagaataaactgttttttagaaaaattaataaaatgaaaataacgaacaaaaaaatcgaaaaccattctcaaaaatgatcatttttgcggatcactcgcaaagagtgaacgaaattaacttggataagctcaccagaacaaaggcgatgaaaaggtcggcaaagcccagacaaacactgtttgatcgctgctgaccagctgttgttgttgtagcaccattggcataattagcgaattggggggacagcggatgattccctggtgccggtgatctgccaatgacggatgtgccaccggccatggccaaaaccgacagaccaatgccggccaatccgatcacaaaaagcattaaaaatttaacgacaaatattttatcagaggcaaataaacatggcttaatttaaaataaagtttgtaattaattttgtcaatctgctcagataattatttattgattaattacacgtgttattagcccccattaaaagccaaacataatcccgaaaatatggggcgtgcttttaatgagaaaatattctttcagtatattcgggatgggattaaaaaaccaacccacacaaattataacaaataaatgtgaataagtggtaaagatttgggaaaaatcacgtgaaagcttttcttccattgcaaatgtaaacttttaaacttttatttttgaaagtgcgaaaatggaacaatcttctttttttattattcatttcaactaaaagcaacagttttgtgcgattgataaaaggaaagtaaactcatataaataaaaaataagaaaaatatccgacaataataaagagttaaaaatatattcaaagatgagaggattctttctatatatacatgaatcaattgagatttaattttcttaaattttaattaagcaaagcgcaatactccgactaaaattgcatatttcttctcttaaaatattttaattgtatcacaaagaagccaatgaaataaaaaagtttactgaattaaatgacaaatttatttaaattcaaaaatatgaatccctaaaaaagtgacgataagccaaaatgaaaggtcaaaaacgatcgggattaaaaagaggaagtaatttaattagcaaaaaattcataatatttttcagatttaaaaagactaaataatttggtctaattcttttatgaaaaaccaacaataaagtgacttgcttaaaattttttgagggttgttcttaaaatgtaacaaatgactctcccccgctcttggccaattattcccttctctcccctttcatcagcggcaggtgtgacgcaatgaatcataaagaaaaagtgtcattgagcccagagggcattcatttgaaattctcagaatcataaataaaacaaaagccaatgaatgagttgagatgggaaaatgaatggcatatttttagttgcattctttaaactttttggctgaaaatgaacttttaattttagaaacatcttttttttctattcaattaatactttttaaaattttaatcaaatgaaatttaattatattctttatttttatgaatatgaatttaaccaaaattattaaaaacaaaaatgccaattatgtatttaacaataaaattgcaatttgaatagattttaaataaaaaatatatataaatttctaaaattcaatccaaaattcggcggaagatttccattggaatgttttaattaagcgcactaatcgggtcacaaaatcacttagcaaaagaagcagtcagataaggtcgggacaacagaacagaagattgcccttaaataatttcgcgccattttcagctccttttttggtcattggatttaaaagatattaaagcggcggcggcggagggacggacagacggacgatgaatgaatgaatgaggggaagaagcgggggagataagcgtacagagcagcgaaatttacgcgcccaaatcccccggggagagcttaaggcggggggggggggctaacagggaaaaattggaatttcccaggataaattgtggagggttagaaaataatttgtgggttaaggacaaattttggcgaaaaaaagtgtaaggcaatggcagcagcggattattattggacagcaaaattggggaaaatgaaatttccaaataaaagaagggcaaattttttagggattaagcacaaaccaacaaaataatggagaatttgtaggggaaaaatgcgatggtcaacgaattcattcaggcatttgaaataataaaaagtcaaatttgcgttatattccaatatgaaacaataaatacgcaaacgccaaataaaataatgtaacaaaaaaaaaactaaaattgtcattttaattgaaatcagcatttttctaattaggcaaaatgaattgtttaaaaacatttgttttgttttttatttgacattttccgctaataattcattaaaaatgaacttttcggttaaatggatgatgatgatgaataaatgcccttccatttacacagacattgcttatttctttagtcaaaaccgttatttatgtgcaatataataaatggacgcgcccattcatccaaaaaaaaaaaatttaaaaaataagaggggaaaggacaaataggaaaaagggaaaaatgctatttaaaaagtttaaaattttaaaatacacactaatcaattataaatggaattattgattataattttaaattttattcttggaaaaatgctcatttaatataataaatgagacgaaaaaaagaaggcaaggcaaaaacagcgaaatggcataggacaaaaaagcattcacacaaattcttcgccttaaaatagaaataaatgaaagcattaaacaaattgacaaaagtaattcagctctattgaatgctaatatgaggaagtaaatttatgaataaataaatatttaaaaagtaatcaaagaaaaaaaaaaagaaaatttaatgaaaaaaagaataaaacaaaaaaagaaaaattttattttatccttttttaattttttagtttaattataaaattttataacattcgcacttttaatctcataaatgtcaaaattttaatgttttttctttggtcgtatcgaatggcaatttgattattcattttccactgctgcacatcttcggcaaatatgcacataaaacgacgcaaaaattttggtcataataaaaaaaaattgagtgggcgaatgagacggggacgggggggggagagagtggtcaatgggagaggaagaagatgcaatttataggggagaaaacaccggcgaggcgggggagggggaggggaagggggggccggaagccgggggggggg

SEQ ID NO: 3366 - DNA, 405 bp, Heterodera glycines
tccataaccaaaaaaaatccccttagactcgaatctaatggcgggagcgggggggggggaatggtgccaatgccaaacgaagacgcgaaaatattgatggatttggcataatactcacattttgacgccaagagggagtttttatttaattttaaaatcattttttgagaccacccatttttaaaaattaaatgttaatcggtatctctggcgcaattttttataatgaaattgacccaaatatattcgttggcatatttttcccaattaaggatgttttcaaaaaaagaatgaaagatttacactttgaatttcaaaaagaaatgtgcccatcagcataattgggaggataccagagtgttatgtgctttatctcatgtggattttgcctggaaaatgcgacaa

SEQ ID NO: 3367 - DNA, 4084 bp, Heterodera glycines
  misc_feature (1474)..(1474): n is a, c, g, or t
tttaaggcgaacatggcactgtcgcagtcgcccggcaaatttgaactgatgtccggcgttgatcaattcttcccgcgtctgcaacatgtactgcttgcgatgctcgcggacgatggggccggagaggaggcgcgcaatctgtccaacaaatgcatgagcttaggttggctgcaatttgattaattaaccttgggcatatatttgaaattctaatattaatttgccaattttaggacataaaacagaatttaattgtaatttatttctatttatggatttattattaatttagtctccaatttaccgtatttcctaaaatatagcccccggggctttattttaagggggggggttataatttaggggggggggggctatatattaggaaatacggtattttaatttggatgttaatttttattttgctaattcccctcccttttccccagtgattgccaatcacaacgatccgaatgccatttttttggtgctgtccgatatgagtgcggacccggaactgatgcttaaggacgacccgctgctggatgatctgatagagaagtgctgggcgcgggacaacaagctccaagggcgatcagcggattgattcgtccactgggccataacgatgaccgattggtctaatcgtcgatcttttttggacattccccttcattttatattggctatgctttatttccaattagtggttactgaccactagattttctactttccgagaccataagactgagaatttacctcgaggctctctgattgtgagtcgaaaccgacacccagaaaccagagaaatagaaagcataaaagaattggtctcacggatcctaatggccatttatcacaggttcacgagtatgctgtttcctactcattgaatattaacaggaatttattgaacaatttacaaaaaatgaaaatatcacaagagaaaaattattcaaaaaaaaacattgttatagaaatagatatactttgaaacgctcatcattggtcgttatgatccaatagtgggtatacacttcaaggtagctataccagctctgattggcaaaatgagcgcttgtgatcccgacgttaaggacacatccggcagatgtcatcgaactgacatgtaccatcacaaaacttctgtaacgatcgtctgatgtcaatgggccgacagcactctcaattttttctgtcaaccgtatcaggttgctgattttgtcattctccctgaacaatgaagcaaattaacaaacaaacaaaaaagcagcgtgaacaatttgaattaccttatcatttttccttctcaaataaggctgtaagcctaatgacacattgagcccagcccaccccctccaatgaactagagacttgacttcaataaaacgcgaaaaatattttacttaataaattctgtgagtgcagtttgcttctcttcaaaccattttgttgcaaaaactgctctttnttcttcaccaagcctatgtcgcacaactacaatgttaatgccatggtaaagatgaattgccaaacagtgctcaaaaggacaccgcagccaaaaattagcaaatcggtcccaatttaacgtcacgaggacttgtgacacataactaaatttttttcacaattagactgcaatgtttaaattaagtttacatattaatttattccacccacccaaatgggccccgagaaacgacttcatggttaatgatgtcagctgtgtaattgtacaagtatgggtccgtgacatcagcagcaatggccttctcaatgtgcctttctatttccattggccatgcgtcactctatggcaaagattggattaattgagcattttttgtgataaagatgatacagtcccccattactgtattatatatttttaatttatttaccagttccatgctgacccactctgaaacattccctaatatttctttggtgatcaccgcaatttcctcaatctcctctttggttttttcgtgatcaggagcatgggagaagttcgcgcacaaaccacccattaaggcctaaatttaaaacgaactacaatttaaatatgcgaataatatgaattagcattgtaatgagtgatagtaccagtctaagtgcatcatgtgttacgacttcggcaaatcgcaaaagtggccgccgcctggaagagtaactctcgtagacactgcggagaaggcacctattataggtatattaaaatactgtaattgaaaaattaatatttatttttttaaattcacttgaatgaaattatttttgttggaattaattttaaacaaaaacaaaggacaaaaacaaacgtttcgggagtagggccttttaacagatcagataaagaagtgttcagttccatcaagttggtcgaattgtttgtagccatttttccaaacactaaattttcgctttagcttcgcttacccataggatgatagataaaaaataataaaatttaagaaatttaaaacaaacattcccgcaattttgaaacggtgtgttgcgcttcgctcttcgagaacaatgcgaaccgttcaatcgtctctaaaataattcattgattgataaattatcttaggccacttattccactaattaagtgagcttacgcaaataaattgcgcagaaagaaacataatcagttgagcctttttggtctcttaatcgccggaaaaccgtatcaaagagccgtttggttttgttgacgtctgccaaatgacttttggggattgaatggcagttgacattcactttttgattaatgtactgtgaaaaatattatgattatttttaaaaattaaaaatccatctgacatttaaaacaaattttggtgccaaattccactcagtgcatgcataaaaaaactcccttttccatctgcgcactttcttcgggtcaagaatctttcggaaaattgaggaaagcgcattcattggaacgtggacaaactggggaaattttccatttccttaatgtttttaattggcctaagaatgaccgtgtcatagtcgttcagctcgaatgccgctcggattcgattcattccgccttcgattatgtttttttgttcggtgaatcttcgctcaacttggtcatgcaaaattccgagagccttgagaagagggtcctcgggctaaaatggatgcaaaacgcttagcagattaataaagtacaaagtttattttaaatgatcaaaccggaagtagctggtcaatgcacgccgccaggatgctgcccgcggggcctgttaatttcatgaaaaacttactgctctcgctgatccatttcaggtggtgaaggaagtcaaatgccgggccggaaagtttgttgtactcggccgtcaatttgctcaccaccgatacagctgaaaattgacattattcttggtcctcgtaaaacgttccaaagaaggcttacggtcgctgtccaaagtttcgccggtaatttttggtggacccaaagcaacagccaaccagcagcagaagcaaaacacctttagcatgtccgaaaatggccaaattacaccaagaaaaatttactgcaattattataaattaaaacagtttattatttttattaagaatttactgaaattttattaaattattcagaatttatagtaatcactccgtttcagttattattgccatttttattaccactttttcctaattgaccaaagtgaataacaaattggtttggtttgctatcagtaaaggtaattgatcattatttcaatgggacaaatgggacaaatggttcgttgaggacgatccgcagaattggacaatgtttcttaaaaaaagacaaggataaatccagcagaagaaaagagcggttgaactgatagtgatcactgggaatggatttttagttttttagctattttttctgcggttttatttcgacgagaaatacacgaaatacatttttagctcggaaattcttcgtcttaacgccactatcatcactaggaatcactattttggggctttgccactaaaaaaaaactattttggaagttggccactaaaatagttttttgccactattttgggatttttt

SEQ ID NO: 3368 - DNA, 1746 bp, Heterodera glycines
ccccccccccctccctctctctctctcggttggaccgcttaactctttggccattatccggcaatggagaagagacttttggcgctgtccgccctcaaaaaaagagccgaaatttgttgctacactttgtttttggctttttgttggcttggccaattcaaactgcttgtgctttctcacggccgccgtttgaagtgctgcgcgttcttcaatcagcagtaccaccgttttcccccatcgtcgccaaatgatgcaaaatgttttggacagacgcataaaaaacgcgattggggcgggcacttcgctttgtccgctgtttcggtgggcccattgatcgcccaaagctcaaaaaaacagcaaaatgtagcataaaatggagcggatgttcgttctcggcatcagtgttctctcagcttctcctccgctgtcttttcttctcccattgcttttggctgaaaattgagccaaaatacaaagaattaaaatttcttatacatattttgtttattttaaactgctctttcaatgttggcacattatttagagcacacaattaaaaagtggcatttgattagcaatggcttaatttaatattttcgataatcaaaagcactatggcaaaggagagatttcaatgagctctttcgattttcggatcaaaatcttagcattaatgagtttttaatgaggttcccctggtttaaaaaaatctgatcggaatttcaaagcatttaatgccgatgccatcatacaaattccaagaaatttcagcctgattctccaaatgcgtctttccgttctgcttgcctatttgtttctgctcctccccgggcccggtggcgcccaatttggccaattgccaataggcggcggcgctttacccggcggcgccacactgcgctcaaacccgctgattaatggtaaaaacggcgcggcgaacattgccccgccgggtgatgaacaaatgtgccaacaaccgctccaacagttcgcccttttgcccccctcccaaacgtcggcacggcgagaggagcgatgtgagtgatcggaaagtgattagaaaaggctctaatcaatttttgggttgtcttccgcaaatattgacgccttttaaaaatgacgcaaaatttcaatttaaatttccctgggttttctaaattttctcccattgccttaggctgttgctgttgttgcccccagcaacaaaatcaaatgcctcctccacctcggcctccgtcatgtgaattttggaaatttatcaaagccacaaatatttttgaaagaaaaaaagagagaaaaaagggcattaatcacattcaaaaataatttaaataatgctggtctacccacaaaacaggctgctgtctctgttgttgtcctcagcaacagcaggcgccgcctccgcccccgccgtgctgcgtaatttgctgctgcgaagaggtcgaaatttttcgaaaattttagtttttggattttaaattttcagcaaagaccgccacctccgcctccaccgccgattatccttcagcctttgccgcccccaccgcccccgccgccgcagggtaaatttaattaattttaaattttacttattttttcatttttctaatcataaaaaattcgattttttcttccttctgcttgtacagtacaccgttcccgttattaccattattaccatcatttacagtgtgtctgttgtgctgttgtgagcagcaagcgcctccccctccaccgcctcccatg

SEQ ID NO: 3369 - DNA, 4122 bp, Heterodera glycines
  misc_feature (31)..(31): n is a, c, g, or t
  misc_feature (3169)..(3169): n is a, c, g, or t
ggaaataaaatgcaaaaatatatttttgtgntccctttctcaaattcattcattggttcgtccgttcgttggggctgtccaaaatgccaatgcaaaggcacgtctttcggcagaacaaaaattgagtggccctgttgatgtcgcaaagtccacctgattaaaaaacatttaaattcttaaggatttttattttatttttaaatttaatttcagctcttccgactttttaaggggaaaataattcggggaatggacagttggaaccatcttccaaatgagtctgtagttgtcaaacaagattcgatgaccttttgcccactcttgacacatgctctcgcccctctcatctgtctccaaggcacagtcaaacacatacggtgtccctaaaatggtgataattactgtaccccgaccttttatggcttggacccatggaaagttgttaattgagaaatgattttaaaaataagagaaaatctgctgccaattccctctttgcccacattttttgctgatcactggtgccgacgttgtccacgggaaaatgtcttaaaaatgacacaaaaacatttcgccaagccaaatttgtctctttccttactgccattatccgctgcagtctctgccgttacaatggaattgtcggcggatggaaaaggcgtcgactcagtggtcaaagttcggtccgacgaaatggcatggttttgaatcagttgaactgcaaaaacaggcaaaaatgactatcaaaatatcaacacacagttggtcaacagatttgttaattgatcggaaattaactagtcgtcgactaattagggctaattaatgataattgccaaatgagcgctaaattccccgtttcaatggtcggcatccaataaattataaataatattaaaatttattattataattcgtacagttctcctcccgcaggtcctccttaagaatttccagtcccccgttctgtgttgttgttgtagttgttgccgttgttgtggatgctaaatttaaattttaaatttgctttcccttggcattgtgccgctttctctctttgcccaccctcttcgatcactttccaattcgctttgaccgtgccgctctcctcatttgccacttctgcttcatgttctccgtccgccactgtttggcgtattgagtcgtccaatttattgtcattgattccattaagggcatttttctccggcttttgctgttgatccttaaaattaataatcgctttttatttttctcttaattacccctaattaccctcaactcagtgacgggaagcaattctggcggctcacctcctccaattccatcaattgatgcagcaaattcagtcgtcacattgtcactgttgctttttaataagcgtaacaaattgcagcaagtatcttctaaattaaattaattaattttataaatttatgtttaattgtccaatttgttccattttacctccattttttgtcttgacaaatttgtccgttttattcttcgggtgttcgtccctctgctgtagcttctcgtctcccaccatattctgcttctcgtttcccatgccctccagcgttttgttgcattccgtcggcgcatcgaaattaatcgcattctgttgctgttcgatttctgtatttgctgctgctgttggtaattcttgtcgttcgattactgtattggccgcttttttaaattctgtttgaaccggtgctgccgttaccgtaccatttccagttgccaattgcaacatttcggccttgttgccactgctgctcagatcgacagcagccggcaaaatggcctccggtacctccgtatatacggtgtccaccaattggggtgccactagtgctacggtactttgctccgcttccttttccgttggcactttgtcgtcggcactttggccctccctttggcactttgttatgtccaaaattagctgctgcctttcagctaatgaaccgttgttttgctttttgctttgattggcttcattgggcgtgaaaaaatcggcttggccaagatggggcggcttcaactccaaatcgaccgccgaccaactttcctcctcccttggcctgttgttgttgttgttgttgttgttggaggaggaggagggcacaattggcaccgacggcggcgcggaattggccaattccgtgcgattgataaagggaagccgagtgaaagctaaaaaagttaacaaatgccaaattgcatgtaattaagccaataaagggaattaaacttgtcaaataaaatcagtaaatctctttttaaaaaataaaaattcgctttaaaaataattttgaaataaaaggattattttcaatttttatcccatgaaaggccattattttcgtgacgggaaaatggatcagtgcaaaataaatttagtgatcattgcttgaaatgaaaggctagtatgatgaatgaattcaaagtttaagcctcaattggtaccgattaaacttacaataaccgaattacagtagttcattttttacggattttggttcatttatctgtccacgataaaaactcactccaatattttggcagatcagtgtcattccgtcctgggctgttttttgcagagattgtcgacgtttcgatggacggcccaaccccttcaaatattcgaatttacaataaaaaatttcatttaaaatgatcatgccatttttatcggtggtgctcaaatcgatgctattattaatgatattcagtgccgacggttgttgcgtttgcgatggcacgtcgaattcgatcaatttgttgttgttcagcaccgactcttcgggaaaagcgaacccgggcgacgagggctcaaagcccgggggtaaagtgccaaaaaccgggtcaaaatgtgctggtggttgttgttgttgttgctttccttggcccacggttggaccatttttaagcgcagcattggacagtgaatggtttgaatttggcgccacggtcgcaacgccaacgtcgccgctgaccccggtgaacttgttgcatggtttcagctgatttctgccaatttcagccgattcttccgctttagatgtccaactctattcaaaagaaaatgacaatttaatttttaattaatttgctcacttctatctgtgccattgttttcgctgccgtttccaattccggncacttccatcggttcgttgctgctgaatttggcattctgtgtctgatcttgcgcttctcctccgctactcctttccgcccctctctgctgttgctgttgttgttggcgttgtgccattccccgttgcctttcgtcgtttaatttttgtgccgtcactgttattgaactgctcgtcgtcgtcatcgtcgtcgttccttctgggatgcttgttctcgttctgctcgtgctgttctcctcagcagcagaaagagcaaccgcggcacgatcaaagggaaatgaattgtcgtcggacttccacgcccattggtttaattgtctttcctgttgctgttgctgcggtggtgaaatgccatttttgtcatccgcataaatttggtttttgatgccaattccaatggttttgtttgtccttgccgctaaaaatcattttgccgtgatcagattttaagaaaagaaacgaaaactattcttgaattcattgagaaattctaaactactttattgaaattaaatttgttctttagtcactatattaaaattataataggaaaattaaaccaataaaaaattcggatgaaatccgaagcaaaaattaaaatatatttaaataaaattggagctttttttcaattttcccacccctttgcgctggccgatgccgtcgctttttgccatgaacgccgtccatgttcagcaacaacagcagctgaagaagacaaatggagaacaagagcaacgaaactgtgaacgatcgcttgtcattcatttttgagacctaattaattaaaaaaaacagaaatttattgaaaaacaaataaatccgattaaaaattgaaacccaatctcgaattatcccacgaagagaacaaagaaaaaaatgaaagcggataagtgaaatcgctttgtcgtcacaatgatcccgtcatccctcgcctcccatccgatccaaaatc

SEQ ID NO: 3370 - DNA, 1732 bp, Heterodera glycines
aaaaatatcattggataatatgtgcatcaccgggcgtcaaagaataattttgtccccggtgctgctcgagagtcttgggggtttttagtgcctaagtgcaaaaattgggcgtcaaatatcagccaaaagtttatctctcgaacaacacatatcaattataaaaattattcaaatcgtaaatcatttttctgacacggcatgactgatgatggcataacacggcacggaatcggcggctcatcgtccccagccccagccgccccatgggcgtctccatccgccgccccagccccaaggacggccccatccgccgccccaaccccacgggcgtccccaaccgccgccccatccgccgccccagcgtttttctctgggatttatggcacttctgaaaagcaaattaaatttacttttaaccaaatttggcatcagttttaataaggattatggactctactcactgctgatcagcgtggatttcgtgctccgaatcggccatcagtggcgcaatgacaaagacaaaaatggcaattgcgaacagaaaatggaggaaaagttggcgatggttggcgagcattatggagaaaaaagtttaatttttgggatggactgtttgttattggattgaatgaatgaatttgtcgcgaattgcgccccaaatttataattggcgtccccccgcctttgttgtctgtttttgatcaaaacgccgccccccccccggcaaaaaaaacaacaaataatcacattcaaaatttatgtattttgtgttgattcgctgaggtggactctgtgctgattgatgatgactgactctgattattgttgtcacttgtagcacattgtgatggcattggttaatgatctggtgcagttttgtgcgcgaataaatgattatttttttaattactaattgtgcgcgaattttgcgcgcattttgcccaactcgacgaattcaaataaaaacaaattcggcaaaattgtgtgtgttgtgccaaattgggacaacaaaaaagaaatatatgtgaattaattaaattaatggaagggaaaggaaaattttgtttcgaaataaaaattgaaaataaaaataatttactgaatttaaattggcactatgatcaaaaaggaatgaatgcaattgtattattggtaattgatcacttgtcccaaagcacagtgacaatgcctttgggcggaattcgcactttgatcacccgctggcgcttctcttcgatcacttccacttttgttgatcggtttagccgggagaggagcacaagcacacgtcgagacgatggtcgaaggaaagcgacaaattcaatgccattcaaatgcgcagaacgccgaccggggcgggtgccaacaaagtctgcaccaattcgaacagatcccggcgggatgaagcggctaagacagtgctgttagcatgcttaaatgtagtggaagctcccaaccctcggaattatgggggatcggggtatcgagggctaggctcggtgaattcgggatcagggtgtcgggaaataataattctggtcagtgaccacctgaaatgagccatcacgtaaaaggtcggctgcttataaaactcgtccgcctttgtgttcacaatcaccggtgagtccacaaaattctgagcccaacttggcccaccgacggtgtccaacctaacggaaagtgccatgtgagtgatatttatgcccaatttgtaactgatcaaaccatcagg

SEQ ID NO: 3371 - DNA, 4726 bp, Heterodera glycines
atgaattacttttatacaaattgggaaaaaattggtatacagtgcaaacttttgatgtggataaaggactttttgagtaataggacttttcgtgttaaaattggggatgctttatcctccagtaacaaagttggctctggcgtcccccagggctctgtcatgggccctttattatttttgatttatattaacgatcttcctgatgctttgccatcaggagtgaaaataaaattatatgctgatgatgttaaattgtatatttgttataaagcaagaaccgaaacagaaattatgcataaagcattgcataatttatcagaatgggcaaataaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaagtcttctaggatttggattattttgtacaaaacttatgttagaccgttattggaatatgctcctgaggtttggaatcaatctcttctaaaaaatattaaaaaaattgaaaaatgtcaaaaatatttcaccaaaagagttcttttcaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacgctttaacattcccttttatagacttaactcgaaatataaattaggcaaaaaatttataccttttgcggggcgggtaactaaaatttggaaccaactcgataaaaggctcattgaaataaactattaaatcaatttaaaaataaaattaaaagtcgaattattaattcattaaacaaaaagtgatttggtcgctatttatttatttgtattgatttcatattatattttattttttggcggcgatctcgtttttaattgttttgcgctttcttgaggacattttaattaatgttttgtcctcaatgtaagcggatttttcccttttgtggactttttctttattgacaataaacaataaacaaaaatatgtacaaaaagtgtcctcatttagtattttaaaaattaatatttggtattttttaggggtacattttcaaaaaatttttagttatttttcacatgaaatttctataaattttaaaaagttctcaaaatatttttaaaaaatgaaaatatttacgaaaaatttgccgaaatattggatttttttgaggattatttccagacccggtccgctcaaaatatgtaaaaaatgaaaaatgttagaaaaaagtccaaaatatgtaccaaataagtataaaacgtcgaaatatgtaaaatatgtaacaaaccccgaatatgtaaataaagtcccaacttttggactcaaacgagagttgaaaattaaatttccgacaaaattctcatttatacaccaaaaaaggtccattttttgtggaaatttccagcttgaaatttcgaagctataaaaagttgcttcgtacataaatatccatctttttttttgtaaaattctgtaatcaaatccgttttatcaccagtcatttttatgaacgattactcacaattaatgaattatttacatgcacataaaatgcaattgaaatggacgaattcgcgagcaaaacaaaggtcaaatacatacaaacaaacaaattataattagtattaatgggccagtcaattttgaaatattcgaactcggtccttttatttgtcttgtcgccatttttttttgatcgtcaacttatcccagagcgtgtccgacggtggccaatgtcccagccgaatgtacgtggacatgggctaccggacgaacccggcacggactgacaccaaagtgccgtcctcgccatattcattaccaagacaagaaaaggcggcagatacgcgaaccaagcgggatcagcagcagcttaagccgaatagagaaaggtgggacatattttatagaattgggaaattttaatcaaatgccaaaaaaactgatcagcgggcgggggagggaatgatcattgctgtcaattgatacgaggatgatcaactgacttttgatctgatcagcggtgaccacgataatcatttgaccattgttgatcaactggcactatcaaaatagtgaccaagatgttcaattggtaccaagatcggtcaattgaatctccgttaacttatcaatctaacacggtcaattggtctgatcatgttttaccaaactgatcagtgggaaggaattatttgtcattttctgatcgtaattttgtatttttttaattccaggataaccgaggaggaagtgcggatgttcggcatggatgtgactgatcagatggacagtggtgatccgacggagagtgatcaggaggggaaagccgagaatttattgcccaaaactggggttgaaaatcatcctaatttggcggtgaataattgcgccattccgtcaatggcattcgatgaatgttcacttttgtaattattgtagtttttttcaaatttttatattgaaataataaattttgaccagcagggcccccatctttccgtccttttcaaaggacgtccttatttgagtgccaaatatttttagaatgatatttcgcgcccttttctctaaataaaaaaagctcggattcgtacttgaaatcgactctcatgcgagaaaattcaaaatttgtctatgttcaagaataactatatatttcgagatttttcttcattaaaaatcgcgattctatagataaccgttgcattgataataaagaattgcgaataaaaaaaacaaagaaaataaatgttttatataattggaacgaaagaattattgtaacaaagcatttctgagagaaattgctgttgcttctcacccaatgggatcatttgcaccccacaaatcaaatcggatattgttcaaattggcatccgaataattggcatgccgtagagcaaatctgatatagttaaaattggcgcccgaattttcgcggtttttccacttaactggcgccgtcgccgtctccccaattgggcaccgttgcaacagccaattataaattatttcgttggataatgcttcgatctcctgtttcagtgtcagcttttctttcgtccgttcgttcaccaattcaaatggttcagttggcattgtgtccacacaaaaaaaaagttgaatattgtaacagacagaagtggtggcacggagaaatgtctaaacaaaattggtaaaataaaaacgaattgacgaaaatatggctagacacacctctttgaagttttgtccaaagcatcgccatcgtcaaagcccaaatgacgaatgtttgtcgcaaaaattggccaaatttcacggataaaaacatcccaaatcggttggacatccgtatcaattgaatgcacaaacactttcaatttggtgccatttctgtcaaagaatcgcttcttggagcggagaaatttgatcacggaatagtcaatgtacctaaagcaagagaaaaatgctttagcgtacacaaaagttaaggatgactgaatttgaaggttcttaaagctgattttgttgggcaacggatggtccggcaatggaaatcccacaaatttgccatagccaccaattaatatagacactttcggttttggtccaatattgtttgcttttggtcctttgtccttgcgaattacgacacttctccaaattgtcaattcgctttttctgtcgaaatgtttgtccaccaaaacatcgaaacggtcggaaagcaatgccattttgagtccgagttgaggacggtcaaaagatggcagaatgtccatccacacgtcgctgcaaagccaactgaaacatggaaaaaatggatgggggaaaatgaaaatttgtaattttaaatgaaaattttgtaatttttcaaaatatttgctgaccggcggttcattttgtggttcaatcagcacaggtctcaccaattttttcaatttaatttgtgtgtcacaaagggcaaaaaaactgtgttaacttaaagcatagacaattaggaaaaatgagagagcgcaaaaagaacacaaaatttagagaaggtacatgaaaagtgaaaaacagtaatttcacattaaaaactttgaaattaccgaaaaggagaaaaaatggcaattttatactaaaatattagcgtacatttgagtaccgataaaatgccaatgatttggtgagatttaagcgggccaggacgtttcgcgtggtcgttttcgcgtgagtgcctgtttacgactgaaattggtcggatatgttccaaacatccatttttcgaatcccgaacccgaattcgaaaattttctttactttttttgtttttttatttcctgaggctggtaccttctttaataatttgtcagcgatataaaaattcaaaaatttaacaaaaataacaaaattgggaacaaactaaggacgcatttggcgctatattaaaagtgaccagttttgaaaattttttcaaaaggggggacccttttgctttgcaaaatttttatgtgat

SEQ ID NO: 3372 - DNA, 2873 bp, Heterodera glycines
cttcttctgctagcggcgacaatggtctaaaattattttcattttttcgacaatcaaaaattgcttttgctgctcacccaatgcaactatttccaccccacaactcaaatcggatattgttcaaattggcacacgcattattgccataccgcggatcaaatctgtaatttagttcaaattggcatccgaattttcgcaattttcccacctaactggcgccgtctccccaattgggcatcgttttaacagccaattatatattatttcgatggatgattcttcggtctcctgtttcagtgtcagcttttctttcgtccgttcgttcaccaattcaaatggttcaattggcattgtgtccacccaaaaataaagttgaatattgtaacagacagaagtggtggcacggcgaaatgtctaaacacaaaaattggtaaaacaaaaggtttcatggcaactcgtacaaaaaaaggtacttgtgtgttatctgtgggcagattttaaaaatttttatgtttttcgctataacttttttctttggcatccaaatccaagattgttggtatcattcgaaagctcttcatatgctctattagccttacaaaaaatgaaatgattttctagcctggaaaaaattttattaagaaaaaacttcataatttcgaccttttcgcaattttcatgtttttcatgtataacttttttggtaattgtttgtacgagttgccattgaaaagcaatgccaatttcgggggggggggggatctggaatcttggaattttctgggtcccaaaattctggattttttaataaattaaaatttcttaaattttttgcttttaatcgttgtttttgtggcgctgttttcctaaaaaaaaggaccgatcatttttgagttacgacgaattggattgatttgatgatactttgttttttgctctttgggcgtacgatataaaagtgagttttgaaaattttgaattttttgttaaattccgaggttcggaaacttaatttttaatttaatttaattagtaaggttttcaataagatattaagtgtacatatgttttattcgaacgaaagaatcaacaaaagcatttcggagagaaaaagagagcatcaaattgagattgatcatttctcaaattaaattatttttcaatgctttcatccgcttcttcttccgctggcagcgacaatggcctaaaattatttatattttttcgacaatcaaaaattgcttttgctgctcacccaatgcaactatttccaccccacaactcaaatcggatattgttcaaattggcacccgaataattgtcatgccaaggatcaaatctgatgatataattaaaattgacatcagaattttcgcggttttcccacttaactggcgccgtctccccaattgggcaccgtttcaacaaccaattatatattatttcgttggatgattcttcggtctcctgtttcagtgtcagcttttctttcgtccgttcgttcaccaattcaaatggttcaattggcattgtgtccacccaaaaataaagttgaatattgtaacagacagaagtggtggcacggcgaaatgtctaaacacaaaaattggtaaaacaaaaggtttcatggcaactcgtacaaaaaaaggtacttgtgtgttatctgtgggcagattttaaaaatttttatgtttttcgctataacttttttctttggcatccaaatccaagattgttggtatcattcgaaagctcttcatatgctctattagccttacaaaaacgaaatgattttctagcctggaaaaaattttattaagaaaaaacttcataatttcgaccttttcgcaattttcatgtttttcatgtataacttttttggtaattgtttgtacgagttgccattgaaaagcaatgccaatttcgggggggggggggggatctggaatcttggaattttctgggtcccaaaattctggattttttaataaattaaaatttcttaaattttttgcttttaatcgttgtttttgtggcgctgttttcctaaaaaaaaggaccgatcatttttgagttacgacgaattggattgatttgatgatactttgttttttgctctttgggcgtacgatataaaagtgagttttgaaaattttgaattttttgttaaattccgaggttcggaaacttaatttttaatttaatttaattagtaaggttttcaataagatattaagtgtacatatgttttattcgaacgaaagaatcaacaaaagcatttcggagagaaaaagagagcatcaaattgagattgatcatttctcaaattaaattatttttcaatgctttcatccgcttcttcttccgctggcagcgacaatggcctaaaattatttatattttttcgacaatcaaaaattgcttttgctgctcacccaatgcaactatttccaccccacaactcaaatcggatattgttcaaattggcacccgaataattctccccccaccccgcccttcaaaattttgaaaaataaataaaataataggagactcagaatttcgaaaattttttataaaaattgatgacaagctaatgtgataaaacaggttatttctcttcctttcagtatccctcgcaaagtttggtgcgcttgtgatcagtttctgaaaaaaaagttaagcctaaactttttggcctgtttaaaaaggaattaaaaatttttaaaaattttattcatctccctttttgatagaaaaagcatcagagtacctaaactaacatgtaaataaaatctggtgcgtttcagaaccctttctgaaaaaatatttaagaattaattatgctaaaaaataaataaaaacgaaagact

SEQ ID NO: 3373 - DNA, 7151 bp, Heterodera glycines
aaatgttgaaatcgcaggaaggaaaacgaaaacaaaaaatgcaaagacagaccaatggaaaaaaggttggcattggcatcatttcctggcaaaaaatttttgaaaaacatttccaatttcaatgaaaataaacgattttggaggaatataaaagccaaaagaaagccatgcgaaaaacataatcgaattattttaatttaattaatttgcttttattatccttcaaaatgcgcgccattctcttcctggccatggtttgcttggtgatggctgttattcttgagacaggtggccacaattaattaaaaaattaaaaatattttattattttagccaactcaaaggcagtgaaaaataagaaaggtataaataaattgataataaatattaattggaatatgcttttaaaggagcaattacaacgccagcaaaaggaaaagcggcgccgaaaggagcagcgaaaggaggtaaagcagaaaagagagagggactaattaatacaaattaattaattaactaattaattaattaaggaattaaaaaagacgcaaaatcaaagggaaaaggaaaaaaggacgccaaaggcaaaaagggtaagaattttaatataaaaagaaatttaaaaagttaatttttgaattttagacaaaaaagctaagccagccaaagggaaagaagtgtctaaaaatggtaattattttaattttaaatgctaattaaaattgaatgaatttagacaaaaaatccccaactgccaaagcaaatgacaaaaagagcccaagtaaataatttaattaaattctaattaatattgtgccaaacattgccaattttaagccaaaccaatggcagcagtgaaagccgtgccaaaggcggcggagaatgctcagaagggaccgtcgagtgcggaagtggtggcggaggaaaacaacttggacactgaggcgatcgacgacttgggggcggaagagtcggactttgaccaattggcagaggacgaactgctcgaggacgacgccatggacggcgaggcggacgaatgggaaggcatgggggaggagacggagatggacagccaaatggcactctgatggccaactaattggacaaatggtaaacggaacaaaacgggacaaatgacacaaaatatcatttttggcatttcattttcagcaaaaataaaatagaattttatttttcattcagtaaacaatggccaattttctgatgggtgtcgatccatgtggagctttttgtttaaaaaacaaaaaacgcatttctatcattttcaaaaactgaggcctttccgccagggctgtgcgaaaatcacaaaaaaactttttcgtatacgaaaacgaaacgaaaaagtgcattcgatacgaaaacgaaacacgaaacgaaaaaaaatattttgaaaaccgaaaacgaaacacgaaacgaaaaaattttgacggacgaaaacgaaacacgaaaacgaaaaaataaccattttcgtacgaaacgaaacgaaaaaaccgaaaattttttgaacttatttcaatcataattaagaaacataaaactttaaaattgtatcctctaactgaaggaatgaagatcctagtaggtggaaaagctaatgtggctctaggataggggtgtgaccaaacaatttttaaaataaagaacatcaatgacaaaaaataaggtttagggtcaaaaaagacaatcttgcaaaattggttcgaatcagttaatatataatttttcgataaaaaatgtattaaaatgttatgtttttcacatcctattatggattttaacaatttttggggaagaaattagcaactgctgaaaaaaaagactttcaaacgtttttttttgcagtgtattttttttacaagttgatgaatgggaagtgggtccggcggcgccgataggcgacgccgggaaaatttttgaaaatttgagtgctattttatagcagattttcaattaaaatcggtaaaaacatgattaaaaaatcggtaaaataaagtgcggtcatgcgggatcgaacattaatgcacagcacaaaacaaacctgctgttttcaccactaaactaaaatactcaattaataaaacttattatttctttccaaaaaagtcattcttaagggtgtaaatattttcgtctttttcgtaaaatattgctctgacgaaaacgaaaacgaaacgaaaatccaaaattttaaaaaccgaaaacgaaacacgaaacgaaaaacaaaattttgaaaaccgaaaccgaaaacgaaacgaaaaaactttagcggacgaaaacgaaacacgaaaacgaaactcaaaaagtaccaaaaatttaggacgaaacgaaaacgacacgaaatttcgtccagccctgattccaacaattaccgttgatgctctgctgctggacgactccccttggtacagtagttgttgcgatgcctttttgcctttggttgattttttcttctaagattttggattattttttggtattcttcactatttctatgcatttttgccctacctaaggccttttttcactatttggtcttttttcaacgttttttattcctttcctaaattttaatttttttatggcctgatttgatgctttttttttgcgttccgaaaatccttcgagaccgattccgagatccaaaaaaaatccaagacttttctcgactctatgccgatgctctcgagtcggtttacccgccaccctttgcccgttctcaccgtgccatcgtgtggctgattttggtggtgttggtctccgtatccttggtcaacaattgggtataaattttgtgggctagcgaatgttggcacaaaaaaggtaaatttgagtaggaaaataagtgaaaaaaatgatgtgtaattaagcatcagcagcagaagatgctgcatttagacagcttaaagcaatcaattaagaagaagaagaagtgatcatttacaattaattaattttaattattcctaaggtttttagctttttcttattcgtctaatttatattattattattattaatgaattaatatgaatgaaattagatgtcaatttttacatagcattcattcactcaatgttttggaaatcaatgggtcgataaaaatattcaaaaataatttaaataatttttattcgagtgaataaaaaagtaatgaaatgagtaaatgcattttgtaatatttgaaggtaggaaatatttataattgcttaaatgttcatatatttaaattccttaaatttttctttctaccaattttcgaacaatactttctctaagacccccattcttacctggtatagaaatctcgtgtcttgtgcaaaaacgacactagacggcctaaaacacgagagaacgagacgagcaaaatcgctgataagtaacagggatgaattctgaggcccaaaaaaataaagcaagtcgaaattctaatcccctaaaagtttcagagtcagaatcattcttagcacaaaaatatcggaagtcgggattctgggtctggtaggaactcagattctgcacctttcctgggaagtagccaactgaataggccccctaaaaagaaccacagcatgttaaattaagtatttaaaaaggttttaacgataaaaaaatgtttatttattcaattttttacaaaatttatgagtctcaaaatggtctaacgtcgcccacatatttttcgttatattctttcttcagcgggcatggccgtatgaattcctggccccgttcgtggatccatttgtttgacacccatttaacgccggtcaacacaggacaagcagcctaaatggattaattaatagtcataaaaacaatccgaaaggaatataatgaggagatttaattaaaaagattttaacacctttttagtttaattttgaaaataattttaaaatatatttttaatttaattgcatgtcttaaatgaaacttggcaaatttaaattacaaagaaaatatcaaaaaatgccgccaccgattttcgcggctttttgccaaaaattttattttttaattattttttttacgtgtctcgtgcgcagatctccgtttccgtcccggtgcaaattgtaccaaaacaacgcgtcgtgcagcgacggcgcaacgcccattttcaggtcagtgtacacagtgaagccccccgttttgggctgggacatctgagaaaaaaacagtgaaaaaaacccgaaatttaattttccggccatacgtaaaagagaacggttgccacgcgattgcctctcgagtcgaattggttcttctcttctcgctaatttgtggtgaaaagattaaaaaatttactgccgattaagaaaaacccccaggaaatttacataccctcgaaaaatcgaagtgcgggtcgtagtgccctccgatgccataattggccacctgcaattcctccgccgtgtccaggttcaggttggtcatgtcctgaaagaaaagttgaaaatttcttaaaatccatttttcagtatgatgagcagttgaaatatagaaaaacccgcatcagataatgaaatagtgaaacgggacaaattcttctcccacaatttcggcattttttggtaaataaattcataaaaaagagtcctataatcaattcaatgaattattttttaatctatgatttataataaggaggttagattttttgtgaaaagcattcgaatgataccaagttttaagaaattggccgactaaaaaaaagttatggccacatcaatttaaaattgtacgagttgccatgacaccccatattcgcactatttcatgtttaaaaatgcagtacatttctaaacccacagtatcactcttatgataactcactccctaccgtacgtctcgtcttacggtaactgcctaataaacactcacactgatgcgtttgttgacccgtgccaccacttcgtgttcttcatccttaagccatgccgatttgctgattcgatatgaggcgaacacgagttgtccagtggccgggtcgtgtacggtggcccgacgaagctaaacatttttttaaacataaattttaattattattttttaatttttacttttggtgttgccaattctttgatcactgaaatttcggcgtccgaaatgacaccacgaaaaagaacgaccaatggttcaaaacggacaatttccactttatggggtgccaacttcagaaaaggctgaaatgattgattttaatagttttaattgagttgctttttaataaaattataaactattaaagataattccgtaaaaatttcgaatttatgataaattaattaattaattttcgaaaaataattaatttctttcataaataatttaaaagtttttgtctttttgttcaacataacaacaccttgtctttcttataataacagttcaattgtgtgacattttctggtggaatttcaaattcgccacggcataaactgaaaaattcaaaaatatatttttaattattttttaaattaatttttaattaattgcctttcaaatgagtctctctccggtatgtctttgtatcgtttgtactcattctgcaattcgggcaaatcagtttggtcatcaaattcttcagcagacattcgctctttgtaccattgcaaattcccttttttatgaaattaatttaattttatagagaataaaaataattttgtttattaatatttcggggtgcaccccaaaatttcgccgggacataatttcgccaaagaaattttctttttaattttcaaattttcaagaaaaaaaacattagaaaatttttttatatgaaaattccaagggaaaaacatttgtaaatttttttagccattttttgaaaaatttcgaaaaaacttattaatttaccataaaatttttttcttaaaatattctaagatgaattttttttaattttcgaggtgaaattttgtccaggcgaaatttcatcggcgaaattttgtcccgttcgatatttaaaaaataatttcaaattaattcttgtagatatttcgataaaattaatttaaaatttaataatgctatttgaaagcattgcaatctttaccatccgccctcggatggttcggtgccaaatatgccaagcgtcgggtgtatgccaacgctctgccggggttcccctgctggtaaagcgcgtaggccaagtactcgatgatgtccacttccaactcgtggctcggctggcgctctaaagcttcttgcatccattgcaaagtgtagaaataattctaaaacaaaatcattagcaaatttaatttaatcagctaaatttcggcactgaattccggcacttgccttttggttgtacgcggcacggccgacctcgaaacagtcgtgcgcattaagcccagtgccgacattttcgccaccaacataaccatttgcgagatcgccgcttttcagctgataggtatcctaaaaaagaaaaagaatcattagcacattagataaattctgagtttaattagtgagcatgttgatcagagggttcgacccggatggccactgggactcggcaccccaaaaactgtgggattccaaattctatattttatatgggaaaaataaataaaatactgatttatacagtcatggtcatatgtttaacaacactcaaaatttctaccaaatttgatttaaattgattataaaatctcaatatgactatattgtgtatataggtatgttttatatttcttgtagcattttttgtgggctttataatgataccattcactgtcccctgtcaaaatgttattattagttacaaaccattttaccaactgcactcccttttggggtggtcatatgtttaacaacactacccatattttttttcatcagcattaaaaatctaaaaaattcaggtaagcataactttggatgctgatcaaaaaaggtagtaacaccaagttgatcagatcactccttcatggtgatctgatcagcccattttggctgggaacgaggggtaaatttcaaaaaaatttctagggggttgggaaaattttctggaaatttttaggcccattttatagagcacaaaatttgctaccgaattgcctttggaatagtgggtctacgatttaggcccgctgagatacgtcgacttt

SEQ ID NO: 3374 - DNA, 3726 bp, Heterodera glycines
  misc_feature (50)..(50): n is a, c, g, or t
  misc_feature (82)..(82): n is a, c, g, or t
  misc_feature (188)..(188): n is a, c, g, or t
ttcatcagcattaaaaaaatctaaaaaaaattcaggtaagcataacttgngatgctgatcaaaaaaggtagcaacaccaagnttgatcagatcactcctttcatggtgatctgatcagcccttttcaatggaacgaatactgtaaaagtgagatttcttggtgctatgacgttactcaaaacccatcnaaaataaaattttttgatataaattagcttatttttaaatgtagccttccgccaattccataccaaaatcgattagaatacctgcaactgccaacacttgagaaaaggcgaaagctgtttgatctgttcatggcgcataaaattgtttatggccgaacagatctgaaactattttctatttttaatccatcagcacgctttaacatccccttttatagatttaacacaaaatacaaactgggcaaaaaattcattccctttgctgggagggtaacaaaattgtggaatcaactagataaagaactaataaaaacaaattctttaaatcaatttaaaataaaacttaaagttcactagggtaatatgtaagaccgggaaagctagaatgtaacaaatttctaagtgatttggtatttcgacctcatttgactttgacctcaatttatttattatttattttcacatatttttgtctttttttaattcctgtgatcatccatatattttgtcacttactctacgacacatttaccggaatagtcgtcagagtaagtggttttcgcccttctgatgacttttttattttttatgaataaacaaaaaaaataaaatgttttctattatcctgcaaaatttaaaaaagtttcgttgagtataaagcaagtttcatgaccaaaaatcttcaagaaaacttgcttttttgagtatctcaggtcataagtttatttaaaacttaacgaaattttttgaaattttgcaggataatagaaaacacttagttagggctatcgtataatttcatcataaaatttgattcattttttctgtcaaaattttttattttgatggttttttgagtaacgactcggcaccgatttcttgattgtgccctttttcgttcaaatcgcaacccttctgctttccaagacaatcagtatttatattaaaaaatttaattgagaattttcaattgcctggagtcttagcagtccttgagcagctccttccaaatcctcagagtccggatattttatctgaatttaattccaaaagcaaattctattattcaattttcatttttagcaccgcattttccattcgttcatcagtgatatttttgatgaacaattcgccttggtttgcgttcatcaaacttttgatgcttttccaatcacgcgccatccgtttgatcagcaaataggcgctgaccggatttgacaccgatgcttcttcctaatattaagaattaatttaaaaaataatttaaaatgttttaaaattaatgccaaaaatggcaaagttttgtttaagcattgcattaacttactttatctttggtcaataaggcttgtttctgttgtttttgttcagataatccccgtgcgtattcttcggcaaggctaaataaagatcaaaataatttaaacatttaaatttgttttttccctaattttaattttttttttttttttttgttttgctcaatttgcccgacttgctcagctgttccagcctgttcttctccgtttggatgtactgctcgagaagttctggtgttcttgccgcttcacttgccaacaaattctccaagtcgaccattgcagtgaaaacgtcaaattttgcacaatgaaaaatgtttagtaaaatgagaagaaaataaaatatctctttcattttgataattcagtcggctaactgaaaaagtcatttaaaaagaacaaaaaaaaattgggggatttatgaaataaattattgaatcaaaaagagatatttttagcagttaagtgaaacagatttgaaaaatcttaaaaattaaattaggctaacaattcttcgggcgggcgcttgtcggggatggggcggtcaatgggcgtgcgagggtcgagggagtggtgacaattaatcccaaattgcttcggatcggagaggtgtattttgatttttgagatttttcatttaaatgttcaactgatatttcggaaatgaccaactcaaaagttcgggcaaaagaggcggcattaacttaattgaatttaaatagggtattacactttaatggggggacactaatcgtaaacattatgttggcatttaattggcaaataaaatgtgcgcatttaaaagttaattaatttgttgccattttataagcaattttttagtgaccaactccaggttcgggaaacaaaaggcgattaacctaattgaatttaaatatttcattattaacggggatgggaacactaatcgtagtcatttttaattaagtggtaaataaagtgtgtgcatttaaaaattaattaatttgttgcctttttataagcaatttttagcttgttgtttaacgtgtcctaaacacttaaaccaacggcgcgagcactgaatgactgggagtgaatgaatgacggagttttgtggtggtgcatttgttcgcccgtggagctgtactttgagcgatgatctcaaattatgggagggggggggggcgggcgggaggagcgcagtgcgcgacttttttggggttttcagcagcagcagctgatcaatgggcagcgcccgcgggggaaagcctaaggcaaagagcgattcgatgggggggggcagagcaattaaaatgtcagtcttcagcaacgatagcagcagcaggtttcacctccgttttgctggatattaatcattcattgtccggtgtgtgtgaatgtgctgctgctgctgttcgttgcgttaacagttattttcattaattaattaattaattactactaattatttttttaaaaaatccagataaatgacagttacaaaattgacgataaattcagaaatagattttctgttgtcttcaagttgtaggaagattattaatgggtcgtttgaacaaggttaaatcgaatacaaaggtttttaatttttaaatggtgtaacgaagaagctgagttttgcccattttcattatagcattaaattaaaaaaatttccttgatttggcacaggcaatgccggattcctttttatttttgtgtaaacaaaacaaatacatattttttgttggcttaaacagtgcgggaatcccattcaagcaatttttgacggaatgtaatctttgtgagaactggaaaacatgggatttccaaacgtattccgtcctgcatttttgaattgcaattcccgctcccgaaaattcgaatgtagttataagcaagaggttaatcctgctgattttcttaaggatgggttttttaaatactaatagcatatttatgttagtcaacattgtatattataataagtagaaaaaatcatttaccaaattctcttacaagtcaaagagtctctccaacctttgtaatactttctgatcagatttttcctcatattggcattttgagccctttttttcatgccgttttgctattctttcttctcccctttttgccatgcttttactgagctgctcgtcctcgccatcttgcacgggcactgcacgcttcctgcacaatccttacaccaatgtgccggtgatgtgccacccgtcctc

SEQ ID NO: 3375 - DNA, 2496 bp, Heterodera glycines
  misc_feature (2455)..(2455): n is a, c, g, or t
tcggcgatttggtgccttttccgtcaacacccatcgcgccaatggacatcggagagatgactccaccaccgttggtcatcgacgaccgatcagagcgcatcgaacagctggagatggagctcaaggaccgggatgacaccatccaatttctgcgggagcaggtgcgcaaccgtgatgcgctgatcactgccatgcggcgccagcgcatttgaacaccaaattgaggagttccgtggttttctggcccaagaacaacggatgcgcgacttcctatctcagaaaccgaaggcccacttattgctcaatcatttcgtcccatttgctcggcaacattctttcctcggcttgctggacgagcagggtgggcagcaaaaattaattaactcaaattttcaaaaacattaggggatgaggcacttcattcggtttggagaagactggagcaatggtggaaatgcatgccggacgcggaccaaattctacaacaattggagcaccattttgtcagcaattggctcctcgacaccggcagaattgctgagatgaagcaggcgagttttgagtggcgtgggaaggggttaattttcccagaaatcatttgaattttaaacattttagaggctggaagaacaaaaagaagacgacaatttttcggagcattcggatggtgaaaatgatgaagactcggtcatcgatgttattgggtgatcaaatttttgttttttaaatttacttaaaaaatttttagaataatatgacttaattattttttctttattcgttgagaaaaacgtgaaatattgcttaattacatatataactcaggtgggattgaacctgggactccctttttggtggcaaactcacagaccactaagacaaaaaatcaattagtttttgaactggggactcaaaattgactcggtgtgtaaacagtgccttatatgcaatagaattgaaaaatttgaattttccaaaaatattcgggttcggaattggtcgaaatggatgccggattcgtggtcagcgaccccgaagacccctcgaaacatgttttcatgatattgaaatttataaaaatgttcgagttcgggtttggggttcgaaattcgccaaaaaggaggccggattcgtgctcagcgtctcaaaaacacccctagaaacgtgttataaaaactttcagaaaaaaattcaaaaaaattgttcgggaccaatgatcgacgtattgccttattcccgtctccgcggttaacgcatcaaatttataaacatatattgaatcgggagaaataatttgtctttttttgtttcgctgtgcgcccaatggaactcccacgaatgaccccatttatgttcgattgcttttaacacggcggagattcctgagagatcgcgaaacaccgtcgatgggtcacacccattgcgttttcgccatattacccttttccatcatttacaaaactccaatccatttgtagttggaaatttgcaagttcattcaatccaaaacccctttaaaaagccaattatgtaatacttaagtagtaattaagtggtggttttagttgtttttccccagtctctttaatttaaaaagtacaaaaatctgttctaagtgctgcaaatccaacatttttggtcattgtttagattatctgaatgaaattactgaatttatgctcagagtctttggcagattccttctgccatttgtttgccgaatatttgcatttggtgagtcattcaatcatttattattcatttattcttttgccatttgttccaattgctcatttacagcagggctcggatctgttcttatttataagaaatgttctgatttcgggctattgtcctaattttattcttatttcttaaaattcttctcagaaaatttgtaattttatggcgtaatgtcacttagattttcaaaattttccacggcggtacctaacggcaccgccgaatttttttttttttgcaaaaagattatattaggggttttaaatagagtagagcgggaccgggaattttgggcttaaccgggaccgggaccttttcgggctgaaaaaccgggaatttttggctgggaaaaccgggaaaaaacccgggactggtcccagtcccggtcaaaaccgggacctcggtactcagttgtactcagttgtccgtgttttggtcccggtcccgctatactctagttttaaatatcggagaatccttgacctatgtctaaccccgaatccgggttcgaataaaaagtcgaaaaataaaaaactagaaaatagttgctaataatttgaaaactagcttaacaacaaccgaaaaaaacatgtttttttcgtgcatttcaggccacgaggagctcaggaatcgatttttaggggtgtatctttcttttttaagtcgatttttaggggtgtatttttgggtttttttgaatcccgaattatgnggtgtattttacaaaatttttcgcccaaaaattaatatttt

SEQ ID NO: 3376 - DNA, 2997 bp, Heterodera glycines
gggattgtaaaaattgattaaaaatatttaaaaagaaagttttaaaataaaactaactcattacgatttttaaagtcggaaaagttttttacatcaacttgatcagttctttccttcatgggaaaaaatggcttgtagaaaaaatttctaggagtgaaaatttttaagaaagtatacaaaattctcgtttctgaatacggtaatttattgttattttaatttcaataaatttaattcgaaaaattatttttgagaaaaaatttgctccaatattttttaaatgtgattttgttttttttaattcattcattttttttataactttgacagttcgttttctctgcggtcgcttatctcattctcagcgctgcccgtgaacaaattttcaatgcgaattgagaaaaaatacgaaaccaaaaacagaaaaaatatttttggtttttggaataaaagggaaagaacaaacaaaccgcgaaatgactaacaaataactcttgatcattaattgtacgctataaatttataatatttttgttggctccggtttgctgcaatttccaattacgaacaaaaatcggaagacaatgacaaatttggcatttttttcggaatttatcgttacgacgaaattatgccgtttgactaattcgttttgccgttttatccgtcgtttgtcgttcataattttgattggccccggtcgggtcactcccgacgaaggattggagtcgtttaagagtgtcccgtcgtttggtcaattgccttgcagttttaggttttggaaataaaatgtggtttcaaaactaaaaaatcattccttgaacataaagggtacgccaaaagtctgagttttttctattattttttcctgaagcattttacaggaaattatgggtttttttagctttatcttcatcttcagtactgctacaaacatccctgcaaagaatttagacattgttttggcccaagaaaattaggatggtcattgattgggtataagaaaaaattaaaaaaaacaaagttcgatcctctttgctctcggtctcgagtctcaggaaattgtcgatctcgaagaacactactattcatccttcctcggttatagtgtgtgctggatcagaaaaagcacccttttttgtcaaccccgggacaacaccaaaacaattagtatctttggaaaatcctaaagagggtcgttaagtctttcttgagtggtgggccaattttccctgctttatcagtgcccagagatggccacagtattctcctctgatctcaatcctccgatgggtttttttgtctgtgagcaattttggaggaaagggtacggcaaccccccttctcagagaataggacaaaatgttcgttcagaactttgtgtattttcaatttggtattgttgataaaaggagccaaaaatgactgtttgtccgcttatgaaagtgccaaaatcattggataggatttgataaatgtttatttgattaattaatattttattatgtaattgttattatgaaaatgagaggcaaaagaaattggagctaactaaaaaaataaaatattatacaaaaagggagagaaaaagcgaattttgtttgtctttttcttcgtctcctcttcctcctccttgtctctcttcctcctccttttcctcctcttccctttcatccctcaatgtttgtcttcttcttcgtctcctcttcctcctccttgtctctcttcctcctccttttcctcctctttcctttcatccctcaatatttgtctttttcttcgtctcctcttcctcctccttgtctctcttcctcctccttttcctcctcttccctttcatccctcaatgtttgtcttcttcttcgtctcctcttcctcctccttgtctctcttcctcctccttttcctcctctttcctttcatccctcaatatttgtctttttcttcgtctcctcttcctcctccttttcctccttcctcctctttcctttcatccctcaatgtttgtcttcttcttcgtctcctcttcctcctctttgtctctcttcctttttctcctttccctcccattttcttcctcttcccttttctctccttcatttttcaccatcggttgctgaattccaataatttgttgcaaataatgttgcagaaaagcgggtgcattggtagaagattcaaaaactggcgaattaaaaaacgctggcgaaggcacggaaagggccgaggaagaagcggacaaagcggcgggagggggcggaggaacattcgccagcggaggagggggggagggcacgcgcgacggaccaccgcgagaacattcggcgagagaggcaatgtccgaaaagttgaattgcttctgctgaattgcggaaaaggccgatgtgagacagctcattaacaaatgcaattaactaattagtgattcattagctgcccaagaacaacacaaattaagcataaaatgttgcgaaatgtctaaaaaattcttttgtacccccatttttatttttgtttccctaattttctctttattttttcactggttccctctctttctcaacatggcatccccccacctgttgttgttgtttgttttgtgcttctcctccacttcttttgtccttttccgttatttctccttctccgattgaattcgttcgttcgctttcgaatgagtgaaaagggcggaaattggccgaatttggcggtttgtcgtcgttggccatttgagaagtgatgaatttgcgtgagtttgactgattgtgagacggaagcgacgaggacggagaagcgaccggcggagggtcggcatctgaaaaagcatacggtggggcgacggacgaaaagcgcacctccgccagcgaattgctcagctgcggtcgcactttgctgcgtggaagccgcggcggctgcaaaatttgccattgcctcaacggacgacgaactgatcaaattggcaacggaggaacagccagcagcagaggccgagctgag

SEQ ID NO: 3377 - DNA, 1372 bp, Heterodera glycines
  misc_feature (42)..(42): n is a, c, g, or t
caagggaacgtaacgcatgggcaaaaggaaggcaaggaccancttggaaccaaacttggacacgcgcctcggtcagggccactttcgcggccaggtcttctctggaaaagataaggaatgaggaagaggagggagagaaagcgaagagagacaagagaggggataaagggagaaacagcagagagagagatagaggagagagaagcagtagaagagagaagggagaaagagcaaacgagacagggagaggggagaatgaacagatgccatgccgacttttataaaattagaggcaattagagtccaatttccgagccataataatttaatgatgaggtcaacagcaaccatttgaattggcgaatgttccgctcacatacgctcaatcggcccatttggctaattgccgttgcaattgtccaggaaaagcggcgaagggggggggtaaagaaatcggaaaaagaggaagaaggaaaaaggaagaaatggaagaaagaaaaggagaaaagggaaaggaagagagaaagggataaaagaaagaagaaaggaagagagagagagataaaagaaagaagaaagggagagagagagagtgagagagtgggggggggggtaaagaaatcggaaaaagaggaaggaaaaaggaagaaatggaagaaagaaaaggagaaaagggaaaggaagagagaaagagagggagggaaggggggaaggaagaagaaaggaagatgaaaaaagcatccgacataatctctcccatttaattgcctttcccactgttttggctttaattatcgcattattatttttcttattttcgctgtctttgcctttccgctgtgaattaatttgaatttgatttagtaaattcgttctactgaggtcccatactcaaaacatggataaaacacttctataggttttattgggtgatgaaacgacgcaaccaccaaaaaactgcacgacaaagcgtttaaaacgttttagaacgattaaaaactcagaaaagtaaacaaaatcgcgcaattataacccttttgaaaaggtaaaacatggacaaaattggtaccattccagtttttaatgagttctgtgtaaaaacagagaaagaaatcgaaccgacgccatttgagaggtttttaccttaataatgaataatgtcccctccctcctctttttgctcatattcgattaaataatccgataatcaaaattaactaaaacatgcgaagatgaagcaaaaagtgaattgggggagatggagggcgcaggaatcattctgacttataaaatttacttcggatttttgattcgctcaaaacctctcaaatgacgtcggttcgatttctttcacttatttttatacagaact

SEQ ID NO: 3378 - DNA, 2699 bp, Heterodera glycines
tattttttaaaatatttatttttgccaaattaaatccactttggccaagtgtaaaattgattatgaacagtttaaaaaaagcttattaaatttaaaaattattttttttttaattatattataggaatttgtttcaaattatttagttttcatttaattttttgggccaaaaatttcaataatcaactttttcgccaatatttttaagtgttttgattctcagttcttattcaatattttatagtcaatgtagtggacaattctttaaagagtctttaattattaaaatttattactatttaaattaggcggctacatgttctacacatataacatattttttatttttgactccgtaatcttctaaaaatatgttttcgttgagttatgtattttgaacatttcttagaagtcgggttcgggttttggaattttgcaaaacaaaggtcatattcgtaataagatccataaattaccttagaaatgactttttatttgaaatttcaaagtggggtctcaaaatagaaaagtaccaatttattgtgggaccttagaacaatattttccttttgattttaatcaaattaaaatgtcaaatgttttccattgaatttgatttctcgctgtctcttttttgagttttttcgttcatttgtcaattaaaacattttaaaaatgtgcaaaatacgaagacccggcttttccattcgcttttcgcttgtccatccattggatgatggatgggccatggcctcgagaaattttggaggatgatgaggacgggtaattgtgctgatggatggcatggcttcgggacagatttggccaatccacagaaacaatgcattccaaattggattttgtctttgccatatgattgggaggggagggggggggggagcgttttgactccaattaccgtacctctcccacgggtgacttaatttggcgccattaactcagtccgtcggaatactctctccccctgcttaattgcccttcaaaattttggccaatttgctcttccggccaattgttgccgtcaaagagggcgaaagaaggtaaaggtaaccgccaaattgttaatggctaatgcactgtccgtttttatttgctcattttgtccttcattttggagaaatcgaaggagaatggcggaagaaaatagaaaaagaaaataagagagagagaaacatttgaaggcgcaataataatttcccctcaggggaaaagccaatccctgcggaaaagaggtaccctcgggggactgcggaagcgagaaaattggttggataggccaaattaaggaaagatgaaagaaaatgggcgggggcggagagtgaaagacggacagaaaatggacggtgaatttgaacgaacagggattaattgtttttggcccaatcggtgccgaaatgacttacctttggaaacagtccgggtactgagtgacggcgaacatctgaacatgtttgcccgtgttagcagttccccgccgctttggcctgctcaccctctccaattcctccagttgattggcactgaacgtcgttcggtaccgtctctgcttgcccctcttgcagctgtcctcctccccaccgcccccgctgtcctcccctccgccatcgccgccatttccgctgatgccattcaacggcgactgtccgttgccgtaatcggcgatggacggggaaagtgccgacttcgtaaggcgatcgggagagtaaccggaggaagaaacggtggacatgcgccgtaaatgcacttaagtagcaaaatgacattgcatttcttcggcatccctccctcccccgcccccaatgtgccgtgcccactccgtcctcccaatcaacctctttctctttcttccgtatcccctccttcttgggttggcattgcttccaacttgctcatcgccccttcccccctcaatggtgccgtttcgtctccatccattgcgcttttgttcgatgaattcgcagtttcctttccgtctcctccccgtcgttcatttttctccaaaaatgccgtcatttttttctcattgacattttttatctgttgcaattgatcttcaggaatttgtgcacaatttggaagagaattggacgagtaaatcgcggaagagacgggcccaagaagagcggcgtgaggggggaaaagcgcaaaaagcgggggtttggccataagttcgacgggagagggacccgaggacgagccgaggcacgacacgacgcagttcgacagagggggcgaagtgccggcggacgcaccgcccgaggccgagacgaaattggggggaagaccggcgaggagctgctgcatgtgcaaaagcatttgagggatttgttgaggatcctaaaggaaaagccgacaaaaccaatgcgaaagaatggaaatgcaaattaagcaaaaaagggggtgccgaattgacctgttgctgttgggcgagaagcaattggacggtggccatgttcatattggcactggcaaggcactccaaactttggctcactttttgacttggactgtcaaaccgacgggatgccgtcttttgttttgggggaggagggcgctgccgttcactttgctggtcgaggggcttaatttggttggccagattggaacaatgggaaagtccgaattgtgctgaatgaacatattcaaacatggaaaagggaatgaatgatttgatctat

SEQ ID NO: 3379 - DNA, 1759 bp, Heterodera glycines
taaattgaaaaacttgacaatctctacattcgtaacacttaatcgacaaagtttaacccctgaaaatttttgaaggcgaagatctaaaaagtgtcgatttcctcttttgatttttaaggtctgcggagtgaaaattagcatagaaagggagggatggaggtggtcaaattcttttttcttcccacaaattaccaatgggcgaagaaaagcaattaaaaggcattaaaaggcaaatcgaatgattttcccgtaattacggtgctttagccgagtgacttcactgaaagtggaaatttcgatcagaataaaaccaactttatgacagaaataaatggcaaatgaatggactgtttggtccgtcggtcgtaaaaacacttttaataaccaatttttgaaaagcgctgagaaaatcggaaaattaaatgataaagtggaaaataattgtataaataacaaatttaataaaataaataacgaaattaaaaatggaatgtttttgtatcccacttaaggcaaaataaaaccaaaacaaaagtgaaaatggtcggccattgaacgggcaaaatgatggcacaacaattgtcaaacgctcgtccaggaagaaaaggacggatgaataaatgaataagggatggatgatgatgagaaatgaaatggagaacggaggggggaaaggggagagagagtgagggagggagagagagaaagcgggagagagagaaagagagagagggagagagtgagggagggagagagagtaggtagggaaaagggaggagagacaggagagggggggggggggtcattgcgcatgacgcttgaggcaattagcaggaatattgctacgggagcattaaaagacagagtatggaagaacacagcaaagcatcccccttgccccccttctttgccataacaattccccaatttgtttgtttgcccttccccccccccctattcaaatggtcattttcctccccacctgtccatgccctcaggcgaccaaaaaactgctaagagacggagggaaaagcgaaaatgaagtgccgaaatgagaaatggagccattcattgaagcgggaaagatggccttaagcataatttgtcgggggacggcgcaacaccgcgacaggtgtaagacgaacaaatgagaagaacaaagggaaaatgaagcaaaaacaagcgaaatttgggtgaattttgggagaaatgaaaaaataattgcaaaaagagcaatttaaaagcatcgaaatgatcaaagctaacagaattgttgaggtatccaaagaagaatgatttgtgattgacactcaatttcccaattccccccccccccgccgcctttctctgttaattttcacgcttttccgtttgcatcatcggcagattacccttcagaagtcaatctccggggcacccaatccatcggcactttccccgggcggggattattagctcaaatgataagagagcgtatttaagtaaacatcctctcccccccccccccttccgtccctccgttctcttcccaacccaaatgaacgtcacatgcgcccgcccctctctcctctctttttctcattttcatcaacaaattctttttgtcgcgctcttttttccttaatctcttatcgtcacgtctaatctcagcaaattagctcattttttatttcaatgcgtcaaattcatttttttgtgtttataagcaaaagacaattaatgaaatggccaaatagcggcaaataaaatgcaataaagt

SEQ ID NO: 3380 - DNA, 3438 bp, Heterodera glycines
  misc_feature (1756)..(1756): n is a, c, g, or t
  misc_feature (1898)..(1899): n is a, c, g, or t
  misc_feature (1914)..(1916): n is a, c, g, or t
  misc_feature (1970)..(1971): n is a, c, g, or t
  misc_feature (1977)..(1977): n is a, c, g, or t
  misc_feature (1982)..(1982): n is a, c, g, or t
atcggggcacgagggtggtggtggtggcggttgttgcgtgccaaatgccaccgccgcctggacgcgtgctattaccacctccaccagcggcggcacgacgtcgtgcccaccggaccagccgaacgggtgccaccgcccacaagccggtgagcggaagtgccgagtgaatcgaaaaattttgttcgaaaattaattgaaaaatggaaacttgaatttttggaaaattaagaaaaatactttaaaaaaaactttgcatcgaaaggcgaagaaaaatattaatattatgaaagccctaatgatggcaacagcctataaaatttcaaaaattttattaagttccaaaaattgatcaaagtcaataaattaaattttcatagtatcatcattcgaaatgccgaaagagttttgtatgataaattaaattgattggcaaaaaatatgaaaatgcgattatttttcaagtttttccatgactacacattaaattttttaaagattttttttcaaaatttcatgttttgattaccggcaaatgccgcagcacgctgcgcgggtcgaccgcgtccttcacagacggttgtggacaacggttgacgagtttcgcctgctggtgcagttgtgagcggagtacggtagggcaaaatcggaaacggtaattggatttaaaagttatttgaatttattcaatgaaattagatttaatataaaggcagaaacaaaaattgaaagattggaaaaaaccagtataaaaataagtcaaaaattaatgatttttaaaattaaaaaatcgattgtagtgtttgaaaaaatccataaaaaaggacagttcttgtaaataaggactaaattcaggatctctgaccctattatatcacctgtctgttaaacgccagtcttgaccgtttgtccgacaaaatcatatgatgtgaactggaacgacgctttgaacgcttcttttcgcttaaaaaataaaaatatatttaaaaaataaaattttaaatagaaattttcgataaaatgttttaattttatttatgtaaattgatgtattaacccatttttgtgctgattgaaaatgttctgcactgttctgtcaccggaaagaaacacatcatcattgttgtcccgcagaagtgtcgattttctgacagtcacattctgcaaatttattcgaaataaaaaaaaaaaattatatagaattcaaattttgattttatatttgaatgaaaacaaattcaaaataagatgaattaattgaatccagattatgccgcctgatcattacattaagtccctggacaaatgctcagatacttataatacagattaaaaaaaagaaaccttaaaagacaaaaccgaaatgcataattcgaaatcccgaaaaataaaattaagaattcaaataaatcataaaatttcttgaaaatcctcgataaatatttattgctaacatcctttcgtaaaaatccctaacccaaaccaaaactttgaaatttcaatttgtttgaataccaccgacccgatgttagaatttgggttcgggatgtcagattgatgaccaacgatgccaaaaatttgttttatgaaacagatatatatcatctttaaaatttgtaaaccaatggggtgtcttgtctcaccattggtttttcgcctattttcataaatttttgtaacccataattaagtgttaatcccaatcaattaggctaattactgttcacattatcccacccttagctcatcctgggccagntcaatatgtgacgatgttgctcaagttcagctgtcaagcactcattttttttgcgtagctgccgccaaatcggacacaagctgatgaatggttgatttgttctcatacaagatttgctcatatttctgaaaattacaatatnnaattacaaataatcnnnttaaacaatagaaaattctgcgttttaattgaatgataaaaattaataataatnntaaaanttcgnttaatttacaaaaaatttaataatgaaataacaaaattggttcaataaattaatattaaattttaatatttaaaattttaaatattttataataaaatgttcaaaaaaaaaaattaattcgacccatttttacccaatctgtcgcttcaggcgattgttcaattcggaaagccgttgattgtcctgcaatgagaagcgcaacttgtgctgtagcttctcgatcatgccaaactgttgaagaactactaaaaaataaataaatatttagcttgcttatatttgaaaatcatagtttacaagaaattaaattataaaatagttttaaattaaaaaaatgataattactgtgccaataaattaaataaaaaaatgatagataattactgtgccaacaaaagttccaaagtgttccaataaaattaatttttatgttttaggtcacatattcagcaaataaaaactcgtcattaaattttaataattaaagaaaaattaaaaaataattatttaattaaaaaagtttttttacgaccttccggattgatcagattcatattccgctctgaacagatacgtgatgaaagctcaaaaaccgcaagcgtgtctgtatgcaatttatgttccattataattctaaaataaatgctaaaatataggagtgacaaattttttgaaaatgaaatatatataaaaactaggtaatcctgaagaatgtgtgcccctaatttttattattttttaaattttgggtcaaacccagtttttaggggttttcgagggtgccgattatgaacctgaactcggatttgcccaattccgaagctcggatccgaagtgcagcgaatagatgagaacgactcggatgattagatcgtattgattatgattggacaacgtgcttcggatgttagatgaacgacagggcgaatgtcgggtcttcgttatatgatgtaaaaagggatgggagtggcatggacaaaatggtcataataatgaaaaatgattatgtaaaaatctattaaaaataagaatgatgtagcgaacgcggcttttccgattggaatgcttacaaacagaagcatggcaagtcataaggaattggaaaataaacgagataaaaattaagggaaagcatacgcggaccaagaagtggagaacgaacggatgctgacttatttgaggttagctgaaaatactaaattaatttgaaattgaaatacccaatatttatagcgccaaacagttcattgacaaacacaacgaggcgtacaaagagggcaaagtgtccttccgagtgggagagactcatattgccgacctggtcagaaatcccgaactgttgttcgaatttccccctctgtttcagcccttttccgaataccaaaagctgaacggattccgtcgtttgatgggcgacagtttgcgccgcaatgcgtccacttttctggcgccaatg

SEQ ID NO: 3381 - DNA, 2129 bp, Heterodera glycines
tccatcctctcggcacccttggatggaggtggtacatgaagaaacgtgggtccgaggtataaaagaaaaactaaactcaaaatacattggtttgataaagaatgcccgacccgaagtgcaccaggaggaacaagaacacctggaaaacagattttgagtacagagaataagaaagctcaattagggacacccattcttcacgattgcataaggactagagttgagcgggtccggaaaatttgacaaaaaccggcaccggggcagcgaaaaaacccgggaccgggaccaaccgggccttttcccaagtgaaaattttttttgaaaaaaattgaaaatttaagtgcactttgttacgaaaattgccaatattcaaaaatgtaccaataaaattttgtatttacgttttgggggacgagttcgaggaaaatttttaaaaattttgttttcagggggggggggggttcttggaattttctgagtcccaaaattctgtattttttaaaataaatttacaatcttttaaattttttgcttttaaatcgctgtttttgtggcaatgttttttcaaaaaacttttttggaacattgggagggggcggagtccggcggtgccgataggcgccgccggaaaaattttgaaattttgagcgagatttgttaacagaatttgtcaaaaaatgaccaaatatttggttaatttatgggtttttaggctattaaaaatgaaaaaaataataattttaaattaaaatattttttattaattaaattcaattaaaataatggtaaagaaaatataaaaaaattttctgttccatcagggaattgaaccgaagagacaaataatgaaagtaaaaaggtttagccacttgaccacttatgcatatgaacacatgctataaatgaaaataaattttttcaaaaatttctgatccctcaccaattcccttctattttctcacccagcccccattcttaccagtacttatttagtcccgccgggaccgggactggcaaaaccgggacagggatttctgtttttccaaaaaccgggatcgggaccgggacttgaaaaacccgggatttcccgccccggtcccggtccctctcaactctactaaaaactaaaattcattaaaataatgttttttaattgataaaataatattaatctttatttaatatgatttaaagttattttattctttaggaaagttgggtaataattaaataaaggaaaatgaaaaaaaaaaaattaattacacaaaatgctcattttgttggggatggcacggactaaaaatgtgaattgattggtccgttcgttggctggttgtgtgcctgtgacctgacctttctttttgagatgttagggagaatttgttaccaattttttgaatttggcattttagcgggcaaatcaattaatgccataggcaaattaaggaacgccgactaatttttgcaataggcaaatttaaggggggctcggcaacgatttggccaacataaaatttaaaaaagattatataataagggtggggatttatttttgtttttaaaaagatgccaatactggaagctaaggtctataacttgatatagcgccaaaaaaacgcgaaaaatattttggctaaaaattttgatttttaccccaaatgctgattttgaaaattttcagttgagagccctggtttaaatgcatgaattgtttaaatttcaaaaattcataatattcatttgattagatagcccaagggtttctctattattctatctaatttcaaacaattttatttgagttataaaaaaaaaagttaaggtcaaaatttttcagcataattttcgaagaaattttatcaacagaaatctcatacacaaaaaagggatagaaaggtaatataattaattaattttttttttttgattttttttgttgccgaatagaaaaatgatttgtttttggttttcttttaatttagcccgaattgtttcatctacatttgcatgtacatagtttgttactcatcataatgtaagtttttgataaagcaaatgttggctattttcgggaaaatagcataaaattttttggcgctatatgaaaagtggccttttttgaaaatttt

SEQ ID NO: 3382 - DNA, 3508 bp, Heterodera glycines
  misc_feature (15)..(15): n is a, c, g, or t
  misc_feature (19)..(19): n is a, c, g, or t
  misc_feature (34)..(34): n is a, c, g, or t
cagtcatatgatttntacntgcagcaaatatctnctggcatttcatccgccgtattcatctcttttttaacgtttttcatatattctctgacaatttttcgtatcttatcaaaataagctcgtacaattttttctgtaatatattaagcatttaagattaaattaaaataaataaatgcaatttattcatggattttatcgtgttgcgacattttcaccgcacagcaaaaacggacatttgcgccgctcactctttcagaaatatattttaaaatatttttactaattttcaacgaatttcctcaaacaacagcgcaacaacggaaaagcaattaaaagaaatgcaaaaaaaaactaatcgcaacgatagacacctaattttttgtgtgtgcatcagcagcaaaggcaaatttgaggccaaggaaaacaaaataatgaagattttaaataagtgacattaattaatcggtacaccgattataaaacgaataaaaaattatgactgctatgcatagagtttgcacactcaaaaccgtaagtagcaattacaatgacgcggcacgggccccagaacgtggcatttgtgtcgcgtttcaatttcatattgaaattgtgctttttagccaataaaaatataagaccatggttaggaatccgaaacttttttaatattttttaaatttgtacctgttgtcgatacggatgtcagttgttgtatggatggcaatgccggcggggatgacaatggcggcaatcccggcgtttccggtgttggcattattttatggattttagacttactcatttccatttttaaccctttcatatatccagtgacagtgttttttgcatcttccagatgactttttagttctttcatatgtttttctgcatctaatttagcttgtttcatttgaggcggtaattctttcgcatattcgtcaacttcacgtttaatttgtttaaagtaaactttggctaaatataaagaaatgttttaatgtcgaaaaataaattttaaaaatttatattaaatatttttttgttaactgcaagctaatgccgaattgtaagctaacgctaaatgcttcaatcaaatatagagtttgtaccaaaataggacaatttaaaggcacaactttggaaaatttttcatgagtttttaaaattgccggacttaagaattctaacggaaaaaatgcctgaatatggtcctacctaagccaatttaataattaaaatttttatcacgtaccatcttcatcttccgagtctgaggattcattatcagtttcttcatcagatgatttttccactataagaaactcaaaaaataaatttaataattaaaatttttatcacgtaccttcttcatcttccgagtctgaggattcattataaattttgagcttggcaaattttaaaaatttttcaatagtattttcaaattttttttaggcagatacttaacatgactaattaactcactatgcattggaaatgtcgacgttgtcggcagcatttccggcattctcggcatggatggcattgtcagtggcattctcggcatggatgtcattgtcggcatcgatggcattgtcggcaaggatggcaatgacggcaaggatggaagtgatgacaaggaaggcaatgacggcaaggatagaaatgatggcattgaccgcatcgatggcattttaagaaaattactctgtgcaggttcattgggcacaaaaatatggtaaccatcatcaccttaaatttaaattatcattaaatggaatccctataaattattcactatgtgttggaaatgccggcggcattatcggctggatcgatgggatatattcttcatcttccgagtctggggcttcattttcaggctcttcatccgatgatatttccactgtaagaaaaagggatgaataaattttgaattcaaaaataatgcactacattaaggcaataattggttgttttcattttcaataaaaaaaatttgagcattttccttaaaatttttttcgtaattttttaagagagttagttgttttttaaaatttaaatttttgtaaatttatgtatataactaatttaaattgatcattttttgatcgtcaattaattgtttacatagccattgatggattttttaaatgcataattttgaattcgtttgcgtcattaaataaagaaatttaatattttgaaaaatataaaaaataattatttaggcacaatcttaaaaacttttagaataatttttaaaaatatttttaaacaaatatatttaaaaaattaatatttagttcactgtttgctagagacgtcgatgttgtcggatgcgtgggtggcatttcggaaacattgccctgtgccggttcatcgggcacaaaaatatagtacccatcaccagctgaattgcatttatgattttttgatattcaattaaagagatatgaaaacttttcatttcgtaacaattaatttaaatacatttgttaattaaccagggcaaaattttcaggactaacacaaattttatagtgtttttagcgcgtactttgatcattttcggaggcttgcacatacacataagtcccaggatttccttaattaaacatatttaacttttatttgggtatttttgtaaaattaattgcgccaaactttcttcgtcctctgactctgagagtgaaaaataagtctcatcatctgaacatgttccagcttcttcagtattttttgatgatgatgctttatttaatgattgctgttgtttcagacgattcgcatcttaaagtattaaataattttatatatttttatttataaaatataaatattttgttgaaaagggccaacaaaagagccaaaatggaaaaatagaaatataaagatattaaaatttgcgctggcgataaaaaacttattattattttttgatagaaattaaatcatttttggtaatttttaaaatatttagttacaaatacttttggcaattaaatatttataaaaaattactttcttcattttccaagtctgtcgctctgctgccaattcgcttcatcggtggcggatgattttcataatatttcctgttgatgtacaaattacttcctcggaatgaaaaatgcgtggcgtgttgacccgaagtcacataatctcggccatctatgcgtactgtgtatacggtaggtggttgttgcgcatttcctacaataccgatttaaaatcaaaaattttttatacatttattttaccattgtgccaaaagcagaccaaaactatccaaactagggcggaaaagagaaatgtgtgcatcatacaatataattaggaacggaaaaatattaaatgaattaaattatgctgaatgtatagcgcttttatgttggcattcgaatcgataatttcaaattttcgcgttaaaaaatattacatggaagatgctcaataaaattagatattatatcgcaatgaagagagatggaagagaaaa

SEQ ID NO: 3383 - DNA, 1549 bp, Heterodera glycines
  misc_feature (206)..(206): n is a, c, g, or t
aaaaaaatttgagcattttctttaaaatttttttcgtattttttaagagagttagtgttttttaaaatttaaatttttgtaaatttatgtatataacaaatttaaattgatcattttttgatcgtcaattaattgtttacatagccattgatggattttttaaatgcataattttgaattcgtttgcgtcattaaataaagaaatntaatattttgaaaaatataaaaaataattatataggcacaatcttaaaaacttttagaataattttttaaaaatatttttaaacaaatatatttaaaaaattaatatttagttcactgtttgctagagacgtcgatgttgtcggatgcgtgggtggcatttcggaaacattgccctgtgccggttcatcgggcacaaaaatatagtacccatcaccagctgaattacatttatgattttttgatattcaattaaagagatatgtaaaactatttcatttcgtaacaattaatttaaatacatttgttaattaaccagggcaaattttcaggactaacacaaattttatagtgttttttcgcgcgtactttgatcattttcggaggcttgcacatacacataagtcccaggatttccttaattaaacatatttaattatattttatttggatattttagtaaaattaattgccaaactttcttcgtcctctgactctgatgagagtgaaaaataactttcatcatctgaacaaactccagctgcttcagtattttttgaggatgatgctttatttagggattgctgctctttcaaacgattttcaccttaaagaattaaataatattttctaataaaatttatcaaataaataattattgttaaatattacattacgtaaatataatttaaaaatatatttgttataaccagggcaaaatttgcatgactttaattaaaataaaaaagcaaagaatcataaagaaataaatgatgaattaatttgtctcgcgttgtttttgttttttaaaatatttttattattttaaaatatgtaggatttagtcaaataattattgttaaaaattactttctttattttccaagtctgtcgctgtgctgacaattcgcttcatcggcgtcggatgattttcataatatttcccgttgatgtacaaattacttcctcggaatgaaaaatgcgtggcgtgttgacccgaagtcacgtaatctcggccatctatgcgtactgtgtatacggtaggtggttgttgcgcatttcctacaacaccgatttaaaaaaaaaaattattttataaatttattttaccattgtgcaaaaagcagaccaaaactatccaaactagggcggaaaagagaaatgtgtgcatcatacaatataattaggaacggaaaaatattaaatgaattaaattatgctgaatgtatagcgcttttatgttggcattcgaatcgataatttcaaattttcgcgttaaaaaatattacatggaagataaaaacaaaattagatatatcgcaatgaagagagatggaagagaaaa

SEQ ID NO: 3384 - DNA, 2424 bp, Heterodera glycines
  misc_feature (2315)..(2315): n is a, c, g, or t
  misc_feature (2372)..(2372): n is a, c, g, or t
  misc_feature (2402)..(2402): n is a, c, g, or t
aaaataataataaactgaagcattcgttttaaaaatttatttccaaaattattcattcttaggggtggaactttcacattttgcgccaaaaagcgaaatgtgaaacgccaaaaaaaatgcgaaaaggcgaaatgcgaaaagtgaaacgcattttttaatctcaaaaccgtgttgaaattcaatttcatttaccgtaataatcgaacctttataatgctgccaaaggtgatcatactacataaaaactcggcacatttcaaatgaccaaactctcaaataagcagatccacccgaaaaatgcttcaatagcataacctttcaacgaaaaaaagggctatctaagatttatatatttttatatggtgcggatttttagtggcgaaaattcgcaaaagaattttaatatctcgggtttcaattgcagacaaaaaaaattcaaaaaatttttaaacttttaaatttgttaatacgaaattgaaagttgaccattcaaaaaacattcattagcaaaaaaaaagaaaaaagaagctgaaatggaataaagaaaataaaatgaaaaaattgatttgttttaattgagatagtcataacaaatattaaatatcaaaatgttttaaacgaaaattctttaatgtatttacaataaaaaattaattttgaataacaccataatcatttgttcaaagaattttcattttctgaaaaacctgccaacaaaaacatgaattctgtttaatacataaatacatatttttattttattaaaaaacaaataatatttttttaattttttaaaattaatttcttgtattatttcgaaaaagtaaccaatattcggaagcataatgttcaattgccatgttggcaaacaacgaatatgtacaatatgtttatataaaaaatttttccataattttgattttattatttattcatttgaaaattttttattcgtcaattttgcataaaatttacatataaataaaaaaatgaaaggaataattttggtttgcctgttaattgtcctaattgaattcggtaattttaaattaaaatattatctttatttaatttgaaaattttgtattcttaattaataatatgaaaaatgctaatagagtttttttgctatgaaaattctttggttgtgattttataatgccgaaaatgacaaaactagtcccaaaaactgtgcgctattgctaattgtttttcttgataattataaattttgtattacataattaggcaattcaatgcctatcgatgaaggaaatgatgatcaaactaaacctgctgtagacgttgaaaaatcagttggacgcaagcgaaagaagaactttgaagatgcaattaattttgtaaataaaattaaggtgctcctaattaaagacagagaaaatgttaatccgccaattcaaattcttcacttaattaattgctccccaaatttatgaatcatagcattttatttttattttacaacatttctaataggctgtcagccggtccaggtccccgatgttttaagtggctctaattcctatatccagaaatagtttagtctagaaatctgagagactcggctataaaaattttcgtaaaagccgaaaatttcttgaattttcgatttttatttagaaatctcataaatattatatttattttgttcataaatgatccatcattattttattttaaaccaatttcagcaacgattcattgaccatgaagatgtgttcaaaaattttctgaacgtttggaacaattatcgacgaggcaatttaaaaaacaaaaacccaaatgaagttttttggcaagttgccacactttttcatggccacgatgacctggtcaaagaatttgaagactttttgcccgagcaaacaattcgacgtaaattgaacgcttaaaatgacgcccaatttaaatgtcagagaaagttggacagatgacattgaaatagagataaaatgatataatggccattaaaatctattcattttaaattgttaattaaaattgtagaatatatcttttttctaggatttcattggatacttaaggcattttttagaaatcaaagtacaaaaagtttataggttcttgaaaaaaggacacatggtccaataatttatcgttaaaaaattaattttagacgctaatttatattactttcttatattcggcttaaacctacaaaattggcatattatggcatttaactgaaaataggcattttttgaatattttattttttaatagtactataaaatagtattgaatttggcggcataataataaaaataatttanatttattaatcagataaatttttagtattccctcaatttgttttcattaattctatncattattttaactttctttcaaagtaatanagatatgtacaattttttttta

SEQ ID NO: 3385 - DNA, 5461 bp, Heterodera glycines
  misc_feature (42)..(42): n is a, c, g, or t
  misc_feature (135)..(135): n is a, c, g, or t
  misc_feature (151)..(151): n is a, c, g, or t
  misc_feature (174)..(174): n is a, c, g, or t
  misc_feature (5352)..(5352): n is a, c, g, or t
  misc_feature (5418)..(5418): n is a, c, g, or t
tatatacagtagaattacagtactagtaaaatcatatcaagnttggcaatgaatcgacctgaatgtatcgacgtattgacgagggcggcagatgcgctcatacaaagtactttgaaagacggatgtgtcacattngagcatcctccacgtntattgggtcaccaatcgatttcncaatgagtcgttgaaatatcgacgctgaagcgttgtgatgttgcctttaggacaggtgtttcggagcatgtcaagaaggatcaaacgggcgggagacttctcattctcttcaggcaaaatcaccttcgaaagagaattaccatttaattctgcaaatattgtttttacttctgcaatttcacaaagactaagccgaattctcaccagtgtgtaggaattggtatccacgaattggcatagagtgagttcagaatagcgaatgtccattgcggccatgcctatgcaaaaagaaatttccaaaccacacatcgacgataaacgcaccaatttgcccacgattattgccctttccttcaatgatggcttaaattttgttcataatccatgatgaaaacaaaagctgcttaccaaccaaggtagagcaattaacggagattgaagtaagatttcttccacttctcgttaaggagatgcttttatttattgttaaagacatgcttctactgtatgtaaaaaataaaaacaaatgattcttatattgttgaaatgggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataagaaagttatgccacgcggaaagccaagaaaaagttaatttttgaggttttttggccataacttttttgtaaactgacgaaattttttgaagttttacaggctaatagagaatctgaagagctatcgaatgataacaaacatttttaatttggttgatcaggaaaaaagttgttagcaacggcgccgaaaaggccggcgccgaagtgggcggttcccgttgaaatgacgattgtaagaagacactatgggtcactccactgtgcagagaaaagcctagtactatctcgtcgtttctctttttctttgtaatttctctcgctgatcacgaatccgggctcagatcagcgctaccattcactacatgagctgtcagggacaaagacttgataggcttcctgtaccaataataccctcatgagcaaggtgccaatgaagatatcatccatacaaattgtctaattttttttgtttgagttcgtgtcagggattcgaaattggcaaaaaagggtgctgtattcgtgatcagcgacccgaaaaaccctttaaaacttattttcgttaattataaaatacatttataggcatctaaaatgtatggaaatctgccccttaaacttgaagagtaccaaaagttgagttatttagaaaacaagacaatgtattagcttaacaggacctataaattatggaatttctcctattttttatgatcctttgtcccgaaactaaattaatacaaaaatttgatttttttattgtctcttacacatacataataaaattgggtaaaaagcatatttttattttctttctcggctcctctcccatcatccaaacacaagcacagtgattgatggttttttgtcaaacggccagatcagtcaatacactgaaatttgaaaaatgctaaaaaaacacccgaatttgcccactttttcaaagtgtcccattcgcttggccgtgcattgtacatgctctcatggacatcaaaaatgtgtacagcgcctgactcatctccggccacaatttgttgccctttaattttacaaaaacaatttgtttagtcaaaaaatttgccgtaaaacaaaaaacttgccgttgtgactccactgaaatttggtgcccggctcaccaagcgcaactgaagtgattggcttctccgtgttcatgttgatgttccacagattgagctacaggggagaaagcatattttacgtcaaatttttggaagaatttgaagggaaaaaaagaatttttagaaaaaatgcattccgattccctaaaaagttcttacaaatgaattgtgggcccccataaaaaatgtgaaattccgaaacccacaaaaatcgatgtcagggaattgcgtttcatcactggtacgaaaatacgccatctttttcaacaacaaaaaaaacacttgccattccttccgcggaaagtgacgcaaacactgcgggatggacgggcgaccactggacatcggtcacgtaaaacttgtgcttgcggtccaatgtcaacaggggagccgacttttgactctgtaatgagacaaaaatgaagggcataattaaaaatcaatttaaaaaacaattaatgatataagaaaaaatgtgcaagaattttccatcaaacgataaatatctcttataataaaaattacgggaatatgtaaaattaattattctgattggtgggttagtctcaccttgatattccacagtttgatgccaaaatccatggagcaagtcaaacacagtgagctgaagtcaatggcacccaacgcgcgatgtgtgtccagcgcagtgatcggcaattggtgggctgtgcaagaaatggccattttatgaaatcaaaagagatgagaaaatgccgggatgagagagtctgattgggaaaatgctgtttttggatttgcaattcatgaaagtaatatgtcatttttgaaaattgttttataaaataatatggcattaaaaagcatcatcaccacccaccagcaatgcttctactcgactcgccgctggccgcgtgtcggtcgccaatgtacagctcgccctcctcagtgcccagcacgtaattgttgatgctgttgtgtaggaatgccatgctaagtgcacaaatctgaaacattggaaaggagagacaattttcatttcattgatatgcaaagcgaaaaaaataatcaccggcttttttgtcctgttacatgtcaattcggtggcttcaatgggcgactgcaagttgtcaatgctccatgaacacattcgaccgtccgtcgaaatggtgaccaagtcgtgcgcatttgctgtgccgaccatacgcatgcacaaaaggggctgtgtgtgtgctttggcggtcaacggagtctgagagggggaaaaattaaataaatgataaaagattttgtatattcatgtttgattatctcaagaaaaggttacaaattttgataaataaattgaaatataaattttgaaacacaaaaaaaaaaagtttttttgaaaattttttgaaaataggtagtaattcttcataaaatttcgaaaatagctaagaaaaatttggtagataactaaaactaaaacggttcactgctcaccttacacacaggcatccgtttgttcacccgcgtgtcccaaatgcaaatttgacccgaataacatgcaccgaagatgatgttcgcgttgaacatgtcccatgtcatgctcatcacgcgtgatgagctggtgaatgtcatcctggaaaacaaatgaatttgtgtgcaattgtttatttgtttattcggtaaaaaaaaatcacataaccgcaaactggacgataaaacttctcctcaattgttgcggtacacccccaggattatttatttgaagtttaacacgacaacttagtcggccaattattaccctttttgaaaaattaaaaaaattaattttttttttaaaattccaagattttttttgtaaaatttaaaaaaactttccgggggtggagcaacgacggggggaatgatgctcccccacccttgccaaggacaatcatcatcattatataacaacaacaccaacacactgacgcactcgggcgatgccgttttgaagcgtgtgttccacacattgatcacactgtcgggtgccaacggctcgtccttgtcccggtcatggcacaccgccaccaattcggggaaaatggtggaaaattcaatggcacagacggggcgaccaccgccggcagtgattgtgccgttgctggtcagctgttgttgttgttgttgatgctgttgaagcgctttgtgttgttggccaagaatgccaatggaagcggcggcaacaattttcctgtccaacttgagcagctcgcgcttgttgtcgtccattgtgtcgttgcgggtgccatcattcacataatcgacgaacacatccgactaatggttgaaaaaaaaggaatgaaaaaaccatgatttttcgaaattttttttttttgttgcatgttttgtgagaaaaaattcccctaaaaattggcaattagtgaaagccataaataatctaattgtttttcaaattgccaaaaaatcaaattgagaaaattgatttttccttaaaaaattgccaatttgtgagtgttttttgagtccgtttttgttagttatttaatattttttttgaaacgaactgctcgaaccccaccccctcctccaattaaatggttattacaagttccctctgctgctcacttcttccacaattgccctttcgatgacgcgcgacgcgtgctgaaaatagcgcgtgaacgcggcactgccgagaattttgcgcttctcctcatcactgagcggcggaattttgacatgcgtttgtgcttggtggtcatcgcatgacacatctttctgtgtctaaatgaatggttttatacattcaaactcgaacagtgtctaaaattcttaggtttgtatccgaattttggaatcgggttaggcattcggtattgacccaaatgaaatattcagattcgtgagcactgataaaggtgctcgaaaccccttcggggtacgttttccctgagtttttatgggaaaaagtatttctgcaatccgaaagaagggtcctttgccggatttcccccgcctaaaatttaaaaaaatttcgtgtaaaaattttactgtgattttttcaaaattttttgagtatatttgtatgttaccaagatcgcacaactgttaccaaccgaatggctgctgtagtgatgaaaatggaggttcttcaactgtttgcgcacttccattgtcggcgattcctccatggtgccctcaatttgcccggccgccgcttcctcgtcaatggacagctcgtcaaacgcgaactcctgcgagcccatgctgaactcgccgtgcgagtgccgtccccgctcctcatccgtctgtgttgttttgcagtaggaaatctatgtgtgatgcaaaattaaatgcaatttngggggttgtgtgtttgtgagtcaaataaagatgggacgggaccgggattttctcgtggtcccgtgngattatattcgagaagccgactttggaatacatccctagtctt

SEQ ID NO: 3386 - DNA, 4377 bp, Heterodera glycines
gaaaaacgtgagtggcacgacggtacacccaattctttttaccaagccaccgttgcattcgcgggcgcttgaatgggcactgctcgggtcgctgggcgcctcctcccgatttgtgcgcggctgaatgcccaagtcggccatcatcgcgtccagctcggccggtgtcatggtcgagcgtgaggttactccaattgaaaataaacacactaaccccctcataaaattttcggaaattccaaccattttcaatccgtttgccgtgcattcgttcgcccttatgtctcagtttggccgctttcatctcggctaatttgcgctttttctcctccaattcccgttgccgttccctctggtcatagtcttgttccgacattaaatttttatgtgtaaaataatatgcccttaatgcaagaaaatatattgaatgagtaaaatttatgaaacgtttttcaaccaacttttggctatataaaatatctccattttcgaaagaaatgataaaattagaattaaaatcaaaatatttagaaaaactgctctcaaaaacaaataagttataaaaaaagattaaggaggtgaggcttaatccaagaggcgggcgtttaaatttcgcaattttcaaatttatggtagagaaagataaatgggaaatttaaatttaaccacatggttccaattaaaagaaaaatgaatactgatgtatgtagaggaaaagaaaaactggcaaaaattttagaaacctggcaaataatgcccagtgcttcggcactaaaaacagttttgatgccataaaaattcagcaaaatcccattcgaagtatgtatgagcaaataacaaaaaaaaaagaaaattgataattgttaaacgatacaataaaccacagagaggggagatatgtatgtatgtatgtacacatgatggttggaggaaactttcttcagtttttgtgtggggagaataggcgaagagaaaggggaggggggcggaaaaatcatgacatgtttatcttttagattccctttatccaattcaggacgtttaaaaaatcatgacgggcggaggggagagacggctttattaagttttagacgtccaatcgacttttagatatccgtccaacaaacaatgattttgctcagtttcttgggccgtaacttttttttaatttgtcaatgaaagcttaatgtctcgggaatttacaaatgcaagaaaagagtaaatattgcaaaaattacagaaaacagggtaaaacaaattatggtctaagaatgaggatagtcactactaattagtgattaggcgcctaaaagtcgattgggcgcctgaaagttcaatagagccggaggagaccacactcgtcaaaacctttctccagtgaacaaaaaaccaaaagcatgtgcaccacctccaccaccaccagcatcattaactaatttctttcgcatttcctttccccccccattttttttgcctttttctcattatttgtcattgtcactctctctgttcatcattatcatcatcatcgttgtcgtcaaatgatggaggaagttttcccgtttccttttctctttttgctgtgtgtgtgtgtctattctttgggcagacgccgtccgccacacactcatcaactaatcaacaaaaaagcggcggtgctttccaaatgcacaaaattattgccagaggatggcaaaaatttccaatcaaaatgtacaagaagagacaaaattgcttgagacatacatagggtacattcggaaaaaatcctatggaatttgaaaatcaatgacccccccctccacccgaaaacccatacaaagttaggttggatctccatgttggcgtgcaatttgtcgggttgaggctttgtcagggtgtagtccccgaaaatggtcagttgagataaagtcgaagatccaatccgttcatgtgttaaattaaaaagccgatggattttgtttgatctcgtttattcgaatgatcaaatttcaattcatattctttgtttttgtcatctatctgccattaaatcagccaatcaattaattgtattgcatttcaaactctccataatggggtcattaacaaatcgatttgatgggcatggcacatactttaaaacatgcacaaaatcgagcgcattcctttcaatcaacagttgctgcagggatgaatgacctaatcaactaaagcaaatctttctctctctgatttcacgggactgatataatgtataaatatgcccaaaaagcaaaatgggggcattaggaggggggaggggaataaaataaccccgaaaagcgaagcgatttgttagcggaaattgttgtacaacaatgatgatgatgatcaccaggaacagcaagttgttaatagtgctgttagagactaaaagcttgtgaccttgggagcctaaaaacccccgagacctctttcgctcgtctcgagcctgacattctcgaacagcactaatgagcggaactcagcgatccacaattcgagggaccaggtcgtttcagcgcccacgtttcggcgccaagccagacatttaacaaataagaaaaaacacacgcaaaggccatctattcacaattttagaaatccggtacttgtgcagtttacaggggcaatttcacatagattttcagatcccaataaatgtgttttagaaattaatgaaaataagctttaaggggttttcgaggtcgctgatcacgaatccgggctcagaccagcgctaccgttcgctgcatgatttattggcatctgaaaatgtatgtgaaattgctcctgttagctgcacaagtaccaaaaatcctataaaagaaaaaagtgtctaacaaaaagtcgaaatttcaaaattctcttttatgttcgtatctgtacagaatacccatttttttgaggttacaatgatttttaactaaattaagcttttttggtgaatttaggaacaaaaataagaattgaaaaattttgagttttcggctttttgttagaattcgggtccgggattcgaaactggccaaaatgaatgtcagattgatcagcgaccctggcgccgaaacgtcggcgccgaaacgaccctggcgccgaaacgtcggcgccgaaacgatacggaccccaattcgagaccgcggtaatttgaatccgcgatgcgcgagcagcgattcacggcagtttgatgcgtggtccgtgaccgtggtaatttgaatcaacgactcgactcgtctggtttttctgcccgcgtcccagccctggcaaggtgcccacttttgcgcctcatagcctgccattggccatgacttttcttgctttatcaaaatctccatggacagacggacaagctctccaaaactttcaaattgctcttttgtcaattccaatttctgctgctctttatgcttcccatgaatttctccaactgttttgcacaaaatttgatcagcatcagtcacaatttttgtaagcgagaagagagagggtgacggacggagtttgcacaccgatcatttgccaccgcctctccccgacacgcggaggtaattgccgccgccccgccggcatcagtcagtcagcaatcatcagcagcagcagccggcgctgccgaggtgaaaataattgccaccggcgcgccaaatggggaaaacatggaaaaatgaatgtgtgggtttgacgcagcgagaagaagcacgcacacacaatgagctgcagaagaagttgaactgctgctgggtggtgcagcaccaccagcagcagcagcaggtggtctgcgaagcaaaacaaattattggttggaggagaaaatatatggatattttaggataattgtgaggggggggggggggggaggggcaagggatgtggtgtgattagtaaatttgtcctccatgtctgccagggatgtgtttcggaatgccggttgccgaaattgttgagccgacggaattccgatttccgatttacgaaaattttttttgtacgtcggaattccgattgccgaaatttttgagaagtcaaatgccgatttccgaaaaggattaggaattggtcttattcctaaaatatttacaacagaaattgccaggaaaatcccgagtgggatttttcagggtttcgtttccaatttgctgggaccaagtctcgattatcgtggaattttccgtcttgcgcatcactttaaaacttcgtcctaaaattatcccggctcaattctgcatgtaattatttcaatcaaaatataaaaaattttccagagaatgtgccgccttccacctctttcttagggctgctgattttgtggggtcgtcggcgtcggatttgagtcgtcgcccatttatccgccattatccctcaaaatggtcgtcggcttatccc

SEQ ID NO: 3387 - DNA, 1600 bp, Heterodera glycines
gaattgcgttgcccccttcccccacaaatttcccgttggtcggtgccttgtggtgatgattggtaccaccatcaccgcccccggcccgcccgggggctccttttcctcaaagcaaagcgcaacctcccccaaatccaaagatagtgatggtggatgactggaggagggatgtgatgtgagtgagtgaatgtgcagcgatccctccttcccccccccccggcccttcgtcctttgacagaccaacaatttgagggaggacaggggggggggggggggaggagtccaccaacctcaacaccaaacacaacatcaacctcaaaatcagcatcatcatcagcaaaatttacggggtggggggggagagaatcggaggaccaaaaacgacggggggaagagatttccattatccgatccgactccacctttgtaggattttagaagaatgatgatgaaaatttaagaggaggttgagtgtttgtttgttggtcgttgtgtcataggttggtggctgcatggttttcaccacataaatgtatttcaatgacggaaattcaataatccgtaattacggagtttttctaaagttatacagacatctgataatccgtaattacgtgccaccttgtccttccgaacaaggaggaactgctggctgatcagttcactttagggcaaattctcggctcgagaatttctcgacgcggttttttctggtttaggcgctttgaaaagttgacaaactctgatcacagcgccagttgaattacattgatcagattttgttgatcacttaatgataataccttttcttatcattaattttttatttttttccaaaattctgagttttccattattttaattttttgcaaaattaattcataaattttttcaagtagaatgatcagaagcgcaccagattttgcaggataacagctgagaacaataccttatttataattaattttccatcccatatagtttcgttaaaaattttttggttttccaatttaaaaaaaaaatttctccaacataatttttcaccaggtgatcagaagctcgccaaactttgcagggatattaaaaggaagataatcaacctattttaatcattataatcccatttcctgaaaatatttcaacgcttattcgttttaattttttttttaaattctgagttttccattattttattttttattgaagctgatctgttttatacaatgttcaaagaaaaatttcatgaaatttttttatttatttggcacaaattataaattgcaccaatttcaacaaatttctggacaaatcactcattcattcttcaacatgtggatcacccatcacaaccttatactccaccgatctgactttttgatcattccaccaacaaaaggcactcactcattgcgccgtccgtcgaaaagtttgacttttggcgcggcggtggcgttgaggtgacctcccccaacccctcgggggtgattttgaggtgactttctttggggggggggggcagggggcacagctccgtcgaccgattggacaggcgcaaattgtgaatgaatggaaattggatgggctccgggggaaggggggg

SEQ ID NO: 3388 - DNA, 2696 bp, Heterodera glycines
aatagaaattttggcgctagtgaaaaagttggtgtttttgaaaatttttttcacttttttttggtcaatttttttttgtttgtttaaaaagtcctgaaaccaagtaccctggagttttagaggtcgctgatcatgaatatgacaattatttgggcctgttaagcaaatttggcgctagttataaatagagaccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggggtttggcacatattttgcacatattttggcatttttgagaaaaattgcaataaaaatacaagaaaattgaaaaatacacccctaaaaatcgacttttttcataattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattagcacatattttggcatttttgggggtttttagcacatatttcagcattttttagcacatattttattacatatttcaggatttttagcacataaaaatccggtctctagttataaagtgatagattgtgaattttatcaaaaaccatagggggacctttttgttttgtaaaaatttttttggttaaaaatcgtgaaatactttttattcaccataattgtgctattaatacttaatattcatcattagggacgcgatttctagtgaaaaaactttttttttgctcgattgatttgatgaaaggagctcaaaaaacgcatttctgcattaaaatttttcatttggacgtcatttttcgtcactagaaaccactatttttgcatttcgtcacttaaaatagtgaaaattcacttttttggcgttttgtcactatttttcactttttcgacattttttggaaaattccttaacagaattgcaataaaaccaaaaaatacacccctaagaatcgacctaaaaaatttcaaaatgtacacccctaataatcgacctaaaaaattttttggaaaattttctcaaaaattcatcgaccaaatctttttttcttgacaaaaatttttatttaaaaagttaagaaatgtacacttcatttgcaacagcaatcagtgaataaaaattatttttgctcaatgtttggctgaaaattatgtcactattcgtcactatttcgaacttttttcactattttgtcacttttttggcacttattcgtcactattttagttaactattttgggatttttcgtcactaaaagtcgcgaccctattcatcattatgtgtaaaaaaattttttaaaaattagaccaaaaaaaagtgaaaaattttttcaaaaacaccaactttttcactagcgccgaaattttccgagaaaaaattattgaaaaaaatatttgcattgagacgcattaaccaaatatttgaacttttataattttttttggcgccgaaacgtgagcgccgaaacgagcgcgccgaaacgtgggcgccgaaacgtgatgcgattctgagaactaccaggggcttatctagggcgctgatcacgaatctgacatcagatttatcattagggctgtgaattttaggttttaattaaattttttgctcgattgatttgaagaaaggagctcaaaaaacgcatttctgcattaaaaattttcgatttggatctcactatcgatcactagaaatcactattttggcgacttagtcactaaaatagttaaaaatcactattttggcgttttgtcactatttttcactatttcgacattttttggaaaattccttaacaaaaatgcaataaaaccaaaaaatacacccctaagaatcgaccttaaaaaattttcaaaaaatacaccccctaagaatcgagctaaaatttttcaaaatatactcctatgaaatgaaaaaaatttttctcaaaactttatttcttggcaaaaatttttaattttaaaaattttttttaggtaactattttgggttttttggtcttaaaaatcccagtcctactcatttgcaactgcaatcagtgaataaaaattatttttgctcaatttttggctgaaaatttgtcactattcgtcactatttcggactttttgtcactatttcttcactattttggcatttttactcactattttagttaactattttgggatttttcgtcactaaaattcacagccctatttatcatatgacatttaatctatgattttatgtaatgtctatgatttttcatcaagtaatttgttcaccaatccgtaaatcatgcacacaattttgttgatcctctcaccggccggagtaggacaaaacgtcgtcagccgaaacgtcgtcgaacgaatttttcgaccataacttttttctttctcagctcaattaaacattcttggtattatt

SEQ ID NO: 3389 - DNA, 3735 bp, Heterodera glycines
  misc_feature (47)..(47): n is a, c, g, or t
  misc_feature (2777)..(2777): n is a, c, g, or t
tacatttttgagctaatgaattctattggtcttttgtcatagcaacncggtgaaaaaacgcaaaattgaagttggggaaagcgatggcaatgagcagcggagtgttgcggtccgtctcttctcggaggacggcaaagagattggccaggcacccgtcgttgtgcgtctttttaatatttaaaatttatttccaatttttgcttctcgtcctttagcttcttgcttccaccactgctgaacagctccaagtgctttaccaccaattgttgcgcagtgaaaaacagcaaaacggcgaatgcggcgacgacggagactttgacgaagggacggcgcccgtccaatttcggaccgtcgcagacgaaaaaagtggcggaaaagggacggaaattgtcgattctttgctcgactcactgccctcagaacgcctcttcttggaaaaggttattattttcacgctttagcataaagcaactggacatttattacgctgtgacaaaaagccattacataattagggcattcgatcaaaaatacagaaaaataggtataaattaccaaaaacggaatatatttgcaaaacgtgggaattttatcaaattcgtttcatatttatatgatgaggttgacagcctagtgaagtgtaactgttttaaagtgtttcatttccaattgactttcagcccctcgagttggtctgtctgccacaggccgtgttccgagttcggcccgtcactcggtgcaccgcttcgttgcccggccatggcgaacccgtcctttccgtacagttcagtcccgacggaaggtgtgcctttttcatttttgtctcactccccccaccccctctttaagctgtttggccagtggttctggtgaccggacagtgcgtttgtgggatttgcacacgaatctgcccaaacagacgttgaccggtcacaacgattgggtgctgtgcatcggctggtcgccggacggtcgcgcgttagcatccgcgtgcaaaagcggcgtcatccgcgtgtgggacgcgcgcagcggggcgcagcgacgcgtgctgaacggccatcagaaatgggtgaatgcactcgcatggcagccgctgcatgaggcgaccagcgacgcgcagtgcaggccgtgttttcttcgaacgagcaattattaagcgttggttggctttttaggttgttggccagtgccggatgggacaaaaccattcgaatttgggacattcttttgggtggcactgtccgcgtgctcagcggtcacaccgcatcggtcggtaattgggcaaagagttactatcaattggtcaatttatttggattgattgtctcattgtcaggtgacagcagttcggtggggcggttgcggactgatttattcggggtcacaggtcggctgaacatttttaatttggctttttacaatatttgtcccctttcttgttttcaaagaagccaagttttacaagcaattgtcattttacaacacaaaaaagaatgaaatataattacttaaagccctaaattaaattcgaatttttcattttaaaattgtgagcacctttttcgttttttatttcatttttattagtatttttgaaaatactgaaaacgaattttaacctaaaaattccatctcttattggctctgtgctcttttgggcccggatttgaatttcgaaaaaattaacgaactacccattcccaaaacaggaaattctcctcttatttttgtttttaattgtttaatttcaaccttttgtgtttgaggatcggaccgtaaaagtgtggcgcgcggaggacggcactttgtgccgcactttgaccggacatggccattggatcaacactttgtcgctgagctgcgattacgtgctcagagtgggctatttctcggccgaggcgcaaagcaaaggccaaccgacgctcagtccgttctccgacggaatttccacggaaaaagtgttccatttttgcaaattcattagttatcagtgcccagtgattccattttttctctttcacagattgtaaacgatgccaaacagcgctatttgagggcactcggccaaccgtcgctggaacggctcgtgtcgggctcggacgacttcacaatgtttttgtgggagccgggcgaaaagaagcagccaattgcgcggatgaccggccaccaacagttggtcaatcaggtgggccaactcaaccaaaacacggagagacgaaatgccaaacaactgttgaatgttcgaatttgaacaggtccaatttgcgcccgacacgcggaccatcgcctccgcctcttttgacaagtcaattaaactgtgggacggacgcaccggcgcattcgtcgccactctgcgcggccacgtgggccccgtgtaccaaattggctggtcctctgacagccgactgctcgtctccggctctgccgactcgacactgaaagtgagagaaatgaccaaaccgcggattggcacccattttaaacctctttttttgttgttctttttaggtttggaacattcggaccaccaaattaatgttggatttgccgggccatggggacgaagtgttcgccgtggattggtagatttatgacgaacatttttgcagcttcttgaaaaagcgtaacagtttctccctttttaggagtccaaatggtgaaacagtggccagcggaggaaaggacagaattctcaaattgtggaaaagataacacaaaattgcctatcctttttgttattgttgttttaatttgtccaatataaattacataattanattctgattttttccaattatgaattggatgaatccttttaaattggctaatcattcgtcttttggtcttcggtctgttgccattggcaacacttccgccggtcgctgttttgcctgaattttttattttaggactaattatttttcgtattttaatttaatttcgtcgctttcaatggatggcattgactcattgccaatcttttatgacatcgatggcgacgtcgaacagctccaattttggtgataaacacaattgtccccccgggggggggggacaattggtcgacactccgccgaattccgtcgcgaaaattaaaaaataaaggcccgggatcagcctttctatgctgtggtcttcaaatttaatttcgctgatttcattttagcatttctctgttttctgtcgaccaatccgtcggcacttttttggctgcaaaaagtgaaattggcgcacaaaattttgttggcgaatcgtccggcagcgaattattgtcaaatgcaaaatttggagaagaacgattggaagagcaaaggcattttggatggatggaaaaagtgccgaaaccgacggttggcacgccgaaattggcacaaaaggggggaccaaagggaagtgacggggcaccggtggaacaagaggaggagcagaagctggaggaggaagagaaacaaaaagaagtggaggaaagggagcgaaaacaaccgccgacggagggacgacaacggcggaggtggggaggggggggggagggaaggagagtacttgaacccacctgtgcggctcaaatgtttgaaaatgttttagatttttcttttttagcccggccaaatttatgctagtttttggaaattaaaaactcacttcacagtgggcacaatgttcgtgggataatgcttaaaataaacaaaatcgggagggttgaatttccatacatatgtaattttgcgatttttc

SEQ ID NO: 3390 - DNA, 4008 bp, Heterodera glycines
caccctttgcgattcggaagcaacgctaatatgtgctaaccaagcgcaaaatgagaagcaaatcccggacaaaaagaaaagtgggccaaaaagggtgaattaaaaaaagatgacaaatgaaatcaaaacttaccaaaaatagaacgttttcatcgactctgaacaattcaattcaatttttgtcttctgaactgcgaagccaaaaccgttcaatcgtcggaagtgaacaaagaatgcaaattgtggcatatttgggcagcgatcagtgagggaaaggacggcacaattcaaaaaataaaataaaatgcaaatcaaaagctttcttcagcatctacgacccgtcggaggagtatttgctgtggaatttgcgagtggcgaacggtcgccgattggtcaccgattgggccattgacagaacacgcggcgtacaatctgccaaaacagggaaagtgttcagggcacggctgacagtcaaagagccgacactttcggacgaaattggggagaaaggacagcaaaaaggggccgaagaagcggaagaaaaacggataattgaggaagaagtggaggaggcggaagactttgaaatgccggaacgcagcgaagcgtattgggcgcattggacggtggaaattggcatgtccagcggagggggggggggggagtaccccaattaaacgccctttttgcccaagggaggggcgtcggctttttgcgagacaatttgcgcgtggaatgggcgttggaaatgccccaaaattgccaatgtttgtcgtctgcacatccgccaatggggggaggcggtggcagcgatcaacagcagcacaaagacggacagcggaagattaacggaatgacacagcgatgcgcggtgaaaagcgtgggaagggtttgtgttctgcgggggaggaataaaatgccaacatttgtgccaaaagtgaaggacgacgtggcacacttcggctatcccatggaattcacgctgaattacgacggcccaccggcaaacatttccgaagaagcggagacaaagcccaacaatgtttggccaagaatgaccttcacggtgacagcggaagacagctggggaaggattttcgtggaaggtgttggcatagtgccaatttttgggtatttatcagcgcgaaaacagtgccaaaaaccgtccgataaacggcaagcggacaaaatcccgactaagcaaaatctcaacttaattaattgatttaaaaaactctcgacttccaaacctcggcttactgccttttttcacatgatttgtgttttgtccattttttgtgtgttgtcctttgtcaactcatatacagacattccaccatttgaaaatgcctttgccatttgtccctcaaaagggtttgccgtctttcctctgcccatttcatttggcccttcgcccgttcacttttggctcaattgcgtccgcccaatttcgcctctgtccaaagtgtggacacttcgccaaactcacattggccaagcggaggaattggcacagctcagaacaatgggcgaacaaatggtaaaaattgttctttattcgtaatttaatttaaaaaacaaaacaatcaaatcgcagttttgtcaagagggaatggccacggaattgggcggaaaattggaactcacagtgcgaactgtgcaccaaagccgacaatacatctccagtgacattttacaatcgcttaaatacaacgcaatgatgcgacggattgggtgggaattggcggggaaagatgaaaggataattaatcacactaattaacttaattaattaatttcccaatcaaaaagcgaagcaaacggaaaagcaatttccaggatcagtgagcaattgcagtgtcgcattgccaaagtgttggaggagttcgatcgggtgaagcgacagctgatcaaagtgcggaagggtcgaagcattgccaacgcataaaaaaggaaatttattttaaattttgctattaaataaataatttttttttaaaattagcattttaagaacttttaattttattcaaattacgcacaaaaatacattaattaattctacaaagaaaaatagcattaaaaatgcaaaaaagagaaaattcacaaataaaaatatttaacaaagttgaagccgtgtttgaaactgctcaaaatgcaacggacagagctcatcagaaaaaaaagtttaaaaacatttcgtggagggaaataaaagagagaaattaaaattaaaaaaaaaactatcagtgacttttcaaatgattgtcaattggaattctgccgcttgtgggattgattggttacaaaatattgccattttgccgtttctttcctctcattcatccgttttcccattttccattccgtgccgccctcgccgtgccgttttcttcgtcgtcacttgcggtcgctttcgcttccctgtcaaaccacgtccagtgccgcctccctctcgtccaattcttccgtgccgccgccgttgttgttgttttcgcccgtcgcttcgtcgccatgtgcttcgtcgatagccaccgctaacgcagaggcggcggcgccgcatgccgtgcccgtctccgcatcggcagtgccgctgctgctcgcgctgctgtccgtccctccgccaatttcgtcgccgctttcctccacgcggtcgccagcatggtaaagtatatgcgatgcagcagaatgatcagcaacattgaggaggtggtgatgctgagacggggagtcgaacgcgtgccggtcggaggcggtgccattgcccgcgtcgctccccgcgcctgcggcgctgccctccgcgccgtcatcgtcgcccaccaaatgcacgccggtccccgccccggccaatccatccaaatagctgtgcagtgtgctcagctcattgccttgaggtttgcacgacgctaaaggcaaaaattaagcgaaataacgcggcggatttgacagtgcattcattcgttaaaataaaaataaaaattcaatttcaatttaaaatatattaaattcatttatttctcactgtttttccaatgcgtccgaagtccgctgggactaaagcaaaaagaaaaagggcatttattttgatggcattcagcagaagagtccattcactcaccttatgtaatttttgccgcaagttcgacacgcaaacggacgttcctaaaaattagaaattccaattgaaaaaatttattaattgaagtaaatttgcacatttgaatgaattcggacgtgcaatttgagatggacgagttgggtgaaggagagattgcacctgaaagaagaaaagcgaaactaatgaaggagctaatttacgaaaaagcatgggcccgaacttggcttcatgtttgactctgacaagtaaatgttgatttttttgaaaggcttgccaaggcccgggcccaggccgcctgacctaattcctttgaaattgctttaaaaagcaattaaaggttgaaaaaatctaataagtgtttaaaaataaaaaaaatatttaaacaaaataataatttttaatctatttaatcaatctttgatagcaagaaataaaacagtgggttcttcaaataaataaatttcaaaatattacccagaaatcgggttttcgtacttaacttggactgggcttttgtaggaaaatcagaatgacaaaaatgaccatgacattgacccaggaaaagcccgacccgaacccaggcctaggccaagccgtagaaggctctttaattattgatatcaaatgaattttgcttttttatctccaccacctgtcgcagctgtacgggcgttgtccgttgtgcagtcggaggtgcgtcttcaaattgctggtggaggagaagcgcttctcgcacaccttggacgaagaaaacgattaaattaaattttgcacggcaatttaagtttctttccggttaatttccttgcctaattaattccttaattaattccctaattaattccctcccatttcgtttatttctgtgctctctttgtcccaccacctga

SEQ ID NO: 3391 - DNA, 5567 bp, Heterodera glycines
  misc_feature (5492)..(5493): n is a, c, g, or t
ttccaaaaaactttttgggaagaaaggggtccggcggtgcagttaggcgccgccggggaaaaattttgaaaatttgagtgagatttgtttacgaatttcaacaaaaaggctggttttttggactactgggctcaatttgtatggattttctttaaaaaattataaaatatgcgcaattaaaaaaaagtatgaggaagcatagcttgtcgatatgtaggaactagagtccggtaaaaaaaaatttccgggagcgggatcgggagttcaaaattttccgggacgggagtcccgaacgggaatcccgtaaaaatcccgctcccgttaaaaatcccgttcaccgaaaaaagcgggagtcgggagcgggaatcccgtaaaatcccgcgggagtcccgatcccgccggactctagtaggaacccatgaacaaaaagaaaatcaaaatatttgaatttctgcagagtgattgaaccaagggaaagaagtggaaaatcaagaggattccatattcgtgatcattgatcagcgacctcggaaacccccggcggatacttgttttctgaactttttaaaccaaaaaaagaatttgaaaaaatgttgaccaaaaatgtggatacaaactcctgtagtaccatttttataattagataacaaagcggaaaacaatgaaaacaaaatttgagaagctcgaaaaacacagaaaaagggaacgcaacagaagagaggaggaccaccaaagagaatattttgcaaaattatgaccatttgccgggcgttttaccttatccccccacccacaaatcaatcgatcaaataatcaattggacggatagaggaaaaggatgaaaatagcattggggaaggaggagagacggaagagaaagagaggaaaaggaaaaattcgaagcaaggagggggagaaagaggaggaaaaggatgaaaatagcattggggaaggaggagagacggaagagaaagagaggaaaaggaaaaattcgaagcaaggagggggagaaagaggaggaaaaggatgaaaatagcattggggaaggaggagagacggaagagaaagagaggaaaaggaaaaattcgaagcaaggagggggagaaagaggaggaaaaggatgaaaatagcattggggaaggaggagagacggaagagaaagagaggaaaaggaaaaattcgaagcaaggagggggagaaagaggaggaaaaggatgaaaatagcattggggaaggaggagagacggaagagaaagagaggaaaaggaaaaattcgacggaagaaggagggggagaaagaggaggaaaaggatgaaaatagcagtggggaaggaggagagacggaagagaaagagaggaaaaggaaaaattcgacggaaggaagaggaggagagaatgaagcagaaaagagagaggaacagcagcaaattgacactttttaaaattttgccggtcctaattgctaatggatgtcgtaaatccacgtcaaaatcctaaaaaatacacaattttcgaaagaaaaatgcattcattcgattacataggcaaaaaattttgtgttgtggcgtgggtttgcaggagcacagcttgttccccaaatcccattaacgatttaaaaaaaaatcatgaatttctcagggaatttcgggcaaatttcaaacaatttattacaaatagagctaaaatttttagaccccctaagaatagaccccaaaaattttcagaaaatttttttaaaaggcatttgatcactgatttaattatgatcggtcggtcatttcttaattaattcatttcttcttcagctgatcactgtttttgttcgtttgtccctcactcatttcgcccttttgtgatgctttgtcccgcttcttctgccggtggcggagacaaaggccttaattaagcgcaaaattcaaattggataaaaatcaaatgctttttattgctcacccaatgcaattagtgccactaaaaagccaaatgaacacattgttacaattgttgttccaattttcatctttcttctgctgtagcttaaccgccgtggtctccgcaattttatggacataaaatagcaaaaatatggacataaattctccgaattgaggggtaaattttcaaaaatattcttcaaattcattaaattctattagaatacatctaaaatggctaaatacggtataagaactcgttttaaaagaaaaaaagctatttttaatgaaaaccaacaaaaaaaaaccgaaattttcctttttgcttatttttgacataaataaccaatttctaagaaaatttaaatttaatcaattttttcgacaaaattttgttaaaaaatgtctttttcggaaaattttccagtctttggggtcaaaacggccaatttagctgacgagggccgttctaataggggttttgtagaaaaatgccaaaatatggacataaatcgcgaaatatggaaaaatatggatatagaaatccatcctagaagcttcaaaccaagctaaaaacatgtttttcttgcgtgtccagaaaaaaaatatggatttccatataattggaagccctagtgatcagtgatcccggaaatccctgcctgaaaagtcaatttttgttgattaatggggaaagcgtaagtggtgaatgtttgccgaaaaaatccattttccaatggcacgaccaccgccagcagcattatcaggcagaaaagcggtgccaatttcgtttgtgttcggctccagcacaccccgcgagatctcccaccatgtcaacgaatgtgccaagaaggggctgaaggccaagttggaccagggcggtggggacacggcgaagcgccggggtgacatcatctactacatgaggcaggcaaagtccactgacgcgaaaggtccagcagagcaggcaaatttcaaatggagtggagtcatttttgtgctccgtaaatacgggtacatccctaaatctcgccactcgaaagctcgccgagacaaaatctggctgacttgaatatttttttttataaaattgaaaatcccggactgctaatttgaaattacatggtttttggagctccgtaattacggattacggcttccgtgtcgaaaaatagctgtaattacggcttcgcgtaattggaaaatccagttacgtacagccctggataggacaaccatttttggcactgtgtgccaatggtcgagagcagaaaattattggcattgaccagggctcccagatcaaaattttcaaaagcctcatttggcaggcaaaaaagcctcatttttataaaaggtattctaaacacgcttaaaatgttcaaattttatatttttgattgcccatgatcaatttgagcaattttttgttcgaaataaacattttgtgaaattctaagcatgaaaaaccgaagttgatttttttgcggcgcttttttcaaaaaacttttggggaataatgggggccggcggtgcagataggcgccgccgggaaaaattttgtaattttcaatgcgatttgttaacagatttgtcgacaaatatggccaaaaacattatgccattttatcaaaattaatcaaaatttaaaaaatctgacgaattttccccaaaaatcttcaaaatttctcaaaaaaccacaaaaagcctcaaaatttctcaaaaaccacaaaaagcctcaaagcctcattttgaaaatttagcctcattgacctatcaaaaaaccacaaaatgaggctaaagcctcgcatctgggagccctggcattgaccaggccagaactaagaaccttccccaccgaatctctggcttagagaattggacaattttacatggacacgagagagggttgaaattggattttttggcataatgccattgggccgaaggtgcgaggttttaaattggaggattttaggtaagaatttcttggcacggtgccagggttcaagttccgccgatccgaattgccgatttaatattttttgccgtttgcctaaatatccatggggaccgaacggtgtggcacagattttctgctttgtccttccttacttggccctcaactagttttgccgggatttgagtcccgacaccgaaattcgagtcccagttttgtcggaatctcgatcctcccgttttccaatagaaaaaacggatcggcgtctcgggaaatcctaatgggatcccgatcccttcccgtttatagtctcgaattttcggaggtcaatctcggtccgagtcttgccgagtctcaaattttccatgcctaattttctgggcctcaatgcgcggctggccagcagcagcccttttccaaaacagtggtgccaagtcttagcattcagaggtgccaattctttcataaatccaccaattatatcgaatttttcgacaaaacatgggataactttgcttaaatgcaataaaattgtatattcttggtatcattcgatagccgagctttttcactattagcccgcaaaataaaaataaaaattggtcaactttagaaaaagttgtatgaaaataagtactatttctgccataacttatgttaaatttggtaacttttttgaaattttccaagctaatagagaaaaagctgggctatcgaatggtaccaagaattaaaatttgattgactttaagcaaagttatgccatgttttgtcgaaaaatttgctaaaattggcggatttatgaaacgatctggcacggcattcggagataaaagaaatattttaaaatgggataatgcatttttaagagcgatggatcactgctggcggcggcggtggtcgctccatttcgacagagtcacgaaatgaggaagatgaagctgcttccgagccggacattttgcaggacagaatgatcgacttcatgcggcacaaaaaggaaagcacaacaacaccaacaacagcaacaacgaaaatggaggacggcggcggcagcaggggaagggtactgtagcttgggatgggtttttgtaacaataatatactgtagctagttggcatacagtaagcggtggaaaatggatcggcgtctcgggaaatcctaatgggatcccgatcccttcccgtttatagtctcgaattttcggaggtcaatctcggtccgagtcttgccgagtctcaaattttccatgcctaattttctgggcctcaatgcgcggctggccagcagcagcccttttccaaaacagtggtgccaaatcttagcattcatcagaggtgccaggtcgtttcataaatccgccaattttaacgaatttttcgacaaatcatggcataactttgcttaaatgcaataaaattgtatattcttggtatcattcgatagccaagctttttctctatttgcctgcaaaattgcaaaaaatttggtcaactttagaaaaagttgtatgaaaataagtactatttctaccataactactgttaaatttggtaactttttttgcaattttgcaggctaatagagaaaaagcttnnctatcgaatggtaccaagaatgtaaaatcttggtaagtgcctttaaacaaagttatgccatgttttgtcgaaaa

SEQ ID NO: 3392 - DNA, 2255 bp, Heterodera glycines
ataaattaaaagtaaatgcccacctccaaatgccgtccttcggcatccaaaatgcgtggcacaatgccaaagaatggcagcgtggcagcgcccggttttgttggcgttgccccaggcattggcgtcagcacatgaccacccttaaattaaaaattaaaaatgattttaattgaaaatatcttgattaaagggaaaaattaaagtgaagcaataattaaaaattaataataaataaagaaaagaaaaaataatttttttttaaataaaaggataaaaaattattatttaattttaaaataataaagaaaaattatataaaaaataataataaagaaaaataattaaaaaataaatacgaatcaatgattttttaaatattattataaattaaaataaattagaaatgtattaaatacagagtaacacaaaatattacagtctccgtttgccaataagtgtccacaatggcacaccgttcttctcccactacggtgtacaaccatttccaagctgaaggatttattggctgaaattaaaaaaaagcaaaaattaattttgtaataattcaattaaaaaagttaccacctcgccaaccgagccgatcacttgaagcgatgaacggtcatgttttgtgaccatttcgtctgaaaatgccatcagcgcacgcacagcggttggcgcagtgtacagcttggtgatctgtatggaaaaaattaaaaaaacaaaaaaaaaataaaggaaaataaaaatgttaaaatctttttaaataattttcaaaaaataatatggattatgttagatttttatatttttacacattttatttttgtagataaacatttttatgagtgaagcatgaaaaacttaaaaaatttctcagaaaaaattttcaaattctagacgatatcacgaaaatttaatttttatttagacttgttttactaaattttttaaaaaattgttatttataaaaattgtcaaaaaaaaatatagcataaaaataaattgttataattcttttggtgttttagcatttttttttgaaggttttttagcaaaggtatataatgtatatatttatttaaaaaattcaaaaccaggcctaataaatcaatatttaattgattttccaccttatatttctcgacaatggcccacattcgggatgtgtctggatagctgggcaccccttcaaagatcaccgatgtcagcccgttcagcaacggtccatagaccacatatgagtgacccgtgatccagcctgtgatttgtgagaatgattttaattctttcccgcaaaattttttctagtaattgtttcaaattttttcaaaaccgggattccggtcgaaaattccaggttcatcgaccaattctaattaaaattttaaaaaattgaccacaatcagcggtacaccaataaacatcatggtcagcatgtgcatcaaacgagcatttggtggtcatgtacacatagcacatgtaactgaaaatacattcagtcacaacatattttaaaattttttgcgagaatttctagtgaaattctatcataaaagcaaaaagtaaatttaatttttttggacaaggtgagtaatgatacggaaaaaaagtcattgctgagaaatttcttacttttaaaatttaccaaaacttaagactttttttttggggggaggggaactagatttttatcaacgaaattttttctatctgcgccaaaaaatccaaaaaattttgaaaacaaataaaaattgttaagacaagaaaatttttaaaaacttaccaaatttatgaggcttttcaaaagtttattaaatttttttagtctaggttttggttttggtaaatttttttaaaatttcctcgccggaaggggtacgacggaggaatcaagaccatcaaaatcccgacaataatttgaatacatattccctacccggccgtggtgtgcaaaatgcccttgggcaccccggtggagccggacgtgtacaggatgaacagcgggtgttccgcgtccacccactcgaccggagcagccgcgccatgcgctccactatgcttttccgctgccattgccgcgtcccagctcacatccctcgcggcatcccattgtgatgttgttgttgcttgcgccgatgtgccgttgccattcccgttgccgttgtcagccgccgaatgccgtggcacgctcactttgcacaaatgttccacgacgatcatgtgctccaccgggtggcccttctccgcacaca

SEQ ID NO: 3393 - DNA, 1759 bp, Heterodera glycines
cgcaggccaacattgccaccggcaattcgataaccatgggcaaatagatggacactacgtcaccagcgcgaacgcctcgggcgcgcaatacggcagcgaacgtgaccacctgtgcagcaaaataaagacccgtgaaagaagcatccggagccaaaaaaatttggattttaaaagaaattcattaaaatttttgaaatttaagaccaaaaattcttaaaaagtggcaactataaaaaaatgaaagcggacctattaaacttttaaaaccttttaatcttttctataaaaaaaattagaatgatttattttttctaaaaaaattttaaaaattctaattttttttaatttgaaataacgaaaaaattagcagaaatttttcgtgtttcctagaaaaacaaaaaaataattttaattctttttgagaaagaaattctaggttttaattgaaaattaaaaatgtacgaaactccattgtacaaactaactgcccattgtacgaaaagccatcaaccctttttaagccaggtaacatggcataattctgagaaaattatttcccattatctacaataggctcaatcatcattttttgccattgaaaacaccacctgatcaagcagttgttggtaagtgattgtccgctcgtcgcctggttcgtttccctcccagcggtaggccacccgatcaccaatcccggctttaatgttacgttcctgaattaaatttttgggggggtataaataatgatcattgaccaaatgggtgtactacatccattcccccaccgtttcccgtccctctccctaacaaaaagaaaaattcaaacataaattttaaaattcaagaaaacaaaattttcgaaaaaaattttccaacgatttttcaaggtttatgatgaaatactacttttttctttaaattttcttataaaaaattctaaaaaaaattttttgaaaattttctaagtagaaatcaatcagatccatacaaatcagtctcacaatcaggcattaggtatacgtcagcatttttgacgcccgatttgtcgcccataccctcctctcggtggttcgctgtgtaatggcacaatttgtgccattcttgagtaaagagagactttcgaggccttaccaagtcaatcatgcaaaaaaataataatttctcaccaagcaattgtacgcaatgtttgtccgagaaccgaccatgaagtgcacaaaaacttcgcctttacgatgatcaaaattccattccagcccgttgttcgaaaacacttcaaagtgaagctgttcagcaacagaatgccaaaactttttcgggtcgtccaaagaatggcgatacatgtcctgacaaaattggcaaaacattcaattttggcatgataaaagtcgagggttttggcaacggattttttgttgaaattcaacaagggattttggccgagcactgatcaacaggagttggagatgaatttgtaaaacagtgatcaaagaaaaacctttagaaattctatcctcgaaatgccaagactagtggaaaaagtctgttaatccattagagaccggcaggacaggagcatgagagatcctgtgcaggattttcccaagatcctgactggaccaggtccggactcctgtctgggtccatcttggaaacccccggcccccaggtccagatcctagttcgctttttttcaaaaattccgggttctattaatcaccacatatgttgccatgccattaacatgggcaccggctaacag

SEQ ID NO: 3394 - DNA, 1446 bp, Heterodera glycines
tgggaaaatttgcaaaaaataaataaaaatgaaaaaaataaaatagtttggctagaaaagatataagaaataacgtttaaataaaagagagtggaaaggaaaaattggaaacgggaaagaggaaatccaagaaaatagtgcatgaatgggagagagtgggaaaaagaatgagcatatgcgtttagaatgcatgaaaaatgtaggaaaagaaagaaagaaaaaaagaaaggaaaatggaaataattttttattatgaaaattttctttaatttgataaaataaataatagtgttgaattatgagagtgggaaaattaagaaaggaaaatggaaatatttttttttaataaaaattttctttaaatgtatgtaggctttttaattttaaaagaaaataatttaaatttatgttttaagaaagtgaagacagttttaaaatggtaaatggatgagataataatctcaaaaaattaataatgcgggacgggagggagggagagaatggtttagccaaagcacgattttcagcaggatttcttaattagccttaattggtttatctgatcatgctcatttatgtgaatgtcagatgatccggttaaaaaatgcacacacaaaaaatgcacacacacacaaataccgattttttggagttttggcaaaatgtgcaaatgtcgtcgatgccgtagctgttgtgacgctgtagcaacaacttgaactcgttgttgccaagcatcggtaactgggagaacaacaatgaaacgacgtgcatttgtcgacaaattacgggacatattttatttaattatttattggtataatttttaccaaaaatttttggactatttgtatttagcgcgctaattaggtaattaatgatgaaagagaaaaatgatttaagagtaggcagtcggtcggtcgctgtttttatttgtttgtacgttcattttaaaatgtcgaaagtgtgtgctgacgagaaaagtgtgggtattgagcgatttttgaatgaacatacagcagagagagcaacagcagcaggtgttgtgagattataatcataattatgatttattgatatggcctagagctatttaaacagaaccataatttcgaaatgaaaaatttcagatttttagaatggatttttccaaatgtagactaggttccgataaaattaagtatctttatagcgctaaaaaaattagataataatattctgctcattattagtttggtcggtgtaataaaaggatcaaattaaatcgactgatcatttatttcctctgggagcaattaagatcaattagaagtgaacatggtcagatagatttgtgcttcaatattttgtaattatttgagaaatttctcaaaattataaaatcatatatagacggaaaaatgtttgtaaaaaaatgagaattcaaaagaaaatgttaatagttatgat

SEQ ID NO: 3395 - DNA, 930 bp, Heterodera glycines
caacatattaattttaaattccaacgccaaattacaagaaacattttgctggcggccaggggcggagcaaaagccgtcaaaatagctaaatttcaaaatccattgtgtaaacgatggaaaaaatcgaagaattttcaaaaatacacccctaagaatcgggcgaaaaattttaaaaaatacacccctaagaattgacttttcggatcggtaccccccccccccccccaagcccaaatcctggatacgtccctggttatgatgatcacttgcgtgaccaattttaattagtaagcaattaaagaaatattgaaagggtttaactttttttttttgcaaattggaaagaccgattcacaacactatgaattaaaaataataaaatagtaatagtaattgttagtaaaaatcggttttaaaacttgtttgtcaagatttgttaattgtgaatgagagtgaaaaacaacaaaagggcgaggcggaagaaattaaaaaagatttcgataatttgatcaaattaaaattgaagttttaacttttatgtgaaattttaaataaatctttctaagaaaaaattaatttaatttgagtataaaaaatattttaagatttagaattataaacaattaaatgaattctaaaaacttgcactggtaagaaagggaattcgagcatgaaattattcatgaaaatttggtaaaagggaaaggaatatgctccaaattttcgtcaattttagaaaaaattctttccttttattttattcttgacctattgtaaatttatagtcgttttttgttgacaaatacatataatgtaagtaaaaataataaacaacataggtggaatggacacatgttttcatttctataaaaatttcatttttcctcaaaacatccttttgtttaggtatttaaattattttattaaaaa

SEQ ID NO: 3396 - DNA, 2355 bp, Heterodera glycines
ttataaatcttttctgatttcgacaaaaaaagagcaattcggcatccgaatcgatatacctaacaaaaattgaaattgttaattaactgatagtgtggaatgatagtggagtcgattcaaattttaaaattcagcaaaatttggatgtagattaaacaatgaatgcatatttgaggtgtactttgattcattcagcattcaattaattttctcaattttaaattcgcgccaatttaaaaaattttaaattaaaaacgattctactgttcagtattaggtatttgaaataattttgagccaatgagataatgattaagcaacaagcttattgatttggattaattcatttaaaaaagaaactcacgcggtggcggatgaagaacagcgaaggttaagcccattttggttaactgctgtttttcaatttttttttcatataatataatttccaatttatcgtttgcttactcaatcgatgtgttttggataaagcaaaattcgttgccatatgaatttttaatatggctgaagtgtgcgtaaggcattaagacggacgtcaatttaattaatccctccaaaaacaaggaaaaccactaatccctttagggagttcaaaaaatattaaaaaaaaccgggtacttgtacagtttggatcacatacatagaagatttttaatgctaaaaatgtgtttttaggggtattcggggtcgctgatcacgaatataacattaatttcgaccaatttcgaacccgtgacttgaattcgaaccaaagtcgaaaaaaatcaccaaaatccgccattattatccaaaatcgattcaaatcaaattttattcctttaattcgaatatttttcatttttcagatactttagtactatttccaattgataactctcctctacaaattacacacaacaaatatggttgttgacatttcaaagatggagcctttttcaccaccagtatgctttttttttataaaagaaactgaaaacaagatacctaaatgaactttattttgcccgacatcgttcgggtgtactttttcgaaatccctgtccttgacatttgcgccttagaacttgattttgaacataggagcaatgtccaaggcgcaaaccagggatggggcgcggacagtaaaataccgcagtcgcggattcaagttgccgcggtcgcggatctcgtcaaaaaaatcccgcgtcaaattgccgtgttcgcgtcccaccccaggcgcaaatgtcggagaacataaaaatcaaaaaatttcattcttttgaatccattttctggttagaaaaattttggtttcgtattcattccggtctctaatggtttaaatataattgcccgaaaatttgggttgtctgtgtacaaaattattttataatcattgtccatttttaggtgagtcacgcgttgttcccccatttgaccactgttttgctttccatcgggctcatcttcaccgcgtggttttttgtgcatggggtaagaaaaaaatggatacattttgaagctatgcaattttttcaaatttcgctgaaattaaaaaaaaaccagatacctgtcggaacggccggaccctgattttctaaggttttcaaaaagccaaaacccatacatttggctatatttaatctcgaaaaaaacttcggaccgaaaaacaaaacaggaaaaaatccatggttttttagagtgggtattaaattgtcgacccctcaaccccaaaacttacgataaaatcgaacaaaacggaaattttctaaaatcactaatatgctttattctacacaaaaaattcactgcatattaatgcaaataaagagtgtcacaataaatttcaactttttttgaaaaatttttgtggggtgggggcgaactgctctcgttcaaattccattcctttttgcaggtgaccagtacgaagaaaacgcgaaaccttgtcaaggagttgttcatcggcacattggcgtccctttttcttggcttcggcaccctttttctgatgctttgggtcggcatttatgtttagagttgaaaggaggaagaacacagggatttttgtcttatttttggggactttttttttctaatttatttgtattttttttattcctctgctaattgttattgagtgagtctgcccttttttgtttgtttcttcccaatttggaaactgttgaatgttgtgtaattgtttgtccctttaatatttttattttaaaataaatggaaaacttgggggtgcaactgtacccgtcttgcggcgccttctctgcgatatcagcaatttaattctggcccacaaacaaaactccttaaaatagttataaattgaggggggggggg

SEQ ID NO: 3397 - DNA, 3032 bp, Heterodera glycines
  misc_feature (55)..(56): n is a, c, g, or t
  misc_feature (107)..(107): n is a, c, g, or t
  misc_feature (144)..(144): n is a, c, g, or t
  misc_feature (2011)..(2011): n is a, c, g, or t
gatgatgcttcaataagaattattttttacatgaaaaatggttaaagcgcattcnngaaacatccctatttatcatgggtgttattgggtccggagcttaatgaacncggtatagtgaaaaagtttggcatttcactgactcgnccatgacacaatgacacagagacccatgctggttccttgattttgaaactagtttccttcctgacccggacgcgataaaaatttttgtaaaattttctagccgatcaccgatttttccctccatgaaatgtcttgggaggaacactattttttaaaaaagaattaaccattccataaattacgtgcaatccactgttgcaagttgaatatactgtactcgctaattataaaattttgtaacttcctgtaggattaataaatggttgctaaaaaatatcaactcactaaaattatatcaacaagctcaggccattccttatccaaaaaattctcatcccagcttggaaagacgagacgcttttcattattagccaattcttttggtttggcatttgattcggctgcctccgcaacttctccagcttgagcatttggtgcggatgcctccgcatctttaccagttggcacatccaaagcaatttcttcataaattggctctattgaggcatctaatatggaattagccaggaatagaattttaaagaaaaattaatttttgtggcattttttaagagcgtgtacacaaattttgaattgggcgatttagtcccgttagccatattcgaccaatcaatcgaaaagtcgcggtctcgttaattttgaacggtcgagcggaaaagattttcgagcttgtttaccatgaccccgtgctccgcacaaaccgtttttgtgatgctcgcaccattcaatcacttctcgcatcaccgtactacttacatttgaaaccggaaatttctaaaaaactataaataatcgtcaagcactctatttataggaaatttattaaaaaagatttttattttatcgaaaattatggcaaaattcattataaaatttctatttagacatgaataatagtagtaatctaattttttttgaacttttaatctaagagcaaaaaatgctcttcaaattccctcatttgtcagattttttccagaggtacaagcctggtttgtgccttcagcagtgtacattccaagatctaggaaataaaaaattagttttttttttaaataattgcatcgaagaaatatgtatttaccttccatcattgtgtcaagcgtagtagaaaaacgaaaaatattacgatcgagctctacttccacttccacgttgtccgcacatttgaggaatatggttggagctggaatttaaatttgtactttttatttatttttaaaataagtttcaaaaatagagaaattaaaaaagcatttaaaattttgaaaaactagctcaaaaatcacgattattaaaatatgttagtttctaaaaaatattttttgcaataaatttttcacactccatgaaaatttgtctttttttgcaaacctattacgaaaactcaggggggggacacatattataggggaagtattgtagagtagccattttttttacaaaaaagaaaattgcatattattcttacaccataaaaacacgtcagtccgaaaaaaacgagagatgaaccaacaggtaaatagagattgtgagagaaatacgcgacaaaatgaaatgccaaaggtttgttaatgatcatttacgcggcggcggcggattggggtgatgcacatattggaaaatggaggacgaatttgcgggatttcggcccttggcacgctgctgctgttcatgaaacgccatctcataggcacgactcttctgaccctggggaaaagtagagaaaagatagaaaaaattgctctttacgcaacctttgcagagcgtatttttcaaaatcaaaaatcggggaaggaagggcctggcagtgcagataggcgccacattgaaaaattgaagaatntagggccatatttttaaacccgcgccaaaaatgataattttgtggttttttggaaaaattagtatggaaaagagacctccattagaaccactgttttacaaaaaaaattttggctgccgaagaaaacaattcaactcaaaattgattattaacaaaaatttcgttgttcacctgctccctctgtttgctggcatctgcacgcgcacctaagggtgatgaggtccctgtttgcctgttcacatgaggcaaaatcaatgaataaaaccgaaatttgaacaaaaaaaaaaaacactaaataggtactccacttttctaaaactttgcttaaattaaaaaaaaaaagttaatttttggcttaattttttgaaaatttttctgatgttagtacagataagttttccttagaaattttaaataataagtgctcttgagccagaaattttttcttgtcagccacactaaagcccccccgccccctccggcttcgttacaacaatttttttttgtacctgctcgaagtggttgatttaagagatgtggaaattggactggcaaaattgacacgattgttccggctactggccccatcttaaaaaatctattattaaagaaaaatttgcttttttttaaagtaaaaaaattcaactgcggctgtcatcacggcctaacggcgaaagtaaagacatttttggtcagaaattagcgcctatattttttgaaaaaattacactggaaaaattaggggcctaaaaaaggttgggttcctccccttcatcctttcggatttttttttctgtttacaggcctgttttaaaactaacagtaaaaaaaatcatgagaaaattttaaggtttttttttctagctaatccacaattttttgacaaattacaaagtttttcaaaaaattttccaccccacttgtttgttgcttcaaaattggctgcttcggtggtgctggcggtggtgttggaggtgatgactgtctcgtaaggctactgctgctgtgacggctccgctcc

SEQ ID NO: 3398 - DNA, 1310 bp, Heterodera glycines
ccccccccccctctctctctcttctctctgtgagtgtctttcgtctctctctctctctcgcttctctctctgtgtgtccctcttatttcgccacctgaatcatttgcggttcgtccattatttgacgaagggcgagacgaaccccgtaaagtttggcagcaaagtcttgttcagattcacattcgcatgattccgccctaaacgcttggaaaattttgaaaacaataatcaaaaattatcaaaattaagtgaacatagtccaatttgcccggcttaatatgccatcaaatctaaggttttagtcggaccaacctgctcttacgaaaccgcacttccccttgttgcaccatctcaagtcctcgcttgtatagacccattgcactttgttcagtgcccattgttgtcagcgacggctgaggctcgtcgccctgcggcggtacttgggatacggcgacctaaaaaggaggaagcaaaatttaaaaaatgttcctttggaaagatccaaaattttgggtacaagctaaattcggcaaaggcgtttgctgtgattagtatgttaacagtagaagcatagccattcccatgcccacccatgaaatgaaaaaaaaaaacttaaaatgggaaatttttagaaaatttaaagcaattcttaacaaagggcattaaaattccaaaaatattcacgtcaacgctacaataccgcccccattttatgcaaaaagcagttttttatcaagattatcagctcggtttgttgtactgatcatgatcattacctggttctgttcgaagccgtccatttcggtcaaaggttggttgatggtttggttggcatgcggagaaatggcatcgtttgcccgttttgagcccaccgagtcaaaattacaaaaattcctggtcatcatgcgtcgtatgtgtccatcaaattttgcgaagtattcctttagccctttgctttcccaattggatgtcgacgggaaatcagaggaagttttgaagtgggaatacccaatggatatgctgaaaatctcaaggattattacaagtccaaataatttaacatacgcaaatgctgcagttccaatggcaccaaatcgaaataatcgcagggaaagaggacggaaacgcatctttaaaacaaaagaaataaaatgcacaaatgttttgtaagtaatagagacagagattttcaaatcagtcggaccatcgagaaaggaagacttaagagaaacctgaaaaggaaaaaaagaaaaggggaaaaagaaaagaggaaaaagaatagagatgaatgaagggtcacagagaaaaaa

SEQ ID NO: 3399 - DNA, 2021 bp, Heterodera glycines
  misc_feature (52)..(53): n is a, c, g, or t
  misc_feature (80)..(80): n is a, c, g, or t
  misc_feature (193)..(193): n is a, c, g, or t
ggaaaaagaaaagaggaaaagaatagagatgaatgaggtcacccagagaaannaagggaaaaaggaaaaaggggagaganaagcggaaaaagaaaagaggaaaaagaaaggggaaaagaaaaagaggaaaaagaaaaggggaaaagaaaaagaggaaaaagaaaaggggaaatcgtgatcagcgaccccgaanaattttgaacgacttgttaaattttgaaaatttccgccaaaaataggggtaacatcttaactattaccatttgttcatatttttgtttgttttgcggatagaaatctgtcttttaagcggagttgtggtgttgagttttccgttttccggagaaattaagggccataaggcttaaatcgcctctaacattagctaaccgaatcaacctgactgcaaccaacactaaaataatgtacagacattccttaagcattttctgttcactttatacaagaaaaaattcattaaacaaaaaatttttgtgggtgaaaaaatgtgaaaatctgggtaaattcgtaaaaaaatttctagggggttggtaaaaaatttccgtattgaaccaaacgcgcctcagcggatgcgcggcgtagagccctcatccaaaggccattttgtagagaattttattctctttcatatgccttaatttgatcaatttgttctcgccaaaatgcttgcgccatataaactcggggaaataagtttcaaatgtgtttgcagtgtttccgctacgtggtcggaaaacccgcgtaattgttcaatagccattagggggtgaggaataggtctaatgccagggatttggccaaatggaatgggttgtggagcacccctccccccgccccttactcccattaacaaaaagacgttcgctgacagacacaaaagctgttcaaaatgcagctgcaattaacaaagaggtcgtcgaccagccgatttaaatttggagaatttttttttaatcctttcgtgcattataatcgattttgggcaataaatgttaattttggtgaaaaataaattttcgacttttgttcgaatttgggtctggggtcgaaattggtcgaaatagatgtcagattcgtgatcagcgtccccgaaaacccctaaaaacatgttttaatcgaaaaaaaaaatttgaaattttttttcaaaaaagggaggggacaaactacagtattacccaaatgacttttttgatcaatactaaaaactaagcttaaatgagttttttcagattttttaatgctcaattcaaaaagtaacagcattctgaaaaaagtgtccttatattaatgttacaccccattttggaaaaaaaaattcgtaaaaatgtttccgtcattatttcgggttctcaattttagaatcttaatattttcagaattgctacgtagttaaaatttcaactcgatcggttcatgggaagtggtcaaactaacaaaaaatagggcgtccttatattaatgttacagtgtatgagaaggcacgaagaaatcctactgggtcatgactgttgcagcattttgctgcgactcgtttttgaatcgttaaaccgaagaaagaaacagttaaagtgccaaaattatttgcaaccgaaatttattaaatatttcgaatgaagaatatttattcgacccaagtattgaaatgaattagaaaacagaaagtaacaacgtttttcacttccttcttctccgttccaaattactcttccgtctttttagcgccgttcgcttccactgcctttccgcttcccttgacatttgttcctccgcccacttcctcctcctcctcagcttcatctttgaacacagtcctcttaaggtcaaaaattgactttgtcttcttttcccagctgccctccgtcccttccaaccttcgcctttctgccctcttcgtcctgtttctgttcgtgtcccctttttctgtttcgtctcgcctgttgttgctggtcaaacttcccacttttgccctttgctttgccctgcttcatccgctgctgctt

SEQ ID NO: 3400 - DNA, 2710 bp, Heterodera glycines
  misc_feature (2680)..(2680): n is a, c, g, or t
gttatttcgggcccaactaagccggtattcaggtataagtccaaacagaaactagcacacgtttaattatacgtttaaacaaccgtaagaattgattaaataataagattgccaggttcccatacataaattttttgattttcaagaacatataaattttaagaaaaaagggttgctaaaatttactaaattttaatgatttatataacattttatttatttattttgttttatttttttgaaatcccccctctggtgcccaaacttcccggtgcccaaatttctggtgcccaaacttcctggtgcccaaacttcccggtgcccaaacttcatgtcgcctttgaaattaggtagcaaatcaaaatgccaaaaatcaaatttataaaaatttttctatcttggtatgcaattcgcaaaatttttcgtaaaatctctgacagaaaattccgacttcttgttcgaattcgagtccagaagtcgaagttggtcaagatgaaggttctattcgtgatattctgaaaaccacctcacacatgtttttgtgacattaaagcagaaaaattctttctaaaaaagggaactataggcagtattaccagtttcttgattcaaggtctttagtatttttcttttgaaatcgtataatggtcgagaggcgcaaggaatcgcctaagcgtcgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggttaacctgttagggactctaattggctaagctaaccaatgtttctgctccctccatttcgatgtatacacttattcgcaaatcttttattttaggacggggggacggttaacccactcgtattcttttcgtttaataggtcgcgttctccccatcgtgtccaaccgaaaacagagaaaagcactgtcagctctcgccgttcaccgtctccccgtcgtcgtcgtccgtcgcctcccagccgcggcccgcgtcgccgttcgcgctcgcctcgtcatgaacgcgcggctccatcaccaccaccagtgaaaagggaacgtactccggaaccaccgccacgccgactttgtgttcggtaatttttgttgtaatttattgaaatacaaatgaattgttcagaaatctaagcagaaatatcacaaaagcgcacatggaggaaatcttcgctctgtttggggctctaaagtcctgtgagttgccaatggaccgtgtgcatgtgcatttgccccggggatacggctatgtggagtatgaaaaggcggaggatgcggagaaggctctgaaacatatggacggaggtcaaattgacggactggaaattcagtgcgaaatgacttttcctttcaaagggaccggcggaggttagagcacatggggagtgttttcttcggtttacttattgcttcgtttaggtcgtggtcattcgcccgtcgggattaattctatgggcattgggatcaagcgcgagcggagccgttcccctgcgcgtcgttttgccgctcgtttgtcgcctccgcgtcgcggccgtcgctcgcgctcgccgcctccgatgcgcgcgtctggcgcaaatcaaattcctttggggaacaacggccgttttagaagtcgatctcctcgtcgttgatgactgatgaccatcttttgcaatgaagcgatttcgaataatacccacgtaaaattgtttgatcaaatgaaaacgaaaagtgttctcgcccctcgttattttgttctcgttttcgaaatcgatcaatatatatggtcattctgtcccaatttatttaaaaaaattaatgtttttacattaattggctagcttttgttagaaatgcacttcagaaatatttaccagattgtttggttttattgcatcttgtttagaattttattgttataaacgatttgcagatgtcaatttttcgtagctttttctctgctacagacgatgctcaatcggacgatgcaactaatgcagaaatagtcgatcgccttgtcgaacgattggaaaccgggagcagtatcgaagacaggagggatgcgctcaaagcacttaggtcgttggcgcgggtaaggcgcctgttccaccatttttcttaaggttacaacctttgattgcagaatcttcgtcttcatgtcgcgactcgtggcatgagcgcttacatggacattcttgaaaaggaggccaacctgcaagatttggttgccctcacattagacattttggacatagtgctcaacgacagtgccaacggtggtgagcaagacgcaacgacagtggctgagaacgaggacgaagtgggcgatcgccttgctgaagtgtttctgcaaaagcccacatttatggtctcgctgatcaaactgcttgagtgttatgacttcgccgtgcgcaggcaaaaaatgatatactttttcaacgagtttacgtattcagaaatgccattaaacttttgacttcgctgcttcggcataggcccagtgccgtgcagcaggcggtgattagtcaagcagtcggaatttcccacattgtcgaccttctccatgacaaggtgngacttacaattatgatcttttataggccta

SEQ ID NO: 3401 - DNA, 1762 bp, Heterodera glycines
tcagaattttacatacgagcggcccaacgcccttcagccgttggcaaaaggcccttccgatttgttgttggattatcaattcaccaaattcttcaaattaatggagggtttgttttctgttcattttttctcactttgaactgcatctttaagggcatttgcttaagtttttccgtccaaacggtgaactttcttcttctgtaaatacacagcttgaaggtgcgcttgtgccttacaaaaagttgatcaaaaaacaggacgaaaccattgccgagcttaccagggaactgaaagagttgaaagttgcgcagaagcaacaaaagacggacaatgagcagcaaaaagagcataccaactgcaatggagtgggtttttctttatactagtactagtacacctcattatttagtttctcaaggttattccaactgaagagtttgcttcaacgactgtccaagcggatgcctcagcaaatggcgagcaattggcactgctgagggcggaattggcagagaaaaatgcactgaacgaacggagggcagacgcagagacgaaactgcagcagctgacagtgtccggaggcggatttcccatgaaatatcgaccaatttcaattttagccttgcacaacaatggcaaatcgaagctgatcgatacaagggatgggctttgcaatggcagtcctaccaaatatcgcaggttttcgtcaattaccgaaaaaaaactatttattttttaactcacaataagttgcctaacccaactgatacggtaatccaacaattggagcagcaaaaaacagagcttgaactacaaatccaatatggatggcaggcctttgaagcgcaaagtgctcaattaggcgaattagtacgaatttcggaagcaaatgcgaacaaactgaaccaggtggagcgtgaattgtccgaagttagcagtgagcgagaaactttgcggcagcaattagaggtcttacatttactctcccagaagtgcatcgaatcaatcgacaaatgtttagagccagcaaaatgtcccgcagggatcagccgttgccacacacagcgaggagttgacactgctgaagcgtgaacacgaggacttgttgctactgttggcagagcaggacaggaaaatacatgactaccgtcggcggttggcctcccatggagaagcattaagtgacgcggacgaagagccatgaacctgcccagaagaagaagaacacgagctcttcccagtcttaatgaggcctacaaaatttgatgctgacaaagaaattctttggttccttttcctgttgtgaatcttgattcgtttttttcttttaaatcgactaacaaaaagctggactgtttataatttattgtttccccttgttgcgaattgccttgagtttggttgtgttattacggtttcaactgaataagagacaactttgtataggcgaatcatgtctgtgattgtttatttaattttgataaagcaaatatgtgtttgtttttcattttctataatggcaattttcccatctgtcataaactaaaaattcaaaaacttaatgcttttcattgtttgctttgcttgctaaaaacgtgcgatggtaattgccacaccgcccgctacgatggaagagggtcgcattttgctggtcggcaatgaaagcgatattttgcactcggctttttgttttccactgaacgaaggcggtaaaaggtcagagagaatggcatttgccattgaatttatatttctgattgtg

SEQ ID NO: 3402 - DNA, 5054 bp, Heterodera glycines
  misc_feature (1456)..(1456): n is a, c, g, or t
ctaatagttatttctacttctgctctgacatcatttctctttatcatttggtcaacttcggtagggtctatccgtttgtccgacttcaccaacacttcccggcgaagtttgacgaattgacgtcctccggtctgtgttttggctttggtcactgcttcaggattttcttcaaaaacgcagtgaacggtggcccggatttgggcgggatcagtgatttgccacaactgacgctgatcgatcagctgaataggaaaaacaaaataatataattaacacccgtggagcccacttcttccattgactgctgagtttgttttctgcccaattccttcatcaattgaatgcaaaccaatttggtgagtcgtttttgttggttaaatgcaatgagatcagcgaaatgacgaataaaaaacggacttaaattgcaaatgtaatttcacttgacttcaagcggaaaagcaccaactcagtgggaggaaagtcggcagaaagccaatcgcaaatatgtctgagttcttcgagccacggaaaaaagcaatcattagggatcattttgccagaagaggtgtaatggcgaataaaagtctccattttggcatcattctgaaacaaaattgccataaaaggcagtgccatccgtcgatgaattaattaagcaaaaaaaggctgacacaaatgttccttttttggtaccccccccccttatcgctgggtctgttcttcacccgttcgtccaatccatcggtccgtccctctcaccataatttcgatggcgaacgacggagggtagccgaactcgacaacgcattgatggaaaaacagttccctttttacgcttcgcttcgcatctttcacccaatccgagtcgatgttgaggcggggcaaattgggctcgggcataaatcggtagtccattttagaacccttcgctcgggatgtcgtcgtggtcttcctgttcacttttttttaatctgaatttgtacccaatgacagaccctttcacgtccactgccctcgtttcctcttctatttggcccccgtctctcagaatggacatttggcgtctcaattctattccaatggcggcgcttaaaaggctcaaactactcaggttcttcaactcggtccgttttcccggagtctctcccttcgacacggagacattcacgtccactctgaaatggccctctgaaaatggaaaacaaatcagagtttcaatccagtcaatatgaccatgaaaatggccggtacaaatgtcgttgtgcatcaacaaacggcgcaactgctcgacaaaaagggtcgcctcgaaggcattggccaagtcgggcgccgtcacaatttccactaggccaacgccggcccggttcaggtcgacgaggtcattctcatctgctcgcagagttttcccgctgtccatttccaattgaagctgctcaattttgatggacttctcganaaaatcctgcaaaattccatttatgaggaattaaaaaacgataatatgaagcaatacggtagaatttttgtcattttgcgagtacaaattgaagtgaccgttccgggcattggacaacttttctgcgtaatttggtagcctaaaatttagaatagcttaattatcaaaaaatgcccacccaatggaaggtccggataaaaataatgcttccgatcaaacggcaaacatccgcaatttcacagttcaacaggactgcggcgagaaggcatttctgttaaggtaaaaatacaaaatacatatcatcaaattgtcgctgcattggctggcgaaatcacctcaacgcacttccgattcaaagttggcaaagtgccgggagttgccaaatcctaaaaatgtgttggcttagtttgagaatttaagtggataaataaagtaatgggcgctcacaaatgcggagacgacactgttactggtcaaagatgaagaagcgggtgaaatggcatccgaaaaaagtttggaggacgaattgatttgtgcgtgaatctgagaaaaacggaagctaatgaagagaggaaagacaagagatgttcgatcgttttacttccaatccaatttgaggcttaaagccttcaaaatcgttgttggaaaaagagacaaatcggcgaacgggaaaaagcgcagatttgtgaaagagagaataattatttattcgaattgccatgattgagctgtattcaactaaaagaaaacgctaaagacgaaaaaattatgaggaaatttgtttttattaggtggggggtcaacaaaatcgttatgcttatttcctattatttaatttaccatccagacaaataggtatttggaatttccgctcatttaataatgtatttttcaaggatttatagagaagaggtcatgtcattcagattttacaattaacaatatcaataagaaatggcatccctgaatataatcaagaacaattgaaaaacccatgatgacaatcaatagcaaggctttatagcaaggacgagaagctaaatgtccattttagtgaataaaacaatacatttaatgaaatagatttgttcctactaatatttttgttaaaacaaagtcttaaggccttctaataaattaacgaataaggtcgaggaaattcttggccggcgtctcaccgctgcaaactttgtgaatcgccacaaagaacggaaacctgaaggataagtaaattcaataaagcaaaaataggagtatttcatcttctcatatcgtttccccacccaaaaaaaaataataattttttttgggggagaaacatagtgcaacccaaattaaacgatcaccgttgatcattcttatttacatattttgttcgactcactctttggtcagattcttcgcttgcagcacttcgaacacttctttcgctgtcaatggcccctgcgcactctgtccattcagcaattccttctccacctctgccaaaggctaaaagaaacaaataaattcttattttgacggattattcgcataccttgtttgatttgacgaatgcctcgcacactcttcggttccgtccgcctatacacgtggtcaaaagatcagcgaatccgcacgactcgaaaaaggtcttcaagttggcgccgggatagaacagttcgatgaactttatcatgtccatgagaccgattcggatgatggccgcctgttgaaaggttaaaaatgattcgctgtttctccttcacccccaaccattgtgttgtcgccataaccgagcccaactgagaatccggcgccgcatgccacgatgtttttaagagcaccgcacaactcaacctaaaataggcatttccgcgaaaaaaagaagcaattcatttaccgttgccgcgtcttcgaccacatttattcggaaattgtcggtgtgaaacaacttcttcaattcatttccatgctgtgggtttttggttcctacaggcaaaataaataaaatgaattttaccaacaagaattaaatgtttaccaatagttgcttcacaaaactaaaaataataaatgatttataaaacaatggaggaaagaatttacgtggtcttctgccacttcgttcgcgagattagcacccattagcacggaagtgtcaatgccaagagaggtcgcgatttcattagagatcagtcgcagcccaatgtctttttcgtgaaaagtggccaagccctaaaaataattttcaaaaataactcactgctttatttaatcgttttcaccttaatcagcgaaattgcgattgcgctctttttgatgtttcctttgagctgttcgcaaactttgtgcaagaattggtgagggatgatgaaaatgagaacatccgcgttttttgaagcctcaacaacatcagtgacagcgataacattagtgggaagtttctgaattccaataaaagttggaaagacaatgacaaattcaaagtttcggcacctttccgggcaaatatttcacattttcgtgtttctcgttgataatttcgctaagtttgcgtccttcaaccacctaaacgaatttaaaaaaaagaatatttcgttttgggtgtttttcacctcttcaaagacccacattttgaccgccgagtcatcaaattctgagttatgcatttgcaccgttttgcccacaattcgagcaattgccgtgccccaatttccagaaccaacgatggtgacttgtttcttcgtcattttaaaattaagacaactcaaatactgaatctaatgaaactgaaaaaagatttaaatgaggtgaaagagggggaaagcaaacaaaaggaaaaaaatgaatgaatgaatggtcggtctgttaacaaaagtacacaaatcaaaagaaagaaagaggcgggaggggaatttaacaggaaaagtaaaacaaatggggagagcgaaatgcttttaaagaacacaaaatccatcataaaaaggtaataaaaatcgtttagaaaaaagttgtgttgttgtccttttatttatggtcgtgaaaactgcaatagcgccggtcatcagaatgagtgaatggtttgactaattaataattgccgcttaaatacgaatactcccaaaaaataaaagatcattaaaaatgatgcttatctattttcgtcctcgaccccccccccccccaccgccccaacgatctttacgctccgtcgaacgactattttcgttcccattcctacgcccataagtttttcaatgatcactataatacctcttaattatcatgaaacacaaagtgtccacgtgaaatacataataatcactatttattaatggccgacggttggtgtgggctgggcggtctttccacaaggtaatttattatatggagtagccaattgaagggagaaaaaaaggggaggaagaacaaacacactttatatttggaacattttattaaagccaaaaatttatgagcacattcgactagtaaccgtattctaaaacaaaaatacaaaatatgccaaaaatatattgaaaaatcgacccagcaaaggaagaatataaatgagcaagggacgagacaatcaatataagtattgcaagatcaatta

SEQ ID NO: 3403 - DNA, 6192 bp, Heterodera glycines
tcagacacactgaaatagcctttgtcgttggtgcaacggaacaaccgcgtgtattccatgaagtccgcgtcccggtcgtacttctttttgccccccaatgccttccaaaatagcaatggttcatttccttcctcaattctttgaacagcaaagtcagaatctcgaccaatcaattcactcgcaacctgataaaaggagggcataaacataaatataatcaaaaaccacctcttccgccaatttgtggaagtaagggtcactcttggaaccaatccacacaaaaacgtttccaatgccctcttcatccgtttgaaggtcagaaggaggaactcgaagaataaaacagaaggcggaattcagtcttgtcgcattacagtccacttggatggtccgtgtgcaaattgaagtgccattggctcgcatatggaataactctggcaccgcttggctcaaattgtgcgacggatttcttttgccataacggatgaccaatttgcatttgaaatgtgacaggaatttgtgattctcttgctgctgattcattcgcaccacctccagcttgtctttgaacaagctttcaaactttttctgaaacggaattatcattccgttggcatgacagtccaacttggagtgaaaatgtgaagtgtaaccatcccatgttgctggcatctcggccctgccagaagtaaacgacgcatttgaagtcgcttggttttcccgaggcagaattctttggctaaaggtggcagtaaaaatgataacaaagtgaatattcacacctctttaattggaccaccctcgtcattctcatccgacacatcgtttgcctctttttcatcttcggctccctcctcctcttcatcgtcgtcatcgataaaataacgacacaaaaacacataacagtccattgaatgaaaaatgccaaattcattctgaggaaggcggacaaattttttcccttccttaaacgcggcatttatttgatgttttatagtaagtgaaatctcaccagcacaaatgattcgatcacttccaaatccatgttgaaatcctcaatgattttctccgtgtcgctgtgtggcattgcaggcagacggtcgaggaacaaagcgaccaaatccgtcttcaatttgtctctctccataataacctgaaatattgataggagttattggtaatatgccagaaaaatctcacttttatgtccgctccgcgtctttgcacagtgtccgctgtcattgtgaaatcgaatggcacaatgtcatcccacgccgcgaatttggaacgaaatatcgttgattcttcatcttcgttttctcggcaaatcacacagaagtcaggccgttcgatcattcgatggatttcagatgcgattttctagcaaaaaaaaaacaattcacttccaaagctgtgttcacaattcaaaacctgtcccgccattttcgtaagacgattagcatttttgccgacccacaagaataattctgaagtgcaatccaacagaaacactcctttcggcttcagcagttctttatgcaacacgccatttctcagctccacctgaggcaactccaaaaatcccatgccaagttggacttcgtagagacgtttcctttctggtttacgatcttccaaaatgtgttcaaagatgggctcatccggccttttagatgatcctaattttactttattttcattttcattcattttttaccagtgagcgcaagccaaaattcttccggcgtttttagctggttacaagactcaatctcggcttttcccttcttatcccttttgttcattttcaccgcgaaaagtcgcactttattggcaatcgttacctaaaaaattaaattgaaatgaaaagtgttgttatgaataccctcgaccgagctccactccaaatccaaataactttgtcacaatcaagcaaaaagacgaagcgtgggtccaacgactcggcattcaacggaaccgcctccatttcgacggacggtccgttgacaaatgctcgatagagtttgtttgagaaagcgactttttccacagcataaaagcccgattgagtgcgggccccgtcatagtaaacgatttcctcactgaacatctccagaaactcgtccgtttcctcattcatttcttcacgaattgtccgacaagatgctcccaaatgatttcgcaaattgactgcgtgtaccgccgcgcacatggccttgtccaggctggtcttttcaccaatccaataataaatggcatgtgtcagtgctccgtttgtctcccgagttgttttaaggaccaaataacagtcagcttcatagaattgaccatgaaaacccgagtcgacaagcacaggataaaagttctcaatctcccaaacccaaagaccagcatccgctccagcgacagcgtcgaatacgtccgaatagtccaatcgcggtttgtgctgctccattttctctttccagccaataactgggcgtaaattggcgtcgttttctttctccacggattgattcatttcatgtgcatcttgtgccattttggacattccttggatgactttagaggccctgtcttgatctgcttgacaccttcggcgccgtataaagtcctttttgcgttgcatgtagtctttttgttgacttttgttaggactaagcgagtccactgaagaaccgggactttgtccagccaaacgaagctgaaatcgggcattgattgaacaatggaaagtggaaaaacccaacctgattggacagggaaaagtcaatgttgtagaaagccatagctagtaaaggaatcacaatcagaatgaatgaaagtccctcgggttttacctttttctttgtcggagggtttaggcggcatcacgaggtcgggattacaaaaacagaataatcattgaaagggaataagaatttgcaaattacttgtgcaggtcgagttccttcaagtcgggcagtaaatatatcccatcgggaagggttattaagcgattgttgtccaatttgattttacgaagtttcacacaacggccaatgccttcgggaattaattccaagtcattgtccgacaagaacaaaacttgtaattgcagaagttgtccaaaactggcaggcaagcctaaattgtttaaaataaaaatcccaagtaataaaattataaattccgaccttcaaatttcagtttgttgtaactcgcatataaccgctgcaatttttgacaattcacaattttggcaggaagagaagtcaaattgttgcccgacacattcaatgtttctaactgagtaaaaacggaggaaggaaattcaattttcgatattttgttgaaactgaggtccaatttgcgcaattgtttgagtgcataaagtgaatcgggcaacgattggagctcattcatcgaaagatccaattccttaaacaaagtgcaaattcaaattagcaatatttatgttgttttaatttacctgcaaattcaaaacatcctcaaatgagtaaggaatatttgacaaagtcctatgtgtgtttctcagaattaaaacacgaagctttttagaactaaatggataataagtacacgtgaattaaaggtaggaaataagcgacactcacccggggagttgtttaagttgtaagtgagtgagcggattattggacagcttcaacacttgcaagttggtcagccgcttcagttgtgggggcaccacttccaaccgattattgctcaggtcaagatatatcaagtcgattaaattggaaaaaatctgaaacagtgaattgacaactaaaaaattaagtgaatatgacctggtttggtacattttcaatattattcccgctcaggttcaacacgatggcacattttgcatattccaagttagaaggcacatccctcaacaaattgttactgaaatcaatgatggtcaaatccttcattcgaaaaatgtctgttggtattgctgatgtttttatcttaaaccgaaagattaaaataaataaatctaattcgtctgataaatacctggttgtatcggacgatgattgagcgaaggagcggaaggtcggacaattcgccatgcacattctgtataacaaggaaatagagaaaaagcaggacaagatagggaattcgatggattgcgtacaaatagacgaatcctcccaagttttatttaatcatttcggtctttacttgtacagtacctgcaatttattacgcgccatttgcaggtgttctaagtgtttaagattagaaagaacatcgggcagtcgctccatctgagcacggtttagcttcaaccaagtggcttgagtcatctcaataacttcgtccgggaagcgatcagcggaaaaatcgtttcgagaaaaatcaacacccttcagaaagcaaagcacacccgtggacccatttgataaggccattttcaatacacttccttcattatttgtaaaaaacgcttaaaaataaacaagaataaagtagagatcagaaaccaaaattaacaaattaaaaataaaaacacatgaagaactgcacaggtttaattgagataaaagaaactgatataaaaaagatcaataaagggctgtccaattcaaatctaaaacgacaaaacactatttcttcgcctttttgttttgttcagcaggagttgcacgaggaggcgtaaccggacgattctgtccagccccagtgtatgaaaatttgcctttcttgtcggacggcttcagaatctaaaaccgaaatacaatcacattcacaaggaattcatttacctgaaaagaacacatcaatgtctcatcaacggtcatcattgacccggcattgtcaaactctccacagtaatttggagcggaaaacagtgtaaccaattgacgctttgcaaagaattcatagccatcttcgaccaccttttaaaccaataaatttcaaatgattattattgactaacttgatgagcacgacaaatcaaatctaggtcatgtttgtgcaagaatttagagacgacttcaggtccaaaagtaaaagacacaccacgatcattttcaccccaaccggtcacatcctttaaaaaattatatgttgattatgtctaaaattgttgatcaagtaaataccttgtctgggtcagaccaaagcagatcgcaaagaagcccctgatccggaacgtcagttggtcgcatgagccgacgaatttgttccatggattggaggtcgggagaaagaccaccatgacagcaaaaaatcttctcatcaataattgcggcaacaggcaaacaattaaagcagtcggtaaaagtcttccacagttttatgttgtagcgccgcttgcctgaaatacagatgcttataaacaatcataaactgaaattaatagtgaagaaagatcaaacattcgtcataaaacccgtaaattcggttgatggaagcacactcgtgattcccacgcaacaaaaagaagttctcggggtacttaatcttgtatgcaagaagcaaacaaattgtttcaagtgattgttttccttaatttgtaaaattgcatccatttacaaaataaattatacctctatccacataatcacccaaaaacaagtaattcgactcaggcggaaaccctccatactcaaacaaccgcaacaaatcataatactgcccatgcacatcaccttaaataatttgtaattaaaaaattttttgtttttttaccgcagattttcagaggagcctccagttcaagaagtacaggttgactcagaaagatctctctggacttcatacaaagaccctttatctcattttccgtaagctggacattctttcccggtttagaaccacgcactaaatttaaaaagtacttcgttactaaatttgaaaaacaaccttcaagaagccttgaaattatattgtccaggtttattttatcagcatctgtcattgttggcttgaataatggaaaatttactagataacaaaaaaatatttggtaaccagagaagagatcagcttaaattaaataaaaaaattaaaaaacagcaaatttgtaaaataaaaaaaggtcaatcggatcattaatggtctgctgaaacatacaatttaaagggaaggaaggaacttttaattcactttattgtcaagcaatattaaaatagagagggaaattttaatcttagatttcattcaaacgaa

SEQ ID NO: 3404 - DNA, 4056 bp, Heterodera glycines
  misc_feature (2275)..(2275): n is a, c, g, or t
tttttagctaaaaaataaaaatgatttattatatttatatcttaaaacatcaaatttttcaattaaaattattttcacccgcgtaaagtacggcgattgcatcgtctccgtttaattcactcaaatcttccgcgtagatgaagctcaacagcactttgaatgctgctgcttcaacatcgggcagctcaacagggtctgacagttcggcggaaatggctaaatttaacgaaaaaatccaatggaaataataatttttaattttcattttgcctttatcagttggatttttctcgtcaatacgaaaaatcgcttcgaacacatcagaagccaacatcagaatatgtttatgtgctcgaaaaagctaaaataaaattaaaatgaatgattttttagctttttcaattttaaactcgcctgcttttcctctcccaccaaaaagtgaatgtccgccccattggccgtgctcaacaacactttcatccgatccactagtttttccggctttggcaaattctttctggggatttcatctgttgaataatgtaatttttcattggattttgtttggccaaagttcgaaattaatggcgaatcagtggcactttgacaacagagtcacgcagaatttacgaatttgtcctctctgattccgatttttcccaaataattgtgtggtggagaggggtaaagtgccaccattatatacagtaagtaagtagcacgactaattttttaaaccgtttcctttttgtgcaggcatttccagaattcgttcccgttgttcaattattcttctcgaacgccgcaattgctcgaattttaaaaaattttcagatatgcctgaaattaattaatttcaaaaccatagcctataagtattttaatactcttttcattttgttaaccaatttaattttggattttcaatttttaatataactctgaataatattaataattttcaggtggtaacaaaagagttagtacagtactcttttctattttaccatggtcagctgtaaattcatcatctgttgaagcggatgaaaaagacatatgtaggtaaagttagtgattataccgaaaatgtttaagacaactaaaaaggataaatttaaatccaagaaaaataattaaaccagaaataagatattaaaaataaattccataaattcaaaatgtttttgcaaatccctttatgattataggtaagtttaaattttcaattttctaaattttcacttaattttctcgttgcttgtgttacttagtgttcgttagcttaaaaaagttggaattcattttttaaatgggcagaataaatacacaatggcacacaaataacaaaaataattagattttttcgaaattcattttataaaatgtttcaattaaaataatcaaaaatcaacttaatggaaaaggacaattagaatgactaaatgaagatgattctgtgctgctgattcccatatttatgaagagggttggagtggagcataaaaaacggcaaaataatgacctgaaaatgggtgggaatgtgatgagtagagcgtaaaattataaggataaaattgcgaaatataaacattgaatttaaaaaatatggacataaactttcccaaattaatggataaatttttcaaaatttattaatattattaaattttaatagaactaatgcgatattaaaaatcatttaaatagaaaaaaaacaaataaacgaaaatttattaatttttagtgaaaattttgcttattttgcacactttaccaatttttctgaaaaatatcgttttacttaaaattgaaaacttacccaactccttggacttaacaaatctcactgaaatttggtatgacatgccaaatgccatttcaaattttgatttttcttagcaaattaaatcccaacgagcgcttgggcgctgcttcgcggcgccaaccgctctgttttcagaatttaaaaatttcactaattaattaaaatttttaaatttatttttttcacaacttatattcttatttattaattttatttctcttctctttatttctcttgtcatactcttctttctctatttgtctcactttctctctctatttcgatttcttttctctctttcactttctctctctcatctcctctctttccccacctcactcattctttctatctccatctccctttgtcattctttgtttgttgctttctctctctctctgcattgctctctctttctcgctttctttctcatccatatctctcgctttntcttctctctgtctttatctcgcgttctctcctctctgtcttgcattccctctctcttgcattttttctttctctctctcagttcctcctttccctcactttcccttcttcatttctctccctttctttctttctatttctctgtactttctccctctcactctcttcttgtctcatatctctctttctctctctctctctattgctctctctttctatctttctttcctttccactctctctctcacttttccattttcactctttctttatctctctaatcctctctctcttatctctttctttctcttatttcctcttttttctctgtcgctttactctctctccctcctctctttctttccctctctttttctctctctctctcgctttttctctcgctccctcgaattttctctgtttctcctctctctctctttctccctcttctctctctccctctcttttttctttgctctcttctccttctttcctctcctcacttttatcttctctccctctctttcgtttgctctcttcgttcatctcctcactctctctctcacttcctctcctctctctctctctcacttcctctcctctctctctctctcacttcctttcctctctctcatcaatctcctttccccccttctatcctcgcctgactctctctctctctcttgcttgcttcacttctcctcactctctctcttcccatttttctatcttctttcctcgccacactatctctcatccctctctcgcttcctctcttgtctctcctcgctttatctctatcctttcctctctccttaacttattctctttctttcttctttcctctctctcctcattttctcactcctttcttctccttctcacatcactctttctttcttcgtttctcgcttcctttctcttctctcctcactttgtctcgtttcccccttttctttcttctctgctctcttcactctctcgcttgctctctctcttaaaaaacaaaaaaaacgaaaacaaaattgaataaacaacccttttttggctgtagtatgtgttacatcacttttcctctttttctctttctttaatatatagtaagggattgtcctcacttttttcatccattatttcttctctaatccctggtccattaattatttttattgctttgataaataagtaaaggtcatttgaacttctccttttttctgccgttggctgattcgcataatttttgaaggaattttacggcaaaattatgacctaacaatgggtggtgaagggaatgtgttgtttgattgtcagtaagaaaacttctttaataaataaacaattcaaaattataaaattaaagcagtaaattgtccattgaaatgcataatcactggaaaatttttaagaaaaaggaaaaaagtttgaaaaaattggctgatagacattttccggcaataatgggggcgtttcttgggtagttttaggcgctaacaaagaatctggtgccaaaaagcctaaaataaagtttctatgaatttatctgtaagtttttgtcttcgatttatcaaaaaccaaaaaaaatgtctctataggatataagcgcgaggacgtggaagtgagcaagcggcgctctctccacctgttggccccgtaaaagggtgtgcggctttttgcaacattaaagcagattttgttaatatcttcctgaattcaccgtgcccctaaataataggaaaagcgacgcaatctccgaagcgcttttttcattataatttaactaa

SEQ ID NO: 3405 - DNA, 1284 bp, Heterodera glycines
ttttaaataaatgcaattattttatactttcctggtcgcttaagtgtttcgaaagccttcgcggccaatgaaattgtgccggacgttgtgtccaaagcaccagaaaagcttgtaactgttgaatacgctgtcggagtgtgcgcgaagctaggcaacgaattggcacccaaaaatttaaccaatgcaccgaagctttcgtgggacgcggatatgggcaaaaagtacacagtggcgatggtcgacccggacgcgccttcacgggatgacccgaatattcggtggcattttattaagagacccatccacaaggcaggagctgataaccctcccgaatttgccacacacctatactcaacaaaattgtaggcattctccggatttgttttaattgaattcagccagcggaagatttaaacgcttgagcagaggcatattcataaagggaaaagactgtgggattgtctgggacctcaatttccgtcatatcactgatatgacgtcatatatttgaccattttgatttttaacattggcgaactttttacagaatggacgaagtttgaaaattttgatatcattcgatacccccaaatgtcctctatttcaatgccaaaaatcaagaagttttattcagctacaaaaaaagttatggccagataaacacaaaaaaaaaccaacttagcaaacatttagggccatccttttttgtagctgaataaaaattcttgatttttagcatgaaaatagaggacatttagggatatcgaatgatctcaagattttcaaattttgtccattctgtaaaaagacgagatagggttcgattccctcccaggtctaccattttcccaacctttaataaactttaatagtcatgctaaataataaatttccaatggaaaggttagcttgcacaattttgtgactttcttttcctaatacaactgatcaaattaatttttctttttgttttggtgaataaaaattataaatttttagcgagtggctccactggttgatcgtcaacgtgtcgggcactgatctcgcgaagggagacaaactcattgattatatggggccggcaccgccccaggggacgggttggcacaaataattaaaatgaggagattcatattttattcattcttgggtttgttgaaaaaatgaaaacgagttttgaggccttcaccgctatacgttcctggtttatgcgcagaaagaggggacggtggtgaatggcactcaaaagccaggtaatcagtgttgagagactgaaaaatgctt

SEQ ID NO: 3406 - DNA, 3839 bp, Heterodera glycines
ctgcttttccccgctttggcgttttgtttttaacactgctccttgtttcggcttgagacggcgtggagtcgaattttcaccttttatattataaatattgttgttataaagatgaataaaaaagtttcaaattaccgatgtgaaggttcttgaaatctttccgaatgcctaaaattggtttcaaaattaatttttaaacttaacccaaatctggcactaatgattatttatttgcatttttctgttattcatttactcatcttcagtgctttctaagttggcctcatttgaattttgattggcctaatttttttacttttttgaataaattttgtcattttacacccctaaaaatgaaggtttttagtgcctattttccattttttggagcctatttttggggtttttagagcctaaagcctacctattttggcagtttttagcgcctaaaaatatcatccctaataataataaacatttaaagtctttaaaatgcaattgagctaatttaatttatatattcgatagccctaagaattctctatttacctttaaaattttagaaaatttcattgagttttaaaaaagttctgaacaaaaaatgctgacataagatttttgaaatgttatgacaataattttttttatacttatttaaaaaaattttgaaaaatcatattctgaaagagaacaattaaagctattgaatgataaaataaaaattaatttggttgaatttgagccaagatatgaatttttatgtgttacccattttttgttttcgaccccattggcggatttaagaaacgcgcatgggtggcgggcggaatttaagaaacgtgccagcacgaaaaaaatacaaaaaataacagcctgtatcgggattcgaacccgagtcgccggctccggaggccgacgccttatccactaggccatacaggcgctgaccgttggaacttaaaatagattttcttaaattaataaaacataacgattagggatttgaaaacaaatattgactcctaaaaaatgagaaatagaaaaatattctaacaaaaaatgccattcaccaaaaaactgtgctcactgagccaaaaaattatgatggcttaaataagagttgttaactcttaaatctgaaatcttcatttgacctaaaatcctaattattaacaaaacgtacgtattttaccatttttaaatccgcaaatttaaggcctatttcaaaaatcccgcattccaagtttgatatcgcaattttaaatgattgtctgagacggtattgctacgcaacgagaaaaagtacgggattcagccgggacggtcaaataatctttttttgagaattgatgatccggtaacgcttttatttcaaagtgacttcggcccgagattttctcgaactgagacggagactttttcaaagaatttcttgtacatttaaaaaaggcaaaattaaccaaacatttcattcaccggttgcaatataaatcagtagggctgctaatatgtaaatacatatttttttcctggcttctccatggtctaaatagtaggaaaaacactttcttttctttgtttgcaaacaaaaatcgggacttttatttacatattttgggatttttctacatattacatatgtaaatattttatacatattttgactttttagtacatatttagcaattttttcgtacatatttatttttttttacatattttgggaatttttgagaatttataaaatttcttaagaaaattttgataattttttttgaaaatgtacctgaaatagtatatttttagtatttaaatttgtcatttttaaggtttttttattttatttgaagaatttattttttgggtaaatattaaaaaatcgggtttttccaaaaatcagatatcaaaaattaatttttaaaatactaaaaagtgattctaagcctattttggtcctttttatggcattttgtgattagttcactttttacgaaaaattttttccaaaaaaataaccattaaaaaaaaaaaatttatttacatgttttagtacatatttgggggcttttgtacatatttcatacatattttagcatttttatacatattttatttacataattcgcaaattttcttaaataaaattagcagccctaataattggataaacaacaatttatgccacatttttcagcagagcgtgcgaacttccacatcagagaatttgccaaggaaattaacgccgggtcgcctctggcagggaatttcttcaacgcgcaatacgacggctgaaatcagacccaattttgagtgggaaggattaaaccaatgatttctgctgctgaatggaattggttgagataaaacaagcaaatttcttctttataaattcgtaaatttctgtcgcattattagtttttccgtaattatttcatgcactttgtaaattccttcttatgtaaatgtgaatttcggaggctggggtgaaatttgaatattaaacccgggccttacttactaattttcgggcccctggaagccctacaaagcgctttgaaatcgattgaagttcggaaaaaaaaattttcgatccaatttaggagtccggagaccggataaagctggtaaaatagacgtttctttttgttagaagtatttggtcatttattatttttacattatcttggcaaaaagggagaaaacatgacaaaccgtaatctaatgccaaggggtgagtttgaggaaaataaaatttgaagaatttgttgacaaaaacgagaattaaaatattttcaagatttatttttttccggaaattatgcgtattaaatcgtttattgtaggaatatcaaatttgaattatatttaaaatttgtgatatttaaattatttgaagttttattatttagtcaaattaatgcacaaaatgatgattaatgaaaaatgactgtttcttcagtcgttccattatttgctgtaaatgcgcgcttatgagatcataaattgcgtatgcccccgaggaaaagcattcgggtgattggtctagtggtatgattctcgctttgggtgcgagaggtcctgggttcaattcccagatcaccccaaaatttttaggtaaattttcaaaaaattgaacatctaataaggaaaaaaaaaattattttctcactatccattaattatttttgttcctcaattttgttaaattttttgcacgtcgtgttcagcgtataaaattaccattaaaatatttaaattttcagcggggggggggacaaaaagtaaaagtaccgtttatttaattttcttttattttaaaacgaagaattcataaatatttttaaaaattttagtccaaaaatgctgatctatcgatttgccattccatatttatcttcctcaatttgtgtcgcttgtagtttttggttttgcttaacaatattcaaaaattttctttaaatattcctccagttttttccagctatacatcggttgccgcgtcaaatttcaattgtttcaattagggttgatccccgttcccgagccacgtaattaaaaagccaaaatttgaatccaatttttgccccccgaggggtcgggaagcaatcctagtttcattgcgccaaattctttttgtgccataagtgaattggttatacatatatatatatatatatatatatatatatatatatatatatatatatatattctgtgattttttgaatatagatttataaggatacgtgattaatagataatttacgtaaaaagaaatgaaaaattgaaataaaacagtaagacagattagcataaatgcgaaaaaacaaagcatatgg

SEQ ID NO: 3407 - DNA, 2739 bp, Heterodera glycines
  misc_feature (2710)..(2711): n is a, c, g, or t
agttgataatgaattagaagcttttaccctgaaaaaactattcttgattaaaaaaacccaatttttttttgttcgaattcgggtccggagttcggaattgggcaaacccgagttaagatccgttatcagcaccctcaaaaacgcctaaaaactggttttgagcacaaaatttaaaaaaatgaaaattagggacaaccattcttcaggattgccgcctgggtaaaaagaggacactacattaagttaaataaatggtttcattttggatttatattataggtccgtctcattttgtcttctttcttcactattaatagggctcggatttttaggtgctaaatatccctaaataggtactaaaataggtgctaaaaaagtgcaaaataggtgctaaaaacccccaaaaaggccaaaataggtgcgaaaataggtgttaaaaattgaaaaaatctagaaataggtaaaaacctaaaaatccgactcctaactattaataatcatacacaataggcgatagataatgaatgcattcattaaatttaaaaaatataactacctaattaaatttttctctttaaatttcatcaatatttttttaaattaatttattattttttatattcattttattatatttaatttgatattttaaattttggcgatatgatatagtcgtaaatggtcattgtcgaaacggcattgtcgaaaaggtattgtcgaaacggtcattggcgaaacggtcattgtcgaaatgtccagccaccgtgtctttaacctctggttttttgaaaaatgcgtcgtaaaaagtgctaagaaaaaagtcttttcgtgtccagcttcgggattggaattcaaatttttttgcgtgacgggatcccgcgggattaatcccgcaatcccgcatttaaaatttgcgtgatcccgtgcgggattgcgggattttggaaatttcgaaaaaaaaataaataaataacgcaaaaaaaaaacaactaaatgattttgagcacgaaagatgtttaaaattgttggtcttgaattttaaaaagcaaaaaaaaaaaacagaatgaaaatgttgcaactctcggaagttctaaagtgaaattttttcaataaaatttttctgtgggtaaaaattgagtaatttttttattcttaattttattgttctcctgaaaaccttgcatttagatgagaacagtaaaaaaccgaaaagcatttatttgccgcagtattttttccaacgcctttgatggggaaggcgggccggcggtgcctgcataaaggcgcctttgcatcaaaaatggtcaaatttatgcaaccaaaattttttaattcacccgactttttttgctccgcattttttaaagatttagccaatcattaggggtgtattttttactttgaaaactcggtctttaggggtgtatttttcccgaaacttcgcgtaaattacccgaagttcgaagcccaaaaacgcgaagttttcgaagcacgaagctcgaagtttcgcccatcccaggtgccgataagcgccgccggtgaaaaaatttggcatgatttgctattttaattgcactaaaaatgtcacttttttgatttttaggttaaattttgtgggtttgttttttatctttaaaaaatgaactaaaaaatattgtcaaattaatccacagaatttacaagtaatttaaattagctcaattaagaaaatttttctttttacttaagaataggccatttagacattcattacattgctaacgctttaaagcaaatattattttttttattcgtttttaaatggttcattctaaaaatgaatgttaaaatatataagaaaaaaattttactaattgaaatggaacaaaaagaaaacttttttattttgctgttcattctccggttggggttaccgaaattcctttttcactgattagaccaaaagataggaagcataaattttacatttaaaataaaatttaaattaaagtttttaattactatttcctgcgctttttgcaatttgaccatttaatgtgttaacggaccgtgaatttataccaccaatttatgaacatgtcaaactttaaaaatccattgcgttttcagtgaatgttctcatttcattttctcttttcttcctttctcttttcttcctttctcttctctgtgttgctcctcatcacttccttttgctcatttctgaaattgaattcggtttaaaaattgtttcgttaatgaaaaattttcaatatgatttattaatttatagtgtccacttttaatatttaattggaagctatttaagacttttaaataaacttaaatagcactaattatgtaacaataaactaattaattatttccttaatttatcaatccacttgcattgcatcttctctcgcaaagagccttagaaacgaaacggtttccgttcccgcctcttcctttgtaaaagaatacctgtaaaagttggggaaacgaagcatttaaaattatttgacttttgaatttaaaaaaatagagacacaaaaggcgtcgaggcaaataacacccacattttgcttctgtttcttcttcgtatttgtaaacaatgcatttttttgaggggcaaaaatgtcaattaaaaggcaaaaagactaataattttaatggcggttaacaaaattaaaattaccaaaatatcggaatttgattataaaagcttggnngtttttttgtcattgtcccccccccccg

SEQ ID NO: 3408 - DNA, 1745 bp, Heterodera glycines
aaatctcagatttttcgggattttcacgacgccaagatttcacgttacctttacaaaatacaatgatcataatcagagaaacacgatctgacactacagatttgacataaatgatttttcaccaaaattcaaaattcgttgaacaaatctaaaattttaaaaacatttttattcaaaatttatttcattgcgaatggcattttgtaaataatctatttcagatgattcacaatattatattcttcatgggtcagggtcagcgttcaaatccgccgcccatgcccatgcgtccatcaaagcccatccatgcccattccgccgtcaattagactcttctgccgccgtagccgtagccatagccatagccataacgcttttaacgaagagggtgaaattagaaattccggcgccaaaaagtgccgcaattggtcatgcacaaccattaggagaaaaatggagtgccaaaaattaaaaaaatgatacctatcaatttcatattaatagatttttaaggcaaataattgccaataaataattaatctaaactgtttattgttgaaatatacagaacattaacaatttttaaataatgcattttttagatttatatttacaaacccaaaatttttctaattccgaaattgcccattataatataataagaataaatgtgaaaaatcgcgaaatagaaaaacaaatttctaaggaggttaatttaaattgaaaataataatttttaaatatttgcatttttagattcaaaattttgtgtcacccaaaattaatccgattaaaaaagaagcaataaatcagttaaaacaaaatatcaaaacatcagtagagaagtgggcagctcaatttacagcaattagtaataattattaattaaaattaactaattgatatttcaatttattatttgttttagaacctcgattgcttgttggtggctctcttttaatgaatggttttgtgataatcattaaaaagtaattaatttaaattaaatttacatatacttatactactcggcctggacccagcaaaaacccaggactggatcaactcaacaactaattgattaggcatttttctcgcagttattttttaattttaattagtttttgtgggtcctttctcattgggttcttgtcggtgtgagtcctttgtcaggtgatcaggtgggttatttgtccgtagatcctttgtcggtgtcctttgtcaggtgggttatttttcgttggatcctttgtcgctatgattcttttttctgtggtccattgtccttgggttctttgtcggtgtgagtcctttgtcagttggttatttgtccttgatctgttgtcgatgtgagtcttttttttgtggtcctttgtccttgtgtcctttgtcggtgtgaatcctttgtcagttggttatttgtccttgatccgttgtcgatgtgagtcttttgtccgtgggttcttgagaggacacccttatgctcttttcgctatgagatctacttaacttgacattgatcaagcgcaaacttttaattgacataaatcgtgaatttttttttgaatgcaataaaaaattttaaaattctttcaccatctaataatttctaacatttattattatttttattccattatctttttattgacaatccgattattggtgcaattaatttcacggatcagcgtccaaatcccatgcccattccgctgcccatgcccatgcccattccgccgcccatg

SEQ ID NO: 3409 - DNA, 1630 bp, Heterodera glycines
cacagccattagggagataaattgaatgccaaaatcaaaataaaataatacctatcaatttcattgaccgctgctggcatggcaattgttaatgaacagcagcagatggcaattaccagcagaacaacaaaaatggtggacgaagaagacattttcagtgtgaaatttggtgctacaaaaatattcgaatgatttccaattaaacacaatcatttgcttttaaatggaaaatatttgcccacatttaattactaattaattagtggtaaaagaacccaattcgacgaattgaaggataaaaatttggtttttgaatgaaaattcagcaaattacgttatattctttgtgcacaaaaaaaaattgttcgctgaatacaaaaattattttcaattttttctaaatttcctaattttgttttataatttattattcaaagaatttcataaaaaaacagcagaaagtaagaaatgagaagcataaaataaaatgttgcatcacggaaattaaagtttattattttaataaaagaattaaaattttgcaatttcgaataacaatttaattacattcattagtaattaattaaaagttgctcaagaacaaaattaaatgacgcgtaattcgttctggttaattgagcgtctatttttctaatgaaattattacgttccggttttgttgcccatccatccagcatcagcagaccatttggtttttgtttttaaatttcatcgggtgttggtgtgaatctgatattagttctcgcaaattacaaaacctcattttagtaaaattcgaaacaaataattatcggtaagcacatgttaattaattgattaaaaccaaagttaattaattattttttaaatggataatgaaaattcaaaaaaattgataaaaactaataataattgatggaaaaagtaaaaaaaattcaaaattaattaaaaaactatttttcacattatattttattggttttaagtttggttttttactttttccttcaataatttttttgtaatatttgttccattatatttttattgaccatttgattatttttactgtatattaccattaatttattcaaataaattaattataaaaaaaatgtgcttttacataatataaatattatggtcacaaatattctaatttcattttgttttcttttgatccatttagttagtcgaaaaatcctcccattggcattccgccaacaaatcccatgcccatgccgctgcccattccaaagccactgcccattccaccgccaaatccactgccaaatccgccgcccattccaccgccgtagccccaacgcttttctcgtttcagttgctcgctgataaatttgaaaaaaattaaaattaaattttttgaattttgctaggaacagaaaatcgcttaaaaggtactaaaaagcacaaattccctaaaatatacactaaaagaaataatattagccacttttagccaaaattacatagaaaagccaatttgaaaaatatttttattgtaaacatctaaattttttttataaatataaaaatttagaaaattcaaaattttagtccaagacaaataaacctttactgaaaccaagggcgtaggcaaggggggggg

SEQ ID NO: 3410 - DNA, 1030 bp, Heterodera glycines
agaaacaatcattaatttttattcaaaataaattaattagaactaaaagaaatattttttatatcattgaaaatattatcatcgctaatattccaatttcattttttttgttttcttttgatccatttaattagcagaggaaaatgttggatcattttaaataatctatttatgatcatttcacgcatcagcggcgtccaaatcccatgcccattccgctgcccatgcctccaccaaagcccatgccgctgcccatcccaaagccattgcccattccaccgccaaatccactgccaaatccgccgcccattccaccgccgtagccccaacgcttttgtcgtatcagttgcatgctgacaaattaaaaaaataaataaattaattaaatttttttataattttgctatgaattgaaattgtttaaaaaggcagttaaaaaagcaaaaatcctcaaatatatacatataatgaaaaatattagacatttaagccaaattttcttattaaaaaaattctttaattataaacatcgaaattttatttttatataaattaaactttgaaaattaaaattgtttaagtcaggccaaataaatgtgtattgaaaaggcataaaatacttttcagcttctgctacgggcatggcaactgccaacgaaaggagcacaatgccaagaatgagcagaatgatggacactttcatagcagtcatattttgggcaattaaattttcgaagacaaaataattaaactgaataaaataaatgaattggcgctttcttctgaccattttcattgctttttaaagggtacaaattgttgcacgaacaattaattaattaattaattgaggcataaatggtctcccgttatgctgcaaaaatcgaattcgacgaattgggacaattcacaaaaatagtttttaatcgaaattgtccaaattgccctacacaaaatgtctttactgatcaacgcaaattttcgcttaataaaaataattatttcgcgaataaatttgtcctccaatttt

SEQ ID NO: 3411 - DNA, 2002 bp, Heterodera glycines
agggatgtcgtaaatgatttttcacaaaaattcaaaattgaaagttaatgcgaaaatggaggacaaaattaattcgagaaataattattgtattaagcgaaaatttgcgttgatcagtaaagacattttgtgtagggcaatttggacaatttcgattaaaaactatttttgtgaattgtcccaattcgtcaaattcgatttttgcagcataacgggagaccatttatgcctcaattaattaattgtttgtgcaacaatttgtaccctttaaaaagcaagtgaaaatggtcagaagaaagcgccaattcatttattttattcagtttaattattttgtcttcgaaaatttaattgcccaaaatatgactgctatgaaagtgtccatcattctgctcattcttggcattgtgctcctttcgttggcagttgccatgcccgtagcagaagctgaaaagtattttatgcctttaaaataaacaattttaattttccaaattcttatttattttcaaataaaatttcgcttctgcattgcagaattcaaaaaatgtattttaattatatttttaaaaaatttgtcagcatgcaattgatacgacaaaagcgttggggctacggcggtggaatgggcggcggatttggcagtggatttggcggtggaatgggcagtggctttggaatgggcagcggcatgggcatgggatttggtggcggaatgccaatgggaggatttttcggctaatgaaatggatcaaaagaaaaaatgaagtagtatatttgcgaccatatattttttattatgtaaaagtacatttgcttttttaaaaaaaaaattggaaatcattggtcaatgtcaatttcaagggcattgttaaaaactacaaagaaaatacacagattttcaaataaaaaaatcaccttatcttttcacaaaacttcaaataaaaaaatgaccgacagacaaatgactcacatcgacaaaggacccaaatcgacaaaagacccacggacaaatgacacacacacacacctataaaggacccacggacaaagaaccaacaaataactgagaaagatgtttagttaccaaaaattaactcaattaaaaagagctcatcactttcactccttggcatttgatttgataaattcgactggggatggccctggtatatcttggctttatttattattagaatcaaattggatatcctgatatcctattcattagggcttatattttatttagaaaaacctggggtaccttccgggttttaagagtcggtgccggtttttggcgattttttctaggtggcagtacacttaacttctaatcattctaacactcattatttttaattattttagaattttttcaagattacgcgtcatttaatatatgttcttgagcaactttttaattaattattgacgaaggtaaataaaaaataattgattgatttttaattaaaattgcaaaattttcatatttttttttactaaaataataaattttcatttccatgaagggagttttattctatgttgtaattaattatttagaatgaagcaaccaattctatctttagccttgttcgtccaattagcgctaattagcactcagtgccggcttttggcgtttttcgaggttgcagtacacttaacactaatcatctaacacttatttatttattttttattaatttggaatttttgaccttttccatcaattattattattttttttatcaattttcttgaattttcataatccatttaaaaaaataataattaaattttttgttttaaaataatgaattaacagatggttatcagtaaatatttattttgattttacaaaatgaggtttggaatttgctaaaaatttatgagaagcccaattaaccggaaataattacgcgccattaatatttgagaattttttataattattaacgaatgaaataaaaaaatattatttgtatttgaatttgcaaaattt

SEQ ID NO: 3412 - DNA, 4509 bp, Heterodera glycines
cgaaaatgcgaaaagcgaaatgcgaaaagcgaaattttttctacaactttttaatagttaaaatcataaagcaaaaatcattttttaaaattttattacaaatttaaaaatcaataaaacgcttttttgaggcgcgctttttccaaaaaaactttttgggaagagggggcaggcgccgccgggaaaatttttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaattggaaattttgatcatttataaacagtttttcactgaaaattagccaatttataggtaaaattttgaaaaattttatgggaatttaatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacctcggcccatccctgatgtttagttaccaaaaattaactcaattaaaaagagctcatcactttcactccttggcatttgatttgataaattcgactggggatggccctggtatatcttggctttatttattattagaatcaaattggatatcctgatatcctattcattagggcttatattttatttggaaaaacctggggtaccttccgggttttaagagtcggtgccggtttttggcgattttttctaggtggcagtacacttaacttctaatcattctaacactcattatttttaattattttagaattttttcaagattacgcgtcatttaatatatgttcttgagcaactttttaattaattattgacgaaggtaaataaaaaataattgattgatttgtaattaaaattgcaaaattttcatattttttttactaaaataataaatttcatttgaatgaagggggtttattctatgttgtaattaattatttagaatgaagcaaccaatcctatctttagccttgttcgtccaattagcgctaattagcactcagtgccggcttttggcgtttttcgaggttgcagtacacttaacactaatcatctaacacttatttatttatttttttattaatttggaatttttgactttttccatcaattattattatttttttatcaattttcttgaattttcataatccatttaaaaaaataataattaaatttttgttttaaaataatgaattaacagatggttatcagtaaatatttattcgaattttaccaaaatgaggtttgtaatttgctaaaaatttatgagacgcccaattaaccggaataaattacgcgtcatttaatatttgagcaatttttaattaattattaatgaatgtaattaaacagataattatttgttatttgaaattgcaaaattttcattttttactaaaataataaacttgaatttccgtgatggaaggtttttattttatcctgtaattaattattctcatcataaaattgaataatgaaataagaaacaaaatttcgttgtgctgatcaacgtataggaatgtaatttgttgaattgggttaaaaaattaaattttttatccattcattttgtccatttggcttttttgctctaattaattagtagttaattggccgcaaatctttctatttaaaagcaaatgattgtgtttaattgggaatctttcaaatatttttttagcagcaaatttcacactgaaaatgtcttctttgtccaccattcttgttcttctgctgataatttccatttgcttgtcattaacaattgccatgccagcagtggacaatcaaattgaaaggtataaattttattttttatttttggcattccatttttctttctaatggctgtgccagaccaattacggcactttttgacaccggaattaaattccgccaatcaattaaattttaagtgttgcacttcgtcaaaagcgttatgactatggctatggctatggctacggctacggcggcagaagagtctaattgacggcggaatgggcatggatgggctttgatggacgcatgggcatgggcagcggatttgaacgctgaccctgacccatgaagaatataatattgtgaatcatctgaaatagattatttacaaaatgccattcgcaatgaaataaattttgaataaaaatgtttttaaaattttagatttgttcaacgaattttgaattttggtgaaaaatcatttatgtcaatctgttagtgtcagatcgtgttttctctgatttatgatcattgatattttgtaaaggttaacgtgaaaatcttggcgtcgtgaaaaatcccgaaaaaatctgagattttctaatcaaagaatagcattttaataaatgacccactgacaaatgacctacgtaaaaagaaaccacagacaaaggacccatggacagtagaaataatttaaaattaaaaaacaactaactatgtatgtgaaaaatacttgatgaccaagcacatcactttaactgcttggcattttaattttataaatttgactggggatggccctggcattttttgactttattgattggatctatcgtccgattcggcaatgtttcagcacaaaatgtttatttggttttatcctattaacttttgtactcacattctaacagatattgttttttgaaattattgaattttctgattttttcaactaattattattattgtttttttatcactttcaattttcaatatccattttatattaatttttttttaaattaatttttgatttaaaataataaatcgatttgttagtttaccgataattatttattttgaattttaccaaaatgaggttttgtaatttaacgaaagtttatgtcagattcaaactaactcccgtagaaattaaaagcaaaaatcaaatggtctgctgatgatggatagtacactaaaccggaaaataattgcgcgtcatttaatatttgtccttgagcaatttttaattaactactgacgaatgcaattaaaaaataattgatttgcaatttaaaattgcaaaattttaattgttttttactaaataataaaatttcatttccatgatgggaggttttattttatgctgtaattaataaataattcattcatttggatgaatcaaccaatccgaccttttgccttgttcgcccaattagcgcattaattagcactcattaacattattgaagacatattagtcagccagcgactgaattaacaaaaccgaccaatgcttttttctcgcacattatttatttggcggtaattaactcgttttaaattgcattataaataggcaattaataatgaccacttcaaaccgacacattcattcattcattcattttccctctcaattttttagcatttgttaaattcgtcagctacaaaaaatttcgcaaaataaaatgaattcatcaatgacagtatctcttctgctaatgttgatcattggcactgctcttttggcattgacaaatggcatgccaaacgcagagtaaaaaaatagagacaaataaaaataaaaataaaactaattgaaatataaattataaataatcaaatcctttttaataaactttttaaaattatttaatttttttgaataattaattttgttcacaaaattttaacagaaatttatatacaataaattattttaattcatttatcttcaaaataattatcaattcaatttctggttaaatataaataaaaaacgcaaataaaatttaataaaaaggaaaataacattttattaattgtttaaaataattgattgaaagaaaaaatatatttaatttttagtgtttcattgacgcgcgaaaagcgtggcagttacggtagtggcagttatggtggtagcagttacggtggtggacccagcggtggtggtgacgcatttggaagcggaggggccgcaggtttcggaagcggaattggcaacggtttcggaagcggaggcggcagcggttttggaagcggaggcggaaatggtttcggaactgggggtggcagctacggtggtggcagttacggtggtggtagttacggtaaaaggcgatgatggaaaaacattggtccatttgtgacgaggaaattgcaatgtgatcatcctttcttcccgatcactgcttttccaaatttatttgttgtattatttatacaaaattttaatgaaaatgaattactgctaattgatgggatggagtaaaataaaaattaaatatttaaatatttttttaatacaaaaaatagctctattccagtttgcgcgtccaatgaatgactgtcctcagtttttaggcccagaattttttc

SEQ ID NO: 3413 - DNA, 5253 bp, Heterodera glycines
  misc_feature (5179)..(5179): n is a, c, g, or t
  misc_feature (5196)..(5197): n is a, c, g, or t
aatgctcgaactgtagtgcttggctgttctgcacatcgaaggttatgccgcgtattttttgcacatatcgggtttcgccggttcgctcatcaaccatttttaaggcgtattgtttcgctccttgtacaaaaaatgatgttaaagaataaagctaccagcagccaccatctatttacctccgcaaacaaaacattggatggcatagccggcatattcctccgacatttgtccaaggaattcgccagtctgaagtggagaaacatcgcgccgatgcttcacaatcacgctgtctgtgtcctaaagaaacacaccatcatcatgatgtgatgatgatttatctctacgaactaccgtataaagcaattctgccccttccgtcccatgaacttgttgcatagagtcaaggagtttaagcctagcgcgacctataaaatgagagatgtgatgatggaatgtttgtctgggaacgaatgcacacaaactcgttgtccacaagctgagcataatattgcttgacgaatgctcatcgacaaaattttttttcgtcctgtaggagaccctgatgacatcatcagacaaaggaatgattgcataaatttccttaagtacaaacaatcattttttggccgattaacaacgaaaacagcattgacatttaccactttatggtcaaggacaagcttgtagaattcttgtggttttgtgatgactcggtttgcgcccagctcattgcgcatgctgaatttccccctaaattccattcatttacgaagaaaattcatcaaaaaaggtcgtaccataggctgtttagcatcagctttgcgatgaatcgaagtccagcatttttgttcacccgggacaagtccagctgaacgttgtatcttctcttgtattcttcagcaaacatttctttttgctgctcatctctgactccttcgggaaagccactcgcctcaacctgtcagaagcaaaaatgatcaaaatctaatatgatggctacctttagcttgatcatcaaccgcacatattccttgaaaatctgatcactccttaagcaggggattgaacaaaataaaacatgctgctattttcaaccattgttcataatgccaagccctccagaatctgtccactcggtagccgctctctaatgcgcgtgccagttcaatgtgtgtgtatgtgccacagtaggcccgctgctggtctgtatgttcacactggtgcgaccgccttgtgccgagatgccgaaatttggtagcacaccgataacagcaacagaacagcagccgctcgtctaacttcattggcaggattggtatgcgaagcccgcgtggtggaatcacacggacacggtacagtccacgatatactaggtcattcggtgagttcctgtacgacagaaaattgactgggtggtggaggctcgctcgctcttcctccgcctaccaattgaccataatctcttctacggacggatgaataatctttggtattccaatggggtaatcagtgtcgtagttgacctgtgtcatcaaagaaatgaaaccgaaatattcgaccgaccgctcttacccatggatataagctcactatatcgtaaacactgattttttcgccctcatctggttcggcaaacagtttaagcggccccgttcgacctgtaggcaggcatcagatgaccatattagcataaaaagcaacgcttcacctccgcaatatgctacacgagggtcaatcggccctctttcatttcccaaatcgtcgaagaattcgtgcatttccttatttcacgggtctgagaccaggccgttgatttcgcattccttaaaattgactattaaaattggatggtgaattaattgtatgtcgcgagtacccaaatttcttccacttcaatgcttctgccatcctggtctggctcgcgaagtttggtcaaacgatcctgagttgcttcgttgagctctcggcatgtttttccatccaccagcttgtctccaggctcataacaacgttcgcatccgtgccaataactgatagatttaagcagcttcatccattcattcacctatgttctcaaaaacagaccatcctagcacttcaatgcatttattttggtcgggaatccagccgtcaattttgtaattttttatgcgcttttcacgcccattgcctgcatgctgtattgtcaagccctcgtccttggccctccagtccaagtattttattgccttaattatgataataaagagctagtttcatgaaaacgtaaccaaagataccagaacacttgctctgtcatttctttcgtacccggcctctggcacaatggccagctgattgtccttcatgaacattccacgaaaaatgttcatacaaaggctaaattttgtgttcatgaattgtggataaaagacacggttatgtcacctagcaattgtacaactaatgggcaacgcatcatatccactggtcacgtcacgcaacaaaattcgacgaaattgaagaatggatttcatcagaatctccgtgtcattttcgcagtagtaacgcagctcttcaggaagaaagaagggcgtctgtcgattctcttcgtaccttttgggaaaaacatattttgctgctgttgcagcagttgtatggaaatttaccattggtcaaatttttctagctttgcctgcttcattgatccgggaaaataggtctctttcggtggaagatgcggcaaccgaatagcataattttctcttaacaagtatgtgatcagtcgtcataaattccgattcattgatgatgagaaaccttcgattgaaaccgtatgggaaaaagggcttgtccgggcagtcaaggtcaaatgtccctttcagtccatcaagccttattggtaggagcaggcatgagtcacgccaaattagaagtgaacggccgcgcgaatgttgaagacgaaattcaaaaatttttagcccgttcatcacaacgtccggtcttcttctggtctcacccagataacgaaggatgaaatgaccgtcaaatctggaagcattgtgtgccttgggaataattttttggtatcataaattgctagcaatggtccatttttacccaaatataagtgttgaatttttcattccatgccctcattatccattccacaaagctggcaataggctcatcttcttcagcttcactcctttttggagagatggtgtagtttttaggaaaaaacctatccaaataccaatatttgtttcgctccacttccccatcctcattcatgcaaatttcacaatcatcaaattgacccaggttggaatcggcacactcggtgcagctaacacgtgcagacaagaagttgactttgtgaatttgttgttgaccaccttccgcgggctcaagccgcgtttccgtatcccagaagaccattctataccgctgcttttccattggaatgcgtaatttcttaatgtagcatcccgtgtctttgccatggtaaacctggtaatgaagtaatattgttgtataacaactgaaaaggcttgatactctgaccttgcaacgggtacagtacttggtgaaacatttatgcggacgttttggatcccgctgatacgtgcgcaagcaacaattgcatcgtttgagcaatgaacatgtctgcccttggtggccatcatagcaaccatgagcgaaaaagaaacgattgcatgcgggacatagaattttgacgccaggttcctttgcgcatggatgccctggtccgacttaatcgatttttatgtaaaagtataaagtactgaatcaaacacaaaagctaactctttgcgcattggggacagcgtctgatgcactcaagagtgtgtttcaaagcacgatcgtacgaacactcacagtctacacaatattgtttggccagcttgaagaaacagttgatttttttgatgccgtcatagtgaccgttggccagaaacagcacaacatcaatacttcgccctgatgggcccttccaaattggcttgggcaactcctcagaccggtcttcgaagagcacaatgcgataaaggtcggtaaaacgttggtcctgatgtaataaaaattaaagcgtactgtttgctcaacatttcttactcacccaatagtcttgtacaatttgaatgtggtccaatccatatgcagctagaccttcagctatgccagcataattcatcagacggcgaacagcggaacacatcatctgccggttgttgatcatgagctcaaatgcttctttgttttcgcaaaaatcgagcatcagcgtcaattggcccatgttatgctgttggggttgttgcagttgccgccccgctgacatccattctttgaacaaagcagggtcatggtacgcccgaacagcgaccaaagcatggaagagacaatagttgtcgcccaagtttttaatccttatgcgatgttgatcattgtatccccaatgctgataagggtagaaacgtggccggcctgccccggtcggtggagttaggcatgtgacggttatttcaacaggctcgctaagcaacaatgatcgcttatcaattgcgtctgcggcaccgtgctctgctgcaccaacatttccgtcatcgccatcactttgaccgagtttgtccaactcggccatcagtgtatcactggtgttctgttcgggcggtcgaagaggcagcacgattggctcttgtaatcctgtacaataatagaacgtacagaattcattctacatacataatgaaagcgttcaccccctcccccaatattagacctctgccctgcaacgtgatgccaattttgacaacttttcgtccactttgctgctctgagttatgaattgcgcgggccatcaacatttgtaatgcatttcgcaacacctcatccggttcttcgacccgggcattcagcacaaattcggtgatgtggcgtgagacagagaaacgttcaagtttgtgcactgagtgggcgatttgccgaaaatactgatcactgctgtctgactggctgctgccttccgctcctgtcgcgctcccctcacctttttgcttttttaaggcctcggaattgattggttttacttccccacccattgaatttcttgtccatcttcatcctccgattcttctccatcctctttctccccgcgtttctttgtcgcttccgctgnccttttcatggtcttgnntgtgctgtccgtgaagatggacgtgattatccaatcgaaatcgcgattttcaaaat

SEQ ID NO: 3414 - DNA, 2919 bp, Heterodera glycines
tacataatgaaagcgttcaccccctcccccaatattactcctctgccctgcaacgtgatgccaattttgacaacttttcgtccactttgctgctccgagttatggattgcgcgtgccatcagcatttctaacgcatttcgcaacacctcatccggttcttcgacccgggcattcagcacaaattcggtgatgtggcgtgagacagagaaacgttcaagtttgtgcactgagtgggcgatttgccgaaaatactgatcactgctgtctgactggctgctgccttccgctcctgtcgcgctcccctcaccttgctgaatttcttcaagttgttgttgtggcagtaatgatgctgactgttgagcaggcggacagctcattgagcggaagtcccagtgtcgtttcattgctttgtggttaaaaagaaacaaaaatatatagttgtaattgcatgtgtcaataaattgggcaatttcaaaatgccttcttgtctgctatgaaaagtgcaaattgcgctccacaacatatttttctatgctaaattcaacaaggatatcgtttatcatgagcttgccgtcatcatcattcttctcagttcttttttgcttttttaaaggcctcggaattgattggttttacttccccaaccaattgaatttcttgtccatcttcatcctccgattcttctccatcctctttctccgccgttttctttgtcgcttccgctgccttttcatggtctttgttgttgctgtccgtgaagatggacgtgattatccaatcgaaatcgcgattttcaaaatcgccttttgactcctgacagcggaatgtactcaaaaataaatttaaagaattgccataaacaaactttgatagtcaatttggcgaccacttgcttctccagtttggcttccaatgcattagccaatttctcaggctccctttcgctcatttcggcaatttcgacagccttaagctgtaaatatttttcagccgagtgggcaaacatggtcgcgtattgcgtgcattcgggatgagcgcaatctttaaactcgatcctcaaaaacaaatttttgagcggcgattttgcagtgtgttcacacgtctcacaatacatttcgtcgtttaacttccgtcgacagcacaatcctcgctgctttaaggggcacgcctgcaaataggagctcatcagcaggaacagacgctcctcctccctcttacattataaattttgtactgaagatttgcaattttggcctcaacaaaaaatattcccgggctcttgaagtctatcacttccttcagctgctttgtcttagctggtattccttcgctggtgcgcttttgtccggcagtgccactctcgagtttaaaacggtccaacgctgtcgacattttttatatttttaataaatgatagcttaaataatgcaaaaaaataaaattgaataaatcggtagaaatgtggaaataaatacgcacagttttgcgcagggctaataggccacgccctaaattttcaattaaatttactcttatgttttagctaaatggcaaaaagttatggaccatggaccgagaatggccaatgattgggcacattaactagaaatacgccaaaatatatgaaataaccaataaatattatataaaggcaaaacattcaaaaaatattagaacaaatcttgaaataaaaatgaaatagcatttaaattaagataaattgttaacttatattgattataagcattgcattttctaataccgcgaaagtaataaaattttaattggctttccattggtggcattcgttaaacgaaataatatattatttccaggaaaacgatttttaggctctaaaaacatgcaaaataagtatgtagttagtaggtcctaaaacccaaaaagaagcagttgaaaacaggcactaaaaaagtctcaaatttatcagtgtaaaatgacaaaatttattgcaaaagtaataaaattaagtcaagtcactattggggcaaataattcttcaaattaaaattcttatgaagaaaagaaattaattaattatggagataattttttgttttcgactctgaaaagaaaaacctagaaaacgggcactaatacctcgaaaagtagattaacaacagccaacaaaaaggtttgttttttcattggtttcagaagccactgagtaaaaataggcaaaatcgtgtgcataattattgttcgaaatatatttacttttttatttgcaacaatcacttttttttggtgctcatatgtttacgatcactttattgatatcaaattttagaggacagaaaatcagaaataatttgctatatgcatttttccgctgatcaaaattttacatcatctttatctgattattgcttcacatgatagaaatagttttttgaggttagaaaagttttccagaaaatagtgcaggctccgtagaaattgaattaaatttttttgtgccctcaaatttgctattaaaaagttattgtaaacataagaacacccaaaaatttattgttgcaaataatgcttaatataatttcggcaatacatattaattctgaatggtatcaatggaacaaaatccaatgataatgcaataaaatattaaagttcgagtaatttttattaattatttttattggaatggcgattaattgcgaaaatatgaccatatctatgtagttaatttaggtatatttagttattttctggcgatatttttagcagggggcgagaattcaaatgcttaatagtcgaaacgtccaaattgcttaatcagcagagttgtcctattttacgttaatgggcgaatgtcattatgcaaaatgtcggttgacaaggtgtcgtcgaaatgttcatacagcattacatagtggtagaaattttcaaattacaaaa

SEQ ID NO: 3415 - DNA, 931 bp, Heterodera glycines
ctaataattgcattcatttttatggactttggaatatcgtttataatttcgttaaaataacataaattaaattatgtcttacttaaataaaattataatttaaaaataggaggttctttaaaatgcattttacaacagatttacgctattagaacccccccccccccccctcccccgctgaatcgtcgaacaccttgtcttgatcctgtaattttgggtagagcatcattttcgagattatcattttgtgctcgcctcgacacagagtgtttcccgtatttcgagttttcagctttttcgtcttttggatcagaaaattgctgcattgtgaccgcttcgatttccctcccaccaaatttttgtcgaaaaaatgtcggtcataagtccaaactagagcccggtgggaacgggattcccgcgggaaaacatggaatcccatttccgtcttttttgcctgacgggatttttacgggaacgggaaaaagggcggatataccggaaaattcatattttaattgatatttacgattgtaattttttatcagaatctccacatttagttgatatttacaattgtaattcattaccggaaaattcatattttaattgatatttacaattgtaatttttttatcagaatctccacatttagttgatatttacaattgtaatttactaccggaaaattatattttaattgatatttacaattgtaattttttataagaatctccacatttagttgatatttacaattgtaatcattcttcttatttcttccattttctttatttttcatccattattaattatgcagtttattaaaccctttttttattttccctgccattgaaattttggaatacatttacacctccttgcgcctcttctgttgctgaagggccattcaaatcaccccttcccctttttt

SEQ ID NO: 3416 - DNA, 3589 bp, Heterodera glycines
cggacacctgcgctttcttgtccgttgttatgaatgaagatgtctgaatgggagaaaatgaagtaacagattgctgaacatccgccaaatttgctaaaccttggccggatgaaacaggaagaccataattacgccaatactcaatagcgcattttgaattcgcatggagtgtattaaaagctgaaaaagcatttatttcacagtggtttaaacaatgtgtacaaatggaataagatggtgatcaaaaaaatgttcaaaaccaagtttcctagagttttcatgctcgctgatcatgaatctgagacccatctcgactaatttcgaatcgcgaccgcgactaccgtccccgttcattttcgttttgatgttcccgttccgtaaatgttttctcaaaaacggggataaaagtacactggtaagaatggggtctgatttgtgagtaaaaattttgtctttattatttatcgcatgggttcaattccacattggaatgggagagttttcatattttgttttgattactttaatttaaatataattattaattaataagaaaattttcaaacaaaaaattatttttctttattttttaaaacagctatagatccataaattaatcatgattcgatattttttggacaaaatctgttaacaaattcactcaaaatttcaaaaattttcacgtcggcgcctaatggctcggcaccgccgtcccccccccggttcccccaaagattttggtttggcaattggcaaatgtgcgccgcaaaaaagcgataaaaagtaaaaaaaaagaaatgattttttcaattagtcaaaattctttttttttcgtcattgaatattttggatgttggtaccggcctattttttaaacaagtcaattacgataaattcaaattattaaattttttgttattttttgcccattaataaaagcaatattacaagatatttctccattctttgcagggctggccgtgatcacggatcacgggtcacggattttttcaaattttccgtgattttgatccgtgattggcattttatatagggaatttttattgagacgaaaataggaaagtggtgtgaagaaatttttgagaaaaataaataaattcttttctgcttacaaattagaaagtaaacatatatatgtagtctggtggttaagccttctgtctttcgttgtctgtctcttgggttcaattccccattgggatatgactatttatatattttgttttgataattttaattgaaatttaattaacaagaaatttcataacattgaaaattatttttctttattttttaaaacgtccatagaccaataaattaaccaatgattggacatattttggacaaaatctgttaacaaattcactcaaaatttcaaaatttttcccggcggcgcctgtcggcaccaccggcagacggacccccattttaccgtatttttgaaattttgaccccaaaatggcagaaaaattaccatttttggcatataaactgctaaaaaccctattttttctctccgtcgcttaaatttaaaacgacaggcctaatcaaaattttcagaaaattttcccaaccctctaagaattttttctaaaattttcccgactttcagtatcttttggggtgttcagatcgtcatgaaggactgagcatgttggtccaaaagattttttcagcatcaaaagttagcttacaaattagaggaaatttttttctctacataaatagatttttggttaaatttaagaaaaatttgaaaaattttcttaataaattagttaaaaataaaaaattttccttggagatttctacaaaaagctctaattttcctcaaaaaattgccaaaaatcgtaaacttagtcattttttggaaaaggtcgccgcaaaaaaagcggtttatttgttttggtttctttaaaacattttttgggaatttttcccccgattaaattccgttttttaaataaatttaaataaaaaatcattagaaaattttttttttataatcacggatcacggctcacggatcacggaaatcacggggattttggggtgccgtgatcacggttcacgggtcacggattttttttaaagccccgtgatcacggctcacggatttccgtgattggaaattcaatcacggccagccctgattctttgtcacttcggctcaccacaatgcatttttattgtagaaaatgttatttaatggtttttttgtttcagttttcaatgccattaatttgctgttctgcttttcttctcacttggatcatttattttctaaagacgaaaccaaacttttggatatgtctgatgtttattaaaacgatcatgtaaaggatataagaaatgtttttaaccaatcgaataattagtagtgttgttcgagagtctcgactcgagaaaagtctcggcgttttttggtcttgctctcgtgtttttaagtctcggtctcgatttccgagactcgagaccgagacatttttacacccctaatgatttgcttttgttaaaattaaatagttttgtaagtttaatatatttctgggacctttttgagcttggataaaatcggaaattttgtaacggtacaattactggactaagcgacactacttacaaaacaaatgttaaatttttcatgtaatttacttaatttttcaaaataatcatttaaaagtaaaattaattaatttttcttttcaaataaaggctaaaaattaagatttaccaaataaaatttataaaaatttatttgtttcattcaaccaccatttttccacggaatcatatatatgtagtctggtggttaagccttctgtctttcgttgtctgtctcttgggttcaattccccattgggatatgactatttatatattttgttttgataattttaattgaaatttaattaacaagaaatttcataacattgaaaattatttttctttattttttaaaacgtccatagaccaataaattaaccaatgattggacatattttggacaaaatctgttaacaaattcactcaaaatttcaaaatttttcccggcggcgcctgtcggcaccaccggcagacggacccccattttaccgtatttttgaaattttgaccccaaaatggcagaaaaattaccatttttggcatataaactgctaaaaaccatattttttctctccgtcgcttaaatttaaaacgacaggcctaatcaaaattttcagaaaattttcccaaccctctaagaattttttctaaaattttcccgactttcagtatcttttggggtgttcagatcgtcatgaaggactgagcatgttggtccaaaagattttttcagcatcaaaagttagcttacaaattagaggaaatttttttctctacataaatagatttttggttaaatttaagaaaaatttgaaaaattttcttaatatattagttaaaaataaaaaattttccttggagatttctacaaaaacctctaattttcctcaaaaaattgccaaaaatcgtaaacttagtcaaaatgggaaaaggtcgccgcaaaaaaagcggtttatttgtt

SEQ ID NO: 3417 - DNA, 3123 bp, Heterodera glycines
  misc_feature (26)..(26): n is a, c, g, or t
aattttttttttttggatatagtacntgatttgaagaaagaagctcaaaaacgcatttcaatgttgaaatttttctacactaatttttcgttatttcaacattctttagaaaatttaccgaaaaaatgaaagaatatataatatatatatccctaagaattgtcactatgattttcaaaaaatatatctctaataaatgaaaaatttttatttacaaaattattttatcggataatatgatccgtatttttttagagcctaaaagcctaaaaaaatttcaaagaagcatttttgcctattttggcgttttgtccaaaatttgttaacaaaaatgcaataaaaatgaaaaaacgccctaaaaatacgaaaatatgacggacagggtcgttttcgtacggccattttcgtacgaccatttgtacgaccgttttctacaaattgttgtcaagcgtcagatttaattgaaaaagcttcggaactaatataaccaatttttattgttttaatttcacaagcatactaattttataatgaattcataattaaaaaaaaatacaaaaataaaaaatttcagaacaaacggctctttttacagggtttgccgtaaaattaacaacttttgcaatttagagctaatttttttaaaaggtcatttctagggttattgtgacgctgatcatgaatttggataccttcggacccgaactcaaacaaaaagtcaaaagtacaagtttttgaattttttatttgaaaattcaatgggagggtcccaaaacagaaaattaccaaaagatcaatgagaatttttaatccgtgttttaaaaccaaaagaaaaatgcaaattttattatttttaaatgtagtaaataattaaattttgaatttttcgaaaaatttataaaattaaaaatgatgatttattatttttttaataaaatttaattttctcccaatctgctgtaaataataatttttctctcaacacctcaccccaatacgttcgtatttcatgcgaaaatacgaaatacaaaaatatgaaatacgtattcgaaacgccctaaaaactcgaaatacgaaatacaaacgaccaacatccctgatatatataatataaattacaatagacactacaataataattgatatatattcataaactacaacatacatacaccacaatgatcgttattgttgacacggagaaaacaatgaagccaaaagatggcaatggcattggcattggcattacgtcatcataatcatctgatgaaatttgcttgtaaattttaagcaaaatctgtggctataaaagagaacagcttggccagtgagcagcaccaattcatgcaaccatttcccattttctgttttgaataataataactgtatttatagggattggattttttaggcaaaaaaaaaggcacaaaattgaaaatcggcagaattttttcatggaataatttttttagtcaaaatgacaaagaagctgaaataaatttcgttttttttctctgaaaatgagggaagtttttttttaaatgaaaatacataagaattaattgagatgaatattttttaaaaaacttctttctattcacatgcgacaattttttttttttttgtaaatttttataggtctattttttgtaaagaaattttccaaaaatccaaaatcctaaccacaaacaccatctccatcattacaaccaccaaaaatgaacgcgcaattcgctgctgtgccgatgctgacaactgttttgctggtttgtgtattgctgttgttcccaacaatttgtgaagcgcgtcccaaggaagataaagcgaaaggaaagactcacaaaactgagaacacagattcccgcccggttattctcgaaagttgggattgtaatacaaatgcaaaaacaacagcaccatccacatcagaaaacttacaaccacatcatacaacaaactcacccgttagcaatcaaattaatggcttgccaaaaagcatgttcatgccacgcaaatagaacaaatcaggttagtcatcagtgagtgccaaaacagttatcgatcccagaaaatttttggttcaactcaggcacagccgttttgatgaaaataaaaaaaaattaatatgtgccaagaggcgccgcatgcctgggaatttttaattttttttctcgaattttgtgatgagaagaatttatttaataacattttcaattgttttttattttttatttaaaattttattttttgcattttccccgtcctccaatggttagcaggtctggtgctgctgcgcatgcaaacggtggagaatttgatgcctgattggtgaacaaacagatgtttttttgggggggattttctgctgatgatgatacatttcatttttgttgatgcctgatactgtattgttgttgtttttttctatgcattttctcaacaatttgttgtcgcatttatttgttgcgttatttttgggtaaaaaatttttttaaaaaaatgtgtaaatatgtaatgaatttttgtatagcttatatatagtagtcctttgtgtttcctggtcacgcaagcagtgactgccaaaagagcaggtccgtaattagaaaaattttatgggcgactgagtcttattggtgatgtaatgccaatgccattgtgattttttggcttcattgttttcgccataccaacagtaaagtagagagtgtgattgtagtgtatattgtaatttaaaaaataaatatatgtaattcgttgggaggctcgctccgacgggagaataacacaaattttagaaaataaaattctcccataaattctaggaaaaaaataaatatgtacatatattataataaatacaatatacactacaataaaacgctactcaactgttagcatggagaaaacaaaattaaaactaaaattgatttattatacttttaaaattcttttaaaaaaatcaaagacattttttatagaaaactcgtagcttcttatcgtctaactgaacttcagctacctcctcatggtccattctaactactttttttttaatttccactttttaatttgtttataaaagaattaagtaactctggctaaagcgacaaacatttggcgcaa

SEQ ID NO: 3418 - DNA, 1647 bp, Heterodera glycines
  misc_feature (77)..(77): n is a, c, g, or t
cgctgcccttctttcgaagcttcagaccatactgttttgcgccaccacttacaaattccaaaatgtcatgcttaatntaaatttatattcataaaatcaaatattccttacctttgggaattcgtcagtaaactgacccaagtgaggtcccgttttcaatggatttcttccttttggatgaacataaatcaatgaatccgtatcttaaaaatttttttaaattataattaataaagtgtatttaccagtgtataaaagaatgcaaccaggagtacgagcgactatctgcattgcttttaacaaatgtaggcgagctgcagaagttgtgaaaagtgaaatgaccacatttgaacagggatgttcctggacccaatccttcttctggttatagctgatcaaaatcctctctggagtcagcatgtcaagtcctgtcacttcaattttccggttgtctagataatttcccagttctgatgggtcatcagttataagagtttgggagagtccgtaattacgaagtgaaaaacgaccccctaaaattttatctttaaaaaaacttttttaattataattaaacttacataaattatttacagctaatttggccaaagcccgctttcccttgttgggtaccatctttgttcgatcaatttttataccaaattggtcccaacattccgctatgaactgttcttcgacttcaaaatttccgtgaatattctcatcaaaccccgaggcatgtatcttttggaccataaattcactcatatatggccgaaaaagtttgttgtcactcctgtcgtactcgagaacgcgcaaaagcatgttaactctgtagccctcctccaaagcgacattaagctacaaaagtttttttttaatatttaaaacaaatttgcacctccaatgaggtacatgtgctgatccatcctctttgtttgtcagtatgctggcaactgtatgcttctttgacacctccatttgggtattttttgcaacaactcatgcagagcggaaaacatagcctatcaccgactttgactggcaatactggaatatcgattttgcggggagggatgacgaacactttgagaattgcaagaggataaggattgtcctctggtctctgccagtcaacttcttcacatgggacatgaagtgtcggatgtccaacaggataatttgttacgcaactaaaaattcttgtttttgatataaaaaaattatcttacttaataaatgggtagagactggtaaagtcataatagctaatttcctcatccgctttcacttcatggtaaagcttcagcgcacccgtccttccacccataaaacaagcacgaatattgattggtccgccatctcccgtatattcattgaatttctgcttcatctgttggtccttggtcagcatttcctcaatctcacattgccaataaatttccacatttggcactttggtcaatataaaatccatccttagtttattccgctctcggattcgggctgcggttttgccacaaggcattacttcactatcatccggataacactttgagcaagcatgccatacacatccatgtatttctagccctttttgttctgactcaatccatccgtccaaacgaaaattgcccactcttgaga

SEQ ID NO: 3419 - DNA, 3381 bp, Heterodera glycines
tacctggccaatgcttcatcaagcaggaacggcatattatggttttgggaatgccatctgtcaaattccttacgcttctcaggattcattccgtcggccaaataattcgctttcgttggaaatatttgacaaccgtaattttccggccggttcgccaaatgtgggaagaacggtttgtcctgcacatccaagccaaacattgggaccattgaggctaatggacccggaaccaaattccacgagtctcgaaagatgacatttgggtttaaactcttccgacatttgaccttcaaaaataaaaataattattaaacagaaatttttttaccttcatttcgagcaatctgttgccatttttaatcattgatggattaagtccttccatgaacaattcacggaacaccaaaaccatgtcaaaacgtcctccaaaatgtgagtaggcaatagtgtcgcattgttttggtaaattatacagaatccatttgacgaaggaaactagggggtgtcggtcaatgacctgcttgtccaccattgtgccatgaaagggcatttggctgaatgtaatcgtccgatgatggccacaaatattgcatttttttccacgcaaagtgttcttccattgtccggaagaaatgcaaccggggcaggcaacttttgcggtgacaaagttgacctggtgtttccgtcgctcaggaatttcgcaatttactggttcgtgctgcattgtctcaaggtcgaaaacgaccagtcgccagtcttgtgtttctttttttaaatttggctccaaaggacgaatgaaacaccctctctcgaaattgtggaaaatttgacaattctcgcaccaccgttcattgcatatatgtccctaaatttactattattcaacatcatattagtttaaacacctctcgtccattctgagtgttatttctcaagtcccaaactacaccgcaatgtttgcattctttgctcattttgcaatattcagacgaaagatgatgctgatagcatatattgttaaaaaataacttattgcatccgttgcatttttgtcggaaaccatgagttggcttacacgggaattttggacccatttgggagctaaaattctcaaataaataattaatctttttgtaattaccattttatacatcgagccttgcaacttttcatatgcctttttggtcggtcataagtcttttcacaactcagacaataaggcacaccgaataagttcccacttttttgcactccgttaaaatgtccgtcttcaaagtaaagaataatcggcacaccatagtctactggtccatatttgaataaaggtttgtaatggcccgtcgatccgaagacaaacgttttaactttccactgatcagaaaatttttctccattccaccagtcaacaattctcggcacataaacttccgcatcgtaatttggttgaccggctggtgcattaatggcacgcatcatttccaaagcatcatgtttaagttttcccctcattccattgttgccattgatatagtcgtgaaagcgacgaaaatcaagatcaccaactgcacggaccattgctgcttgcatcgaataaaataaacaataattgtcagcatcaaaattttgtatctaaaataaaattttttaaataaaatatttattttattagaaactttaattagacagtttgggtgaattctatggtgaacgggcgccaatttccgtgctgcacctccttttagttgtcttttctctggtagaccatttcgattaactgttgtcacggtaacagtaaatggttcgccccaaagtgtcacaccatcctgctttttgctttgagctacgtcgttaaaacgatttaaaatcgtgttaattgtatcaggagtaagttgtcgaataggaatccaaatatctgacgtaagcagctggctggaaacaatgcagccgagatgagttggctcaactccactttggtgactgtcaacaattgcctcatccatacagtgctggaatatgccgcttagcagtgcttcggggtcagcagggacgtctttgataatgaagcgcgatttgtttttgacccattggaactttggaacatgctcgatttccgaatcaagttttttgatgtaatcttttgggttttttcggggaggtgaaagttcattatatggttcccgaagtaactcttcaataaaaaaacgacgagaacgtttagagggaggagaagaagaagaatttttcattttcttaaaaataaattttatttaaaaaattctttattatgaataaaatgcatattttttcttatttttaaaccagaatatgatggatatgatagttctcttatagataaaattttatatttactcatcattattattgaacaattattggagagggaaatgacagttcattgcgccaatcatcgccttcccactcacatagcaaataaagaagtcatatttgaaaaaaaggaaaaggtctttcagccaatcatccaacggaaaggaaaagagtcattttcgccagtatgagagggacggattaaccttttcagccaatcacagttcaccattttatgcagacgcggaaggtttctctcggtaaacaatcggtgccggggtaccgagtggcagtcaatatgtttaccttccccctagccaatccctttccatccccccaaaatttactgaataaaaatgcaaataaattattttattggaaaattattaataaaattacggacaaataattctggattgtttgatataataagtttatgaaggaattcattaaaacttaatccaaatgataaaaaatacacaaaacaaatacaaaaatgggcacatgatttagacataggggactgaaatgtttgtttattataaattattcctggaaaatcatgaagaaaagagtttaaaacaatttcattgattggaaaggttaagctatcaaaataaattgcttttttctctaatccataaacaaataatgcaatccaatgtgatccgggaaattgatgtgggtccaaattaactattagtgaggatgggaatcgtagtgattttgaatcaggtagttgatcgcatgggaaacagccaaggaatgtgcgattcgttatttctgatgtcttcaatattttggtaatttgatgagtgtccatttgtcttagtgcgcttttctgtcaaagtgagctttaaccaaagtattgaccgtaactgataaattattaagctgatgactgatagggcgaataagactatcattgcccaacaaaaaacatgcgcatacacattagcttcttttggtaactctttgcaaagaggaataaatggaaaatttatagtttcagctggttgttgttgttttaatgct

SEQ ID NO: 3420 - DNA, 3060 bp, Heterodera glycines
aaaattttcaacattttaaaaatgatttaaatggttgtgtcggtcgcgatcgttctgttttatccaaaaagtagattgagtctgcttctcccataactatcagtgtaattccaccatcgggcactggttttttgaatttaatgtttactgccgtacatccctttttgattagatcaaataagccgccatgatcgtctccactgtttgtcatattaaacacataaatacagtgagtgtgcaaaaatgaaaagtaatcaattccatttccatatgtagagttagcaaaaccaagcgcctcctgcgtgtcattgtagggacgaacaaatttccaattttcatagtcaatgtcatacggggcctggggataagagcgaccattggccacaacactcaactcccgtacattaaagtgctgaaagttgaatgggctccttttgatgtttcccacataatctgaatttgcgacaagtcccattgttacacggcgtggaacttggtccatgaataaatttgcattaaattcatagcgtcccgggcttatgaacagtgctttcatcattgtcttccgtacagcataccgtgctggtttcatttccaattttttcgccaactcaagagccaagccatccataagactgacttttttgcagtagagtttcaatccaacaagctcaatactatatggctgaccgggtgggtctaaggtgtcaattaacaaaaaattgtcgtcatggggttgtatcgttatgtcaatttcacaatgattaatcaaatattggggtacattgaaaagatcggcatcgatttttgcaatgtattgtgctgttcgacctcccaaataccgttgtcttctacttttgaacccttcggaatttgcgttttgtagattgctagcatcctcacggtcgtatccggcagcagttaaatgcgaaactttagcttcaagtgattgagaaagttcatgagaaagataagttttgtatgccatcagtgaatttgaattgaaaatttcacgaccgtttattgcaattttcatgtctcgtatgaacgtgtgtccgatcagttgtatcggtacaacctgatcagtagcatccaaatgtccccattcaccatttggtggtgtcaattttcgcattcgaaattcggtcaaaaggtaacactttgacaggtcaatgtagttttggctcgagtgtattttaaaatggtaaggtgtgtcggtgagtgggttactcggcaaaatctcgaaaacctttgacgatgatacggtaacatttgtagggggtatactgaaaaagtcaacagcattggtaattgaatcaatgctgctcgagtcaattttgtgaaatgccattttatcttctttttttttaataaagtccaaatgcgtctgatctgagtctctttttgcttttaattagtggtttggtaatagtttttccaattaaagtctggtgcgatagaaggggtgatttgttagcttttatacgctttcttcgtcctcctgtaccaaattggcgttgaaatccacccttctccaaaatgttgtccgcgcctcgtttaccctcagttgtcaatgtttctattgtcccctttaaccccggcttttcatcgatcattcgatttataaaacgttttccggtttgcattgtttcgtccgtaacagtatcaccggctctgcgaattagaggcagaaaaaagcgccagagtcctcgaaaaatgtctccgatccctgcacccgtctgtgctgtgccccacccgcgctgaaacggtggcgctcctcgaaaaacttggtaggcggagtcatcaccgactccacaaccattttgcacaaaaaatgcatcatagcccgaaaccgaagtgtcatagagaatgtgaaccattttattcaatcgattatgtcaaattatacaataatgagtgaattcaaaaatttatcaccttcttaaatatcagtacgatcagcactgttccataggaaaatggtactaatcttccgtcggtcattgttcttaattcaatttgaatttctgacacttcttttggtaaaacacgtgcgtataggggggagtcgtaaattttttcagtgtattctcccggcgttgctcctgacactgagacaacacggagaagagaactcagtgaatttccaacaatcatgttttcagtcaaccctttggcgtatacggcaaaacttgcaaatccaccacgtaaatcactcccatatttggcaatctcattgtttcttacgtgttgtgtattttcaaaacctaatacataaccaagttgaggagaaaatgagataaattcaattctcggatgtgtaaaaaccgctttgaaccgttcaagatttggatgatattgtaactccactccttcaatgatttgtctaaccatatgtaagtttagttttttccattgctcatctccaaacaaaacggaaactaattgctccgcgcggtctctttccgtttgttcttcaattcgccctatcaaatccttgattgtttctttcggtggttcggtaattgtcgtggtggtagttgttgttatggtcgtccttttactatcaggtgttaattcagttacaagttgggtctgaccctgtttaacatttaaactcttttcatttctctgtttgggtggtggcccaatggtatcaattgaaattaccctgggtggggacgtggattttttttctgtcccgattgcgtgtgttggtgaagttggtatcggttgacgcggtggtgggactatttcaattgcacttttttcgtttctttgttttggtggcggaccaatttccatttgtttcgcctcattaatcgatgaaactgtttgattctcattcttttttacatgaggagcagctactacttgatgcacttgtgacactgtagtttggttcgacactggtaatggagacgtatgctttaaaactgaatgagttggtccgctgctgccttttaattcttcctgttttttagtcacatttattgatgaaattggaacgggtggaggagaagtaatattttgagtaataatctgattggaccctttttt

SEQ ID NO: 3421 - DNA, 1820 bp, Heterodera glycines
ctgaagccgtcttctcttttgctcattggtaagttgggaatttggaatggtgaaaaggtgctgatcctccgcaaactgacgacgctgctcttcggaaagtgcttcgccaaacgggttcttttgtctttttggttgatttttgataacatttggtgaagacaatctttttcttgagccaactctgattctttttttttcggtttcttcttcatttttactgcttttccgcttttttgttttactaggcaatggaggttcaggtgggagtggctggttctgagtcgaattattaggttgttgtaagagttccaaatcatggtcatcatcatccggtaatggggcagcggctgcctcggccagtaaatccctcggaggattacttctcgttgccaaggtcgaagaagttgaatgctgcggttgtgttactctgggtttgtttgtcgttttctgtttaaaacgaagagaagcctcttgttgaagaggaggatgtcttaactcttccgaatcaataaggctcttttttgcttctcgaacatcatttaaattttgctgtgcttttcgttttctgttaacttgagagtgtatggggatagatggttggggggctggttgaaatggttcttcctgttgaacttctgctggaattttttcttcacttcgccatgagattggcggcagttttctcctttgtcttttagctattttagaggaagaagccggctcatattgctgtatgagttgccgcttagctccctcttcccatgaggaataatactcatttgctttccttttttgacccctatttacagcttggaagggtggagagtctggtagtaatggcatttcctcatcgtcgtggtaatgatgatgaggccggcgctgtctgcgaatttgtgaagcagggggttgtgatctttctgatcccaaattaaaaatttgttcgtcttcatcactctcatctccctttttgattagtgccttcaaccctttggcaatttctacttttgatggatgattttggtgttcatctctcaggtggagataacgagacaattcttggttataatgaatattttttgctgtcacattctccctctttctttttgttctttccagcgcatgcttagtaaaacccaagtttatgtttcccgaatcactgcttgttaagccatgataaatttcttctggtacgagaataaacttcgaagccatgataaaatgatcaattgtcactctttgagcttgaatttatagcagagcgtgctaaatcaataagaataggagtgagcagagctgcaaaaactcctccgagtccacttccggtttgaaccaggaccttccgtgcccctctttcggtccttcgacgagcaagacttcgaacaaaagttgcataaggtagcaaacgctttctttggcgagttgttaatttaaagtgtgaacaaagaatgtttaaagctatttcaattagtgttaacaattgatcggcatttgcacgttttaaaatttgtctcctttttttcatcgatttggttttggcaagtactcgaataaaatcaaaatttttatgtacaatttctccaattttacaaaaggccattttttggaatgaaaatgatcttttttccttcttcttcgtcgtctttaaatatgccgctccttaatcgcagcagggggtttgaagcagcatgcatatcaacaacgagatagccatagggtttattagtcgcaatacgataggcagaaaggaaataatccagttttcccggaaaaagttgcactccaatgttacgaatcgccagtgcggaatttggagctcgcat

SEQ ID NO: 3422 - DNA, 921 bp, Heterodera glycines
ctccgcttggagcaaatcgcgccgatactcactgggcgcccgttgcgcttccgattccttccaattgattaaatgtaatgattagacattaaaaaaagctcggccttaaaggtcattaattctccgcgattggcattttgactggaaaagggacgccgcaaaccccggcaccaaaaatacggagattcaaatggacccgagcgatcaaagataaaatttcatttgaactatgattttgtgaagcaggatcaattcactcactcaccacggccctgccctttttgatgtaagccatcaccgccaaactctcgatcagtgaaagcactgtgaacgctttgatcacgacgaacctaaaaaatgctcaaaaaattaaataatgtgatcaatttgaggaaagaaaggcccaccaaatgtcgagagaagtcaaataggaagtgatcacctgaatttaaatgaaaaataaaatgtttttttttgaaattgggtggtcattggtcacctcctgattccctttctccatttgcacgagagtgagcagaacctgaacatcatcactattatatgtttatgcaaattaaaaataatatttttaatttagtggcgcccattctcaaggctttcccactctgatcaatttaattctcaaaaaagaaacttcctgtaccgtgatcggagtgatgatgcgcacttcctcgtaattgtacggtacatagcttaattgggctattaagagcataatgaatggaaatggacaatgatggtcaatgaacctacggggccacccaggagaagatcatggccaaaatgctgggcatgtaccgttcggcaacatatcgtgccgagtcgcgcttcagctcaaaaccaaagcgagacacgacgacggaactttgggagaaaatgaagggcaattacatgattact

SEQ ID NO: 3423 - DNA, 4662 bp, Heterodera glycines
aagagctcccactgcaagtcgagcatcgttttgggatgggctactgtaaaacggtacggtagcgaatttaattttaaaaacatttttttggtttgtccaaaattgcaaaatgttcgccattttgaggcacaactgactcgagctgatgtaaaggccgcatcgttgagaatcgtgggggaaattgcaaaagttcatctgacagtcgggcaacaaagtgattctgacatttgaagggcacaatttgaacatttgaaattacataaaataaaaaatgagttttttaaatttttttaaaaagcattgaaaatgtaaaaaaaatgtgagggaatttggaaaaaaaggaacaataagctaaaaaaggaaaagcatgtgcaaatggcatagctaaaatgtaaatccgtcaaattatgcccttttgcttggcttcttcataaacttcgctcgattcgagaattgggaatggtctttcagccgctcgaataaatgatgctgatggcgccgagttcagtgcccgtgccatatcttccgggtacatatgttcttcggctttaactttgcttggatcataaattaaatcatgcgatgcacccgatggatcgaattttgccattgaattttgcccaatttgccattccgaagcgtttggcattttgtttttcaatggacccgccgctgtccttccccattcaggtgccgaagtcaaatgctggacagcggcgcaaaagttggttttgtccactggcaccacaaagggtggcggtttgcgtgacttttttggcttccgtgcactttggcgtttcatctccactttttgagcgggactattgtaagcagaagcagttgcctttcttcggttgctctgtccgcttttgttttcggcatttgtggctaatccctgctggttgcccatcatttgattggcatttgttgccaactttggctgggtcaaactgttggcatgggttgccaatctctgctgctggtgacccatcatattgctgctttcactgctttttgccaagcctgttccgctgctttcattctcaacgctcaattgctgttggagaatcggactaattgacatgccatgctcattaagaaaggcaatttgatcgtcaacgtttggcggaagaaaggcgtcataataattgtaagaattatgatgatcataattgttctgctgattgtttgccaaattgttgctgttgtcattgttcattccatcgcacagtttgaaaaagcaaatgaaaatttgaaggacaacagcaaaaagaacaacaaaagtgtgcatgttgttcagaaacagaaacaaaacagcagaaggaaaagcaattaaaatgtgtaaaaaagggcttaaaaagtaattaaaatccaaaaaaaactaatttggattatattattgtaattgcaaaaagaaagaatgaataaaatggagaataaataatttcataaaaatttataaatttacataataaaataaagggaattacatttgtcacattttctgacaagcaaatgattgatcgaaaagcataaaaaaggttattagctacgtatgtgaagaaaaattttcaaattgattttgcccattttttgtgagtatttttgagaaaatgaattaaattaaaaaataaatatgtgtaaaatgatgagataaaattaatatgaacaaaaaaatggacaaaaattcgaaaaaatgtaaaataatgaaaaaatgtggaattaatttttttataccaccctaattaaggaattaataattgattaattagtgtaaagtgttgcctggtggtgaagctgacgtgtccgtcgggcaaaatgcgcatgcgaaagttgggaaaagtgaccatgtgaaagtaggagaatttggagttcaaaaacactgcgtccggcttccaaattcggtcgatgattttctgctcccgaattcggattggtttcgaaaaattgttagccaaacttaaaaaagtgccattgccaaaaaatggaatttatttgagtaaaaagcgttaccgaacatcgatccaacgcagtcggaccagcacatccaattcgtattccatctggaaattgtcgaagttgcccaggtggagcacttccagcgaaagtgccacgcgcaacggcatatctgaaaggggcacaattggcaatggcattcccaaaaatgtgccaatgaaaattgaaagacctgggaatactaacggcacacttttgttgtcgtatttgcgctccttcagcagtggaaggatgaagctgccgcccagatcgcggtacgtctcgcgcaattcgtcctcctccgcttcatcgctgacgttgttggacctaacggacggaacggaatagcaattgccattcaaatttatgactttcaaagcccattgaaacgcgttagattagtcagtcggaaggcaatccatcccgccgcttcccaaaccatttcattatccaatcaattgcccacctggcaattagttgtgccagcaattgctgtctgtcccgacccagcgggtcaacgtgctggttcatcgccagttcctcctcgttgatcggtgcccaagttgtgcttgtacccgtcgtcgtcgtggcgggcattggcttccccaacgacgtgccgttcagcagcactttttgcccactgtttgacaagtcgttgcgcaatggtgccattgggtcatctttttggtccctgtcttgaccccaaattgtgccatttccattttccgtttccgccttcgccgtttcttttgtttcttcgcccgacggagtcacaaaagcgccgaagatcagaatgtcttccaagtgcagctttacatctgcttttgctgtgccgccggttgttgagggcgtttttgtgctgcccgtttctctttgcgctacttcttcgcttacattggcattttgttccggcatagttttgttgacattttgttccgtaacgataattgttccattggatgattgctcagtgtgtgttccttggatttgagatgaatgagagtgatgaagaggatgatggtgatgccgaagacgatggggaacccaagggataatcagctgcttgaaaagtgccacgtccggtctctggtcatttgccaaaagtcccttctcttcatccctccctccctctttcgccttgtcccttccttgcttcatcttccgagcatcatccgtctgatcatcttcaattttcctccgggcatcctcctccccatctcttcctttttccttccctctttcttctttttcatcccttccaatgtcccattccttccattttccatcctcatcccttccacttccatttatccgatcgttttgtttccttaacttttcctccgtcgtattccttttttcttccgaattgtcaaattcgatgattgtccatccgtcgtcctctgcgtcgtcgtcataatcttcttctgctgtttctgtttcgccatcttccatctcatcttccaaatcgtggtcaaaattttgttggacaacccgaaaattaagaagtgaaagccatggcccatctgaaataattaatttcaattaaattgccaattttgaaatgattacctaatgtggcttctttgtgcttatttgcatggtttaaattgcagttaattaatctccattaaacattaagttatttttattggacaccattaaatatttaattcgattgtttttttcaaaattgcaatgatgaaaagaaatgccaaataaatgagttcatccgaattcttttacttccgataaattccaaataaaaatgccattccaccaccataacattaacccgatcaattaaacactatcaaaaggcctttgcatttgcctggttttcggtagaaatgcactcggaaagtccgtttccgttgttgcgaatcgccgaaaattgccgggccaataaaaatggcaaacaaaacatagacaaaaaagagcccaaattttgctgtcgatgagcacatcgtggcactacccaccacatcaccgcgcggatcgaagaagaaaagcagtgccaccaattttatttggcgaaattttaaacggaaattaacgaaaatgaaattcaagaaaaggaaattttaattaaaattacattcattaaaggcaaaaggtgaagcaagcagcattagctgatcaaataaagattaatgtgttgcgaaggacaaaaacaaacgaattaacaaatggattattaattaattaccgaaaatgtcttgggcattttcagggatttggcactgcttttagacggtattttattagtgttttgagaccggcagcagaacttttttcaaaaacagctccacccaacacaataacatgaatgagtacaacaactccatcaaccccaatgatgccccttttgttcgtcctccgtccgatcattttgcgatggtcggatgcgttttgctgcacattttgtccgctgctgatcgatcgatcagacgacggcgaattatgtcggctgattggacacaaaagtgcgtgtcctttcggggcatcagcaaaaaaggggggcccaaattggaaattgccgaaagcatcgaagcgaaatttcagtgggggggggcaaaagtgaattaaaacaatttgattatttattttaaaatcaaaagaaaaaatagcgaaatgaaatgggcaatttaattgtcgaatgggagaaaa

SEQ ID NO: 3424 - DNA, 1904 bp, Heterodera glycines
  misc_feature (1880)..(1880): n is a, c, g, or t
tttttcaatttttgcttacgatttgcggcctgggctcccccaaggataccacgcgaagcgttggatggcatatggccacttgaaaatagcataaatgagaaggccaatgccgaggataagcaagccgacgacagacgcacggaagcttttaatgattgtgactatgacaagcgcgaggcaaatgcacagaaaaacgacgggaagaatcaacggcacgcggatggccttctcgtggacgccgtgccgcgcggcgccgatttgcaatttgatgcacaaaagtgccaacattgtgcaagaacgaataatcttacggaggaggggggggggggtaaacaaaggatgaatgaaattaaaaataattaaaatatttgttaaattttccgtttttcactttttgattttaattttattaaaaagtgcaaaaactcacccaatgtgtgaaggcgacgtagctgatcagttccttttttatgtaaatcattataaaatattccaaagttgtaccaaatacctcaaggttgccgagaaatgagaaagccattgaaagtaccacctgaaaaatgacaattcacagataatttcaatatatgtctgatcaatttttcaatcatgcagtttatttattcattgatgaattggttaaataatgtttgcgtttagatttaaaactatttaaaacaataattatttaaaacaattacaatttaattgaccaataaattctttaattatgaattgtggcaataataaacgcttatacattgtcctgctgatcagtaacttattctgatcatttatttaaatcattccgatccccaaacattctgcagatccaaaaatttatatccgattttgttttggcatttacatggacaaaaagtgccgcccggggactgtcatgttgccgattaatgcatgagatgaatgatgggaagtgccgttcccgagcggatgcccaaatgtaacgactgccttggaacaaagtggcattcagagacctgtgaaaataaccatttatcattaattaattaattgtaaatgggccatgatgacggcacccacccgatcagcacaatacacaccaaaaatggcatggcatactgcaaaaagccgccgagggttcgttccgcaaaagtctgcaacaaataagtcgagtgttatgggtcattaggtaaaatgggttaatgctaatgaggcaatttggggaagggaattaaatgcacaacgaatgccacaaaataagcaattttgagttttatgtattggcattgacttgccattgcgatggcattggagctttgcacttcggtcacactgagcaccacaaaataggacacattcatggccaaatacagtgcagcaaccgtggacatgcccacaatgatggcgaaaggcattgacctcaaatttttaataatttttaactttttgtagcattttaaatttaaattttataaattatcgtttgataatttattatgccaatgccttcccccggtcagccacacctgtgcggtttcttcacatcctccgccccaaaattcaaaatgtcccagccgtcgtagctgaacagcccggcaaacagtgccaatacccaattgcccggcttatcgcttgtgttggcgaagggttgccgaaaactaccagattgaacttctgaaaattgcaaaaaaaaaaaaaaagtaaaacccaaaaaaagatttagtaagtgccgagtgacctttactgattagcagccaaaggccgacaatgataatgatgccggaggcgatgaccttggcaatcattgccaacatttgaaagcgagcgacgacgccacggatggaaaagcaattgaggaagaacaaagcactgcgagggattgttggacataatgccanatggtggaccaaatatttaatggt

SEQ ID NO: 3425 - DNA, 1576 bp, Heterodera glycines
aggtggccttcgtaagacaattttactttttgttttttggttgcaattgggttagccatttctgaaaaatgtccaaatcagaatgtaaatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacatttttctatttttgggttggggcccaaacgaccccggggcccaaaaacgggggcccaaacgcatcaaaagccaaaattgttcaaaaaatcagttcaaaattaatttaagagagacaaaagaatgaattgtttcagattcaaattcaataaaaagggattaatcatagtgatgtgaaaagaggttaatcctagtgataaagttcataaaaacaatggtttatttgagaatgggcatttcagtgcatgattaattaggcatttcattgccaagtcgtaaaattagtggataaattggtaatctgcagaatgatctggtggcaaatgagtaatacatgggaagggcacggcatttattacaagcattttagatcactcacaaatgcagctgaaagagattagccggttgatcgcgtaatttgctgactcatcgagttcaagctgaacagataaggaaaaggacaattattattggacacacaaaaagcgactcaatcaaatttatattctttaataattaggcaaaatttttaaatttattttattgttattatttattactagggctgctaattttatgtaagaaaatttgcgaattatgtaaataaaatacgtataaaaaatgctaaaatatgtatgaaatatgtacaaaaactactaaaatatgtaaataaaattttttaaatggtaattttttggaaaaaaattcttcgtaaaaagtgaagcaggcacaaaatgccataaaaatgaccaaaataggcttagaatcaattttagtactttaaatattaatttttggtatctgtttttttgaaaaaaaattcgattttttagggatacattttcaataaatttctataaattctcaaaatataaaaaaaaatgaaaatgtgtacgaaaaattgcaaaattttggatttttttggggcatctttgcaaaatatgtacaaaaaaaatgcgaaaaagtccaaaatatgtataaaaatatgtacatatgtaatatgtagaaaaagcccgaaatatgtaaaaatatgtaaataaaagtcccaacttttgttcgcaaacacaaaaaagaaagtgtttttcctattattcagagcatggagaatccaggaaaaatatgtatttacataaaattagcagccctatttattacgatgaaattggcccaaggatatccgatcattattaccttcaatcccctgatcacgtactccgaaaaggtttgcatttggatggccattgtgccagggttcgtgaaaatgctggcacaggacatgaaagagaaagctgaatgggaaaagggaatgaattgccaaattggcaaaagtgccgactctga

SEQ ID NO: 3426 - DNA, 4914 bp, Heterodera glycines
taatatagccacaatttatcattttttgtttcccattcatcatatttcgttaaactcaaatttatttttaaaaaaattctcgatttttttcttgggacggagttggcgggacggagttggctcgggacggagttgccctgggacggagttggcgggacggagttgcatgggacggagttggcgggaccccttcataggttttaccgcttcgccaactggagtcggggtcgttttggcgcccacgttttggcgccgacgttttggcgcccacgttttggcgccagggtcgttttggcgccgacgttttggcgcccacgttttggcgcccacgttttggcgcccacgttttggcgccaaaatgtagagaaagggcgaaattgtatatttttttgttttttcttggagtggggcaaagtctataaaaggagcaccttcctagtagatttagtattttttttattttcattcttcaaataacgcatttttgttttttcttgtttaggaaatgatgaatcgtcaaattgatacaaaaaagcaaaagcctaaaattacctatgaaggccagctttacaccttcgataaatcaagtgcggacggaacgagaaaattttggagatgcgaatacaagaactcctgcaaagggagaatttggagggatttggacgatcaattcattcgtttggcaactcctcatacctgtccagtgaacgcagcaaatgttgaggcgcagaaagtgaagacggcaataaaacgacgagcactcaccacgttagaaccgccagcagtgatccgatccgaagcacttcagaatgtgccatctccagctggacttttggttacgcaggatgcttcaaaactggtactgtttagtcgatgatatgaaaagcaatcacgaaagaaatcttaaggtaattaaaagggcacggcacgaagtcaatgcaccacctgcggttccacaaagcgttgaccagctattgttcctcccgcataccagacgtacgagtcaactgacggcgaagtggagcagtttctgttggctgactctggtgtgtattacgaggccggaaacgaaaacccgcagaggtaattttttttaaaaactataatccattttactaattttttcaaggattctgctgctttggacgtgaatctttcgggcgatgggctgatcgaatgaaagactgcttcggggacggcacattctcattggcacctccgatgttctatcaaatctacacaattttggccaagtgctgttttaatttgatttcacgtgaaaattgttttaaggcgtgggtcgtgggttatcgtcgtgtgccattgcttgctgacgtccaagtcgcaagcgtcctacgagaggatgtttggacttctccgtcaagcgtggccgacattctcgcctgcctcgttcaacatggacttcgagacagctgcgcgcaacgccgctgttgccacgtttcctgcatgcgaaatcaaattttgcttcttccatttcgtgcggaatttgcaaaaaaaaatcaaggaacaaaatctctggcaggtcagtaagcatattcagtttgtttttgtaattttcgtgtctattcagagatactgtactgacacagtgttggctgagaatctgaggatgctcacttctgtcgcgtttctaccgctcagtgacatcagaacagcagtcatcgcattagacacggagttcgggaacgtgactgcactccgtccgctcattgactggttggttatattattcagatgcattcaatttctgtgcaatttttaggttgctcaacaattacattggacaaccccggccaaatggaacttggtctcaaccactcttcccaccagagcagtggaacgtctacactcgcacactgaacggggaagaaaggacgaacaaccacgcagaggcagaacatcaccgtcttcaaggcgccttcaactgccgtcatccatcgatctggcacttcattgacgttctccgccgtgagcagaagggcaccgatgggaagtatgcgtcatttcttgctggacttgagccaccgcggaaagctaagaaataccaagcggctgatgagcgcctcttcaatttggtgcagaattacatcccggtgaacccgaacaatgaaaatgatcacaattaccacataaatccaaattttcatattattttagaatttctccgtggaatttcgcgcaattatcatatgaacccataaattgtttccatttcttcattttgttaagtttattatatttaacgaaaaatttcattttttgtttccatttcttcattttgttaaatttattatatttaacgaaaaatttcatttttttataatttttacaatttcttcctgccttttttttcatttttggcttggcgccaaaacgtcggcgccaaaacgaccctggcgccaaaacgtcggcgccaaaacgacctggtccctatttatgtgatttaaacgaaatgaaaaacaacttagaatgtacgcttttttgctccattagtacacaatctttaaaatttgcaggattagcttgctaaataaaaaaaggtgtgatcaatttttcgcaagccatatttttttcatactaatttatgaatgttttatttttaaaggtcgatagagccagaaaagaacattttgcaataatgacatcgacaagctcaagtccggaaagtaccaaaaatggcatacacaatattcatcaacgaattgatttttataataaaaaacggtaaatcagcggtcagtcactgcccttcgctcttttttctctcttcttctcttttttatgcttcttactcttccttttcctctttttcttcgattccgcctactctctctcttcttcctcattcttttcttctcctttcttgtccttcttctcgtagtgcttctcgaacagcttccacaccgtgctcttctcctccacggtcattttcggctggtgactgctgctgttcccttctcttccactgcctccgttctgctcatccctcctcgtggtccctctcccttcgcctcctctgctccggtgatgataatcccgctccctgtcccgatctcgatccctttctcgatggtgatagtctcgatgctctgtccggtgatgtttgtgttggtgcggttgctgctgctgataaatgccactgcctccggcactattgttgcgcatcagttggaaattgcgctccgccttttcgttctctttgcgcttcaaaaagttctcccaaacggacaacgagtcctccgccgaaagtgccattgtcgtcgtcgtggaatacatcggcggcggcgcggagagcacagcgccgccggcgaccccgccactgattagagtggtcgttggagccgtaactgccggtgttgttgctgttggtggttgtgttgttggacccgcaccggcagaaagcatttccggcgtcagtgtcggcggtggtcggtttgggtcgaacagtgcggccaactgaacggcagccgcgccaggccgaacggtcgtcgacggcggtgttgaggacgcagtcgctgctgcgcttgcggtggtttgggcagtgcatgttggcaatcccatcagctttagagaatttttcttggtttacatttaaaaaacattaattgtgaaaaatgaccattttgaaaaaagtaaaaaatgatgtaaaattgaataatatccaactgatagttttgagagacaccaatcaaaaacaatgcacaccaaaacacagcgaccaaaaacacagccaagacattacacagccccgggaataaatttaaaaccgtccgtgtggggaacagggacgggcgaaacttcgagcttcgtgcttcgtgaaaatgctcgaagtttcgggaaaaatgcacccctaaagattgagttttcgaagtaaaaatactcccctaattattgatcttaatgtgagtaatggtgataatgtttatgaattttataaattaaatatttcttcaatattacctattttatattctacatattgcatatctctttttaaatgatttttaacacattttacatttttagcttgaaaatgccaccacaaagcaaatatattaaatattttaaaatttctcaattgtgacagatttgagaaaagatttagcaggagaaacgttgaaagaactcctttttcttcaacagaatttgcctctttatggatttaaattcgaaatttaattgaattttactatctggataaattttttggattaaaaaattgaaaaacttcgagcttcgaaagcttcgaaacttcacggtttttgggcttcgaacttcgtgcttcgaaaaaaattgggcttcgccttcggcttcgagtgccgagccgagcttcgcccgtccctggtggggaaggggcggtctgaccatttacgaacgaatgccctcgggggtcggaggaatggaattggagtaggtgtccataactacaaacgggtctcaccggtctcaacaaaaattaattatttcttgcttttcccagtgccctgctccccagtgttttgcccaccattggcgtcccgtcgggtgccgctgttgacgttgccgtcggtctggtggtggtgtccaactcgcgctgtgcttgcgcagcggccagtccgggcaacagtttgtgcagcaacgaatgagtgtcggtcagcacactcggtttgttggcaccagactgaaattggtaaaatggttcatttttaaatgtaaatttaatgtgttttttgaattttcatttaaaagcactcgtttttctatctcacaacggtcggaggcggagtctgctgctgttgtcgttggtcctgagccataaccgcagaaaccagtgttgtcgccactgtcacggcatttcccccggcgattgtcgccagtaccgtcgtcgtcggctgctccaacgcaccgatgccg

SEQ ID NO: 3427 - DNA, 4920 bp, Heterodera glycines
agaaattaaatttatttttcatattttttcgggtaaggcagcaaaatgtaccatgttttgacacatttttagagggaagaaaagaatggtgaacgagcagaagccaattttcgtttctgatttgtcaatgagattgggttgcgtcaatcacctgaactgctccggaactgcagatatggcggactgttgctgaccaggagaacggctttcatccggctgaccagggaatggctcctgaaaataaagaaaaatagaaatgcacaaattgaaatcgtgtttatcaagtcgtatagaggtcaaaaaatagggaaattttttgaaaatgtacattagttttcttaacaagtttagtaaaaaatttgcccgatggatcctatcggcaccgctggaattcctaaaattaattgttagaggaatttggtcacgttattggcgaaaactgctaaaaagcgatttcttcgcctattcgaataatggccgaagagcagagaatttctcagtcaagcttcttttttcaggtttaagcctggtcgcaaatttttataaaaattttccatttaaattatgttaatttccattccttaatttctcgcccgacatgtcaatccccgaatccccccccccccccctctgctggtggcttacgtgttttcgctgcattcgtgcctggtggtgcatgatcggcttgacaaatttgccggacgggtggagcatcgccagcgggtcgtcccggtccgtctccatcagctcttccattgtgatgcccgctgtgcgccgtaagtttagctgaaaagtgaaattttcgggcatgacttaggccgggtttcagcttatttaaaatttaaaactttggtcattttggctgaaatggaaattttattgcattaatttaaaagatttctatacaaatgagatcggacaaaatacatttttgaataaaatgaatggaaaagtgtgccgtcattttctagaggtgccattttggactagggcatgaaaaatttgttttgccttcgtgcgacaacttttccattattatggcattatatggtaaaacagatggaatattttaagaaaagagtgaaaagtcgaacatttatatgcatggaatgcgaaaacgtccaccaaattatgcatttcgaataccaaattttttttagtattttgcgctaacaaaatgcataatttgatggagaggtattgaggattgacggacaataaaaggctgagtagggtgggcaattattgacacacttaattagccaattagttaatggaagtgaagggtaaagcatgacggggagggggagactgacaattacaacgccgacaaaggaagagtggccattttgagattaattttgaaattcgctgatccatcaccgacagacagcacagtgtttttgcctgcccaaccaatgggcggagcaatgggaaggagaagaagaagcatttaccagtggacagcttttgtaccaatgcccgggctggccgcaacggttgcacacgtacgtggccggcggagggcccgtcattataccgccgctgcgtcgctgataactgaaagaagcggacacattgttggtcatattcataagcttttttgcttgaaaaaagcccagtggttgaaggttccgaaagatggctccgaaaaaaagaaattttgaaaaaaaattcccgatttagtgggtggcatttcgatgccaatttgccaataaaggttgtttttttttttacaaaaatggcacactttttcagttgggatgggacgatacatctacttaacaactttttttgtttgaagaaaaattgaaaaaaccaaacagttcgtgtgcagcagagatttgcgcctatgccaaaaatcggtttcaaatttagttgttttgtcaattttaaatatcataaagagcattaaataagagatggaatttgactaaatgcgatacctcattcttagaaaatttttgaacccaattattgtcaaaagaagttggtttcttggtacttgtctagtttacaggagcaattccacataccttttcagattccaataaatgtgttttagaaattaattaaaataagttttaaagggtttttgaggtcgctgatcacgaatccgggctcagttcagcgctaccgttcattacatgagctgtacagggacaataaattgacaggcttcctgtaccattttaataccctcatggccaaggggcccatgaggatatcatgcgtacaattttcgaattttattcttcctgtaccaagggtacccacatgggcaagatgtcaatgaggatattatccatacaagattctaattttatttttgttcgagttcgcgtcaggggttcgaaataggcaaaaatgggtgctgtattcgtgatcagcgacctcaaaaaccccttaaaacttattttaattaatttctaaaacacatttattggaatctgaaaaggtatgtggaattgctcctgtaaactagacaagtaccggtttctttaattgaaattatcaaaaatgaaaaaaagcattgatatgaaatcgcttttagtcattcgcgccaatgttgcgtaaccaaaaggtttccattgttttcttaaaaacgcgtcccactccaactgcttaaaagtgctcattgtcaatgccttgcttattgttagctcactttgtcgagctgtacttctccgttgacactcgtttgatgtgtgccaggcgctgttcttcgctcattccggcaaattcctcctaaaaatacgaaaatgaattgaatttgaaaagaaatttcgaaaaaagaatattcagtcctaaacttttgtttaaagctgctacacaaccagttttttaaatatttaattttaagattttggttttataaacaagatttttttaaaaatctctccgcaagaactccgccgaacaaacgaattttggaccagattttaaatacaatacaatagtaaatacagccacaaatcaaaactcggcaagagcactcaaaacccgggcaaagtactaacaaaaatttcccgactcgttacaataaagacaaagcaaaccgggttaatgtagctgttggcgctgttctgttggtacgtcgacaagtttcttacgacaattccgcttgtgctggtatcactaaattggagaaaatgagcaactttttcaaaatgggattcccatgttaaaagcaaagaaaagaaaaatgattgtactcatttaaaatctcgagtttttttctcagaaatgcaaaaacaaaatacgagaaaaatcgacagagtaaattcggttccctcacgcttcaaacaattaacttttgagaggtaatcccacaattctcaaatccaaaatgggcccatcgattggccattttgtgccaaaaaaggccatgccgtattttctcgcccattcattgtcagcccaacacttactgcactttgggcaatttttgcgcattttcgcgcggaattcgctgcacaaccaccgacgaattgcgcggcaccaattcgcccactgcatattcgcgtttggtgtgcgcgttggtcagcagcaggtcgaacgactccgtccggatgttctccttgtcgcagatggccttcttcagctcgtcaacgccgatgtgcagcccgtcaaatgtcagcgttttgtactcgagcgtcgccttgaatttgtagtggacagagaacattttgggaggccaataaatatttttgtctaaaaaagaataaacacaataacacaatgaaaaaatgttagaaaaagcttctaaacatgtaaactctcgaatgatatcaacaatgttgaatttggtcaacaatgaaaaaagttgtagcccaaaacatcggctggcaccgaaccgtcacctacccagacaaaattgctcataacgccaaatagcgtaattggcgtaattatttgcgcggtaattcaaaaatttacactggtaatgtcttttttgtattgtaaggcgtaaaagggttcagccaatagcgggaagggaccgccccttggatctctcccgagggcccccttataagctcgggatttccttcccaagagatctcagtcgcgacttatcagcaatatctcctattcaattccctatccatcgatctcgtcccccttctccagcccagggagtactcagcgcgagggttacggcccgggatggacaagaggggatccgtgggaccggcacaactctaactggtagcacctgatggttctgaccttaccctgggcccaaggttttggccgatgccggccaatgagaaaggaacatggccgatgccggccagtaaaaaatgaaaataacaaaaaatggaaatggccgatgccggcagacagaaaataaagtcggccgatgacggccaacgaaaaaaaaatcaattctaaccgaaaaaaggccgattaaaaaccccggtgagggctaaggccctaaacagaaaagtccggaggtaaagaacattgcataaaaaagaggctgaaaaaagagaatccagtcgaaaaagaaaaaaaaaacataaattccggctggaagaaaatgaaaacaagccgatgaaaatgcgcaaaacagccaaatgggggttaaggcctcaaattaattgaaatttgattattataggccaaacgaagttatgtcaatcctaaaatggcacattttagtaatccaaaaccgcgaaaaagcggtgttgaaagcaaaaaaaaagttaatcaatttacatggcggaccagacccccttgtcttgcaaaaaatctgaattttagtgttctttatcctgaatttgaaaaagaaggctggtcaacctgtacatatacttctgaaaaattctaatgctaaaaaacaagcactcgcgtgaaaattgaataaaaatttcgtatttgaaaaattttgtccaaaaatttttacgtcgtaaaatt

SEQ ID NO: 3428 - DNA, 206 bp, Heterodera glycines
tcaagaaatttatacccctcagcccccccccccccctgcctacgcccttctaacaacaccgtttttttagaatgaccaaagggcggcacttggtcgcttcgtggctaattacaaaattctaatggtcaataattttcgacttggatcggatgttttttcaaagaagtttcttattgttagaggggaagggggcatatttcatttct

SEQ ID NO: 3429 - DNA, 8040 bp, Heterodera glycines
  misc_feature (81)..(81): n is a, c, g, or t
  misc_feature (8023)..(8024): n is a, c, g, or t
gtgcacttttaaaatgtatcttctatccttaataattacaaattgtacttctttctcttaattctgcactttctacctaanaatgacgttcccaaatgcttaataatttacaaattgtaacttccattgcttaattctgcatgcattttcactccttaattattcatttttctacctaaaaacgacaagttcgtgcacataatcaaaatgtatcttcaactccttaattatttacaaattgtaacttctttcgcttaattatgcatttttctacctaaaaatgacgttcccaaatgcttaataatttacaaattgtaacttccattgcttaattctgtatgcatgttcactccttaattatgcacttttctacctaaaaatgacaagttcgtgcactttttaaaattgtatcttctattccttaataatttacaaattgtaacttctttctcttaattctgcacttttctacctaaaaatgacgttcccaaatgcttaataatttacaaattgtaacttccattgcttaattctgcatgcattttcactccttaattattcatttttctacctaaaaacgacaagttcgtgcacataatcaaaatgtatcttcaactccttaattatttacaaattgtaacttctttcgcttaattatgcatttttctacctaaaaatgacgttcccaaatgcttaataatttacaaattgtaacttccattgcttaattatgtatgcatttttattaaaaacgtgaataaaacgacaaataacacaatttttggtataaaatagagaaataaaaggggtacatgtatgtgtacgtgtgtgtatggggtatatgtttatgcgtgtggaagagagatacaataaatggtgaacaaaatacaaaagggtacatatgtgtatgtgtgagagagatacaatgattggtgaagaaggtattacaatgtgtgaacaattacaatgaatggtgaaaagacattataatgggtgagcaattacaaagtgtgtccaaaattgagaacattataatcggctcctacaatacccttcccaatataaggctgataacatttttgcatagagcttgatattacagatccaccatcacgaatattgggtctaataaagtttgggtatattacattaattggttcaatctctcctgtttgagcataacgtttgacttgctgtttttatatctaaagccttggttgttgatcacatcataattgagtgtcaatccacggagtttaagcacgtattccatttccgcatcatgtagaacatttatacgtcttaaagccaacgcatactattttgcaccagcagtgcagaattctacgatttccatcaattaactgcttatagtgtcgatcttattcagctaaaaagcatcgcgtagatgtgagaaaacaagactatccgtgtcggtggagagtacttaacgccccggctatatcatcatttctgaatagttttattacccactttttttattttcgtaggtaatcaaaacatgatacacctttcaatcctcgatggccattacgtctattgaacgattatcccaaatattctccaaaatcaagtacatcattattgaagtaaagtctgttaaaggctgtaatttcgtaaagaaatatgtcgcacaaattgttcaagcatagtttaacaatcctactcttcttggttcacagctatctttgttgggttaagatctctaatttctctttgcactctcttacaaattcagcttccttctcaccatttccttttatgtcagtatcaattgttaaatgggtaaccttcttcaaccgtagtaacattaatttcgattgaaatgcagattgctcagccatctcattgtttgtcattatgtttgcatatgtatttacgtctatcctgcctttttgattgtttttggtgcacttcataaataaagagaatcagagcctactattcactttgacgggcaaaacagaatatcgaattttctaaagaaatcatccaaaactttgagtattgtcaaggggtagtgtttatcttccgggtatttaactcgacttattcattcagcacatgtacattggtttaccaatcgagtagtgtgtagtaaaattaacaaaggggtagagagaaatgaagtcacatagaaattttttcattccgtcttcaaatccgctcatttatttgttgctcattaacattttagcgatctcgtagcctaatacacttacaactggatggacaacttgacttcgtataaattcataacgttttacattcctctcccgcactttatcatttatttttttcaattagacattaatatacatcttctagatagcgctaattgcaggcatgctaaacatatccgcttacttctattgcagttctctctgtttccaactattcatccacagaataatgatcaatttgccaagtgttcagttgaaaagttattgatctagaaatatcgcatacaggccttatactagtcatacattcctttagtacatcaatgggtactaaaagacgctgccttcccttaataatgccttagttcctttgagacatcaaataattccctcctaaacgataccagcaatgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttaatttaattttttaatttagttttatttatttttatttatttaacatttattttcttttaattttaatcttatttttattttactttttatttgaattaatttgaattttattttactttatttattattcagtaatttaaaggagttgttcagaacctctatccaataaaggctatttcgccgctcagcacggcataaaaggtactttaaccgtgcaccgtttagcattgtatgatatcctcactattttcaatatttttacttgttttaattgtttatttctttgaaatttctattaatattttacttttgtagtgtttaatgcaatcaaagaacattttaacttgaaatttttaacaaaatgaacttaataaaatattagtagttaattattgtaaaatataatttattaataaataagtttaattcatttattaaaatctaaaaataatgataagaatatatgtatacttcatattatatatcattttattaattaatttttcaatataaaatttctttcttccatcattaaaatgtttttgcttagcaataagtaaaaaattccatatatgcacgctacccctctccgcctcccatctgatatgaaattcttaacgcttttttcttaattattattatttttttcatttatttccttatttttagctatcatcaccattattattattttactaaatttattttaatatttattttttctacaactcttcatctcttcattaggcttgggttatgacacaagtaccatttgccacccctccagtcgccacatgtcaccacacccctcaaataagttttgggttatacgaccaccatttggcaggttgccaactaaattgttcatgctatgccacactacactaaaatgagtcgccgtctgaagaacattttatgccatccacggtcagtcattagcgcttaaataaccaccagcgggcactcagatagcccatgcgggcgcttaggtgacacgtgcgagcgctcaggtgacccggcgtcgcttccctcccgaagctgacgcccacccctccccttttaaacatcagcaaagccccataaaaacattccaataggcatccgccaaaactaaaccaatttctcaaattcaaaaataacaaaaaattaaagtttgtcaccagattcaaaattttgaccacggattgactactcaaggactgaaacggtcggactcaataggtagcgccctctcgagcttttttatttgactattataatttgtgtttattattttttttataatttatgaatttcttaaatttttttcatttatttttaaatttttatctattattttaaatttatttattaattttttaactattattattttaacaatttaattttaattaaatttattttttaatttatttattattattattattatttatatttttgtgtggtattagagagagcaagagaaaagagagagtgagagagaagagagaatgaaagagagagaaagaaaaaagagagagagtgagagagagagaaaagagagagataagagagagaaagaaaagaaagatagtgagagagagataagagagagagagagaaagaaaagaaagaaagaaagagagtgagagagagaaagaaaagagagagagagaaagaaaagagagagagaaaagagagatataagagagagaaagaaaaaagaaagagagtgagagagagagtgagataagagagaatgagagagagagaaaaaaagagagagaaaagagagatataagagagagaaagaaaaaagagagagagtgagagagagagataagagagagagtgagagagagaaagaaaaaagagagagagagaaaagagagatataagagagagagaaagaaaaaagaaagagagtaagagagagagagagagataagagagagagtgagagagagaaagaaaagaaagatagtgagagagacagaagagatagagagagaatgaatgttagcttttttattcaattattttttaaattataaaaaattttttttaaatttatttattttaatttataatttattttattttaatttaatttattttttattaatcaataaaaacccttcaataggtttaggttcactcccgcacccatccaataggttttggtttaaaccaataggttttagttttgggattgtttatttatttttatttttattatttatttttaatttaatttaattatttaaatttattattaatcaataaaaacccttcaataggctttggtttaaaccaataggctttggtttggaacggtggttttccaacccccaaaatcgcccggagtaactactgatttacaaatgaattctgtgccgagatatggcatgccaaagtttttggcatttataattggaaaagaactaattattttcatttcagtaagaagccattggtgtagagatagtgcgttagtcaagtcttttttaagtcacaggttcgaatcctttgcgtgcaaaacctcaatttgaagaagcaatttaatttaaaaaaacaataaaaattgaaaatcggatgattccatgaaattgaaaagaattatttcagatttttcgtcccaatttgtcgcttttcgctcctatttacgtccataaattttttcaatgttttgcccctaaaaacccgcgccatattaatgagaaaagcattataaatatttatcaatcagcaaaatgctcactgctggagggcgtgggttctattcccagccgaggcctaagattttgccaattcttattaataataaaaactcatatactttgtaagagtgagtcgaaattgtcgggtttttactcgtttaactgccgaagctctaggatttcattattttcacatttatttctttttggatttaatttccctttttactaattgtaccgctctcccagcgattcacttttcacttgtatttaatgttcgccttttcaagcgaacggagctcagtcgtcccgagaataaagccacttattgtgtgaccagcgagtgtgggaaggcaaccccgggcttgatcaccccgtggacccatccttcgggaatatgtggcactttccctttccctccccattccgaattccaattcccaacgccagcacgaccaccgcgcccggccgcgctactggtagcaccggatggttcacttttgtgaacttttcatcaacctgggcggaacaggaacagcgaaagggaggtgagtttgagtgagggacattgaggaggcgcctggtgtgaaggaaaaggagaagaagaaaaacgcttcggcgatttaaatgccccggggatgaaaaatgaaaataaaaggcactaaatatgagagaaatgtataattgttgcctgcagatgtactaattgccgatgacagcacaaaataaaaagcaaaaagtgccaataattcctgcgaaaaatgcctgcagatgagacgaaaaaaggcaaaaattatgcttcggcagtttatagccctccggaggtgacaaaaaaaaggaaaaaaagagagaaacaacaacgaaaagaaaatacatttgggcataataaattaaaagagcgaacgaaaattgaggataacgattcataagcgcccacagaagaacaaattgccataacaaatcctaagcgccaacagagaaagaaaattatgcttaaaaatcataagagccccgaaatttcattaaaaaggtaaaatcgaaaatatttttggcagcgacaatacctgcaaactcgatgagcgccaaaaaattgtagagaatgtctaacgaaaaaatgaggagtgtggcttcggccgtatatgagttcaaataagattagagattagtcagaataaaaagtctatgtttgtaattcaattatccagtaaaatgacttagaaaaatttacgaaacatgcttcggcagttttacagtcaagagtgaaaaaggattgattacggtaaacattttggttgttcgttcaaagtccgccagaggcgttaaagagagactctgcccgcccccattttcccttccatttttccgtttgctgctctccacaaaattcgctgtgacttatgccctatctcactgtcctttccctccggcgctgcgctgctcgtttccgaagatgtgctgattgccatctgctggccgatgaattcatcgctgccttagcgcttcgcttggccatcaatctgtgatgttgcatttttgctttgttccattcttcccctcccccctttcccatctcttacacattaaaattccgtttgccattctctcattccaccatttgtccatcccttcccatccacgccttcggcgtcgaccatcatctcattcacataaacatttatccctttttaattccttggttcattaatgctaaataatcggaaccaggacctttcgggttgaaaacccgggactttttggctgggaaaaccgggaaaaaacccgggaatttcccggtcccgatcaaaactggtcaaaaccgacagttcggtactcagttgtactcagttgtccgtgttttggtcctggtttcgaccaaccctaaacaaaatgatttgaatgagtcaatggagaaaaacaaatggttgtgggactgaactggacattacgcaagatgccaaaataataattttttttaatttttaactctcttttcaccttaattaattgtgcactttcttcacccggaagagagagcagcgtatggagaatatatttgctaaataattttaagccttttaaggttttttggtaaaaatattaaaaaaatgtttgtttattgttaagctggttttgttcacttaattcaaaatgttataaaaattttagaatttttcctaaccaaatgaacatttttgaagattttctgcgtttcaatgaggatttataaaattttaagaccaaagctccggttacgattatttaacaaggaggcactggtgaatgattttaaaatttaattataaaatgtttattaattcacaagaaaatccgccgtaaaaaacatgctttttattttattcaaaattttttatatattttttttctaaattaatttgtagaannatttattatatggaca

SEQ ID NO: 3430 - DNA, 3145 bp, Heterodera glycines
  misc_feature (377)..(377): n is a, c, g, or t
attatttaaatggcaaatttgcagagcgaacggcaatgctattcttgggcgtatgaatgggaggcaattgtcggaaatggaaattgcaaatcaatgggacccgccaaatccctgtcccgcctctcttttgctcacatcgcctggggcattgtgtgtcgaacacaccgggcccaataacggtaaatgcctctaatgatgttcgagaatcggtttttcaacactcagtgccgagtaatcattcaaatttgatcaaagcaatttgcaggggatcggcattttcattttacccctcattttatgggtggggagctgcttgaaaatttataataattttgagaaagggggtcgggtgattttcatacattttttagggggangggggtcgaccccccccccccccccccctcgctcgcaaagggggcctgcgaggggggggggttcgcagcgaaggggggccggtgtaaaagaggtggggagagagggttcgcagcgagggggggtcgcaaattttaaaatttttccaaaaaatttccccggcggcgcctggcggaaccgccgaacccaaaattcctatttttcttaaaaaattggctcaaaatcgcaaaaattggccatttttggtgaaaatctgctaacaaatcacaaataaggatcaaaaaatttttcctggcggcgcctatcggcaccgccggcccccctgttcccgaaaagtttgttggaaaaagcgtgccgaaaaaaacggttttttgaaaagcaaaaaaaaaaaaagtcatcggcggccgaccccccttcgcaaaaatttttaccgacccacccccctttttaatgtatgatttagacgctcaatatggtaattagtaagaaattgaccggccaaaaggtgttaattgcgctgagtgtaattgtggtcgatttcgttgggtttggccaaattgaatagacgaaaaattccattgtgatggccagagtgatcaaagtattgctaaaataatagaattaaattacacaattaagcaatgctttcacgcacacgtttatgctgacatcgtggaaaatttggacgggcgccacaaaagcggcgctgtaaagcgaattgatggaaatgtactgggggatgagcacgaaaagcctaaatatttcaaaacttaatttaaattcaaattcaaatgtccgaccgcgtggcggcgatgccaaaggcggcgaaaagcatgttgaggaaaagcactttcatagtgccggtgaacgaagtgatggcggagaccattttggcaaacggtgccgaggcgccgatcacgcaaacgttgacgaacatttcgaatatgcaaaggccgagccgagtcgagtccatttcgtacgcgtcgctgcaatttttggccgagtgatcaatcggttggattacagccattgtgaaaaacttaaaaataaaatttatttttttaaattgccatttatctgttgccagtgattagcccaacagaccaaagactgactttttcgccatttaatttgaggtaaagttgagcgggaacgttaaggaattcattttcaaagtcaaaaactcgaaaaaaaattttcaaaaacacggcaaaatttttaaaagatacggcaaaacatgcggcagcttatttagcaaatttaaaaattaaatttatgtaaatcaacatttttcacgtgatttgggaaactttgacaaatatatggtttggttgattttaagttcttcatatacataaatttccgattattactagtggaaaaatattcgaatttaaaataaataaaaaatatttcaataaaaaagctgttatttaattttaataaatatttttgcattatgcgacttaagtgtgtgataaagccaaaatggacttaaggaggtcaaaggaaatgaatgcatcagtgatacaaatatttttaaataaagttctgtagcatgaagtttgtagtacaaaagtaaaattctataataacattattctgaattcagaaccctggacccgaattcgaacaaaaagaagcccaaattttggaaatttgcgttttaggttcaaaatcagtttaaatacacggaaacaaagccataaaatacttcaataagagattgtttactcttttttgaacaaaaaatgctaaattcgaaaattttgattttcggctttttgttcaaattcgggtccggggttcggaattggccgaaatggatacagattcgtgattaacagggatctttttttatgtaagaaaaatcgcgaaatatgtaaaaatatgtaaataaaagtcccaacttttgtcgcaaacacaaaaaaagaaagtgtttttcctactaattaggctatagagaatccaggaaaaaacatgcatttacataaaaatgatccctggtgattaatgacctcgaaaacccaaggaatttgtttatataacattaaaattttcaccgacgcatttccgagagcaatttttatactcataattagaccccctattatccgtgattatttggtttcggtctcggttgtcttccaccggcgggaccgagacagaggggcttggctttttcaaaaattgagaccgagacttggaaaacccgggaaggaatcagtctcggcctcgctcaactcaatttgaagatggaactttcgggaaacttatgaatggcaaaaataagactttttgcatttactaactgcgttcatgcataggacaatagaagaaatggcttcaaatatgccaacatttcctatttttctgggttttgtctccctttttacgcatttcgtctcccaatttacggcacgcaataatataaacggaagaagataaataaattcaattgaaaaaggccgaatgacaacgaatatgttgtgtatttgattcttttggttttctgcattattctcacgaattcacaattggcacaattggccaaactatttaaaggcagccaattttggtgggaatttacatttttaattagcaatgagaaataaatagggtgggaaaaaatggtgagaatttctcgaatttattggtaatttaataaaagtattttacttgagattgggaaaatttaacctttagcattctgtacttggttagacgggtccgggtatttaggcaaaaccgggtccggtttattgccagt

SEQ ID NO: 3431 - DNA, 1846 bp, Heterodera glycines
aactaatttttttttaatttttctttccactgttttgatcaacaattttacccagatacccattcttaccaatgtacttttggagccggttggacgtggacctatcggcgggtccggaactgggtatcagattttcagaaaatcgggtccgtgtccgtcttgaaaaactgggtatccggtcttggacatttttgattcaaaaattcgcattcttaatttgacggcttttaactgctttagaattttgttttaaagatattcgccaaaataattcttagtttctcaaatattaggcaatttcactggcgaaatttaagaccgttaacacaccgagtcaattttgagcccccagttcaaaaactaattgattttttgtcttagtggtctgtgagtttgccaccaaaaagggagtcccaggttcaatcccacctgagttatatatttaattaagcaatatttcacgtttttctcaacgaataaagaaaaaataattaagtcatattattctaagatttttttaagtaaatttaaaaaacaaaacaaaatttgatcacccaataacatcaatgacagcgtcatcttcattgtccgtttattattttaagtctttgtttataaattttaatctttaacaattgaaattgcaaatatttttgtcttcccaatcagttgtggtaatggaatgaagaaacaccacatctaaaatggatttaattttcaaatagtaaacagatttaaatttaattaaaatccaagacccccgcagagaagctgaagtcgccgcgatttccacgttggccatgcttttccttctgtagtccgattggcttgtgcttctgtccgaatgcaaattcctcacgaaaagttccttcacttttaatgttgttttctgaataaaattttatgatataaactacagtgtgttccattagaacaaggcgcgggggtgagaaatttctcgcccccggggacgggggcgggggtttgtttttaattagctccaaaaaatctcacaaaaaattatttttatttttttgaatgatgtgtttggctccacattcctttattcgatgtatcgcctcgattcaattcttttttggtataattgcatagatattgtctaaaaatgaccaaatttaaggattataaattatgccagaatagtcaatttttatgggtgtttttgtctaaatccagggtttctatttcaaaattttcaaaataagaataaaggccaaaaaacaagattttagggtcaaaataagaacattttgctaagttgcttcaaatatttttacattttatacgatcaaaaatgtattctattattatatttttcataaatttcagtgcattcgggatcactaaacagatttttaacattttttgcggcacatttccaaaaaacttggtgaatgtgcgaggggagaggcccggtggtgtcgattggcgccgcaagcggaaaatttttaagactttatatgaattttgttagaaattagccaaattttttagaaatttcccttttttagatgaaaataaggtactaccccaaaaccagaacatttcttagaataacaacatagaaaaaccctgtattatttggaaaaaaaaaataataaaatcaaaagaaaacgtcaaccggtgtcgaactcataacaaaaagtattgttaatgttgaagcactaaccactaaaccacaaatattttaaaaaatataagcaaatttactttatttcataaaaatttgtaaaagagttaaaaaattcaaaattgtataaatttttgcctttaattccacgaatatgccattcttaggggtgtgtttttcacccacgtgcccccg

SEQ ID NO: 3432 - DNA, 1123 bp, Heterodera glycines
agtttgccagtaacattgaaaatgttggtaccagcttatttttaaagagatcaattccgaaaatttaattattaaatttttgttttaatcatttacgtagatacaattttttaaatttctacatcgtccgtaattgtttgggaatattaaggaattaggtgtttggcggttccgacatagaattctcaggttcgaatttataggattttcttatttataaatagatttttagtattggaaaaagaggcacaaaaacgataaatatcgtttatcgatagataaattttcttgtttttcattattttttgatatgcatcgatttcgttttttattgaaaaatatggatcgatcatttggccggtctctaattttgtaattgtatggaaatattaaggaattttgtgaatggcggtgctggtagtttaatttcgcatcaaatcattttttctatttcaaaaaattccattcgttgattttattaatttgacttttaccagaaatgaaaacttgccatcctctgcagttggcttgttgcttcgcttctgtccacttggccattgtctgatgctgttgccgctgggcttggcctttggccccaactttgtgccaattggcgttggtacatttgcgcggtgtgcggcacaattaaattttcacccaacgcatttctgacttgcattccgtgtcgttcagcagataccgtaatgtttgggagaacatttgccggactcacagagccgaacaaaaatttcctgaaaatcttttttaaatttcagtgctttggtaaataatttaaaagctaaaaatatgccctatggttggtttaactgggattttgtaggactcgtccaccgattccgtgggcacctgtaccattgagctaccgtatcataaccgccatttctttatgggtcttatcaatccccattttccgcgttttaaccgcccagaacagctagatcatttattacaatcgcattttattcaaacgacgacgcacataaactgttttctgaattcgctgtgcgtgaaaatcagcggcacaatgaacagcagagagtagagcgctaccgtaatgtcataggcatggttacagtacaaatggacgtagtaaagacactcg

SEQ ID NO: 3433 - DNA, 3236 bp, Heterodera glycines
  misc_feature (149)..(149): n is a, c, g, or t
acgacccctttttttgctttcatatatttttgcggtgcattttcaaatattaatattattatatttacaaaagagaaaaacaaatatttttgatgattttttcttctgttataatgttggcaaatagctaattaatagggatgctaatntaggtaggaaaatcgcaaaatatttattaaaaaaatacaaaatcccgaaacaggtagtaggtaaataaatttttttatttagtggaaaaaggcaaataaatggtaaaattttggttctatttttgtgtaagcgaataatttaaacatttctaatatttccttagaaaatatttacctacatttttaaattaaaaaatttgtcaagaaaaaaataataaattttaaaggataaatttgagaaaattttataattctttggtgtggaacttttactttttttaattaaagttccagcaggattttacttgatatttttcgtccaaacttatcgaacgcattgttttgtttttgtactttttacaattgtcaaagtaaaggcgcagaaaaaccttaaatgaaaaagcaatattaaaatatataaattattaggtcagagattttggcaatgccaatttttctgccaatttcttaggatgaaaaaactcaataataaaatcatttttgaccaaaatttctgatttacatttttgagagaaaaaatacggtttttaatttattttgataaaaaaggtaattcaaaaatatttaattgaaatgaaactaccatccaactgataatgttaatcacttccagcacagcaaattggggcactgtttcaataatgcctgtggaacattttgtaaatcgttttaaataatatataaagtacttaccattttgttccaaccaatatataacaattgtagtagaccactaaattaccaaaaattaaacggtcaatatggtaattaatagatattaccggccaaaaggtgttaattgcgctgagtgtaattgtggtcgatttcgttgggtttggccaaattgaatagacgaaaaattccattgtgatggccagagtgatcaaagtattgctaaaataatagaattaaattacacaattaagcaatgctttcacgcacacgtttatgctgacatcgtggaaaatttggacgggcgccacaaaagcggcgctgtaaagcgaattgatggaaatgtactgggggatgagcacgaaaagcctaaatatttcaaaacttaatttaaattcaaattcaaatgtccgaccgcgtggcggcgatgccaaaggcggcgaaaagcatgttgaggaaaagcactttcatagtgccggtgaacgaagtgatggcggtgaccattttggcaaacggtgccgaggcgccgatcacgcaaacgttgacgaacatttcgaatatgcaaaggccgagccgagtcgagtccatttcgtacgcgtcgctgcaatttttggccgtgtgttccatcggttggattatgttgcccattttattatagcactcgtaaaaattcttctgcttaagaaatatatcacctctggcttgagttcgcctccgatagacgccaccagaaaaatttttgcaaattttttttataccagtggatagagcagggtcgacttctattgtgaatttctaatattacgggcccatagtcaagaaacaaaaaagttatgaagcctcaaaaattgaaattttggctatgttttcacttagttggttaatttcgcatttttggggttcaaacccaacataaaaacaaataaattttaattaatgtataatataaaaaatcattttttaaactaaaaaactgtatgatagttattctttagtaaaaataagcaaaaataataataaatgtgattgggaattcatagaaagtgaataaagctgcttagcctaaaatttcgtttttgaggccacataacttttttgtttcttgctctcgaaaaaggcactataatagcaccaaaaaataaaaaaaggcattaaaaggcacaaaaatcccaaaaaaggcatttaaaaaatttaaacgtttttagggagcaaaacttatcaagaaaaaaaaattaaattttggcgatcaatttttgagaaatttttcaatttttaaggggtgtattttctgaaatttttgtcgggtcatttcttaggggtgtatttttcttttttattgaattttgttaagcatttttcggaaaattccaaaaaggcataataaaagtcatcgtagaagcttcaaacaaagtgaaaatgtgttatttaagcttaatacatcgaaactagtcgcagaataaaaggcatatgtcttcgttctctatatatcacacatatgcttttccgacttactgttcgggaggttcccttgttagttcggaggatttgtgtcgtcccgctggccgttttcgtgattatcgctgccaaaaacggtaacagtacttacaattagcggcaatttgtctgttccgatattagagcctggtcagctaaatattttacttttaatttacaatataagcaatgaaaagccacaaaatatacaatggttttcatttatcatatagtaattggcctttttactatttaatcgtaatgaataacgacacaaaattgtttcaagttgaattgtcacgctttttgattaattaggaaaaaattaacaaaagcatacggtaataattgcgtgttgcctacaaaatatataaagaagacgtgtaaatttgatgaattctgctgctgttttatgtactaaatggtgaaaagggttcatttgtgcgctaattaattccatgaatgactttcattggttccaatcacttgggcagtgaacaacattctcataaaattcacaaacatgcataaaacattttaataaatatttaatagtatcttaagataatccaatttgcaaggctaactggacttagtatacttaaaaaataaagcaaaaaatagaatatcaatttctaaaaatgaattaaaatgttactaaatatttataatgtgttgttgttgctgtggactgagcatctgttctgatgttacctcctacgagtgattcagtcaataaagctaaaaataatgataattgtattttcgactttttataaaaaaataaatcgaattaaagaaaaaaaaattggcgcaaatgtgtggggcggaggcgcggccccaaaaaaaattacaaaatttgggcataatttctccgaattttattagaaaatttgccat

SEQ ID NO: 3434 - DNA, 1082 bp, Heterodera glycines
  misc_feature (1024)..(1024): n is a, c, g, or t
  misc_feature (1061)..(1061): n is a, c, g, or t
  misc_feature (1073)..(1073): n is a, c, g, or t
accgcttcattcaatttcttataaattcaatagtttttccaattgtcataaaaagcattgatcacaaaaaaattatgtaataaaagttatcatcatacgacacattttcataataaaaagatgataatttgattaaactctaaattaacaattaaaataaatcatgtaaaacattctttgaaaaaaaaaattatttttagactttgcatggtcgttaaaagaaatgattatgattatttcttcaaaaaaaacggattctttaaattagcatgcaaaaatcttccaaaaatctagattatatgtaataagttttgcaaatttagtgcttttatacgctttgtctataaaatcgaattaaaatttttctttcgtcacttggcacttgaaatcgcaaactgtgttaatgcaattgaagaaacacgacttctaaaagaaaataaaaattccaattttaatttaattaaaatccaagacccccgcagagaagctgaagtcgccgcgatttccacgttggccatgcttttccttctgtagtccgattggcttctgcttctgtccgaatgcaaattgatcacgaaaagttccttcacttttaatgttgttttctggataaaattttatggtataaacgagacaattttatgtaagaaaaactaaatttgtgggggtcacgctgcgtgattttgaaaaaataatgtcaaaaattgacgtaactttttttcattcgttcaatttttctgaaatattgccaaacgaacatagaattttacacctcgtccgtaattgtttgggaatattaaggaattaggtgtttggcggttctgatagatttaatttcgaatcaaatcattttttctatttcaaaaaattccattcttagtattttattaatttgacttttaccagaaatgaaaacttgccatcctctgcagttggcttgttgctccgcttctgtccacttggccattgtctgatgctggtgcggctgggcttggcctttggccccaactttgtgccaattggncgttggtacttttgtgcgcggtgtgcggcacaattanattttcacccancgcatttct

SEQ ID NO: 3435 - DNA, 999 bp, Heterodera glycines
tctgcatcaattgacttttctcatatcgaattgtgttgttgaagcggatgacagttgaatatgaacaagcaaaagcctgtagaagctttctatggaaaaaacgtgaaaaaaattagggttttactttgctagaagaatataaatttgactgaaaaaggcggtgccaaactgaaggtttcgctttgtttttattttctaattgggatattcatttatattgtagctaaacatagatattttaagtttttccttttataattgacaaaaaaaatattttaagagttatgggcaaaaacagcttgccagactaaaccgaccctctgactaaactggccagactaaaacggccagactaaaccggccagactaaactgacccggtccgtgtcttggtgacaactcgtacaaaaggaaggcacaactcgtatcgatgtcgtctgtaaacaatctgctggcactcgggcggagatgccctaaagtgaacttttgaaaatacatgacactaacagataaagggtaataccctcatatgcataatatgcccatgagggtaccatctgtagaaatttagaatttcacatatatgattcaaaatgagctaaacaaacttttattgcagtttttatgtgacattaagttcatttctaggaattggtcgaaatggatgctgtattcgtgatcagcgacctcgaaaacccattgaaaacagcatggaatatttccttcattttaggcgtcattttcccccaatgcacctttttcttcggtttaattacccaagtttgaggtacttggcgtattctgcccataaaagtgccaaaataattagtttattttctaaaaaacccccaaaatagttgcaaaaatgggtaaatagttgttaaaaagttccgaatttaggggcgtaaaaataaattatataatagatataaaataacttcactgaaattttcaataaatgattggcagttccgactcaatttcttcaattatcgcagaa

SEQ ID NO: 3436 - DNA, 6433 bp, Heterodera glycines
tcaatttcttcaattatcacagaatttagtatttaaattcattattctgatccttcgggaataacggtttaaatcgaatgtttttttagacgtaaaataaagagagtatagttaagaaattatgtttaaattttcattcgcttatctgttatttagggcttgacttaatttttctgatctattatttgctttacaccggtgaaaaattggaacaaatcacaaaaataatgttttaaattctgaattattttagaaaacaggtttcgataattttaaattatatgctttcagttatcactataatcaatttattaattttcataatagggtataggaatccacaaaaaaaattctggaataattcccaagaaaaatcaataacttttcatcatcttcaatcaggtatcactaaggattaacgagattatttttgaaaccattttcaagaattgctgatatatggattcgaaattcctcatgtcttgttgattcttttttcacagtatattaataatagttagcttgctttttgaacagaatcatcttttattttaacattaaataggctttattttattttttttaatcatatatcggggtaacgatgacgatgaattgctcatttgttagaattttttactattgttttttgaaaataaatggtgttgataaaaattccatttatccccccggggggataaatggagaagggggggggggggttatttttgaaagcctcggaaaggggggggtggataattggagccagcgggattaatggagaacggggggataaaaagagaaaatatggtattctattttcatccattttctcctatcttaattttaacatttaaatcacctttttccttttatcatttctcattattcaatttgtccaactcttcgacttttttcctcgggctaaataaatttgtttgtttggttttctgtcctttttcggcctaagggacgatcctctaacgttgggggaaaatcgccaattttgttgtttggggcactcatcgccccagggtccgcgtcgtcgagagcagctaatttcgtacggggtcggattaactcctctgatccgaagcccatcccctcacttcgtctcccccattttggtgattggaaccgggaccgttcccggtgtacaaggaggttcactgactcccacagtgtgctggttccgttagaccctttccctgcttgtgcaaattgggagccgctcccgtggtccccgcaattgacacactctgtattctttcctttattatttttatggctcaaaaaattatataattttgaaggtattccaataaaagaaaagcaggaaaatcaccaaattatgcaaatataatataaacgttcaaaatggaatgatcacatgaaaaatggttttatgtaaaaaaaaatgtcaggagaaaaaccaaatggggaaagaatcggtttatgaatgactattttgaaaagggtaattttatattgtacatttgccctacccatttttcaaaaaaaagaagtaaattttatctagcttaaaataagtccatttccgggtatcgaaattcgtttacgaaaaatgtgccatggcaaaccttcctataaacaaaaaaatgatgataaaatgacaaattgtcttcggaatttttgcccacaaaatattgagttaaagcaaattaaaatttttattataaacatatgaccacccgaaaacggagtgtgtcagacaaaggcaaatgtaattcgggcattaaccggtatttcgcctaatgattggtatcattgtaaagcccattaaaaatgctacaaaacgggtaagattgtaggcctataatagagcttactaaaattttataaaaaattattattggaatcggaaaatattataaacatacagtcatggtcatatgtttaggaacacctcttttttttgaataaattctttgaaaatattgcttctctggattgaaagaaaaataatcaataatctttttaatgcattttgtagcattttttctgggctatccattggtaccacacatttctcgtttgctttattcctttttgtaaaaatttgtgttttcttccatatagtcaaatttcggggtggtcatatgtttaggaacacttcataaaattcatattttctaacaatagaaatgcctaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgagaaaatttttctggaaattttgagtaagccgggaccttgatttacaaactgacatggattttctggacaaaaacccttgcaaatccaggtccagaaaaatccaggcctgtatcccggcccacatcgagctctagtaaatacattttttcctgggttctcatgctttaaatagtaaaaacattttctttcacacaggtctactcaaatatttcattttcttaaaaaaaatgcctcaaattttcaaaaattggctatttttgggcataatctgacaatgtattgtatttaaatattcaatttttttccctgcgccgcctatcggcaccgcggcctccctcttccaccctggtcaccaccaaaaagttttttcaaaaaatatgccgcaaaaaattgttaaaattaataaagggaatcaacaaaaaattatttaaaaattttaatttgaagcaatttgaaaaaatttctgattttcgaccaaaaatatgattttttaatttcaaatttctgcttactaaatttttctgtctattttttctctaataaaaggattgtccttcaaatttgtgcattaaaaatatttttgtgagtatttaattaaattttcgaattactcccgctgccgcccgggactcccgtaaaatttctgccggattttaacgggagcgggattttcacgggattcccgttcgggactcacgttccggaaaattttcaactccgatcccgctcccggaaatttttttttaccggactctagttttggcccaatatttttgcaccactcaaaacgggatgcggttggttcggcaattcttattaggcgatacttttacatacagactcgtttcgcaaatatggattagccatctttagatgttgtattaatatttttccctagcaagagtattttcgagaaaatttgaatttcgctgatgcactactgcctttggcccagtacttttcacatgactggatgtacatattttctatataatttgctttttcacattttttcaaaatatttgaaattcctgaggctaagaaaaatttttcataaatgtcaaaataaaaccaaagtttcattcgggtccaatttaggaattagtcgaaatggacaccagaatcatgaccagcgaccagaaagccctttgaaatatattttcagattttttaaattaaaaaatatttatttcaaaaaagtggggtaacaacggtagtattaccgaaatttgttatgcttgcaaaatcatacttacccatccaccagttttaaatgtattttttatggctcaaaaaattataaaactttgaaggtattccaataaaagaaaagtaggagaatcaccaattatgcaagtacatatacaatacagtacatttaaatggaattgatcacattatgtaaaaaaaaagatgtcagaagaagaaccaaatgtggaaagaattagtttaggaatgaaattttgaaaaaggtaattaaaataaattgtatatttgccctcacccaatttttcaaaaagcaaatttttccgggatctctgtgatcaggaatattgtgataatttcgattcaatttatttctaaaagcccgacattttatttacttttaaaactacacatccatatgataaatttatcgaaaggccaattttgcagaacggaatgtctgtgaaagaatgtccgtttttcatggacatatcgccaacaaaatccgtttttgaaagaaattttcagcaattcattacgaaaaatgggcattgacaaactttcctataaaaacagaaaaagtgatgatgatcaaaatgataaattgtctgtggaatcatttccgatcaatgtggataacgaatgtgtgaatgaacgtcgtcggcaaatgccaatccgctgatcggccatcagccaatggagggcaaagggtcaaagaaacggcgtgccaccgccgccgccccaccgttgaagccactgtttagcaccgtcaagcatggcactggtggcactattgttgttgttgttccgctcatccgtcccgctggcaccgttgttctgctgctgttggtgacgccattgcttagcggtccacccaatggtgccgccgggacgatggtggggttgatgatggcacatttggccatcattatggctattgtctccatcattgcactcctcactgctcggcgagcgaatgttcagtctgtccaacttgaccacctgtttgtgcgttgtttatgttattgtatataagggaggaatcggaggcgggcggtcccacaaagagaaatttcggcatccagaaatatggcatcataaaaaattccgaaccgacaccagtcccaatcctgttggtggactttcttcccaaaataaacgaaacatattagaacacatcaatcatttcacattcctcctccccgccccgcttcccccgaataaatttaaaaaactgaaaaatttttagatttctaatttcttagttttaaataaaaacaaaaaatatttttcttgtaattttcttataaaaaatttataagaatttcttttatttcgaagtttaaaaaaaaatttcggcgccgagaatttgtgccgtccccgccgctgactatcgattgggcgcctatcggcaaggcaaaagcacctcttctagcgcaaatgggggcggctttatgtgctgctggcggttgttgtgttggtggtgatcaaagcggaacactttgctgccgctgttgtgctggtcgccgtcgtcttcatgttgttgttggttgtggtggtggaaatcgacggatgcggcgaccgcggcggacgacgacggcactgacacggaagcggaggacggcacggaggaggaagtgatggtggacgaacagacggaaatgctcagcggatgttcttccctttaaaatgggaaaaaatgcggtacgcgacatttctttcccgccgtttctttcccgggacttttctttcccaaaattagaattaatcctaaatattaaaaataaatttataaagcaatataagcagtaataacaatcatcatgaccaatcactgacaaaaaaactcaattgctcactgatccatttcaaaattgtttgcaatcccacgtaaatattcagcaatagtccgttctccgaggccgccaacaacaatgtttctaatacgctcatctgttctttggtacacaagccttttttttgctgcatcatctccccgaacaaattcttcgtataatttgtcacgatttttttgaactcttttcacccttctatgaaacacaaaagaatggcgggaaagtaacggcgggaaagaaatgacgggaaagaaacggcgggaaagaaatgtcctgctccggaaaaaatgatggaatggagggagccacccgaacatttttgtctgattttttgttcgtaggcccataaatttttttattccgatattatttttaaaatctatgcggtatgggtaaaaattaagaaatttcgtcaaaatttatttaatgtatttttgcaaagttttgcaagttgatacaaattaaaaaaaaactttttccaatattaaagtttcgttatttttaaaagatggaaacagtaagtaattaatggaaaatttgtcttttttgagtcatttgaaaaaaacgtccacaaattttaaaaatcaagaaaaaagaacatttttgattttcttcaaattcaaaatttcgaacgcacacatcctttttctaactcattcaactgtatagcgtttgcttataaaaagcttctcctcatcaagagctttcgaatgataccaagattgttcagcttggtttgcataaactctcaaaaatgatttcgaaaatcgtcattttttaagtttttttttctttctctgtaaagaaatagttcgccaataagagagaaatgtgtctttctctgcactctctatttaatgacttatgtctcattttttgagtcggtgtgtccactggttctaaaatcggtggaaattttttaaattcttttttcttgttttaagattttttcataaaattttttgttttaattttgtttttaattctgaaaagtggtggaaaacgttgtgcacacgtcgtgaacacaaattgatgcattcactcactcaccc

SEQ ID NO: 3437 - DNA, 2798 bp, Heterodera glycines
ggtgatttgactatggcaaatgccaataagcaaagattcactaatggcatttggcatttgcctaacaaatgtctttcagcatccaagtcgaattcaaatcactcacaagaatttcatgtccattgtggacttcagcccgacaacaccaccaaaatgtgccaaattcccgaacaacacacatttaattgaggatcgtccgccgaagtcggccaactgctgattaacatttaagctctaaaatgctttaaggtatacgactgtcctcggcacaaaagtgccggtcatttcaccgctcctttgctctagacaacgttatgatcaaaaaatggccaaaagcagcacggaattggtgttgcaaacagccgatgaaggcgaaaatcgcgaggcggaaggaacggagcgggagacatggggtaaaaggagagaatgagaggggggaagagagagaatgcctgaaggggagaggggagggggaaaagcgggagacaaaaagatgatcaaggcgaaatcaacatctaatggaatgaatgttgggggatgcctttgtttagagcgcaaaatcgactttcttctctctgtggtcggttttgccgttgatttggccaatgtttggcgttttccttatttgtgcttcaaaaacggtggcggtaagtcgcttaaattgccgtttcgttctccccactttttgccgcttcttcaggcgcttttctgctcccttacacaatgatggttcttttggcaggtataaacatccaatgagcacccaaatcagctttatttggcttttgtaaggcattcctttgttttacatggagttggcacttggccaattccatcgaaagggtgcgatcacaacttggggccgaatttgtccgctcttcaaaggcatggacgacggaaggtcccctttttgagcatcattcgctgttttaggcatcggctactgcgtcattatgaccgccttttacaccgacttcgtaattttgctaattgccccccccccccctcttttttgctcactttcccagttttacaatgtgattatcgcttatgcccttcactatttctacgcctccttctccacccaacttccctggtcaagctgttccggaaaacgttcttaattaattctgctaattgccctgtgatttccttttgagacaattcgcccgcctgttacgagccgagttggagcgaccaatcgcagcaatgcgcggacggccccattttccggcagaatgagacgagaaatggcacttcgccgcgcattgaccgacccgtctcagccgcagaggaatatttttagtaagaaacagaaattgggagagagggaaaagaaatgcatttgcagcaaatatttccttggactacacgccgaaaaagaagccattccccacgtcacacaaagcgtgggacaactcggaccaatcaattgggaaatcgtggtaagacagtcaaagaaaggcaattaattggttaacgatgactcattaatccaatctcagactaattgggttgttgtaattctccgttttcccaaggcttgtctgtttgttgtctacatcatctgctatttttcgctatggaagggcatcaaaatgtcgggaaaggtccgtccgttttcttaccgtggttcccctcgtgatgctcgagagtctcggccaaagaaaactgttttctctgatgggttcagtctcggatttgtttcagtcccccgccctctccccccccccccctccccaccccttcccatgctcatttgtcaggttgtgtggttcaccgccatttttccctacgttgtgctcttttgtctgctcatccgcggcgtcactctccccggtcccttttccctttccctctccctttttcatttttcaattataaatttcaaaaggttccgaaaaaggcatcgaatattatcttcggcctaatttggagaagctgaaggacccaaatgtgtggcaagatgccgcaacacaagtgcccaatctgtcgcgtataaatttgttaattttccatccttaaaggttttcttttcacttggcccaggctttggcgttttgatggtttgtactttcatttgaatattttttattttaaattttaggcttattcttcttacaacgaattccacaacaatgtttattttgacgctcttctgacaagcacaataaattgcgccacgaggcatttaatttaaatgcattaaaatttagacaattagacgcattccaacccaattaagagttgattgttttacattaatattctaatagttttctggccggtttcgtcattttctctgtccttggttatatgtcgtgcaaaagtggaaaaccaattcacgacgttgcgcaggaggggccggggtcagcagtgccttcatgactccggccattagtcggctcatttctcagtttagcctcgtcttcgtcgtttaccccgaggctttggccacaatgcccggggccaccgtttggtctttgattttcttcctaatgcttttgaccctcggattggacagctcggtgagcaaagaaacaaaccccgcacccaattccaatccattttattgttttcgttcagttcggtgggtccgaggcgatcatcacggggctaagcgacgaattcccagcaattaaacgcaaccgcgaagtgtttgtggccgtactgttctctttctatatgatcattgggctgacaatgtgcacaaaagtcattttgctttatttggccactaaatgtgccaaaacccaggccgaattaagggcggaatgttggtgatggagtggctgatg

SEQ ID NO: 3438 - DNA, 2313 bp, Heterodera glycines
  misc_feature (2261)..(2261): n is a, c, g, or t
catatgatcagcaggtattataaattaattgttttaatattatttattaattaaattattattattattattattattgttctttaattgttgcgcaattcgcttcagaattgcactttgaccatctcttcatggaccaattccaagtcggcgttggattattacgcggatgaaaaagttaatttggcgtcgttcattcccaacgaggaatgggaagtggccagcttccgtattttccggcatgaggtgccaaaagcagacattacacttaaattttgcattaattttgcaattaaattccaatttcacttttcacagtataaatacgcgtgctgtcccgagccgtgggttattctcgagtaaaaatacatttggctttctctccaatcaattcattttttgtgcttttcccagggcttcgattgttcttcgacggaagccgctttattacgtcattaatttggtgaaaagttttttgtttttcatttttttaaatcaaattccatttttcagatcattcccacctcaattatcactttggtggccatcaccggcttctttacacccgcgtcaacagcagacgatcgaactgaaaagataaaccttggcattacgacggtgagaaaaattaaacaaaattaaaaataaattaattatttatatttgcccttcagctgttggcaatgagtattctgatgctgatggtaagagaaatgaatgtttgatcaaatgtaataattgtccatttgttaggtcagtgatcaaatgccaaccaccagcgaatttgtgcctttaattggtgtcaaattaaaaaacaaaacaattttttttttgttattttcagcgtggttttacctgtccattatcattgtatgctttttattttcttccagtttttatttaaaaataattttaattaattaattattaattttaaatttaattattttgctaattcccctcaattagatcatttccattggtacttttctcaccagtgtcattctttctgtccaaagtcgtcgtcaatatggccaattgccttcgctccctttgcgcttcattttcttcgtcaaattggtccatcgcattttaatgctcccattaattgcccttttgcccacccccccccccccaattaggcaatgattctgagcagtttcatcaacctgcagccccttcagtaccaagactacgtctatcctccgttggccaattctttgggcattgtttttgccctttcgtcagtttcggccattccattggtcgcactttggcaaatgggaaaagcaaagggtcgaacttttggcgaggtgcgaatttcacacttgggacattaaatttaggactgctttaaactgaaattttccgtgactcttggccataaatggggaattttatcggcccgagaccgactcgagcagtcctaatgaacatcattcattaattcggtgataaaatttaatagaaaatgcgatttttgcttacgccgacggaagaccaaacgcatcgacagacggaaaaggcacaaaaccgtgtaaaattttcaaaaatggacatggacattccgaatgaagaagaattccatcaacagattaatgctgaacacggcgacgtattattatagggaacgtaagaaaaaaatgccagtggcaatttgcaattttacaattatttaatttgaattgctccccgaccccactgggaggaaattctcggggagccaaaaaagaccggggacagtcagggattggggtcggggagcaaccctaatttaattgacagaggtcgttaatgagctcaattaatgtgaactccggtcaattaaagtgattagcacaatttaaatttgttcaatgacttcttctgtttgtccttctttcttttaacaccatccgcacaactttggacatttcgtgtacattttgaatctgaccattgggttttcgcttgcgcattcattagacgttaattcgctgcaaagtgtttcgtcggtgtttctgaacggtgctaattatcatccaatgcaattgatcaattgctgctctttgcctgcattcgctgttctgctgctgagtgatcgaattgcacagtccgcacttattaggacagaaagtggccatcacactctgttgctcggtgcaccacccttggtccaaccaatgttggcacgttctttcatctgtggacagagcccaacttcacaatggcactccgtcccaaccccgcggcaaaccctttttgttggtgcatttaaattncgggtcgttcgcagcacatttggcaggtcttagcacattttaacgcttcatt

SEQ ID NO: 3439 - DNA, 2266 bp, Heterodera glycines
  misc_feature (61)..(61): n is a, c, g, or t
  misc_feature (65)..(65): n is a, c, g, or t
  misc_feature (72)..(72): n is a, c, g, or t
atcatttaaatattctcttctgctgatgcgcaagaccctttcggttgcggcagggaatganttgngccttgncccaatggaatatttttgtactgacggcgagaaatgcggcacagaaagaacagtttgagttggaattgcgcagactccgcttaatcgagcagaacttttgtgagcaaattgttgtgctcgaagattcgccggttaatgccaaaatcggtggcccaaattaaccaattaataagaagaaaaaaatggccttaattttcgataggttctggcggtgccaccctaaactccttactttttctcttcgagagttttggcggtgaagccttttttgcgcaaaatcgtatccttttgctgcacagcggcggattgaggtcagaaaatggggaaaaatggaaaatggcgcacaaattgccatttttagccaacgcattttccatgtcgccctcacaggttttttggcatttccccttttccgtccttctctttctccgtaggaaaagccttcatgcttctgccggatggtcgcactttacttgagcataaactcatctcttatcggttagttgggcagcgcttttcagcggccgacaaaaggccaaaaattggccaaaatgccattcttttgtttttgggcctctccttctctccgtccattcgtcgctcggcttcgttttcgtcgcttctgccgatgtgctcgaacactttcctcccgccgtttccgtcccctcttttcctggcgatcttttgctgatcgcgcaccaatcgccggtcgaagtggccgaagggcacggcgtttatttactcgacggaaattcaaatcacagcaacggacaaagccaaaagttgaaggtttttccattttaagaaacattgcccaccaaacagcacagagagtgctgcaaaaaccgacggcggaggaaattcgcagagaaaatgcaattttggaatgccaaagcgaagggggggaggagttggtgttgacggacagttgctatttgctgggccacggattggccgtcgaattggcgcgtctgagacggaaaatgggtaattagcaaagacaattaattagccaccaccatttgcaattaataattgtgcagaagctgtgccactgaatgagctgtgctgttatcgcgactttctctgcccgttgggtttcgcttcggaagagcaacgaaaggcccatttcaaggcgaaagtgccggaactgctgcaatggcaaagtgccctttggtagttacaattaacaaaatttagtggccaacaactgattttcatgctaaataaccgattaaaaaacacaaaaatatccatttgacttttcctaagatatcattaaaaaacagtcatcattaagtttatttctgaataatcccttactatataataagcgagccgaagctccgcccctttttttggtcgagttaaattggcgtaaaaagctttgatttgtggcgatttgttcattaataaaaaagaaagaaaaatcaaaaaagagcgttagaaaaagaaaaaaagaaaattttgcaataacttcccatgacagtgacaggtaaacaaaacaaaaaagagagaattatttttcagttgtttatgtcaatgtgagagagaaagaatgaggaaagagaagaggtaccgagagagagaaagaaagtgtggagataaagagagagagtcaattaaaagaggagggagagaaaagaagaaatgagatagagagagaaaggtgaagagaggaagagaagaaagaaatagtgagagagagagagagagagagaatgaaggcagagagagaaataagtagagagaaagaaagagagtgagtgatgaggtacgaaagaaaaagagaggaattgaactgagagaaagaaagaaatagagatggagagagaaaggtgaagagaagaagagaagaaaggatagaagaaaatggagatggggatagtaagagagagagagaaagaaaggcagagagagaaataagtagagagaaagaaaaagagggagtgatgaggtacgaaagaaaaagagaggaattgaactgagagaaagaaagaaatagagatggagagagaagagaagatggaggggggatatagtaagcgagagagggagagagaaagaaagaaagaaagaaatcgagagagaggagagaaagacaaagagtagagtgaatgaaagaataaaagaagtgagtgagtgattgagagagagtgggagagagagacaacgagagagaggagagttagaa

SEQ ID NO: 3440 - DNA, 1070 bp, Heterodera glycines
aaaaaggaagaaaaatcaaaaaagacctttaaaaagaaaaaaagaaaatttgcaataacttcccatgccagtgcaagtaaacaaaccaaaaagagaaaattattttttcagtggttaatgtcaatgtgagagagaaagaatgagaaaagagaagaggtaccgagagagagaaagaaagtgtggagataaagagagagagtcaattaaagaggagggagagaaaagaagaaatgagatagagagagaaaggtgaagagaggaagagaagaaagaaatagtaagagagagagaatgaaaggcagagagagaaataagtagagagaaagaaagagagtgagtgatgaggtacgaaagaaaaagagaggaattgaactgagagaaagaaagaaatagagatggagagagaaaggtgaagagaggaagagaagaaaggatagaagaaaatggagatggagatagtaagagagagagagagagagaaagaaaggcagagagagaaataagtagagagaaagaaaaagagggagtgatgaggtacgaaagaaaaagagaggaattgaactgagagaaagaaagaaatatagatggagagagaagagaagatggaggggggatatagtaagagagagagggagagagaaagaaagaaagaaagaaatcgagagagaggagagaggagagaaagacaaagagtagagtgaatgaaagaataaaagaagtgagtgagtgattgagagagagtgggagagagagacaacgagagagaggagagttagaagagaagatggagaggaagtgagtaagtttggtgtttgtgtgtacatatgtgtcatcgtttgaatgtggcgtttcgttttgttatcgctttgcgttaaaaaatgatttgaaaaatgcgttagaaaaagaaaaaaagaaaattttgcaataacttcccatgacagtgacaggtaaacaaaacaaaaaagagagaattatttttcagttgtttacgtcaatgtgagagagaaagaagaggaaagagaagaggtaccgagagagagagagaaagtgtggagataaagaaagagagt

SEQ ID NO: 3441 - DNA, 1329 bp, Heterodera glycines
ccaaatgttttagttttgcatttttatcggtcgtcccaccacggccaattctctcacttttgaattaattaaaatgccaagggatttgatgcacagcaaagaagcgcatttgctcgacttgggcacacagagttttttccattttggcactccaagtgaacttctctcccatttctacggccatccatcaatttttcgcgaaaaatttttgcacaacggaaaaattgggaatattttatattcaacaattggggaaaagaaaaaggttgagaagagttaacggattatttagttttttatttttaaatgttcagatttcggctgaaagctttttggaatggtgcgatttgaatgaaaattgcgaagttggcaaagaatgcattttgagcggattggtttatgacggggattcactgctgcgcattggcaatggcatttgtgccagcactttcccaatcgatcggaaaccttcgggaggacacgcgggtcggagtttggcattttcattgaaaaaataattcatttgacaaaagaaaaagaaaatatcggcacttaaaaaacaagaagcccttattgcgtttttcagccttattagcatatttttccgttcttcagttgacaattccacggtctctgcttttgttacggtggcatttcaccgcgacgacgacattaagcgaagttcggccgaatgtccgctgctttggtttggccacagattggccaccatcgcccaagggcatgcccaattccattccctttggcactttccccttttctcggctcacccaaatcccagcgaatccctgcaggaaacattggacacaatcaatcgactgggccaaaacgaaccacaaaaaagcgacaagacaaggccgagaagcgatcagcaacttttgtcaattgaagaagtactgcaaaaagtggacgcaaaaaaactgagggaaatgcgcgaaaaattcattaaaatgccaatggaagagaaagaaagcggaaaaccatcaaaatgatctgtgtacttaaaacaccggaaaatccaaaacattacgaaaactttaagagtgtacactatcaaagagctatttataagagaaattttcttaaagattttttatcggaatgggaagtgattataaacatattattttgtgtgtttgatgttttggcgcttaatttgtaacaggaaattgagaaaataatttttggtaaaaatttcagcccaattggacaagtgaaagatagtggaattacaaaaaatagtggcgctataattagcaagacataaaaccaaggaaattttctcataaaataatctattacaattttgta

SEQ ID NO: 3442 - DNA, 3459 bp, Heterodera glycines
aacaatttcgcatttttgaataagcatccactgacccatcctacgttcattgttgatttgaatgtcgattctgttccattgatcattgaattgccagtcaatcgcttccttttcccattttgcccatttgctcgcgtctcgcgcaatcggacaacggaccaacagaagaagatagcaatagtcagttcctttcaacgtcaattgttcccgagtcaattcgttggtctgatcaaatggcacaacggagtcagcaagacgcggtggccaaatgacaatgaaattgacgggagatgaagcattggcaaatgcctcaaatgtggaaaaattggttaagaaatatgaaatgaatgacacttaaatgttgtggcgacatgaaatatgaatttcgaaatttctattttttaacttatttttaggaacattattcaagcaaaaaaaaaaaaatttgagtgccgtccaaaagaaatatttcggtcagcgaaccacaaagaccgtaaaaatgacaaataaaatcaaatcaccgctttcaaggcttcaattctcgaggacaaattcccatcatccattaacacctttggcacattgtcaggacggggagtgaacagccatttgtccaacgcttgtccatccgacgccatggcactgtcatcggccggaaattcggcgaaaaagccaccagaataggaattgataatacgaagcgatggacaatcgtttagaattgacggcacggattgtcgcaaacggtagaaaattctgccgtacaattgtatggcacaaatgtttttcgcgatcattggccaaaatttgcgcaaaatgaactccaaagtgcggtcaccacccgtgtagatgaccaacttaattggacaggaggcgaaaagttggcgaaaacggcagagaaaagcgatggcattttggtcgacgtatctgtgaaaattaaggaatcgttttacaacaaaaaagaaaaaatcaatcattcatttcactttattgaaatgcgcttgaatccgacgactttctttggcaacgctttttgtggagttggcaacggctttcgattgaaattgacaatttcccatccatttgtgccgtccgcttcaaatttggctttaatttccatgggtttgagcgcccaacgccgcgtcttgaagtgttcgtcgatgtaaaagtcaaaacggtggctgacaagtgcaattccaaggcccagttgacgtggcggaagcaaatcgaacactgaaagccaacagtcggcggagatgaaactgaaaaaaaggaaaacaaaatttaaaattgaaattgaaaattggcattttaattttacattgctttttccattttttcttcggcttcttttcggttgtctgacattttgttgcagcaaattattaagacagttttcggcactttttcagtttcttaactaccaccaccattatcaaggtaaaaaaattattggaaaaacaaaatgatgggcgatagaaacattttcaaaagtcctagaaaaataaaataaagatagatatgtattacgtatttttcttaaagattaaaaagtaattctctatcgaatttggtgagaaaattggcgggaccgttggagctgaaatttttcgtaaaaatcctgctgggtcaattctgaatttcattttataattcctgaaatatcaaatagcccctgctaggccagtaaaatttcaaaaaaaaatttgacaaatttttttttcttattttgtaactaatcatagtgcctcaatcgtccccccccccgtcatttttcgctttgtggggggaacatttattatcatttatcaaaattatcagagagaggctcagtttgctgtcaattaggattccaagatctcggattgtttgggtctctttaataatttttccattaaattggcagggaactttaaaattatccttgccaatgtacagagaagctgatttttctggtgaaaatggtagaccccacataaaaattttttggaaaaatacacatgtatcttatttattcatcaccccataactttaaaattggatagtaaataaataaataattcagaattttttttctctattacctatatgcaaaatttgttgtggatttatgtaacaagcagaaaaaaaaaaaaattttatttttacataattaaaacaaagagatagtacaccaaagtgagagaaattacaaagaaaaaaagcaactacgagatagtatgtgctaggcttttctctgcacagcggagttgacccatagagcacacctctgaaccaaaaaaaccttataaatatgtcgtctcttggggttaattttcattttgttgtatcccattgtttttactctttttcgctaaaaacctgaatccgcatagtttttcgagacaaaatttgtaaaaagtcgactaaactttttctgatttctcccacctttgaaaacattttgcttctatctctataatatgtaaactcggccaaaaatttattcagtttaaattttcatgtctttatttgctatgggattattgccatccaaaacgacaccatcgccgaatggcacgactccatcaccgccaactccaccgaatggcacgactccatcaccgccaactccaccgaatggcacgactccatcagcgccaactccatcgaatggcatgactccatcaccaccaactacaccgaatggcacgactccatcaccgccaactccaccgaatggctcgactccatcaccgccaactccaccgaatggcacgactccatcagcgccaactccatcgaatggcacgactccatcaccaccaactccaccgaatggcacgactccatcaacgccaactccatcgaatggcacaactccatcaccaccaactccaccgaatggcacgactccatcaccgccaactccaccgaatggcacgactccatcgctgccgcagcaacctccgccagtcgccacagctccgtcaccgtcgccaccggttggcaatgtgttgccgctgctcgccaacggacagtacgcagttggatgtgccgacattatggtgggttgggtgtgtgtaatgaatgggtaatctgagggatttgttacagattcacttacaattaacaacaattgtttttttctatttctccctcctttttcacagctttccgaaccttccgctgcctcctcatcttctgctggtggcgttggactgttcgcccgactgttttaccccgccgcttcgtccgtcgtcctcgcggatccgtcgacttcgtccgccacaacagcgtcggcggtgcgttttttttttgagtgctgacatacaaatacaaggggtatctcggaccaagggctatacgacggacgattgggacagggggggggtgtctcgagacaccctttgtatatgtatggtgctgaatgagccgaaaaagtgattttggagttcgttctatgtttcccctcatcat

SEQ ID NO: 3443 - DNA, 737 bp, Heterodera glycines
cgatcgcccgtccattggcatgcgccggtcttgccgggtgagcagcgctttccactggtcattttctcgcatggcatctgcggctgtcggttcttctacacgactgtgtgcgcatcgttggcctctcacggctacgtagtggcagcgttggaacaccggtgagtgagtcgggcatggcatggagcttttgaaaattcaaactatacctcctccccctctccgccttccagggacggctcctgctgttggacgtatacgcttgagcaggtgctatcaccaacaccgccgccctcgccaccgctaccaacagccgttgaagggacgccgcagcaacaaaacggaccggtgccaattggtgagaagcggtgggggccggcaatcggggaaaattgaaaaattttccttttcaaaatttcgctggggaattaattggagcagagttccacggaaaaccgtaaaatgcaaattttatattcatcataaaactgaaaatcactgaaaaaaccgaaatttgagcagagactgtccgtgttttatatatactttaaacttttttttttaattttcatattatttaagccgtcaccgctggtgctgaaaacactccgccgcagacgccgacaccgccgccgcccgtgccgacgacaacgcatgtgaagaagccgatggaaatgcgcatactgccttacgacgagaccgaatatgaaacacgcattgatcaggtgggaggggggggg

SEQ ID NO: 3444 - DNA, 2960 bp, Heterodera glycines
atttttatttattttcaaattcccctcccctccccgaaacgacgtgttgctgagacggtgcacatgccccccatcttagccgaaatggacgccaatttgctgcaaaatgtgacgacggacaacaacaacgaacgccaaattggacaacagcaaattcttctcggccaaacattcgattgggcacaattcaaagtgagtggaaaatggggggaaataaatgaaaaaaaaaatagaaaattccctccccgttttgtcagaatcgtctcgcgttggatcgctgcgtgtgcatgggccacagttttggcgccgcctcatcgctgtccgcatgtgccgaatatccgtcgctgttcaacgcctgtgtgctgctcgacgcctggctgtacccggtggaacgacgaatgtatccggcgactgtgcaggtgtgtgaaatgcgattttttggaaaaaaaattttgaggaacggcggaagggtgccgataggcgccactggaaatttttaaatttgttcaaattcaaaatttgtcttctttccccccttcatcggcacatacacccaatgggattcgaacccacgccaataaaacccattttgtgcaaaaaataaatttggcccgtttccagaaaatttcggaagtttttttttctcatcgcctttccccgcttttttagcctgtgctgatgctcaacgccagcaaatggcaatggccacgcaatgtgcgacgaatgcagcgactgttagcgaaagcgaccacttccaccaatgacgacaaaacagcaacggagacgacaacaacgacggcaccgcagcaacagtcgcaggacggcgccgcaacgacagcagcaactgcacagccgagtgtcaccaacacggacagccgaatgatgttcacgataaagtgagtggtgggagaagcggtgggaaaagcaaaaaatatacatattttcttgttttcacccactctttttggcattccccgaattgctcgctcatatttatttgaacatttgtttccttttcagggacattgtgcaccaatcgttcagcgactttggcttcctggtgcctggccgtgtcgcccgttacatcggcgttcagggcgacttggacccgctgttgaccggcacagccgtgctcgagatggttctgcagttcttggagtcgcaatttctgcaccagcaacaacagaaggaggacgaggaggacacggaagatgaagaaggagaagaagacgagttggaagaaaaggaagaggaaggagagaaggagtcaaaagagagaggaggaggagggcaaagggatgtgcggactgagcaaggggagcaggacgaagtggcgagaaggtgaaaaacagggcattaccttaaatttggagttcattttgtttcctccccatcccccgaaaaaaatcaacaaattttcaaactgagaattttcaacaaaaactttttccagacataaaagtaaaaaaatcactgaaaatgtttcgttttttgaaatttcataagaaaaaaatttcgggcgggaaacgagctctgctctccctatttgtaagtgtgagagggtgaatttgaatccaaaaaataataatttttgatacaatttgaccaataatatgggaaatccatgcattttgtcaaatttgccccaaatttacagcaatgcctccgcgttggaccgtttgcgtcgtttggtggcggagaaatacgcggcttttgtggtggaagggacggacattccgcaggtgaattggggtcctgggcatattggatggccatttggggcgcctttaacaattttggaaaaattgttttcacactaacacatgttttcaaaaaataaaaaatatttttttcttaattttcccaccttttactaatgtttttttattttcgcccaaaattttaagaaattgcaatttttccccgtctaaacactgtgctctaattcaggtcaaattggacgaggtggccccccttgtggaagcggaacaacagcaggcggtgtccgcggaggaggagcgcaacgtggccaatgacagcggcgtggacacaccgccgacgactgagacaacgacggaggaggcggccgagaataataatcagcccagcagttaaagaatgaagtgccaaaagtgtgatattgaattcaaataaatgccatgccccaagtgtatgtatataaagcagtcaaaataatttaatttatttttttgtatgtattaaaggaggagcaataaatggaatattatgtgttcaattagtattgtatcttccttccattgattggagttaacaaatcttgatgcctttatttttcggggtcgtagaatccgatttcgacacctaggtattttctttcgcttatttataaccctgaattcggattcgaactaaaaccaaaaattgaattttcatatagttaccccattttttaaattagtaagagaaatagctcaaaaatctttaaaatcttagatctagtcggttttaagcgttccatgaatgtatcctcagtttcttcggccgtaattttttcttagttggtcaatgcctatattctttggtatcaatcgaaagctctaagcctatagaaatttttttaactaaaatttcggataaaagcaatagataaaaattattccttgaatttcatgtttctcattgtattttttttcttaatgccaggtatttgctttttcttccatttataagatctcgagacttcaagctttcgattgataccgtcattgaccaactaaggaaagggtgaactgtagtgaacgccccgtgaaaaaaagagtcaaatgatataccgatcgattcatctcaaggagctaagcatggaaaaatatgtcgcgagttgcggaaatgccaaaaaaccggtttttgaaccagttcaaaactcgaaaaattgagagatttcacagtataactttaaacgatcgaatcctgacaaattt

SEQ ID NO: 3445 - DNA, 1406 bp, Heterodera glycines
  misc_feature (1248)..(1248): n is a, c, g, or t
  misc_feature (1334)..(1334): n is a, c, g, or t
ttatgaatgaacacaataacaaaacgaattaaatcaggatcatcaacaaaataatacagtaaacgcattggacacacaaaatgatcagtacggtgttgtgaagaagcgcacacattcaattgatcttggaaccccccggaagaaatcaaacattttaagttgccaaaattacatgggtcaatcatcttcagagtccaagagatctgatgacaaaaccgagcaacaaaattttaatgaaatggctgctttatcatcaccgaaagcatcaaatggaatgccaatttctgatttttgctatgaaatttttggggatgatcaattcaacaatttgacgtcatatctcgatgagattgatggatttgagtcaaacctattcgacggccttttgcaagaaaatgatgaacaatttccaatcactgattttaagattacagaaaaacaattttccggatcgaatcaaactttagccgaacagtatgatgaagcaaacactagtcgtactgtaagcgaacaattacagcagggggaaaacattgaaaatacccaagaaaaatcaattggatctgatcaaggaacaaactcgaactcggaaaactttcaaggaccaattccggatcacaacatagttgttgtacaatctccaaaacagcatgagtatactgtattgcaccaagaacgagaaaaggaaataaaaattgatactgtatcggttcagcctaaacgcaagagtccaaacaaaggtgcatctaagaagatcaaagaaaatcgtaaaaaagcatttgatgatagccaaacaaaaccgacccaaaaagtaaagccaaatgcggaaaaacaacatcaaaaaataaaacaagtactcagcgtaactaaaggtgtacaaaagtcaaccagtgccatggcaaaccatggacaaaaattgaaaaagtctaattcattttcaaaaatgctaaataatgaaaatgttgaacatgttttgacaagaccaattcctggcagttctcatacagcaaattaccaaagacagagcaatgcttcaagtccaattaatattcaaacggcacatatgacagtgtccagtccagctaatccaacacaaatacaaactggcacatcaaacagcccggatttaggctggaaaacgcagaaatccttgccaaaattgaatatgacaaaagtcgcaaaattgcttgacataaaccaaaacagtccacaatactcgaacagcccgacaacggtgctaaatcctgngacggttccgaactcaccgctgatgtcctcccagccacgcacgccaacgtatttttcgccgactgatatgaggctcagtgccttcngcaaccaattacagctttcacgacgcaacatgccttcagttccacaaccaaatatcgtatcggatccgcaac

SEQ ID NO: 3446 - DNA, 2069 bp, Heterodera glycines
  misc_feature (2041)..(2042): n is a, c, g, or t
agatttatgattccatctagattcatgctgctcccttttccgataatgttgctaacaatcatgcagggatcaatcaacctgctgcgaacaaaccactttttaaagttcccgcgcccccaactatgaggcaaactgaaaatgacaacattgtcaatgccgataacaatacgtcagaccggctacaatcgcaacattctgtttccgattacttgaagaactcaccatcatatcccaacttggagactactgtagcatcaacatcacaaagtgtttcatcaacaaacaataattatgctgaagctggacattacaatagcatttcgcctactgtcgatgctacagtaaaatctatgcccccaccacagttttcaaatcctttcgcgtcaaaatcacaaaatatgaacgcaacagatcaacttttggctattaataaagccgcgagaaatctttggacctcacaacaaaattctactaccaatgttaccatctcaggcttacgcctgccacagttgccaattactgatgcaaatgtcaggcaattaaactcacaaccaaataatgctactgtatatatgcccccacaacaactttcaaatcctatcgcgtcaacatcacaaaatctgagcgcaacagatcaccttttggctattaatgaagccgcgagaaattatttgagatcacaacaaaatcctactaccaatgttaccgtatcaggcttacgcccatcgcaatttgctgttgcagatacaaatgtcaagcagttaaactcacaaccaaacaatgctacagtatcaggcttaaccacagagcaaatggctactgctgatgctgcggttaaacgcttgaattcacaaccgaatactgtaagcaatgctaccgtatccgacttaacccccgagcaatgggcgctcgttgaagcatcagtgaaacgtttgacctctaaacatgctgatgatgcaaacattgctaccgtcaaagggcaaacaccaacgcgtgtagctactgtaattgataataccgtgcattcatcgcaaattcaaagcgcaacaaacgccggaagggacgcccaacccattaatagccctcaaaataatgtgctcacgcggcagtcatctttggaatttataaatgaacaaagctttattactgctgccaacaaaacagctgcgaagggcacgtatttacgaaagtctcattcaactacagtacctcattcaatttttaccgtaccacccgtacctcaatttggtaaagaacaatttcctaattgttgtttctcaggaataattttctgacaaaaatatacaaaatattaatattttgatcatggatttttcggaaaatttattgcttaaaaattctatcgacttttagactaacttagggtgttatgctagacaaaggcccgtaaaaaagatggaaattttaaaacgaaagattcactaaactactttttaaggccacacactatacttaaggtaaatccgaagtgctgagtcgaagtaataaaaagtgcttgtgatcaaattaaaagcaaaataattattttaaacattaaaagcataaaaattcttttagtttaaatcaataataatttatattttaaaagcaaaataattatttaatttcaattaataataatatacatctaaaactttaaaactattcatatacctggtcagccgaacctatactatttaaaatttatttattaaatactaaattatatcaaattaatttaatttaaatcaaaattattattttgctttcaatttgatcacttgcacttttcatactcctttatagcacataaatgcgaggtgcaatatccgaatctgccgtcagattggtcatgtggcttgaaaaatcgatagaatttttgacaaatcttttatttttattttagcccatacctttcttttttcattaacctaaatgagttaaaattagctccattagtgcaccggattatatataccccaaataggtgctaggtcgtttcgtaaaatctgccatttgagcgatattttccacaaaacanntagtatataactttgcttatgggcaat

SEQ ID NO: 3447 - DNA, 1366 bp, Heterodera glycines
ataactttgcttatgggcaataaaattttacattcttggtaccattcgatagtccagctttttctctattagcataaaaaacttcaaaaaaattatcaaatttaacataagttatcgtagaaatagttaccacacaactttttctaaagttgaccaatttttttttaaattttggaggcttatagagaaaaagcttggctatcgaatgataccaagaatatataatttggttgcttttaagcaaataatgccacgttatgtcgaaaaaatcgctaaaagggcagattttaagaaacgacccagcaccccaccccaatatataacaggtttttttatactttttaaaaaatttggtttacttttaggggtgacaatatttttaggaaaacccaatcaataattgtttaggtaaatcaacaccaatcggaaacaatcctgctgaggctcagattcaaaaccaaataattgaacctctcaacaccgtacccactacaataattccatcgttggcagttggtggaaaagttggcgaaacttcggacaatttaaaaattgagcaattatcaattggtctggaattggccaaattggcattaaatgccacaattccaccacttattattggcacaacagcgacacatgtaaatgattataaacagattttgaaaatgaattttgcctgtctaatgctgaacaaatcagaactggacattgaccaactttatcaaaatgcaataaattcaaattttaggtaatattacaataaataggaatgggatttttagtttaagaaaaatcccgaaacacctatttaaataggtacaaaaaaactcaaaatacttattaaataggtacaaaaaaccccgaaattggcagagaaataggcaaaaaaaaatttattaataatttttaggtagtaaaacatataaaataatcaaaaaaaatttaattttgaatatttcagtcgtaaatgcaaaaaatttaaagtttttttcgaataaaggacaatttttaaacctaaaattcttgtcaaaaaaaaaattttagaggataaatttttgagaaaatttttttttaagtaatcggtaaaaaaaactcccatatatatagttaaaggataggtgttataaaactgggtccagaaactcaaaataaatgtaaaaatggttttttcgcgtttaaccacacgtatgaagtccgaaattttttttttagacattatctaaatatcccatcctaattataatacttttttaaaatatgcaaaattaaatttaaaaaaataaatataaattggaacaaaaatggtgtattcatatatttttttattttaagcagagaaatagtgggcatattctttcaaatc

SEQ ID NO: 3448 - DNA, 1065 bp, Heterodera glycines
tacccacccccccccccgaaattttctaatttttttcctaaatttaattatgacctaaaatatttaaaaaaaaacaaagaacaaaattcaagggatattgaaaacatttgcataaattcttcataaaaggacaaaataattaattaatttatttgacccgatttttaaacaattttttcataaaaaaaagttacttttcgcttaaattttaaacaaatgaagcgctcgctatttatattaaaataatttaattgaaattattgattgatcgcctcgcgatttgtaataagctaattttgcccgtttgatttgctcatccaaatcaccactttcgttctgatgctgatcattaagccttttttcattttggcaatgactacaatacggctttggcattctgtcagtccgctttagaaatttcttcctctttcgccgcaacttaaagtataaaaaagaggttaaataaattaattaaaaattaagaaaaatttcaaaataaagtttccgaaactctaaatgaaatttttccagaagaattttgcccttgttcaaaaattttttaatgaatccatcgaattcaaaatcaaaaataaaatatagaaaatgaaatctaagtcaaataagaatatttctgtgtttttaggaatgatttttttttattgttatacaaaaagacttattaaatttaatttttttcaattaccgtagttggcaatggtatgccattttcggttacggtagtggtaaacattggcacaggtggcgcggatgatgatgctagtggttgtgattgctgttgtggtggtgggtggttgtggcactttttgtggtgaaggatcacggtgttgtataggcaatgtaatgatcggagcattcggttcacactgccaaaaaaaaaatcatcaaatttgaaaattgttttggtaccgtatgaaagtttttgtcgggtttcgtgtctctcccctttaattaaattaaaaagcaaaaataaaatatttaatttaaaatctttagcagatcaaaattatgttcaaaattagaaatgtcaaattttcaaaatttccc

SEQ ID NO: 3449 - DNA, 4726 bp, Heterodera glycines
tagttgatgaaaaatcatgggtaaaaatcaatgattttcaaaatctgagttcaggtccgtaatcaacgcattttttaagcctagaaaaaatacctgcgaaatttttaacttttttttgtcgggacaccaattcttgaccgctcttggatggtctttttaattctatgcaatggaaattcggttcgtttatttctatgtattcaaattttcaacgccgtaatgaacaaattcaatgccaaattgctgtgccggcgccgctcttggatggttttcggaagagaaaaacggacagtttttcgtcctgaccctcaaacttatcagaaaaacagatcaatttgttcggaaagcgattaaagtatttcacttgatcgattttttctgattcgtttgttgggtcatagcaaaaagccgaaaattgtgcacttttttatgttttgtcgcccatatttattaaaaaagcgaataaaatttccttttcttatgaccacccaaaaaatggtgtgtggcacataaaatcgaatagaacttctggcatcaaatcttctcttgcctaatgatctgtatcattggaaagcccataaaaatgctatcagaaagtgcgctttttttctctttaaaattgaaaaaaaaatacaattttaaaccaaaataaaatatgaatgagaaaaaggaataaaggaggaaaaatttttaaattaataaatgtatggggtttacattaattaaatgaattttcgaattaataaatattattattatgaaaagtgataaatttaaatttattacttaattgattttataaaagtaatcgataacagacaagtgatcaaaatttgcttaaaaaataatttaaaaaatcaaaatttgaatttttgcatttgaaatttcgggtgaagctactaaaaaagaattttctatctttcaccgttcgagcaaaatgcttaatttttgaaaatttttgtaaattcaagtaaaacttagaaaatcataaaatttgtaaaatgcacaaaaattaagtcgtaaaaagataatttactttcaaaaaaaaattaaagaagtgcccaattaaaatttaaatttaaatataatttattgttgtttttttttgccacctttgctgacgacaatgagcttaaattggcagctgtttgtgcaaatgtttgggcttgttggtttaacagtaattgatgatgaagctcattctcgttgtatactgtagcatcgtgattctcaactttaaaaatacggtatataattatattaataaccatgttttgcaaaatattttgaaataacaaaaatttaaaaatttcataaaaaaaactataaaaatccaaatgctaaaataaaatataaaagcccaatcggttaccagcctattaattcattaaaaggtatactgtacaattataattgattgattgattattaattgattcaaatggaccgtttaaactcaaattagacccattttggctatttgtttcatgcgtttgtaggtcggcaccatcagcagcagttgcttctttgtcaccaattatgcgtaaaatcagcatatcaacctcaattaaaaaattcacattttttaaaattattttttaaattaaaataaatttaaccaaaacaatgaattgtaatgttaaatagtgaaacattattgttaattcgatcaatttttgtaggttaataaaagtcgtgctgacgcgttttataaattccgccacccatgcgcgttttataaatccgccaaaatgggtttgcgcgttttataaatccgccaccatgcgcacccccaccatgcgcgttttacaaatccgccagcgcgttttataaatccgccaatataaatcaatatgctttatataaatttattatttgttgtgaggacccttgtaagcaaaatatagcaattatttaccaactttaatactggataaatccttatataatattttatctgaataaagcatccgaaaatttttttaattgaatttgtacgacattagctatcacaaaaccttaataactatgataattaataaagtgttctatgtaattaatttaaaaaattcatatcaggtgatggtgcaaaaattttaggagatcagatctcaaaaaaagaaataaataccctgaagagctgctggaaaatttgataaaattggattgtaattaccctaaggactttattttagacattttgtaaaaaatatagctgaaattattgcataaaattttaatattattaaagatatatgcaaaaaaatgtgctggcggatttataaaacgcgcatggaaacaaaataaaaaaatgtgtaagatggcggatttataaaacgcactagcaccataaaagttattaaaggcttattaatgatagaaaattgtttgtttgttttttgccttaaaagcttaagttttttgttgaagcaaaaaaccctcaaaaatttgccacggcacgtaaaattctttcaaaaattattattgttggttggcactctgttgaccaattattaaatcacaaagttggcacacactacttcgctcaaattggcacgtgaatttttgcccattcggctgagtttttcaatggtccgtcgcttcatgtccgcccacttttggcgcatgtatgagtcatctttgccgacaaaatgtgccatgccattggccaccaattggtcacgaatgtacatccaacgaagcttcttcccctcatgcgttatttttggtgaaaactaaaaaaatggtaaaaaaataaatttatcaaataaattttgtttaaataaataaatacgtaatatttttttaaatcgaaaaatatccgaaactaacaaattaacttaaattcgtttcagcaatgcgtagtaacttcaaaaaaaaaaacacttttatttctgttggtgattacttttttttagaaaaaatgattttttatttaattttttttttggtgaaaactaaaaaatggtaaaaaataaataaataaaattgactaaattgcaaacaaatttatttaaataaatgaatagttaagaatttttttaaataatacgaaaaatattcaaaattaaaaattatcttagaatcgtttcaatcaatactagggactcaatttttaggcaaatattttagggtttttgaaaaaatccttaaaaaaatgcaataaaaacgaaaaatacactcctaagaaatggtccgaaattttttttagaaaatacactcctaagaattgaaaattttttacaaaaatttatccacaaaatttaatattttttcttaataaaatttttcggttttcaaattttttcttttcgaaaaaacattaaaatatttaatatttttattagaattgcaaatttttatgtgttttactacctaaaacgcgttaataaaaaaaacttttatttgcctatttttgcctatttgaggatttttgttcctattttgcgatttttttctgcctttttaggtgcctatttcacgattttttgtgcctaaaaatggagtccctaatcaatacatactaaatttcaaaaaaatcacatttttattaattttttggcaattaattttagaaaaaataaataaaattttatttaatctttaataaaacaaatatatattaaaaataacgaatttaatataaaaaaatacataacattcagaaataaatgaaatttatatatatatattactgaaatatttaaaataataattttcttataatatttttttcaaaaatgataaaaaaaaattttgaaatttaatttgggcactaacttttgaaaacagatattctcgatgtggtaaaatgcactgcacaaatgccacattatgtgcgcatcgatttgacatcttaaaaatataaaattccttatagcaattaaaatctaaaattaaaatatttataaaatttaaaaattaaagattattaaaacaattttttaaaataaataaaggtatgtattatttaatttatcaaatataataaaaaaaattttgttaaataacaattaaacagagaaaaattttcgtcaaagattatttttgaaattttgtgatcaaaaaaaaattatgattttcctaatgccgaaaacggaaaacccattggcgcgtcaaaaaattatttcaatagatcatgcaaaatatatatttttttattaaaaaaaaaatttcacgaaaaaatcaatacataaaataaatttttgtggaatttccagcgaagaaatggggaaatttggaaaataatggtggatgggtcgatgggggacccaccagtggtgagcggcggcacagctgaaaaacccagtcacgccaacacacaagcccatcccattaaatgggacgatggtggtggactgggtgaagacagagaaatgtggaaagaagaaatagtgcatgaatgttgtaaaagaagaatggaagagaaaaggaaaatagtgcatatgggagagatgagagaaactgagataaaaaaaaatagtgtgtatggaagagaaacgattgaaatgtgaaaggaagaaatagtggaagaaatgttgtaaaagaagaatgtaagagaaatgaaaatagtacataagcgagagatgagacaaacagagataaacaaaatagtgtgtatggaagagaaatgattgaagtatggagagaagagaaaaagagagagatgtaaagggagtatgtaagagatagaaatatggatacactttgtgagcaagacctttta

SEQ ID NO: 3450 - DNA, 2221 bp, Heterodera glycines
  misc_feature (76)..(77): n is a, c, g, or t
aaataaaagaaaaaataaaggaaaaggaagaaaatatcagaaaagaaatgaataaatgaaagaaaaaatagcgaannaattggggacaaatcgaatcaaaatttataaatggattaaagaaattggactttataaatatcacaaatcaaaaactgatgaacaaaaactcgaaattgtgcaaaaattcattgtaatgaaaaatgaatttaaacaaaacagaaaatattcgcaaaaagaatgggagaaaaattatgccgaaatttgtaagaaaattggagttggctatgtaacaattaaaaaatggaagaaacattttggctttcgatatatgagaataacggaaaaagaaaaaatggaaaaaataaaaatttattggcaaatgaaaagaaaaaatccaaaaatgactgacaaagaaattgctaaaacattgaaaattcatcaaaatagcctccgaaaatggaagaaacagtttggaagagaagaaaaatgagaaaaaatatttgaaaatatgaaaattgattaaaggaagaaaagtttagaaattttttgaaaaatttgaataaaaaaataaaatcattttaagacgacaaaaaatgaaattattccaactattatttttatttatcaaagaaaaaaattaaaaagttttgacaaataaaaaaagaaaaacaaaaaatgaatgacaaaaaaaattgtaaaaatgttgaaaattcatagaaaaatcatgaaaatttgaaaaaaaatttggcgatgaacagatgatttagaagtacacaatttgatttaaaaacgcggtttattttttgacaaaatttttaatattctttcaagcattaattttgcgcttttttaatggcataaacatgaaatttaaaaaaactgattaattaaacaaatccaatcgagctttccataaactattgtcttagactttcattaggcacccaaataagcccaattaattaatggtaattattttatgcgagagtctttggtttatttcaaatgccgatagtttattccttatcattggctaaatttcccttcggcaaataaaatatcatttacaaatgagttgttgatgatcaaattttcagtaattaattaattttgaacctaactctttctattattaataaaatcgcaccaaattttaattattacacgttaaaggcactctaatgtataaatattaaaaatggtttataaattcgaaaaattgtttttcaataaatttatttttttgcttagatattaaatttggaaaagaaatattagttgatctctttattttattatttctttgcaattaaataggatttccttattttattcgttaattaatagaaatattatctttttcaatttttaatcagataaaattcataaagcgacacttgcgtcagaattaaaagaccaaaaaaaataagtttggggtgtctacaatgccttttaaaatgcctaattttgcctattttggactttttgtgcttaatgccaaaatgcctatttttgtgcctatttggccatccttttttggcacctattttcagggttttcgaaaaaatccttagcaaaaatgcaataaaaaccaaaaatacacccctaagaaacgacccgaaaaattttcaaaaatacaccccctaagaattgaaaaaattttcccaaaaattgattccctaaattttagttgtcgattctcgataagaataatttcacccacattacgaatgaatttttttatcatttttttctttttgttgttgtaattaatgtaaaaattttttttcatacgcttttgtttttggaataatctcatccctaaacattcattgattggattaattgtcctgctgtttttggtaatcaatttaatgctgcaatacattttcattttctccattcaaaaatattaattcatagctaaaaatttccaaatttctttcatcgaattatataaattagcattacaaaaaaattaattttgaataaaatgcaattatatattttattatttttatttttgattactctaattgatcaaattggtggaacagaaaagaaaaaattgcagcaaaaaacatttgaggaaatctttggagaaaaatgggaagaaaaagaagaagaaaaattgcaagaaaaaagagaaacaattgaaaaatattataaaattaaagaaaaaatcaagcaaaaaggaagaaaatactcaaaaaaagaatgg

SEQ ID NO: 3451 - DNA, 2278 bp, Heterodera glycines
  misc_feature (57)..(57): n is a, c, g, or t
tcattaaaaaataacaaaaatgcgcgctattcacattccatatgatgtattatcagngataaaaagcaacaattgttcgtctttctcatcaaatggttcagcttcagaatatgagatgagttgcgtgaatttgcgcgccttttgttgttgttttttttattttggtgtgctattccaaaagagaaaagtgtacccatttttcatcctcctcccacctgctgctgctttcaattcccaatatttttttttgccttgcttttcttcatttccacttcctgttgtttattttgcttattcttacatccctccttttacagtatcctgatcagtgattgccctgcctaataccatctccgtctaccgtaccgtgccgtcctccgtcgcgtgtcatgcctttggtcggcgcctcctccgcctgctccttctcctcctccttcaactcctacttctcaccccgcgtctgttcttcctccatccccgcgcccgtcggcttttttaatgaaagcaaaatctttctttttaattgtatttaatttaaaaaaaaatcattaaagataatagtgcaataaataaaatattctttcagttaaaaaccaattaattttatctaaaactttatgagtaacctattttgccaaaatggataaaaaaataagaattttaaatcataaaatttttttgtggtaatgataattgaccttggcataaaaagcaaaaataaaagaatataagcaaaaaggaaaaaaatatacaaccaaagaatggcgacaaaattataacgaaatttctaacaaaattggaataaaccgtggaacaattgaaaattggaagaaacaatttggaattagcaagaaaagattaatggagaaagaaaaaatggaaatccaaaaatgaatgataaagaaattgcaaaagtgttgaaaattaatagaaaaaacattcaaaattggaaaaaacaatagagaaaaagaaattatttagaagagcgagaaatttaaataaaatcataatttaatttatttttgtcaatttttttccgtgcagggccgtttcgtaaaaaccgccaattttacagatttttctgaaattttttaagctaatagtaagatatcaagattagtttttaggttgtgtttaagaaaagttatgacagatttttctcgaaaaatctctaaaatttgccgttttacgaaacgcacatattgacatttttttacgaaatgatctacactatttttttttctatatataatcatttgaatttaaccacctataatattgtgtctattttaaaacatgacaaatctacacaatgttatttttgtcaaaattccgtataatgtctattagctatgagacaccttactcaaccggcaaaaaagtcgacttggagatcgaaatttcggcgaacgcccgaattgagggcaattaaaaataacacaataataagaatatttttgctaacaaaatcaaaaaggataaataaatatctgcacaaaaacaaattagatttaaaacacccagatctatttaaaatcatgtgaaaattaataagtcactaaaaacctaaattaataatttgagttattttaaaaaattataaataaataagcatttttaaaagaattaaatataatttcacgagaaggtccattgattgaagtacaaagcaactaaaatgttaaaaatttataaaaattatatttattaaatttaagaatcatttttgcaagatttttaatcattgccaaaaaatttttctgacgaattgtccactgacggattatccatgacggattgtccattgctaacggattgtccttcactgacggattctccggaccctcaatgaccgcggctccggacaatccgtacagaggcatccgtcagtggtcaatccgtcagcggacaatccgtcagtaagtggacaatccgtcagtggataataatccgtcagtaactaatccataagcaaatttattttttaaatacgcagatctatttaaaatcatgtgaaaattaataagtcactaaaaacctaaattaataatttgagttattttaaaaaattataaataaataagcatttttaaaagaattaaatataatttctcgagaaggtccattgattgaagtacaaagcaactaaaatgttaaaaatttataaaaattatatttattaaatttaagaatcatttttgcaagatttttaatcattgccaaaaaatttttctgacgaattgtccactgacggattatccatgacggattgtccatt

SEQ ID NO: 3452 - DNA, 3845 bp, Heterodera glycines
tttaatcagaaaaaaaatcatttaaatgcctcaaaaaaatgatttttttaatcaataaatagaaaaaaagaaattatttaatagaaaagaaattcttttaagcaaatggtaaggaggaaagaatatattatctttttttcttttttcaaatcaattttttgccgaagaccattagagagttgtgattttttcatgtgaataaaaggctcttaattgacttaacttaataatgtgaatttatttaagaaaaaaaaacataatatagattcatatttgaagataatcccggaaaatgaaattattgttattattctttttgattttaattctaattgccctaattagccctattggatcaaaagaaaaaaaactacaagaaaaatcatttgatgaaatatttggagaaaaatgggaagaaaaagaagaaaaagcgcaaaatgaacagaagaaacgggaaatcattagaaaatattttaaaataaaagagaaaatcaagcaaaaaggacgaaaatactcaacaaaagaatggaaaaaaattgaattaaaaataacgaaaaaattggggacaaatcgaaccacaatttatcaatggattaaagaatttggtcttcaaaaaaagaaaagttataaatcaaaaactgatgaacaaaaactcgaaattgttcaacgatttattgaaatgacaattgaatataagcaaaaaagaaaatattcagcaaaagaatgggaccaaaattatgccgaaatttgcaagaaaattggagtaagccgtgaaacacttagaaaatggaagaaacaatctggcctcacagtgatgattgttgagtaggacttcgattggtagttcgaagttcaaggctttgatgccttgccgaactatgcagctttctgcacagcatatttcgaacttttggatttcgggtggcactgttacgacgattcctttcgtgtaacaagtgaggccacactcatcacatttcccgattgggaaaccacttgcaaatggaagggcaagtgtcaggagggtcatagccaccactggaagcatttccagtagtttggcttttcttctggtgaccatttggtgtcccggctctcgagcgagcttgggatggttttcatttggctgttcagttgcagcaacagcttcagttcctgggtccgtcatttcaggacccgcttccaaagggaagatgcggttcactggacgagtaaggactgtctttcgtggcatgtcctttggtttcctgttgttggtccctcggacagggatttcaactttaacacttcggatggctccaggccgtccgtgtgtttcaacgattcgtcccattggccattgattgcgaggaacgaggtcctgagagattaggaccaccatccctttcttcggttcaccgaagttttggagtcgtgggcctttgtggtcccactgggctctttctctgagtaatgttaaatactcagagtgccatttggcccagaaaatgtcgttggcttcccggagtgcttttattcgggaagctaaacgtttgtgtgtggaggaaaacatttcctctgaatcaattgggtccgttgttgtttcccaattgatatgaatctctggttgtaagagattgatgggacgcagtgggactggtccatctactgcgtctgagaccgcggtaatcggtctgtaattgagggtggcctccacttcggccacgaatgtgttgagttggtcgaaggaaagaatccttcgacccaaagttcgtttgaagcagtctttgactagcttcacgaggcgctcgtaaaagcctcctgcccaaggacttatttgggcaatgaagctccatttgattctgttctgagtcaggaagttttgtacttcctgatccggacccggagcactgagaagctccagggttttctgagcgagtttgaaggtcgtggcgttgtcggtccaaatgatgtcgggttttcctcgtcgacttatgaatcgacggagaacattgatgaatgattccgatgtgaggtccaatgttgcctcaaggtagacagcgcgcgtcgcaaggcatgttatggaagaaacaatttggaattagcaagaaacaaataacggagaacgaaaaaatggaaaaaatgaaaatttattggcaaacaaaaaaagaaaacccaaaaatgactgacaaagaaattgcaaaaattgtgaacacttctcaacagaatatttccaattggaaaaaacaatttgtggctgaataaaatcattcgattttagaattaacatgaaaacttttttgataaattttataaaatcatttaggtttgctgtttttttcaaatgtcgtaaatataccgaattattaaataaatatttaaatcaaaaaatcgaattttccgagagaattctaagagaggcttttggagaaataaataaattaaaaactgataaacagaaaactgaatacgaaaattcattaaagcgaataatgaattcaggcaaataataaaatattcaaccaaagaatggcgacaaaattatgccgaaatttgcaaaaaaatcggagttagcctttttctctaatgagttaattttttttcaaaatttttccactttctccttaattactccgattttaacccatttgtgctgtcttaattaatatataatacatacatgattaaatttggaagttgattccatgctggaactttcattttataaaaataattttatcaaaaaaggaccaaatttaatataaccaaaaaatgtattagtttgaaaaatagtttttaattaaaaaaatggatttgtatagaaaaataaaaatatgttggatttttgattatttatcgttttaaattgcgaaaaagcattcgtttttctgatggatcttctcaaaattacatttttcccatttaaaacactccttttttgactaattttcaagggtttcgcaataatttatccattaatttgcggataaaataggtataaaaaggtaccaataattgttcaaaatgacaataaaaacaagcaattttcaataaaacttattcataaattaagaaaatttactttttttttaaatgagcaccttaattgaacaattttgaatgcttatgcatagctttgtaaaatttctgatttcgtagcccatggagtccacaagttgttaattagttaattacacgtaatgaattaatttaatagaataaaatatgaataaaattattattatttctttgcaattaagtaggatttccttcttttatttgttaatcaatagaaataagatctttttcaatttttaatcagaaaaattcatttttattcatttatatgcctcaaaaaatattacgataaaattgtaaaatttcagcgacagttccaggctttatttggcttgaagggtgtgcaaaaacccatccaaattttcagttgtccgtaactgactttggtttaaatttaaattttattttttcttaaaaattttacgactttcgaataagcatttaaacattattttaacaatttgcaatttattggtaagtggaaataaaattattaatatttttattaatttttctttgcaattaagtagaatttccttattttattcgttaatcaatagaggtaggattttctttcagttttttaatcagagaaaattcatttttattcatttatatgcctcaaaaaatgaattgcgatttaattgaataaaaaaataaaatcattttaagacgacaaaaaatgaaattattccaactattatttttatttatcaaagaaaaaaattaaaaagttttgacaaataaaaaagaaaaacaaaaaatgaatgacaaaaaaattgtaaaaa

SEQ ID NO: 3453 - DNA, 2830 bp, Heterodera glycines
  misc_feature (2682)..(2682): n is a, c, g, or t
  misc_feature (2701)..(2701): n is a, c, g, or t
aataaatgtgattttattttatttttcatattttaaaaattttttcgaacttttgcatccgtatgaaatgacatcaaaagggttgtacagaatttgtggcgaataaaacaattcgaatttatttcggatcttctgcattctttcacaaatgcttggcgatattcgctactaaacatttattgctaaattaaaattttaaatttaaaggcttacctcgtccaaaaaagaatcggcgcatttgaaatgcaactaatgtttaacaaaatgccaaaaatttgattttggttccaaatttcaataatatcattgttcaacaaaggaattatcatggtaatgtgaatcaatttcaaaaaataaccgccaacattaacagaaattataaaaaataatgcacggaaaatgcgaatattcaattgattggaatttgaattgggctgagctgaaaatatttaattaaaattgtagaattaaatttattcaaacaattaaaatcgtcttttctgaagtaaattaaaatcgtaacaagcaaataaatgagaattgttgataaatatatcatattcataagcgtaggcaaaatagaatccgtcaaattgctgctgcactgatacttaattaaacactaattagaaaacaatttaaaattattttttactgaggctattccaatgtcattcattgagccagtgactaacgtttcgccagcaacatcacaaatttgtgaataaatataaattacattgattagaccaaagatgggcagaaacagtgcataaattaaaatactttttgtttccctaaatgaattttaaaaaattattaagttttatgtttatttatttgttaccgtaatagaaaaagcacataaaataaaaacaaaaacttcattaattgttgttgcctcagtcattcaaaatttaattcaaattttaagttaaattgcggaaaaggacttcggctgttaaataaaataatactatttgtttaattaagattttagttttcataatactttttatgtacaataaaaaatattcccacgcaaataaaaggttgaaatacaattcaaatgtaatgaaagaaatgttgagagtgaataaaagatgaaaaaatttgtactttctgttgcacggcaatggtcaattatgaatacatgaggaatgatgatttgcacaatgaaatatgaaatgatgattagaaaatgattggcttttggtaaacttatatttttataaattttaggtacttttttgttcaatttcgttagcacctgcgtggtccagtgggttgtgctcattttttggatttttggaaattgaatcaaaatcaaaaaaaccaaaaattggtctcaaaaaaattcaacgattttaaagagatttttaagcaaataagaaaaatttttgaaaaaagtctcgggtttttggggtctcggggtcaagtctcggtctcgagtcttgggaccatggcattttaattctaataaaagtgattttattttatatttcatattttaaaaatcttttctaaattttgcatccgtataaaatgacatcaaaagggttgtacagaatttgtagagaataaaagatttcggatcttctgcccttctttcacaaatgcttgacgatattcgctactaaacatttattgctaaattaaaattttaaatttaaaggcttacctcgtccaataaagaatcggcgcatttgaaatgcaactaatgtttaacaaaatgccaaaaatttgattttggttccaaatttcaataatatcattgttcaacaaaggaattatcatggtaatgcgaatgaatttcaaaaaataaccgccaacattaacagaaattataaaaaataatgcacggaaaatgcgaatattcaattgattggaattcgaatttggcggagctgaaaatatttaattaaaattgtaattaattttctaaactaaattgccttttctgaagtaaattaaaatcgcaacaagcaaataaatgagaatgcatagattaaaatactttttgtttccctaaatgaattttaaaaaattattaagttttatgtttatttatttgttaccgtaatggaaaaagcatgacatcataatcattttgtaatccattgtcccaatcaccaccccctaatcacatatgacataaccaattgttgccttgggggcggtccctttaatccaactcttttccctttccccactctcccccacgttcagtctctgtcccgactgcgaatcgggaagaggcggtccatccaattgtataatactcttgaataaatgattgttaacaacaccgctaccaatttgggaatgataatggacccgcctggatcctcagtattcatggaggtcccgccctaaggacagagactgtatatgtacatactgtatcatacaaaattttttattaaattaattactggaaaatataaaataattataaaaattttttcaacaagtccagccaatgcaaaagagaaaggaagtgaaattaatggaaaataatgacaaaaagtgagagagcgaaattgtaaggaatgaaaataatttaaatgccggaatggaatttaaaaaagcaagtgtttaaagcaacaaattgccaatggcaaacatccatcattgccaagactcaaacaaaggactccgaaacaggctaaaaaaagacangaaagggtttatcaattanattttgccgatgagagtgctcacaatagccaatgatgaggcattcttacgagccccagagcgcaaagagtggccaaaaatggttttttgttgggcaacgaatgaatcgccgaaggcatgctgagtgaaa

SEQ ID NO: 3454 - DNA, 2086 bp, Heterodera glycines
actgtacattttgatcatgcttattctcggcattatcaaagtgacaaaaaaaatcgggtgtgtgtttttattttttggctcggaaataaaaaagcaattttaaaatgattttttagtcgcatttgttaatgatcaccgaaattcgtcaaatgtgacgagacatgacgaatcatcagcggcgatgctttcatcatcagaggcaccacattcatcagcggcagcgagttcatcaacagaaaaaaacatttcaaaagaaaaaaatatacgtaagtgcgggccacagacaattggacagaaatggaaatatggacagtgaacaatatttaaaaaattataaaaggcattagcaaaaaatgatataagttttttgaattcttagaaaaattggaatttttttaagtaagctcgacggttatttgataaaaaatgactaattaacatcattttttaaatttttctgtcaaagtgtccggattcttttagtttccatgagcttgtttctatttctgattggcaatgaggggatataaaaaaataaaagaaaatttgaacttttttggttggcttacacgaaaacgaatgttaattttgaagaaaaacagaccattcttaggtcaataaatgctacaaataacaccttaggtagatatgacgattttgtgaaatttaagaagcattccaaaacagattttctttcctttataaattaggtttttagcaattttcttttctcagtttttaaacccactaaccaattatctctcattaagaaataaaactcttccaaaagttgagcaaccgtcttgctgtttccaaaggtcaatgtgcaatttgtttgggtgatttagtggatttagaggccaacacaactgtaaagcagttgccgtcgtgtaatgtaaataagctttaaaccttttaattatttaaaactaatgaataataaacatcagcatgaattccacaacgtttgcatggaactatggtaagtaatgcatactgtagtacaaaacgtatttgttcaacagaaatttaaacattaaaccaatgcttttatgcgtaattaaggctcctaaccaagggcaattgtccaatatgccgtgccgaaatttttgtcatcaagaatggcaaaggtaagcatcctgcataaaaagttcgaaaacaggttgaataatcccgcatgcaataaaaaggaaaaatacactgctacgaatcgacccaaaaatttctgaaaatacttcgctaataaatgaaaaattttctcaaaaattcttctccaaaatttattcaattattttcatgataaaaattttacatttaaaaattatatatctcaatattgatttggcttaatattgttgacttttgaataaaattttgccattttacaccctaaatttgaaactttttagcagctattttcccatttttagcacctaattttgggttttttgaaccgaatttactgtccaaatgtccgattacgtttgaaagttagaagaaatacggataaaaaccgggtacccgaccgggccaggataccccgacttttccaagacctggcctcagtacccagacccgactttttgaaatccaatacccggtacccacccgaactggtaggtccgagtccaaccgggtcgaaaaatacactgctatgaatagggtttttgattgtttagtaaaattaaaggaaagaaaaatggaaaaattattattacttatttcaaaaactttcttgctgttgtggcctagtgttattatctttagtatacaaagttgactaataaagattctagaatttttacaacatttccgaaagaaaattaaaaattttttttgataatactccgtcatatgcccttagcctgagacgccccttgtgcatatgtatgatttggaaaatattattgaaattttttgtgccttctggagttttttcaaaaatattattttatttgctatcgaatgtttaattacaaattcttttgtaaaatttaattattttttaattataaataatttttttgaagaccccagttggactcggtatctttactagtgtcgagagtctcggtctcgggttgta

SEQ ID NO: 3455 - DNA, 1701 bp, Heterodera glycines
  misc_feature (1610)..(1610): n is a, c, g, or t
aaatttgcaccaaattattatattttttcctttcaaccattcaattcaaatgatatgtttttgcccctctcaaaagagagagacgacaaaagaccaacgccggagagcaatgatcaggcaaattttggtgaattgtcctagcctaaagcgctaaggcagggactttagggctgattggttaataagctgaacagaaagtgattaatgagaaaatgtaaacgaataattagtggccagtcacaaggtcacacggttggccaacccaaaaataaaaataaatgcaagctaattaagctaattaagaaacaatgtgatgtgcacaaaataaaaaaggatgattaataaatgtgacaaaaaatgtgattaacaaaaggatgactaaaataaaaggggttcagcttaacctagtcagatcattttcttcgactccaatcgtcagcaaaaatcattctaattaaaaattaataataattataaatcacgttttcgcacaaaatcaaatcaaattaaaataaattaaattaattaagcaaatccaaaaacaaacaaattgcactcagcacttattaaagcactttctacaattgtcgacaaatcaagcagtttcaaacagaagtgggccgaacagaagtgtgccgttgtgtcaaacagaagtgtgccgttgtgtcgaacagcagtggccgttgaaaacgttggtgggcgaagacatttgaataattatcaaaataaatacataaaaattgtcaaaactgagtcactcatcagtccctgaatatttggaaagcaaatttaaaaataaagatcaaagcaaagccgaaagggaaaaaaggacaaaagaaagagggttaaaaaggagagaaaaagagactttggaaagtgaaaaagataaagttcacatcggaagaaaaaaacaaaaaatggtggatgttgatgatttagaagtgaaatttgaggctttaaaattaaaggtgaatgatttggaagataaattggcaaataaaccggcaacaaatttgccagcgggggtaaaaacaccgaaatatgatgctacaggcgaccttttcaaattcttacgagaatttaatttaatggccactgccagcaattggcatgccacggactgcgtccgaatgttcccattattccttgagggagaagccaaagagctttttctaaatattccgccagataaaaagaaaacatggcgagatttaacaaatgccatggcggatcaaacaaaaaagattgacggtccaatgtgggcaaaaaaattgttggccagagcaaaaatgggccatgaaagcataacagaatatgccaataaaatacgtgagttggtggaacaggcttcccccgacccaaattacacgagcgaggcccgagaatgtgagagtgtgcattattttttaaatggacttccgactttcctaaaaaggaaaatattttttatgaaaaagccaaaaacgcttgttgaagcaatttcaatggctaaagaagttaatcaagcaagggaagaacttgcaaatgatgaaaagggagacgaaattaaacagcaaataaatgagataagggagcaaataagtgtaatttcgagtcaaaataatgggaanaacgaaaatcaaagagaatttgttaaccgttcttggcgtaacattttgaaacggaaattcttggatcgtggagagaaataatacagaggag

SEQ ID NO: 3456 - DNA, 2847 bp, Heterodera glycines
  misc_feature (84)..(84): n is a, c, g, or t
  misc_feature (114)..(114): n is a, c, g, or t
  misc_feature (2754)..(2754): n is a, c, g, or t
tcccgaaaaacgaaaaaagcagcgggaaagtacagtaacgctttttcttcctattcgagatccaaaaaaatttctcagttatanaatgttaccaaaaactgacaaaaaattgcnactggcagtctcttattcttttggaaagacataaaaagccaagaaacaattgttaaaggagtaaattttgaaaaatgtcatgattttaaaagaaaaattgatattcttatgaaaagaaaaaatgaaaatttgtgggctacggataatcccgaaaaaatcgaatatgtttggtcaggagaaaaatgtacaacaacaggtcaataattttattgaaaaaggacatggaggaattttggatttttacctcattacttcttttggtcataaaatgaatccatacagaggatgggaggaaatgaacagtcaaacatttatttgggagattcccgagccaactgacacttattgggccacccactttccagtgggcaattttcttgctgaaattacggatgatgcaatagtgattgagagtgagcaaagtgtgttctatttcgaaaaagaacatccggaagaaagagaaggaattattggcataccggatgacgcttttaaaatgacaaacgatgcatttataacaattcaagtaaaacaaaaggcaaaaagagaggcaaaacaaaaaattgagcctaagaaaaaagagagaccagtaaaacaggaggtggtatttttcaaatttcgacaaaataagggaaatgagagtgttgtaaaccctaccattcaaattacaagggaaccgaacattagccaagaggagattaaaaaagaaagagaaaatgcgaaagaaattatttcagaaattccaacaatgcctaaaccggaccaaccaaaagagaccaaaattgcggtagcacctacaaattttcccataacaactacagtaagaaatgtactaactgaacagacaaaaattacgacaagtacgaccccaaaaacaaaaatggcggcagtaacaaaagcgccaaaaacggtgccaaattcaaaagttgaaaaccaacctttttcaaaaggttggatcaaattaaaacagaccgagcagaaatatatgataaaaggagtgaattttggaaaaattgatacaaccataattccggttaccaaaacagctaaaaatatggaaaataccacagcaacaacggccaaaactccgttaatgagttttactacaataaaaccaaaaaaggaaaaaacacccaagaatatttcgaattccgtttttgagaatgaaaagtcaaaacagggaaataagacaaaaacacagacaaaagggacaaaggaagaaaaacatcccaaaatggtaaaaattggcaaagaattagacggaaaaacaatgcctgaggaggaaaaagtcccaaaaattgtgaccaaccaaaaaccaaaagaaaaaggagtaacgaaaaacattaccacaacacaaacacctaaaatgaccacaataaaaacaatttcaaccacaactcctaaaccaaaagtggaggagataaaggcaaaaaaggcattgccgaaccaaaatacaacactttcaacgatttctgttacaaatttttctaaaaattctgaaaaggaactaataaaaactgaaacaattgaaattaaaaatgaaagcggagaaaaagacttacaattccgaaaattgtcagaaggcgatgaaaaagaaagtgacgacgtaatttttgaaaaagtgaaagacaatttagaaaatgaaaatgagtcagatgagtatgaaaatatggaaaattctgcagaaattgaaaatgaatacgaattggacagaggggaaaatcagtttgaatttatggaaattgagagaaacaaacgaacaacaattactaccccagacgctaaatggctcagtaagcttaagaaaagcgaaaaaaggataaaatcagggcaagagaacaaaaatttaaatacgcgtgttaattatgcactttaccgactaaatgaggacagaaagaaacagtacgaaaatatttttctccaagcctgtgaaaacacaaaattccaattacaacttgcaaaggcaatattacaaataaacccaaatgagggtgtacggaaaatttttgatcgggatgatttagtcgcccgatgggttggtgaaaatttggaagttgggttttgtgtgccaataacaccggaaaaaatattttggagcaaaaaaattgggaatgagtgctacgaatggacgccaattttggcagaaaatacaacttttttcgtaaagccagggtcccgggaactgagcattttgggtaagaaagttggctgtgccgaaatggaagaatatgttatgaaaaatgacacacaaaaagaagcaataacaaaaatcagtacaaattttgagaaaatccgaccaaaatacagaaacattcaaaatcctttggtcttaaaagcaggaactctttacgagtcggaaaccaagcgaattgaaacagcaatgttggaatacagggcaagaatgaatactttaccttctgcaactctgcgtataattcaaaaaccgaacatttctgaggtcataaaagtaatcaaagaagaagcaagtgaaaccatggaaatagtgatgggaaaaacgggaaattggttcgaaatggttaaaaatatcccagaaaaagcggaggaggcagtaaattatttaaagggcgcctcatttttgcttattttaatacccattttaattttgttggcactaattgngtatgtgatggtaaagtaccgattgattatttttgctggttttcgcgcgggaagattcttaacagaataattggacaaataattgaatgaaaa

SEQ ID NO: 3457 - DNA, 1352 bp, Heterodera glycines
  misc_feature (42)..(42): n is a, c, g, or t
  misc_feature (74)..(74): n is a, c, g, or t
  misc_feature (94)..(94): n is a, c, g, or t
ttttcttggtcaaaaaaaacgagcaacaaatgtcatcccganccaagcaaaatgaatggatgatcagagaaaancaacaaaaaaatgacaaacntcagaaatcacacattttcatcgcacaaaattctgagttcaattttgcgttggttcgctaaaattaattaaataaatggtaaaaatttattgtatttcaaattaaaataaaccgttttttaatgaaattatgaaagttttgcgcgacaaattggacaattgttgttctgtttaaccctaaatttgtaaatgttaaagttaaagaaattaattgtcctttcatttaccaaaaatcaatgcattccgagtgaaaattgtgctaaatgcaaaattagtatttaagtatagtttaaataaatcagcaaaatagaaattgcggcacaattacaattatttatgcgtccacctcaatacggcactcagtttgctatgttccgattggcttatatttgttatgagttatgctttatcattacatttcggatagcgaacaattggaaatttattcggaatataatttgtgtgatatgacgggtaatttggaaaaacaaattaatataatttaaaaaaagccttaacagcaattgtgaggcattttgtaaacactcaaaagattaaattaaaatatttaaatgcgatttgattgaacgcataaaaaaatgaataaacgcataaactttacagtagtaaagctgaaatctcaacaaaagaacaaactttcaacaaattaagtgcctctgctacaatagccaatgttactaccgtatttcatctacgcaattcctaccataacttttgcgttgacaaatttacaatatttcctaccaaaatcacttcgtacattagcccctattcggcttaaacattcacctgacatggcggaatctgacgaatcatctgtccctcctgataagcatccaagcaaatcgcacattcgtctccgttggccttaagcatttcatattgagacaaacgactcagagccttcgtaacttaaaatgaattacgaagcaacttccaaaaaagattttataatattccaatattatcagacaacttatctcggtaaaatatcagtgctggcacccatacctatttgattaagaatttttatgcctaagaatagaaatgaaaattttgaaaatttacggaccaataagctaaaaattttgaaaataatcaaatatggtttttaaaaaaaatacaaaataaaagttaaaatttaatatgtttttcgtgcgtttcaggccttcgatagtccagcatttccgaattgttagaaccaataaaataaccaaaaacccaactttttttgaggc

SEQ ID NO: 3458 - DNA, 1564 bp, Heterodera glycines
  misc_feature (15)..(15): n is a, c, g, or t
agcttctgcttaatncatcgcttttaaacatcaaaagcatttgaatgataccaagttttaagaaattggccgactaaaaaagttatggccacatcattttaaaattgtacgagttgcctttgtacgagttgccattgagccagtgaaccctccgtattgaaaaggtgtatattaaatgtaagagaaagcgtaaagtgatcggacaaagcattggtcacgaaaggggcggaaataataaatatgaaatttactaaggaaaatcagaacctctcttacattatcaacaaaaattgcttctcaacttttatcacattcatttgtatattaagaaggtttttaattcctattatataaaatgtcagtgttttcgaaagaaacaacagattatattccacaaatcatttgaatttataacgctcggatcaatcgtcggttccttttcgttaagccccaacttttgaaacttttgaaaatgagatggtagacttatttgaagacatcgaattctgagaagttgaaaactgctggaaggtctgatgagttcatttgactgattggtccaagttcttacttaattaattgctgctttttctgaaggtccccgttttgcattgatttcacttttaattacaattcagaaaattctggtaaatgtccaatgggtttaattgttaaattagttcaaattttccgcttcatttctttatttggaattgttagtgatcacatttacttgaggtcatcagtatcaattcttgtaaaaagaaatgatttttactttccaaaatttgcacaacaataaaaacaaaatatttgctgcaaaaaggactaattgcaagaaatttacatttttttgtgtttttttttcttctttttcatcaattttatttatgtaaatttgaaaaaaacaattctctagtcagtatacatcggaaaagattttagttaaaatgagtccctttgacaatacaataaacattccttggattttggcaagcttattttttgattttggtaaaatttacaaaaaattattattttttatttttctgaaactttttttttgttatcctctttttttcttgctttcttcatcattctcctctctctgtcggcatcgtcggactcaattccctacttttttttttaaatttgcacaaaaagccacaaaatgctcattttttgcataagatttattaacaaagcgaacaaaattttaaattaatccccagcgtttctatcggcaccgtcggctcaaatattgttgggttaaaatgctttgcttttttggttcactaatatgcaaattgaaagttagttttaaaaatgtgcttattttgacaagctcatttcaaatacaaagtaaaaaattaataaaaataaatgaaaattcatggtaaaatctacaaattttgaaattttaaaacatataaagcttaacgacggtatcttcgtataccttcttgtagcccattctttctttctacaaaatgacttcgggggcattcatacaattattatacactcttacataaacaataattgtttcattctgatcagccag

SEQ ID NO: 3459 - DNA, 3844 bp, Heterodera glycines
ttaatcgcttagcttctgcttaatcattcgtttttaaacatgaaaagcattcgaatgataccaagttttaagaaattggccgactaaaaaagttatggccacatcattttaaaattgtacgagttgcctttgtacgagttgccattgagccagtgaaccctccgtattgaaaaggtgtatattaaatgtaagagaaagcgtaaagtgatcggacaaagcattggtcacgaaaggggcggaaataataaatatgaaatttactaaggaaaatcagaacctctcttgcattatcaacaaaaattgcttctcaacttttatcacattcatttgtatattaagaaggtttttaattcctattatataaaatgtcagtgttttcgaaagaaacaacagattatattccacaaagcatttgaatttataacgctcggatcaatcgtcggttccttttcgttaagccccaacttttgaaacttttgaaaatgagacggtagactgatttgaagacatcgaattctgagaagttgaaaactgctggaaagggtctgatgagttcatttgactgattggtccaagttcttacttaattaattgctgctttttctgaaggtccccgttttgcattgatttcacttttaattacaattcagaaaattctggtaaatgtccaatgggtttaattgttaaattagttcaaattttccgcttcatttctttatttggaattgttagtgatcacatttacttgaggtcatcagtatcaattcttgtaaaaagaaatgatttttactttccaaaatttgcacaacaataaaaacaaaatatttgctgcaaaaaggactaattgcaagaaatttacattttttgtgtttttttttcttctttttcatcaattttatttatgtaaatttgaaaaaaacaaatctctagtcagtatacatcggaaaagattttagttaaaatgagtccctttgacaatacaataaacattccttggattttggcaagcttattttttgattttggtaaaatttacaaaaaattattattttttatttttctgaaacttttttttgttatcctctttttttcttgctttcttcatcattctcctctctctgtcggcatcgtcggactcaattcccgtacttttttttaaatttgcacaaaaagccacaaaatgctcattttttgcataagatttattaacaaagcgaacaaaattttaaattaatccccagcgtttctatcggcaccgtcggctcaaatattgttgggttaaaatgctttgcttttttggttcactaatatgcaaattgaaagttttttatcgagttttaaaaatgtgcttattttgacaagctcatttcaaatacaaagtaaaaatgtaaaaaattaatacaaataaatgaaaattcattgtaaaatctacaaattttgaaattttaaaacatataagcttaacgacggtatcttcgtataccttcttgtagcccattctttcttctacaaaaatgacttcggggcattcatacaattattatacactcttacaataaacaatatttgtttcattctgatcagccagcccttagattcgaatcaaatccacacagtttcgctcatccactctctgatagccgggcaaacagtcgcatttgaacgagcccggaagatttatgcaaatggatccgacgccgcatccaccgagctgttaaagccattttaattttattttaaatgaatttcttttaaatacatttagaaagttatgtattttctcttaacagaaaaagctcttctcttaatcgacgagtgacctaattatttaattgcctaattacctgttttttaattggttcattaccggttctcttaattggcttctcaacattgtctattttttattcgctgattgcctagtctcttaattattagctgtatttttaattggttcattacctgttttataattggctcattacctgttctcgtgccatttcgtcccacaggcattcgtccacatcgtaacatttgctgccgttcccgaaaaagccctaaaaattctcccaataaatagcgttaatctgtatcgatgaccattttgcattgacaaattggcgcatggcgtcccgacaaacatttggcgttagggtcacaaattttacgctggctgtcggcacaatggtcgacattcacacagacggggcaacaatggttgggcaatgtctcttgctcggcacagtccaacgggggacagagcgcggcatttctaacagtgagtggtacggtagtcacatagttacggtaagtaacgttaaaaaacgtaaattacccgtgcaccgttcgaattttatttaataaaagccggcaaattatcggccggtttctggtaaaacctcataacagatttgaaatgttaatgacccaaataatttttttaaatgataatttagcgctaaaaccttctaaattaataattggctcaagtctcagtgatcatttgccccaattttaattcactttggtccataattagtgtggcatatttgaactcgaaattcagaggccaggaataaattcaatttcaaattctcgcgaattcttcacctgaattcgcagttcattcgtccgtcgctgcactggcaaaatacgcacgactttggccaaaaagaggccccactttcgtatgtttgaccattgtaaaagcactgaaatttaaacttatagccaggccagatttttctggctaaacctctgaaatatggggaaccgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgacccgaaatatgcctaaacaatttattattgatagagccaattggctctaatatttaaatattacctattcatttctaaaaaaagccaaaatatgtgaaatatgcatttttgggaaaaaatttattttatgcgccaaaaatccctttaattgattattttccataaaaatgcgaattttagcttcttaaacctattaaattaaaatattccaggtttatttttcatttctttgaatgaattttgtcagtttagcttctcagcgaccggaatgatttaagatgatttgaaagtttttaccagaaaattttgcaaggcttttctttcttcgccatgacttgcttttttaaatcgtctctttcattgagtgattttttttttcaaaaaataaaatttttaaaaattataaattccacaattgagatccggtttacatgcagtcttggtgttcaatgttactcacttttttcccacaatcgggacaacatttgccctcccgtttgatcggatgggcacaattcaatggggcacaaccgatcgggccgcactgcgcctcgccatccatgccgcagtggcactcacgacagtcggccaactgctggacgtgctgtcctacggcatgccatttaccattgatctgtgcgaaaattgatcagttagtgaattttactgttcaaattaagaaaaaaatatagaga

SEQ ID NO: 3460 - DNA, 788 bp, Heterodera glycines
aattagcgcattaattagggaagcgacgaattttttgtgccgctatttgcaataaaaggttaaattgaagtggactctttcttgctcgtctgactttgcatcccctctggtgcagctccacccgcttcactctgtgctcaacgcgtgccaatgccgcgtcccaacggttcagtcgctgttcaatgcgcaaaatccgttcgtccgtcgcatcgtttacatttgttttattcctttgcgttggtgccaaaattgacgtgtttttgtgcccgattttcatcggattgccatcagcgacccgagtttcgagatgggcacaaagctgctccaacggcttggccgaactcgagacaaacgaacgcatttgcatgtgcccccctccatggccattttggggcgccgatttgacaccgagcaaaacattcgatctgccgaatggaagagacctggacaaaagcgtacaaaacaattcaattataaattaattaatgccaaaacctatgcatttatgatttgtaattgacattaatattatggactcattaaatgtttataattctgcttaatgatgctattataaactaaaaatactactattaaaatgatttaccatatttgcgaattgtcatcgtcctcaacccaaagtaaacgatgacaattctgtgctacggccaacagtttcccgtcaaatacaaaagtgattttgtggaattgaccatttgaggtcaaaaaaggagtttgcagagtgattagtttatgtcgaccatcgatcaaacgaaactcgagaataa

SEQ ID NO: 3461 - DNA, 1606 bp, Heterodera glycines
ctttgcgttggtgccaaattgacgcgtttttgtgcccgattttcatcggattgccatcagcgacccgagtttcgagatgggcacaaagctgctccaacggcttggccgaactcgagacaaacgaacgcatttgcatgtgcccccctccatggccattttggggcgccgatttgacaccgagcaaaacattcgatctgccgaatggaagagacctggacaaaaacgtacaaaacaattcaattataaattaattaatgccaaaacctatgcatttatgatttgtaattgacattaatattatggactcattaaatgtttataattctgttaactcttaatgatgctattataaactaaaaatactactattaaaatgatttaccatatttgcgaattgtcatcgtcctcaacccaaagtaaacgatgacaattctgtgctacggccaacagtttcccgtcaaatacaaaagtgattttgtggaattgaccatttgaggtcaaaaaaggagtttgcagagtgatcagtttatgtcgaccatcgatcaaacgaaactcgagaataatcttataaaaataaatttatttcatcgaattgatttttttaatttggcacttcatttggcgttgtgatggttgagctttcaatgcgaaacagtaaattttggtcgccatctttgaggttgaacaaatcgaattgagtgaaatttgattgtcgaaagtcaaattcgagggataaatttcttgccataaataattcagtcaatttagccgacttaaaaaataatttaattttacaatataaaaataaaaaacatttatatatacattttttaatcaccaaacatttacaaaattaaacaaaaacaccttcaaatgatccaacagaaaatttccgcgtccaaactgagcagagacaacaagaaatggaagaattgataaaaaagaggccatcacgttaaaaagggattatgtcttaattcattctgcctgatttaattaattgttttaatcacttcacattttattttaatttggagcgaattttggcagccaattgctttataggacagcacacaaaatattaattggccacatctgtcggctgctgatgatgaatgacagcagcgaatgtgttggaaaagcgagaaaatgaaggaagggaaatgagggaaaagccgtcggagggataatccggcaaaagcatttcgccggaggcgaaaagccgcggcaaatgcctttggggcgaaagattgacacacgacgggagaggaaatgaatggaggcgactcggggaaatgtgccaagagaaagaaatgcgccgattgaaattaaaaattggataacggacgataagccgaataaacatggaaaaagtgtggtcgaaaagaagtgagatttagtgacgccaataataaggcaaataaataattagcaaattcatttattaatttcgtaacatggacaagcagaacgacgacacatcgtacgagacagactttttcaaaactaataaagtacaaaaactaaatgggaaatattacaatatttttattcttgaaaatgtattaatgaaacttcaattttaaataagatttaaatgattatt

SEQ ID NO: 3462 - DNA, 1545 bp, Heterodera glycines
  misc_feature (278)..(278): n is a, c, g, or t
ggttatggtgtaaatatgattttataataggggccgaaatttcactttttcacccagcgacacctaaaccaacaattcatcttatgtcaaaatcgcaaattttgtcattgtgtaaatctgtaaaaaattgcactcaaatttcaaaattttcccggcggcgcctacgagcacagccggagaaaaacccgttgataaatcaacaaaaaatttacgatggtgtccagggatggcgttcctaggaccctcaaattttaggaaatcagaattccgtgccatcncaggtggtgtctatcggcatcaccttacggttccttaaaaatttttacgacgaagcgcaaaaaaaaagtaaaaagttttttggagattttttaatttctcgaaatttttcgaaatttccaaaatccctgggatgccgcagattttaaatgcgggacttgcgggattaatctcacgggatcacgtcccgctaaaaatttctgagttccaatcacgcagcgggatccgcaaacttgaatttccagtctctaatatttataatttccctcttgaaagattattttattttattatatttttaagatggctattctcctcccattcgaatattttgtggtacaaaaagtgtacacatttgcgcacaaagtgccacttgaaaatttgtgccaaggaaacaaccaatgcattttaaattattttgaatcatttactcagaaagaaaacgaactttcaaaaatcattgaccgttggtttaatgcaaatgaatttgcgtattttacagaaaaggttaatttgtctttaaattaaaatttattataaatttaggacaatttttttctgagtgctattttgaaagagttggtaaatgaatttaaaatcagtgaaaacaatggcaatagaattggtggggattatgccaatttgctcggcattttcagcaaagcttttattgaagaaaataacccattgatgaatattgtcaagttgagattggctgaagagcaaatgatcgacattatcagtgaaatgtgccaaacaatcaaaaagataccgaattctaaacagtttttgattgagcaatttaatgtatgcccttcaaaatgctcaataattggctttctttgcctattttgcatttttaattattatgaatatattattttttaaatagtttactattttttaaaaaacaattgattaaattttatagccaaattcttaaagtcaattaatttttagattctcgaattaaaaaatttctgtgataaatgggcccctgtacaccaaaaaatgttgcacttcagtgagccaaaaatcgctaacaatgcgcttgggcattggcttcggcaaaatgtcaatgatgggaaagaattggcggacgaagagcgacaaattgtcaatttttggatgacagttttgagctcaaaaatgcattacctgtgtagcaaatggatgccaaatgatataattatgctaacaaatattggttaattttcaaaattttcatcatttaataaatataaatttatttatttaggaaaattgctg

SEQ ID NO: 3463 - DNA, 1359 bp, Heterodera glycines
ctcctcgggactttgcgcaagtttcgccaacctgtcgcgatgcctcggccacagaaaacaattggccaatttgatactcctcaatggtcaacggcatgacgatgcgactgaaaaaaggaaagcgtaattaattaaggtgtcagaagaatgatgatgaaaaaagcaactcactattctctgatgagcattgttgctgaagtgcagtcaaaaggggaacaaagtgaagaaggagacagacgcttattatgtcagtaaaggacaaatgaagaatgattgtttctgcgcttaaatcgtcccttttatacaaacattttcctacccgtcaattccgtgtaaaaattctctataaaaagggatgaaatttgcgagatccactcattcttcgcatttgcgacttttactctctgctgaacaatttcttctctcgacgacactttgcgcattcaatccgagcacacttcttcacccatttgctagtcccatgtctctgcaatacgtcggcatcgctgcggtaatcctcggaagtaagtgccaaaacaattgttgttaatccatgttgatttgctgctaattaatcgccatttttcagctgccatcgctctgttccaaactgtgtcgctcagcaccagacgacaaatcgccgcacaaaatggccgaagcagcggcagcaaacgccaaagcaagtcgccgtcgtccgcaaaaaccttggcacacaaaatcgctgcgacggtcatcgctgagaagagcctgagctccatcccggacaaagaaatcttgcagctgatggacatcggctttcaactgctcgacgaggtgggctcagcctggatccgggatgaccagccagtgcctctgttaattcgtgccaccactgttttcaggagccggcgcgtgttgatgtgcatgccccttgctacgttttcggtgacatccatggcaatttgtcgtaccttctcaagtgggttttggactcgtcgactcggctttttaacatttcagcggcacttgcaaatccgttgttgttcaggtacttctccgacacccacatcgaaccgcagctgctcaagctccaaccgccgctgttccatttgctgttcctcggcgactacgtggaccgcggcgagttcagtctggaagtcattgcgctgctcgtctcgctgaagatcctcttctgggacaagatcactctgctgcgtgggaaccatgagatcgcggaagtcaacgcggagtgagtgccattggcgaaaagtgccattgtcgtcattcaattccccttttcaggtacacctttcgaagaagaactgagaacgaagcgaggcaagggcatgggcgattttacaaggtgtcagagctaccaaa

SEQ ID NO: 3464 - DNA, 3995 bp, Heterodera glycines
tgcttttgccatgccatttttttgctttcaattttcaattccttttccccctcagctttctgccgacatgaaacacattcacttcgtcacgctgaaaccgaaggctactggagagaaattgagccaggaagaatgacagacgagcggcggaaagaaagaagccccgacgacgtaaatgaagtgctgcatattcaattcgatcacctcccatttaatgatgttgaccattctcctgctgttgcccgagtagatgtgataaataattgctccgttttatgctgtccggatacatatttgaccacgtatatgtcattgttgtattatatgtgtatattgtatatatgtatgtatgtttttgtatatgtacttgttacaaaacgataaaaagaatgtttaacccgcaaaattttggaattccaatcccgcagcgggaccagggacggacgaagctcggcttggcactcgaatcgaagcccaatttttttcgaagctcgaagcccaaaaaatcgaagttttcgaagcacgaagtttttcgaattttttttatgtcgaaaaatatattcaagactaaattttttggcgttttgtcactattttttcactattcgacatttggaaaatttgttaacaaaaatgcaataaaatcaaaaaatacacccccatcgaatcgatctaaaaaaatttcaaaaaaaatacacccctaagaatcgaccaaaaaattttttaaaaatacaccactaagaattggaaaatgttttcaaaaattcttcccccaaattttttttcttgacaaaatttttgatttaaaatgtcaatatttgctaagagaattttataaaggaaatgtagctcatttgcaactgcaatcagtgaataaaaattattttttgctcaatttttggctaaaaattattggccaatttgatactcctcaatggtcaacggcatgacgatgcgactgaaaaaaggaaagcgtaattaattaacgtaattaattaaggtgtcagaagaatgatgatgaaaaaagcaactcactattctctgatgagcattgttgctgaagtgcagtcaaaaggggaacaaagtgaagaaggagacagagggtcggggtcactttggcgcgggccattttggcgccgcgaactttaaagtgttataacttttttcttatccaaccaaataaaataattttgataccattaaatagacctaagtgttctttattagcttgtaaaatattagaaaaaataaattctgtttgacaaaagatatagcgtgcggcgccaaaatggccagaaaaagtcagttttttgaggttttttggccataacttttttgtgtttcaattaaattttttgaaattttgcaggctattagggactatcaagcgctttaaaatgatatcaagcttatttaatttgaatgagaaataaaaatgttatagcgtttggcgccaaaatggctggcgccaaagtggccggttcccggagacagacgcttattatgtcagtaaaggacaaatgaagaatgattgtttctgcgcttaaatcgtcccttttatacaaacattttcctacccgtcaattccgtgtaaaaattctctataaaaagggatgaaatttgcgagatccactcattcttcgcatttgcgacttttactctctgctgaacaatttcttctctcgacgacactttgcgcattcaatccgagcacacttcttcacccattggctggtcccatgtctctgcaatacgtcggcatcgctgcggtaatcctcggaagtaagtgccaaaacaattgttgttaatccatgttgatttgctgctaatttatcgccatttttcagctgccatcgctctgttccaaactgtgtcgctcagcaccagacgacaaatcgccgcacaaaatggccgaagcagcggcagcaaacgccaaagcaagtcgccgtcgtccgcaaaaaccttggcacacaaaatcgctgcgacggtcatcgctgagaagagcctgagctccatcccggacaacgaaatcttgcagctgatggacaccggctttcaactgctcgacgaggtgggctcagcctggatccgggatgaccagccagtgcctctgttaattcgtgccaccactgttttcaggagccggcgcgtgttgatgtgcatgccccttgctacgttttcggtgacatccatggcaatttgtcgtaccttctcaagtgggttttggactcgtcgactcggctttttaacatttcagcggcacttgcaaatccgttgttgttcaggtacttctccgacacccacatcgaaccgcagctgctcaagctccaaccgccgctgttccatttgctgttcctcggcgactacgtggaccgcggcgagttcagtctggaagtcattgcgctgctcgtctcgctgaagatcctcttctgggacaagatcactctgctgcgtgggaaccatgagatcgcggaagtcaacgcggagtgagtgccattggcgaaaagtgccattgtcgtcattcaattccccttttcaggtacaccttcgaagaagaactgagaacgaagcgaggcaagggccatggccgcatttacaaggtgtcaagagctaccaaaatgaatgaatttttaatgtttttgttcccctttcatttcagaggtgcaacaagctcttcaccaagctgcctctgtgtgccatcatttccaagacgttcctctgcatgcatggtggcttgccgcggccagaaggatgggactttctgatgggtgatgacttccatgtgcgtttttcgtgtttccctgtcaaagcctttgtcatttccaatttctcacacatttttcagaagccaaaaaccgacctggaaatcgacgaaaacaacacattctgtgacctgctttgggccgaccccactaacaatgcgcaggagcttcgcctttccaaggattttgagccggacaaaggattcctcggcgagtacggcaactatcgctttaatcaggtggattttggaggactgctgacccagcattttgttgaccgcttttttaatactttactgtcattttcaggaccgcgagacttcaattcagttcaacgaccgctttgcgcaggagttcttcaaccgctttccccacatccgcggcatcttccgggcgcacgaaaaccaaccgaaagggcacagcatcaacgaggcgcgtacaatttgcacggtgttcagctcgcctcgctacatggaagacacggactgtggatctgtgctgcgggtgcgtgctgcttttgccatgccatttttttgctttcaattttcaattccttttccccctcagctttctgccgacatgaaacacattcacttcgtcacgctgaaaccgaaggctactggagagaaattgagccaggaagaatgacagacgagcggcggaaagaaagaagccccgacgacgtaaatgaagtgctgcatattcaattcgatcacctcccatttaatgatgttgaccattctcctgctgttgcccgagtagatgtgataaataattgctccgttttatgctgtccggatacatatttgaccacgtatatgtcattgttgtattatatgtgtatattgtatatatgtatgtatgtttttgtatatgtacttgttacaaaacgataaaaagaatgtttaacccgcaaaattttggaattccaatcccgcagcgggaccagggacggacgaagctcggcttggcactcgaatcgatgcccaatttttttcgaagctcgaagcccaaaaaatcgaagttttcgaagcacgaagtttttcgaattttttttatgtcgaaaaatatattcaagactaaattttttggcgttttgtcactattttttcactattcgacattttttggaaaatttgttaacaaaaatgcaatacaatcaaaaaatacacccccatcgaatcgatctaaaaaaatttcaaaaaaaatacacccctaagaatcgaccaaaaa

SEQ ID NO: 3465 - DNA, 1294 bp, Heterodera glycines
  misc_feature (1234)..(1235): n is a, c, g, or t
  misc_feature (1249)..(1249): n is a, c, g, or t
  misc_feature (1267)..(1267): n is a, c, g, or t
  misc_feature (1278)..(1278): n is a, c, g, or t
tttaaaaccatatcaaataaaaagtcaattcaccaggatcatcgaggtcagtgaaaatgacaagtaaatttgacggagattccgtttctgatgtattgttacaacaattattgcggcaggaataattcacaaaagaacggaccatctttaatagatttgtcattatttcggaaaggaattaaaaggatatcaagcgtaaagaagcggataaatcttagtttcgagtagatacaatgtgcatgggcttaattttatctcatttaaattaaaaaaattatttaatggcgttatgtaattaaattttttttaaatgcgaattccttctttcgcttttcactaaaatttacaaattctgctgtaactcaaaaagctttattccttcctggatatagcatatattttgtatgagtgcgcctaacaacagtccttcgagcatttcttctacaggaacaaacggaattcgtataacacgacagaggagcagtgctcgcattaattggctgaccgaactcaccacgcgcgattcaactccagttacaaccacccaaacttcaaagggttttgtgtattattcatcaaaatttgagctttaattttttagatttttctgaaatcagcaaacatttagcgctcgttgaggacgaagacaatattaaaaggattcaagcaaaacgagaaaaaggtttttgaaatttccattttaatataaaagacgcctttattgatttcagaagcccacgaacgcgcgttggcttttgtcaagaatcagttattgaactcgcggaaagacgactggctccatcaaccaatcgaagaattgcttggctacgcaccgaaatactaacggaatggcgaagcaatgctttgttactgttggcagtacgcgttttgacgctttggtcgaatctctgttccgtagcgatgttctcgatgctttaaagaaactgaaagttgaatgtgtgacaattcagaatggcaatggtgtaattcctaagcaaatacaatccgccaaattaaatcaaacgcaatgcatcattgacggaataacggtagtctattacggtaaaacaagtacatcattaatcaaatttactgtttcagtttcatttgttcgattacaaagccagcataagggagtatttacaaagtgggttatttaaacaccagcacgataatactgtcaatgccccttttgataagcgagtcccaatgaaaatagacatttcagtataannagtagttttctaantttaataatgcataattncgcaaacatanattatttttttaatcg

SEQ ID NO: 3466 - DNA, 5994 bp, Heterodera glycines
ggggggcattggcagtattacctagcagcgcttatattgtaattatgatattctaattcattaggtgcagaattaatagtgggacatgcaggggccggcacctgcttggaagcacttgagtgtggaaagccttttatcacagttgtcaatgattcactgatggataatcaccaagctgaactggccgaaaaactcgctgaagatgggcatcttctgtttacaactcctagcaaacttggagaaactttggtcaatcctaaattgttcaatcttaaaccccttgagcaagctgatcctttaatttttcgcaattttatggaaaatctcataaataattgttaaatcgtgcaagactaaatatcggaataaaaaatatatattgtgactatatgatcattattttttgtactaatttcaagtgatatattttaaccaaaattaaaatttgcattttatgaagtgacttaaacgtactgaatcttggtttaagaaaaataacaaaatgccaagaattttttagtaacagacgaacgacagacttttgctgtctctattgctgtgtgtttatacttttacttccttaacctttagggatttaaaattcattatattttgatctttgcagtcatttcatttgagcaaaatggcgtctaaagcacgaaaattcattgacgaagcggccaagacggtttttgaattttgaaaacatttgtaagactttctttaaggttgatgatgaagacccttttgccgagacaagacgaccaaaaatagctgaacgtcaaagtcagtatcaaagccgcgcccgtaaacggtttgttctttattgcgctgttaatagacaattgtaaaaaatggattcaacacggctactcttaaaatactacttttgttaaacaaaaacaacttttgaaatttcagggcaatttctccagaacgacatgacatgttcggtaggttatctttaaaattaaaagattataatatcggtttagttgaccaaactccggacgcgcgagaccgaacttacgcgcaaattatgcaagagcaaagatttctgacagaaaaggtccgttattttccgtattgtggaacctaagccagagatttagttttttagcatccaatgtaataatctgattgtgtttatgaatatcttcaggaaaaaattgaaaatgagctagcagagaaacaacagcatggtgaactaaatcaatcggcaaagatgtctaaaccttttgttgctgggactgatttgacttctgttgcatctgaggacgttgaaaatacaccgtcccaattggttcggaaaaagcggattgtattgagcgaaaatgttatttcagcggtgagataattccgacatttaataaatggaattgcaaatttttcgatttgcttcaggaaaaaactccaaatgttgcgcgttgggaggagacaccggctcatatcggtgctggtgatgcaactccagcggcaggcaaacaatgggacgcaactccgtcccaaactcctcgtcgaaatcgttgggacgaaacaccaaaagagtctgttcgcgatggcggtatgactcccgggtggggttctgaaacgcctcgcgacataaaagtcgacatgtcggagcgttctgaggagacgccgggtgcttctaaacgacgttctcggtgggatttgactcctgcccaaacgcccgccgttggttctgagacacctttgaatggaatggatgcaccaactccagcgcatttcactcctaaaatccaaaatggaggaatgactccgtcgctgttaaccccgggagggtcgactccgatcggaacgcctgcgatgggcatgaaaacgccggctgttccctttgttccaatgacacccgagcaagctgcaatttacaagtgggagaaggaaattgacgaccgaaatcggccactttctgatgaagagttggacgcacttatcccacccggatatcgcattttggctcctccatctggtactgtttttaaaatattttactggttattttcctcattccaataactaaaaccttttcaggatatattccaataagaacgccggctcggaaattactgtccactccaacgccaatgaccggagtcggtggttttatgattcctcctaccccggagcgtggcggtgctggtgacaaaggcgttggtggaattctggacacgcagccaaaggacccggagttgccagcacttaagccagaagacattcagtacttcgacaagctgcttcaagacgtcgacgagagcacattgacaaaggctgagaagaatgagcgtgagattatgggttatctacttaaaatcaaaaatggagcgccaccacaacgaaaatctggacttcgaaaaatcacggaaaatgctcgtcgtcttggagctgggccattgtttaaccaaattttaccacttctgatgtcaccaacattggaggaccaggaaaggcatttgatggtcaaagtgattgatcgtattctctacaagttggacgatttggtgcgtccttacgtgcacaaaatacttgtcgtcattgagccattgttaattgatgaggattactacgcccgtgttgaaggtcggccatttaattgttattcccttttattttaatttacttggaaagttcaggtagagaaatcatttccaacttggccaaagcggctggacttgccacaatgatctctacaatgcgacccgacattgacaatgtggacgaatatgtgcggaatacaactgctcgcgcatttgctgttgtcgcttcagcactaggaatacccgcgcttttgcccttcctcaaagccgtctgtaaaagcaaaaaaagttggcaggcacgacacacaggtacaaaaataagaacattttgcccaaatttctgtgctttttgtaatccaactgatccatttgaggaattaaaattgtgcagcaaatagcaattttgatgggctgtgcggtgttgccccatttgaaatctttggtcgaaattgtggaaagcggactcgtcgatgatcaacaaaaagtgcgcacaatcaccgccctttgtattgccgcgttggctgaggccgcgacgccatacggaattgaagcgtttgattccgtacttaagccattgtggaaaggtaaaataaagaagcaaaaaacatcctaaaataacaaaaaaatataggtatccgaactcatcgaggaaagggattggctgcatttttgaaggctattggttttctgatcccattgatggatgccgaatacgccagttattacacaaaggaagtgatgctgattttgattcgagaatttgtttctccggacgaagaaatgaaaaagattgttttgaaggtatggttactttactggactgtagttataatttatatttcgaattattgttttaggttgtaaagcaatgttgctcaactgacggggtggagccagcttacatccgcgaagagatattaacgcccttttttagggcgttttggaaccaccgaatggccatggaccgtcgcaattacaaacaattggtggacacaacagtggaaatagcgcaaaaagtgttttctatattttaagttattgttataattgcaagctttaggttggctctgtcgagattatcagtcgaattgtcgatgacctcaaagacgaaaacgaacaatatcggaaaatggttatggaaaccattgaaaatatcgttgctctgatgggcgcttctgaaatcgactcgcgactggaggaacagctgatcgacggcattctctacgcttttcaggaacaaactcaggaggtttactaatctgttctcctcttttcttatttttttattatttaacaggatgcaataatgctcgaaggctttgggaccgtttgcaaaggattgggacgtcgtaccaaaccttaccttcctcaaatttgcggaaccattctgtggcggttgaacaataaatcggctaaagtccgacagcaagcgactgatttggttctactgtttcttcattttttcttattataaatttaatttttgcagattgcaaagatagcccctgtgatgaacatttgccaggaggagaaattgatgggtcatttgggcgtagtattatacgaatatcttggagaggaatatccagaagtgctcgggtcaattcttggggcacttagtgctattgtttctgtgatcggaatgacgaagatgacgccgccaataaaagatttgttgccacgactgactccaattcttaaaaatcggtaaatctatacaatacttaatttctcctttttccttagcaaattttgtatattggttttatttccaattattcattcagacatgagagagtgcaggagaattgcattgaattggttggaaagattgcggaccgtggctccgaatttgtgtcggccagagaatggatgcgcatttgcttcgaattgttggagcttctcaaggcacataaaaagtccattcgtcgtgcagcaataaacacttttggttacattgctaaagcaatcggtcctcacgacgtattggccacccttttgaacaacctcaaagtccaagagcgacagttgcgtgtgtgtacaaccgttgccattgcaattgttgcagaaacttgtgctccattcactgtgctgccggctattatgaatgaataccgagtgccgggtcattttttgctttatcccctggatattttatacatattattaatatttatttttcagaaatcaatgtgcaaaatggtgttttgaaagcgctgtctttcatgtttgagtacattggtgaaatggcaaaggattacatttatgcagttacaccgcttttggttgatgcgatgatggaacggttggtcacataattaatttttcttaatagtcattgatcttacaattaggcttttttatactcttatcagaccaaagagcaactaatttaaagaacaataattttcaaaagaggtttttaaatatttttttcgggaagatatcttacaatattttccaacaacttattattttatgtattattttgtatttccagagatgtggttcatcgccaaattgccattgacgcggttgcccatttgaccctcggcgtccatggttttggttgcgaggatgcgttgatgcatttgctcaattttgtttggcccaacatgctcgagaattctccacatgtcattcaacgtttcgtgttcgcatgcgatgcgatgcgcgtgtcacttgggcctatcaaagtgctgcagtactgtctgcaagcactgtggcatcccgcgcggaaggtgcgagagccgacctggaaggtaaactgataattgcatagccgaacacgctgtattttgtctttaattcaggtgtacaataacctcattctcgggtcccaagatgcagtcgttgccggatatccgcgaattggttagtcatgcctattctattcacaatcagcagtttgtaaaacccaatttcccgtttttagctaacactgaccgaaaccactacactcgctatgagcttgattacgttctttgaatgaaatcgtatcggtctgtgaatgtttgggcgacctgtggtgaaattctgtaaaacaatgatctaaaaatggtttcgtaaaatatactcgatttgtaatagtagttcgtttctttgtttcttccaacaactggttaaatttgtgtactgtcagaatgtcgtacattaaaagtgaattacaatttaatgcaatttgttcattatttatttatactttgtcaatgtctccttgataaatctgattttctgttatgcggttgaattccattttccgtcctcgctgtttgcgtttgttcagttccgccgctttgcccgcatcggcactgaaaaggccgaatcgtttctacaaaaaagttgaagtgcgcgaagtggacaaagataatgaagtgctttcaaccgcggggaagtcgtttggcgtttttctcgacgggcgttccctccgaacacgctc

SEQ ID NO: 3467 - DNA, 4112 bp, Heterodera glycines
gtctgatcgcccaaattgtctcttcgatcaccgcttctctgcgctttgacggggcattgaatgtcgacctcaccgagttccagaccaacttggtgccctacccgcgcattcacttccctttggccacttatgcgccgatcattgccactgatcgagctttccacgaaaaatcgagcgtggccgagatcaccaatcagtgctttgagccgggcaatcaaatggtgaagtgcgacccgcgcaacggaaaattcatggcctgttgtttgctgttccgtggcgatgtggtgccgaaagtgtgccaattttgaaaaataaaaattcttttggtcaatttttgaggatgtaaattcggcaattgcagcgatcaaagcgaagcgaaccatcgaattcgtcgattggtgccctacaggtgtctctttcgccttaatcatgttggcacaaaaatctttcaggcttcaaagtcggcattaattaccaaccaccgaccgttgtccccggcggggatttggccaaaatgcaaagagtaattggcgaaatcggactttttatgtggggtcactcggccatttaggccgtttgtatgttggccaatacgacggccattgccgaggcgtgggcacggttggaccacaaattcgatttaatgtatgcaaagagagcatttgtgcattggttagtattgttttggatatttaaattatgcggctaattgttaaggtatgtcggcgagggaatggaggagggcgaatttacggaggcacgggaagaccttgcggcattggagaaagattatgaggaggtcggggtggacacttacgtggaagacgaagaggagtactgacgaggaaaatgaacggcgagacgacgccgacggcacttttggcaattggccaaattaatacaaatacaaaacgaatcacttccaattcattttaataaaattcacaaatttcgtatgatccgctgatgtcagaaatgttttgttttatattgaaacaaactttgttaacagtgacgtaatatgagcgaatgacgcaaattgaaacagtgcgtttcaaaataaaagttcaaaagttcgattggatgagtgcaactttttctgtccgtctctcctccttcaattaattaattgattgatcggtcgttttgccaatgttcccccatttgccatttaattttcggcttttcccattatgtgccaactttggttttcgcctatctctctctctctctctctctctctctctcttcattttctgtctttttccctctgtttgttcatctgtccgtcgcgttggcctttttttccatcaaattgtcctaactttttattgtcaactttttgaagtgaactttgacttattcgatcattctgaaaatgaaacttttttttctgttgacaattccctttgtattggccgcttttctccaattttcgtccgcttttttacttccgctagtgccaaataatgcggcgatgggaacggcaaatcgaattgacgaagggccaattgggacagaacggcgcaaaaagcgcgaggaatgggtggaaagttccatctattgttggtacggatgacggaagaaagagggaatgaaaatggggaggaagagtgagtgaaaaagagagagaaaggagcgaaagaaacagagacatttaattaattaaagaatttattcaattaaagaattaattattgcgccgtttattaattggaaatttacaaccattctctgtcaattgaaattttataattttaatatcatttgaattaaatgtctttaataatctctccctccgtccgttctttggcgttccctccaattttcttttgtcccaattgccaattctccgaattggtcctcacaacaaatattccctggccgactgaatggaaaatttaaaacaaaaaaaaaatcagatgggctgaaaagggcgtaccaaacgaagtctttggcgcaacggcctttgttgcaactgccaaagggcaattgtcccccggggcattggggacaacaaaatccggtgccatggcaagagaacccctcacggcattgcttaacaattcttgcgccatttggccaattccatcccccgggcccacctgatcggacgaacattcgctgacccccggctgaggttgccccgccgggcattcgcaacacacccccgaggaaacgcattcgaggcgtctgccggccacgacgcattggccattcggcccgcagcttccgttgctggccaatcctccgcacgaatctgatgatattcttgtgggaagtcatgacaaaaggaggaggggaggaaagaaaaaaaatgggacggacaattcatttcgtcgaagccccgcggacagcacaattggttaacgcaactttcgtcgtggcgacagtcgacacccaaaaaacactggcgatcagtgcgagtgccttcgtagcaaaatgctaagggacgacggatcagtgccagttaatcgttgcccacaacttggcttaattgggctgaccttcgctgagtctattcgggatcagtgcgctgcttctcccaccgatcgcttctcttccgtccgatcgtccctttcctctcgcttctcttcccgtcggttctctcactgtctcaccacagcacgccccgtcgatgcatctgatccgaatcggaattggtctgctcgtgctctgatcaaatgctcgaggacattggcgatcataaacgcaaaagtggcccataaagtgagggaaatgcgcatttcggaagcaaaggccaccaacgccattcgaacgatggactgaaaagcattttgttattgaattgaccgatcatggccaatcgtatattttataaaatccccaatggaccaattggtcctcaacccgaccgaatcagttgtaaaaatccatccgatcggtttgaaccctttctaggtatcagcttcatcctcaaagttcgtcccattctgtacgatcggcttcattccggtcgttttcgtatcaatttccattcgatcgggttgtccccaattcaacgagttttttcccgaaatgcatcggtcggcttcacccccaactccatccgatcgttttcatcttttgatttgtacctccgttgcccctctgatgattgccaatccttcccctttcttcttctccttcgtcttcgtcctcccattgactttgtcttcttcggttgtcatttgatccttcccattttgtgccatctctgcccaaatagcagcaaaatccgctaatacatgcgaaataatcatggggaccgcagttggatgcctgcttgcaaacggtgcgcgagtattgggcaccgtaacgggcgcaaacggcacggccacgctcaaagtcactgtccctaaaaggaaggaattcaaaataacagagttttaaaaaacatccatcccatttgaccattcgttgtcgccgtgtctcgcggggtttgtgcagcaacggcccgaaatgcaaatggctgtccattgtttctggtacagtaccccgcactcattgagtcgctctccgctacagtatgtcccctacagccatttttgtttttaaaaattctaatcgcaaaaaataccgtaaattgtcccccgttttgacaaactccgccagagagaggcgacgaatgggggcccaattcagcagaagggaaattgggggacgataaccttttacaatgggcaaaaagtgatgccaccacaataaatgtgaaagacaaacgaagcggaaaacggcggggaaagcaaaagcattgaattggaggatttaaacgcttcattttttaattaatttcaaaatgatgcgattaaataataaaaaatgaataaatatacaataggtatttgtgcaccaaaatgtgtcaaaattcacggcaaaaaataatataaaaacaaatgcgaagcataaagggaatttttacaaaaaagggatgggggggggataaagcggatgaacaaataaataaaatgggcgggggagagaacggccgattgatttgtcccattgattgattcgatttatgcatttttggcagcaaaaaaatccagcgaattgataaaacagcaaaaaaaccacaaatttattaaataaaataacaacaaaaattaaat

SEQ ID NO: 3468 - DNA, 2412 bp, Heterodera glycines
  misc_feature (1199)..(1199): n is a, c, g, or t
  misc_feature (2356)..(2356): n is a, c, g, or t
  misc_feature (2363)..(2363): n is a, c, g, or t
ggaaaatcaattagcattgaatgctttgggtttataattcaaatccttctgagttgaagcatcccttctgtccgtaaccgtcgaacttcgccaaaagtaccaattattgtcggaggcttctctccgtgcggtttggtcaatgtcaatgtcagacacaaaatgggaggacaaactgatcaaatgggaggccattaaaatgtgaaccaattaccgatttgtcctccccccctctcagtaagtcttctttttggtcatttcctggccaattgtctctctgcttacttttccaattcggtggcccatcgtccgctgagttggagctgttcagcgccaaagtcgtcgtcctcgttccagtaatcttccgtcaaattcgaattgttttcgattgtcgctgatccgaaggagtcgctcaaattgtcggcggatgttttgcgtccgttgtgattcgccgacggacgtcgcctgtggggcggaaattggcgcgacgcgcaccgcggggtcgaaaggcgggagagctgaagcgatgcgcgaagagtgtgccgaatcggcacccactcacttgaataccaatcgaacgctgtcccaccgctccgtttccgcgtttcattcgctgcgcttcggtcggtgggcttttcctttttgccgaattggccaggcaattgctcagtttggtgctttccgtgccatccgccgagcggatcatttcgctgtcaattctttttggaaatattccaatttgtttttaatattatttgttcttttgtcctctctcactgattatgacaatgcgtcgacacgagcaatgcgctcgaatctctgacatttttgtggtaaatgtgcccaaattgttttgccaatttcttttttgtgtgcctaaaatgcgtcgatttgttgcgatttcagaggataaatttaattaattaccttttaataacaaaaacaaaaacaatcggaggaaaaaaaacagcaaacagaacgaagagcagcgaaaagacttttaaatgcaaaataagcaaataaatgatagttttaagtgttaatttttaccaaaaagtgccgaacaattcgcaaattttggtccttttgaacataaaattcgcattaattgtaagagagtgctgctgccccccgccgccgaccaaatttctgcagaaaattacaaatttttaaaaacattcttttagggaccttcaaaggcnggtgattttgtattccaccaaaatgccagagtccgttccgctttttttgccattgatctccgttattatcaccgatgacatttttcagctcgaaaatggctcgctttttggaaaactccttcaattattacgctttcatcgtgtgggttattctccgaattccaaaccatttcctgaaaattattattcttttttttaccaaatcctttccatcgaaatgccttttcttcgccattgtcccgaatgacttcaaatgccatcgtcgcttcttctcccattaatctgtccgttaatattatttgcactcggaatggctttccaaattcttaattattttattaatttttctttccttttttttgctatttattatttaaatttgcctacccaattgccattgttggacattttttgtagggcaaaatgatgcaaaaaacattccttgtggccgttctgaaagtttacatccgcaaaggcatttagaagtgccgttgtcatccgccgatggattttcgaaggtcaaattgcggacagattggccaaagccaagcgaagaaacggccaaatccggcggaaggtcagccgctgtcattaaaaagcgcaaataattatgctccgttccgttgggactctctccgatggcacttttccctttgcattattcccccctcccaccttggttccgttggcactctctccgatggcacttttccctttgcattattcccccctcccaccttggttccgttggcactctctccgatggcacttttccctttgcattatttgtccccctcggcactcccctcttctgccgaaagccgcttttgtcattactttgcttaaacttctgactgttgtccgttcaatcgaatttgtgttgcttcgtcggcaatgcctttaatttttgtttgttttgtatcattaactaattacttgtttaatgaccttgtcctttttcgaattccactcgattcgtttcgctgacaaaaacattttgcccactcggaccattcgctccactcccaaagcgcatcaaataaaatatttccatttaattaattacttttcaaatattatttttccattttaaatttgtcccattttctccaataattcccccccccctttccctttgcttttatttttcagttcgncatccgntcggatcatcccacaactcaaatttctttttccttagctgctttacccc

SEQ ID NO: 3469 - DNA, 2946 bp, Heterodera glycines
ggtcacattttgctaaatgttcagctgtttcacaagttgcatctgaagggctctttcattagattattttaaccatttcaataaaattcttgatttcttaattcacctctctcaacgttccacaaacaagacatccaaatttgagaattgctgctctcaacttttcaatttctcttttatttgggctttgtcggacatgccatttgatacattcataaaatttgatgaacaaactcaacaaagaattcagttaaaaatgatctgacgctccaatttgaaaatgcttaaagacaaaaggtaaaatcttcttttaccattaaaaggggggggaagggccacttaaatgtagttttccattcccttcttggataggcatttgccagaaaaaaaaaaggaaaggccccggccaacccgaaactttacccccaatttagttttgtgttaattttttgaaaaaatgccttttaaattttcccaaaaatttttttctactgaaccccccccaaaaaattttaaatttttaaaaaggtttaaaacaaaattttttcaatttgaaatattttcaaaaagcaaaatttttccaaaccaaatagggcccaaaaaaaaatatatatgaattccgactttttttttttttcgcgggcaaaattggtcccccaaaacaaagcttttttttcaaaaaaaaaaatttttatataaatttttttgtgccccactcccccccccccccccccacacctttctctttttttaaaaccccacaaaacaaaaaaaaaaaaaaaaaataatatttttttttctccaaaatttttccccccctaaaaaaaaattcccccccttttttttttgtttttttaaaaaaagaatttttttcacacaaaaaatttttatttaagcgaaagaatattttttctttttctttctttttttttttttgtttttcttctctacccccctcgcccctcccccctctccttctttttttactttttttcttttcttttttttttttttctcacttcattttcaataaaaaaaaatatttttttttttttttttataaataaaaaaaaaaaaaaaaaaaaaaaaaaaaaaaaaaaaaaaaaaaaaaaaaaaaaaaaaatatttttttttataaaaaaaaaattttttttttttttttttttttttttttggtgggccccccccccccccctttttttttttttttcccccccccaacaaaaaaaaaagggggggggaagtttttttaagggggggggaaatttttttttttcccccccccccccttgttgcccccccccccgcgagaaaaaatattttttttttcccccccaagaaaaaagttttgtggggggggttttttgggggcggggggaacccactaaaaaaaaaagaattttttgtgggaaaaaatttttggaatgcgaaaaaaaggggggaaaaaaaaggggggcctcggggggggtttttccaattttttgcgcccggaaattttggaaaaaattttgggggaatttttttttggggagagcacaagaaaaattttttcccaaaaaatttcccccgaattgggcccgcttaaaaaaatttcttaaacaaagaaaaaaattttaaaaaaaggaaattaataaatttttcaaatgaaagcaaatttttttttcattgagctttttaaaacgggtgttattatcccaaaggaaagtccaagcaactcaattattttttggacatttgacaaaattccaactgatggaaagggcattttggcaaaatgggaaaatggccgaaacaggcgggagatgaatttgtatggcaaaatttgggggatttattgaatccattcggaagacgaagtaataaagggcggactaaatgaaatgaatgttaattattaaaaataatcagccggcggcatttcttttgggttactcaccggcagggaaagccgatacaaaccgggcgcaaaaaaatgccaacattcgaattccatccgaattcgcttcgtcgcccttaaaattttcctgccaatcgctaaaaataaattagactttttaatcaaataatttttttttacaaaatgtgcccaattgaaagattttcaacgaattcaatgaatgccgaaattccaaatttgcttcaaaaaaacattcgacggagaaattagtctctaaatatttttaaacaattataatttatctgccaaactcacctgaataaatttcgatatttatggtgacctttggaaaagttcgatcggactaatgaaagcgatttccgacacattaaatacaccgtcacaatttggttcaaataaatcccgtattttcttaaataaaattttcatcaaaaatttaaccaaaatttaccttattattagtggcggaaccattcctaataaatacgagtaaaaaagcgaaaaatgctagtaaatttaacattgttatttgaatttattaaaatattagcatgcgtggtatttctatctaaaatgatttggaatggacaacaaatgaggacaaatgaacaacaattggggaaaaatgaacaacaattggagacaaatggacaacaactggggacaaatggacaacaattgaggaaaaatggacaacaattgaggacaaatggacaacaattgggggacaaatggactcgcgtggatccccccccccccctcccccgcgggcacatttttggcaatgagtgatgaagtgaccctttcactccgtcgcaactttccacggatgggtggtgggaattgtgcccattcatttgtttgtgttatgttgattgatcggtcgttttgccaatgttcccccatttgccatttaattttcggcttttcccattatgtgccaactttggttttcgcctatctctctctctctctctctctatctatctctctatctctctctatctctctctctctctatctctctc

SEQ ID NO: 3470 - DNA, 2860 bp, Heterodera glycines
gaaataagcatattctgaaactctgagcataaaaaatcgaagttgatttatttgcggcacttttttcaaaaacttttggggaatcagtgtccggcggtaccgatagatgtccccgggaacattttttgtaatttttaatgcgatttgttgagattggtccacaaaaatggccaaattttgtgattttcgagcaaatttttaagaaaacaaagtacttttaggggctggcggtgccgataggcgccgccaggggaaaaattgagaattttaaccatatttttagcagattttttattaaaaaattattaatcagggctgacgatttttctcgagcgagactcgagagttttagcactacctcgcacatcgtttcttcgcggcactgcctttttaataaatgttatcagtttttcaggcgagttttaccaaaattttgccaaaaaacatttttgtaaaaaaaattttcggctggctttacgacagattttgggtaaaataattttaaagataacattaaaagacaatctaacaaacaaattcataaatcataaaaacttttctcagtgacgaaatgatagggagccgaaaactgaacctaactttccttctaagtaattactagggctgggatttttatgtgctaaaaatcctgaaatatgtaataaaatatgtgctaaaaaatgctgaaatatgtgctataagcccaaaaaaatgactcattctttatcattttcgcccgcacaattgcaaataaaaaacatttggaggtgtttgggggtaaaattagtccttttttgataaattgtttttaaagataatttttccatcagttgagtaagttcagcaagaaacttcgatatccagtaacgaattaatgaagaattcgattttcggtacacgaaataaataaagaaaattttgaaagagcctctaaaaatggcaagaaagttgatttttaggggtgcatttttaaattttttgtgttttcttagatatttttttcaaaaatgccaaatatttgcaaaatatgtgccaaaccccgaaatatgtgcgatatttatttatatgccaaaatgccaaaatatgtgtttttatgtttttataagtcgctctaattcgaaaattgttcggagaaaatgttatttttgggcttctctcgccataactaagccgcagaaaaaatatgtaaaaacataaaaatcccagccctagtaattacatattggattgtaagtaaatgctgatgttaaataaaggaatgtgagcaatttcaacagaaattgagcattcagtaattattgctcatatgtaaatgctttggctaactttgttttctataataattgcctaattagatgttcctaaaatttaaccacccttttcatcagatgcttcaatttatcgctgtgtttcactttttgtgagttcttctttaaaaattgttttaaagtacgcgcctttctttcagttttctttgggttgttttgcctttgctttccgtctttgtgccattttatttatttttctacactaaattttggtggattgtctgtttgtatttcatttggtttctttacgactttgacacgccaagaagaggatcaagaaattgggtgctttttgaatttaatttttttttaaagtttcaaataattttagttatggtacaaaaattcctttgtatggaagcattttgctgattattttccaatcaaattgatcaaaactgctgaccttccaccgaacaacaattacattttagggcactgtttaatttatattcattaaataattttaatttatatcttattttaaattgtgtatttgtactggcattgtttgtttcagatgccatcctcacggagtgttcagtaccgcttcgttcgttcatctttgcacttctgcgacggggtttgggcagctttttcccggattgaaatcgaacattctgacattgaatggccaattttggtttccatttcgtcgcgaaattggcatcggattgggcatgtttacggagacaaacgcggcaaaaggacaatcaaattgtccaaagtttacccaatttaaggtggggtcgaaagttcttcgcacagtctcaaattcttgctgaataaccccggccgaggccgtctcattggcattgtcatcggcggtgctgaggaagtgctggacgcacacccgggaaaacaccacctgaacataatgggacgacgcggattctgccgattcgcgttgaaaacggggcaagtggaaaaggcgcaaaaatatgcacaaaatgtgcaattttataagtaatattttctgatttagcacccctcttgtgccttcgtacagttttggtgaaaatgatttgtttgaccaattaccaaacccccgagggtcccttctgaggacagttcaggcaacgcattctctttctgtttctgactttgcacttcttcatttagtccaccatcaagaggaagtgtggtttttgcattccgatcatcaacggatgttgcggaatctccgatcgctttggtctgttgccacgccgtcgttcgatcacgacagttatcggtgaatgaagagacaatgtttacacaaatcctttgattaaggtgccccgattgaagtgaaacgcattggcagcccaacccctgctcaggtcgaccaactccatcttcgctattgcaatgcattgaatgagctattcgaagagcacaaatcgaaatatggcgttccaaacgacaaacatttgactgtccattaattaaatgacttttaccatttaattgtttgtttattttttgatttaggcatgtaaaataatttataaaaataaattgatttctttcttgtcttttcattttccgtt

SEQ ID NO: 3471 - DNA, 1443 bp, Heterodera glycines
cctatcatttttttgacaaaatctatttaacagatctatcagtttcaaaaaaaatttcccggacggcgcctatcggcaccgcccggggcccttttaacctgcacatcaccaaatttttttttttttggaaaaatgtgccacaagaaaatatgttacaaatctgagttccaattttgcttgagtaaatcatgataatttaatatattaaaaaacaaaaatttatcgtaaaaatcttatttttttttgtaaacatctgttagaaatcgagcttaaatttcaaaattcgccaggcggcctatcggcacctccggccccccaaaaacctattttttcttaaaaaattagccaaaaatctctaaaatttggtaattctttagacaaaatctgtgtaatttatgccaaaaggaattgaattgaggcgatacatcgactaaaggaatgtggagccaacacatcattcataaaaattaatttttttgtgagattttttggagttaattcaaatcaaacccccgcccccgtgggggcaaaattttcgtgcccccgtccccgcgaaaagccacccccgcccacggggtccgaaccctacttcaatgcataaaattttttattttaaaataaaaaaggaatttgaggatgaatttattttgtaaacgcttttcacctttgtctttgcccaccatatgccaatgccatcgttcgtccttttcctttctttgccatttcgccgccctttgggcgtccgttaaaaaaacgacgcgttgaacaaaaataatgaacagcagcagaagaaaagagaaaaaaggcgaagagaaacgcatttgaaatcagaaaataaatttaattgtggcgacggaagggaaaatatttattaattcgttttcctatcggcccaaagttttaaaaaggccaatcaaatggaagggcaaaatgttttttgttttttatttgatggatgagcgaaggatggacttaaaaaacctgttaaatcaattaataaaattcaaaaaaattgagtttgcctgtgggtacgttccccgtgtccccccccccccccgaccgtcccaataaaaggtgattggagaaagcgagcgaatctaagggacagtgccgtgggcacaattatcaaagaggaaatttcatatttttacaatcacaaagtgtaataaagaaaataaatgttatggccatcggccggtcagtcgtcaaatgcgtttgtttctgctaatttcccttaattggcgcttcgtcatgcgtttaccccgcggcgtttcccgtcgcgccgccggccacggcaattgccacggccactgactgtgcattttgttgcggctgttggtatttgctgcctctgtgcttttcttccgacgaatcgtcgcctcggtctgaaaattgcatccgttccgtgccgttcgtccggcttttcccctgccgctcacttct

SEQ ID NO: 3472 - DNA, 1176 bp, Heterodera glycines
atttaaaattgggagaattatgaagagaacgaaattccaaaagggtataagcaaatgatgtcattcataggcccaaaaaaattttcggaattcgaaattccaatcccaaaaaatcttgaaaatcggaataccgtgccttccctggtataaagcaagtggcattcacaaaggtcgttcagctcattgtttgtattcacatattaccgttggataaaaaattccaaaatgtttcattccccgtcattcaaccgaaaaggcatttactccttttgcgtgcgactgcgaatgcgcagtaatcccttctcttcccccccccccctcttttcccccatttaaatttccccaaaaaatttctttgtttttggcgccccgcccctcttcgccttctcttctgttgttgctgaaggtcatttgttccatcattctgttgccggtcaaaagaattgtgtccaaccgtctcttcccaaaattcccatcgcttttcatttccaaagccacaaaaaagggggagggaatgaatgaattcgattgtttggtgtttcggactgtcccctcccatacataaaatgcctcccattgtgcgcagtttcccattcccaacgcaatgaccgaccgaacccaacccattcattactctttgactccattccaaaaaaaaaggattttttgccaaattcaaccaaaataataacattctccaacagtggtgtttctcatttttctctgcgcgttcattgttcacctaaaaaacctgtcggtcactgcgttttgagatggcccacggcagcgaagggacgctgaccctcccccggagggagggaggggcgggggcactgctgcggggcaatgcgttgtgtcggatggggatgggccgggggcggaagcgccgacgttgtcgcctgctgctgctgggtgttctccaaatgggccaagtacaggtcgtcgtaccaatggtgggcaactcgaaacaaaacctgcacaacgaagggacgttgaccaataaagactatttaattcataattgaccgcccttcttcattgttagcttcccacactcaaatttgctccctcctcttgcctcggggtaaacgccgccccgctcgaccgctttctccaccgccaaaaatgctacttccacaagtcaggagccacgctccttgcactgattgagcgcct

SEQ ID NO: 3473 - DNA, 1745 bp, Heterodera glycines
gtttggggtttcggactgtcccctcccatacataaaatgcctcccattgtgcgcagtttcccattcccaacgcaatgaccgaccgaacccaacccattcattactctttgactgcattgcaaaaaaaaaggattttttgccaaattcacccaaaataataacattctccaacagtggtgtttctcatttttctctgcgcgttcattgttcacctaaaaaacctgtcggtcactgcgttttgagatggctcacggcagcgaagggacgctgaccctcccccggagggagggaggggcggggtccctcgttcccccccccccctccgccccaatgattgctaatgctccctcctcctcgccaacctttcgccgccgtcgtcccattctccgcttcttctgtttgcgcttcgcccctttcgcagaagtatcccttccccccattgtgttgggtcggcggaagagtggacactttccgccgtcccttctcattaatcgctcatttgggggccatttatttgtcccctctttttttcctcccaaattcgtttcatttgccattcctttagctcttcaatgccctcctccgcgccgtccctccctccgcgccattcctttcacccacaaaagggcaattcgctgtcgtcccctccgggcagcagttcgaccagcacagtgccaattgccgaattggtcaacggagacacgtccaaagctctgtcggtggacagatgcgtttactttgaacctcagtcatcggcacgagaaaaagtggaggaggacaaatttgggggaagagagcagcaaaagggtgagggacaatcaatcacttcttgggatagccaaagcagttcacaatcagtagcaggggcttccatctcgtcttttgcctattctgtcgcccttttgtctttttttgtcaccctttgtccttttgtatattttggcccgtttgtccttttctgtcgcccttttgtccctttttgtcatccttttgtccctttttgtcgcccttttgtccttttgtatacattccttctccttcctttttaggtctccgccctttcttcttcggcgattcccccaaattccgtcgtcctccccactctttcccgtcccaattcgatgggtcgtccatttgtgtcgatgcaaatgcgccaatctctccgtcttttacggacattcgtgccgtcaggcaaatgcttgcgcggaagagaacctttggcggcaattcttcacggacaatttcgatggatttcgattcggagacatcggaggaaacggagaggacaaattatgaggtgaaaaagggggagaaaatgattaaaaaaggcaaaaaagaacaattgttgagcgattgcatctcatcgcaataacttttgtttgtaaattccccttttttatttcctttgtttctcttttcgtcccctttcgtttggcatcaaaatggtttctttaattttgccatgactccgattgttcccttctctctcttcctctctctcccccctctcttatcccctctttccctccaatttccgttcatttcgtccgtcacttttgcccccccctcccctctcacagtttgagtttgtcccttttgcgtcgaagaaaggaaggcagaagaatgaccttgattttggttggtgtgggttttgcggagaataaaattaaggaaagcgagcggaccaaaggaaaaggcgccggtgggcgacggatcgaccggagggattggggggggggggagaa

SEQ ID NO: 3474 - DNA, 2940 bp, Heterodera glycines
ttttgtctgatcaaatttgaatgatcagtcccacctttcctccaccactgcttctgttgtacattcaccgcgacttcaaaatggcaccaatttaatggcggaggagggcggaagcagccccgaggggacgggtcaaagtcaaatggacgagcaaatggtggggggcaacggcgtaatgccaaaaacggacgtcggcagaggacacagcggcggaaacggcgtttcacgcgaatcgtccgccgttctctcaacggtacccacggaaaagcacttgttgtcggatcggtctcttcttcctccgtttctttccttttccatttttaaattcgcataatcattttcaattagtgctgcaaaatttaaattaatttttaaccgattattttattatttttttttatttttgcgtttttaagcaccgaaaatgcaacagaaaagcggagaagcaaacgatgggcacacacaacgccaatcggacggagcaaaagcaacgaaatcaaatgacggagtcaccgattgttgtcgcacgacaacaacaaacgcaacagagccaattcaacggggcacaattcgacacgcaatcattgcaaagtcgaaggtgcgagaatggcattttgactaataaatgaaaaacaaataaatgactaggcaatttgtgtggttggccaatggacagaaaaagaaaattttgaaattgggaaaaaagggggagggggggaaatggtgttgagaaacgcatttttaaggaatatccgatcactgggtgaacaaaaatcagaggagaatcatttggaaaatggcattatttgataatttaggcgatttgtcaatgtcataataacccaattccttcggcaattgattcccttgccgaaggagcaaaacaattgggtcatcgtaaacgaagaagttacagtcattcattcattcattcattttctgatgaaaaatggggaagcaattagcaaaatgattattaggcaattatttaattattggatggattttattatttatcttcacatatattagccttataattagcccatttccgtttaattccctagccgttcccgttcgatcggcaactcccaaaaccccaactctctccccccaaatgtgtgccaccatcgccaacattcctcggggggcttccggcacggcagttgcaccaatcttagcgcattggacggctccaacaatggggcagcagcagcgggtccgctggtgttgtacaatggcggagtcattgatggcgagtgctctccaacaacgatggcaccgcaccggcactcaatggcactgattgacccgccggtgggagggggcggggaaggcataggcaaagggccaagtgccaacggtggctaacaacgacacctcagatgccgtcgcccttttggtgccatcagccgatgctccacccccacgcgccgcctccccccttttactattccgccgccactttgccccatccgccgccgcctccgccgatggatttggtcactttccgacgcgccctcaaagtgcggccaaagggaaaggcggcacatggaaaagcattgttttcttttttgaaggaatcggaacggatggaaaaggaaaggcaaatgttggcgggcgagcgcggagtgtgcgccgcgtgctgcgacttttgctgcggcggctccgccgtcctcctttggctcgtactcactttggtcgcgctcggattcctaagcttccttctcatcgccatttactttctttgaaattgaaataccaaatgcaatttaatcgccagcagaagaaatgcagtaaatacttcacttcaattttcatttccgattggacaatcaaacgcaaattgaactttttttccaataagaattataattactattttcgtttgttgaattatattcgaattttaatcaattttaaaatgacaaatccactcgttttcaaaatatctatattttgtttccgataaacatatgtaacatatatattagtataataaatagtctctgatcatgaagacccttcccccaatccatcatcaaaaccgaccattagttaaaatattccataaaacatttatagcgcaaaaacatgttaaaattttacaaaaaaaaacaaccacaaacataaatgaaaaaattttaaaatgttagacaaagcaaaaatcgtaacaaattttgatttaaaaatgttagtacaaagtaaaaaaattgttaaaaatatgatgagacgaagaatgggtttgtttaatagcctatttcacaaattgtttattccattctgtcgttgtcggcatgaatgtgtccttgtccctgtcctcctccgtcctccccgtccattctttcgtccatttcctccaaatttgcctccccaattgacaacgttacattatcaccccggcctgtcgcaaactcgaaaaattattccaaaatttcagccgttgcgccacctgtcgccggcgttgtccccccaaagctgaactccgccatggttccgtgcccctcttgccgctgaacagtccgctcggcctgtgccaaattggccggtgttgccactgcgctttccctccctccgctgccgtccctttcggctgttctccctctgtcgccgctcaaaaaggactgaactcgctgaatatgttgctgtatctgttggatgtgctgcgtcatcgacactgtccctcgcgctatctctacggatccctcggcactcatttcctccgcaatcgccgctgtgccttcctcgtcttcgtctccaatgctcaacggaacggtgccatcctcagacaactgtggggcagcggacccggcacaatgcttcaaaacccccccccccccccctcgttccccacttggtcatcctcttcctcttctcccaagtcgtctccctgtccgccgatgtcctcttcgtcctcatcaaaacgtagtggcgcaagaa

SEQ ID NO: 3475 - DNA, 3743 bp, Heterodera glycines
  misc_feature (15)..(15): n is a, c, g, or t
  misc_feature (63)..(63): n is a, c, g, or t
  misc_feature (3658)..(3658): n is a, c, g, or t
ctgaaaaagtgtganaatgaaaatcatcaaaaagctatgaaaagagggatttgctaaatttgngggagaggggtctcaaaattgatggcattttagtattaaggaagaaaaacattgacatttctatgcttgtccatagattaaagaggtcttttcaagataatagcagattatatgacataaattctgctgatcattgatttattcaattgaaattaccccaaaaaacattcaggagcgggaggctcaaaacatacaattaattaattataattaaatgaaatggattggtgggctaagcaattaaatcgtccgtttgttgccccggcaatcatccaatcaaggagggattttataaattctcaaggctaagggaggcgggtgtccaactcagtgaaatgcttaccaaaataatttgatttaattaaatcagagaatttcttctcacctttaaagaatcaatcagttttttccagtaaaattttttattataccggagatcaaaaaaaatcgaattaaaacaaaaaatgattaaaaaagcatcggctgatcagtcttctgtcggccattgattgaatgatcagactttgtgcgccccgtgttgcgaaatgaaatgctgtcgttgcacaaatgtgctggcattgtacacgaccaattcaaaccaaatgttaatcacctgataaacaaaaatgaaaatggcgtaaatttaaatttaaatttgaaatgtaaaatataaaagtgccgaaataaaaaacaaaatgcccctaaaagcttttacctgaacaaataacattaccgctccgatacatccggtgaccaaacgcgggtactctaaaccgttgaaatgagtttattaattggttattaattctcaattttttcatttccgtcaattgctcatacgcatgattgtctcctgatgttgaaagtcgctgaactcattcagccaacgttgccaaaagtgcgggacgagcagaaacatggcagccaaaaccaaaaggtacagcgaaccaacagcaacggcaatgccctaaaaaagccgaaaaatggaattaaataaatttaaaaaagtattggcgattaaaacatttgcgcacattggccaccaaaaagggccaataaaggcgcgctgttttggcataatgcgcatagaaaatggaagccttaaattggatcaatttaatgatttgagaaaaggtaattattacgtaagcagcagccaaaattaatggaacagtggcaaagagaaaacggcccaaaatgagcaaaagcaacatcagacaaaggcaggcgaaaatgccaatgcaagcgatgatcaaagcaccaatctaacggggaaaggcaaattgaaaagtgatcggactgatcagtcaatggggaacataagtgaagttgtttgactgatcgggagaagttgactaataatttaaattgggatgaggaagttaaaaaatataaaagtgatcagactaagcaagaatgattgagagaaaatggtcaaacttaaaagaggtggcaattttaaagtgtacggaatgaatcagtcattgggcaataaaatggtcgaattgaatcaaaacaaatttaaggacatttgtattataagagattttccgcttttgtttttagcgaatcacctgaattttgatcgcacaacagcagcgatttcgtgggtcttcgtaaagcatttttctgagaatttattcgaagtaaaataataattttattcaaagaaatttttaaaaataaatgcttacatttagctataaatacagaacaattaaaaatggaaatcctttcacaatttttgatgacacaaaaggacaaagtcaaaatttggcatttatttgacttgactttggcaaaaaaaaggggggaagcaattaaatttaaaaaatgaattttaaaatagaaaaagtaaaatgtaaaacagtgaatccataggatttgtgttactctggccttttgccacataatctttggttgttttgccccgattttctctcccatccatttttctttgtctgtccaaaattggcacaatttccgcaaaatttgcaaaagtgggctccggcttttgatgcattgaaatggatttttgttcgcctcgggggatgaaaacaatgcgggaaaaaaatgagtgccctcggggggcaattggggaggggagggaaagggcacttggccatcggaaaagcggaaatgaaacggaatgagacgggggggggggaatgtacgaacggcacaaacagcagaagatgaacgagggatgagagacgatggggaaaaaagagtcgagacaaattgggcaaaatcatttccggcatttaattgccacacaattgcccaatttatacttattcaaaaaaaaattgtgaaagaatgcgatagaatttcattaaaattatttcaaagaaaatattggaacaaaataagtggtaaaattaatttgcagaagccccgcataaaaataaataatgttggaaaaccatattcacaacgaaggcgtaaaacagcaaatctcccgcggagtgttggcattttaatttggccaatttcgccaacacttttcatttggcctttgtcgcttttcctctttccgcaaaggacaaatgagccttggacaattgagtccccggtactcagtccaaaattcggtaaaaaccggcaaataatttttcattcattcgacacagcaaaaattgtgccaatttttgacagcagcggcggcacacatagaagcagtgtttgaatgacaaagtaaataatatttattggcttggcaaatgcttcttcttcgcgagagcgatgaagcggctgtcagcaaagagtgcccatgggcatttggagagatggaaaaaaggggaaattgtgaaatttggttttatgaagagaaaaacggacggacgaatggacgacgagaagggcatttggaggggaagaagaacaaaacggcaaaaataaagaaacaaaaaagatattcaataatgtatatatgtctacataagtacggtataaaaccaattaaagggcaattaagcatcgaatgggtcgggcacaattaacgccggggcattattatttccggttcgttccgacgtgtttttgttagtgtgtgaataaactcattatcagttgaatttagaaaatggctttttcttttcaaaaatcccttgctaatggatttgtcaagttttacaaattgtgaaaaaaactcattcatattattatatataattttaaaaaagtattctttattcatttggtcttttggataaagcaaaaaacaataaaaaataaaaagcaaattttagtgaattaaaatgacaatggcttttttatattttgaaattcgaagctaataatcttttaggctttgtatatgggaagaaaatataaggcaaagaagggcaaacaaaacgaaagaaagtaaaaggaaaaatgaaaatgaaaagcgaccaaaagaaaaaggaaagtaaaatttaaaattaaaattaaaataaaaataaaaaataattgattttactcaaataataaaaaataataataataataataaaagaaagaaagaaagtcggctgcgaaagtgaagaaagaaaattcgctgtttttacttaatgtttccaccaaagtaaagttccgttggccgccgctttanattcaatttgttggcgccttcggcctgtgacagctgactttattcgtttcttttcgtccgtccaccaaattttgcgaccgatgga

SEQ ID NO: 3476 - DNA, 3245 bp, Heterodera glycines
  misc_feature (17)..(17): n is a, c, g, or t
  misc_feature (26)..(26): n is a, c, g, or t
atcgaaagggagccccnaggctaatncgggattttaattataaaaaagaataacagtatttttgctaaatttccgccagtaaataaaaactgaaaaatattttattgtatttgttaagaaactagggagaaagcacgatctggtttctttattaacaaaagacccatttaatttgttttctttttttgaaattgagattaattaaatttataatttaatttttaatatttaaatgcgcgagcaattaaaatataattttaaaattttccctttttaattactaatttatactcataaatcagttttccatcctatcattatttgcgggtccgttttccactcacaaatcacaagttcagatgcggcaccgggtccttccttcactattggacttgctgtgaagattacccatttgagtgctgcttccattttcagccctgggcaatgtaccgtaattcacttttaatttaaactttttgccaatattttaatgattttttttattattttcattaattttttctcaaatttcagcgtttttctcgccatggtcgctgttattctcgttgctgttttactgttcggaatcggccgatttcttatcgcaatgcaacgggaggaaagatgaaagcaaaagtaaactgaaagattgagaaatattcccataattttttaataaaaaaataaataaaaataaatggcaaaaatttatattaaaaaaataatggcataaaattgaagagcacaaagcaagtgatcaatgatcagtcagagcattttgttgggttcacgcagttcaaaagtgaacacaacggcaccgccgtcgcttttaatgcgcgatttttgcggacacaaaatgcaattggaggaggaaaccaattggccgaaagcaacgcattgattggctaagaaaaatcacataataattaagaaatgttttgatcaaaatcacccaaattccattggaatccgtcagttgtgagtcgaagcgtcttctgctcaatcgggaagagaccgcaagtgccggtgatgcgttcggcatccaattcgacgagcatttccccctcaaatcggacggaaagcaatcattagcgaaattaattagcactttttcaaatcgaattttaaatatccaagggaagtgggttttctgtttttacctccggcagcacagtgaggacattttcattgtccacagcaaacaatggcacctttttcatggttagaattctgaattaattgcccctcttgggacttaattaatgacgaaggattacggaattttgccttcgctttgatcagtgttttccagcatttaatcactttttgggtgatcaatcacttttttataatcaatcgaaaggcatccgccgacactcatttatttctccactctctgctgctgttctgattagtctctgtttctacctgtggccattgctgcacgtgcagcagcaaagcgtgcaatgcgccgaggacgtggtcaaagcggccatggaagccgccgagcaaaagaataccggacaaattgggatgcttaattggtgcaatttgggtgtgtccaattaaaatggttggctttttctcctctccgtccgtccgtcccctcactttttcccccaacgcttccaatgccttcgtcagatccgtgctgttctgatccggtacttttcgctgttcgcagttgccaaaccctccgaagtggtgccgtgcctcggcactgattgagtcgaagtcgccaatgatcaattcgggtactttgagttgatcagtgctgtcatatcattgttgatttgaattattttggcgttttgttttagtttttgtgaccctttattttattttgttttgtttggggtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgtggcgctcctgtacaaaggtggctcagcagtggcaataaacgacaaatttggacgagcaacgattttaaaaggaaaagtaaatccttctgcaatttgtaacaggaaaagcaaatcctggtctctggaaaagggaaacaaatccctactgaagtttcttcattggttgtggaccacaaaatcagtaaaacgggaaaactaaatccctcttcatatcaaaaaaaaacgcagcttcgaaaaggaaaagccgtaaagtgtgaaacaaatcacgaaaatttgtcagttcggtaaattaactccgtctacaaaactgacttcaaaaccgggaaacgaaaatcccatttcaacatgaaatttcttcgtcaacacaaaatttcgcccgaggaaaattggaaagacaatcgcaactttttggtttcattacaaaatggtggatgcgaaagtaagaaagaacaaaaacaaatttgttctttggaatttctcctcactctggaaaaacttcccgaactaaatggaaatgaaggacgagagcaaatacggacatttttcaaaaaattttcgttagctaccgaagaatggccagaaaaacgccgaatttcagcactcgagtgcaaagtaagtggaaaagcggaacgttctttcagcgccgctgcagtgaatcggccggctaaaaggagctaataaaacgtcgtcgcgaggacgcgaaaaaatgacaaaaaccaaaacggcaagaaaaaaaacgtcgtaggaaaaagaatagtccaatgggaaaggggaattgtatcccaaatccaaaaccaaatcgccgtctcttttcactgctttcttttacttccaattaataaaacagcacacagcaatcaattacaaatttaggaagagcacatatatcacacataccccaaaaaaaaaataaataaagggtcacaaaaactaaaacaaaacgccaaaataattcaaatcaacaatgatatgacatcctcgccctctacaaagcgatgtcctcagcgcttcaaatccatcgaggggcagtaagggtggacaatcagcagtggcacagaccaacatcataatttgacctgtaaaatgtgcgaaaaaaacgaaaactacaattttgaacaggcctgatagcgtgacttgacgcagctttattcgtaattgtgccatcaacggctgacaattttcgttctgtgtcggctttcaacaacttcgtcgttggacctgttgatt

SEQ ID NO: 3477 - DNA, 2707 bp, Heterodera glycines
  misc_feature (2668)..(2668): n is a, c, g, or t
cgagttttggtgcgcaagtctcggagtgcgctagggggctgggcgtcgggaaagtactgctcaaaatggcgtcagagacaaaattccttcggcgttcagcttagggggtggtgaattgatgtcctgtgaaatttgaagtcaatcggacaagggctatgcgagttttagctctcagacacccccacccccagttctgtactttgctaaacattttaaaaaaatttttatcataattaaaattgcaaaaatgaaaaaaaaacacatacgaaaatgataactgattggtcctcccttttcattgttggttctcggcatattggcgcaaaatctcggcctcgcgttcggcgcgctgaagaagcgcggcttcgatggtaggtgctcgacggtgtccaaaaagaaaacgaatctgaaaaaatgtgatgaaatttaaaaaaatgataaattgaaaaaaaagaagcttacaattttcaggtcttcacgccaccaattcaagagcaaatcctcctctgcgtcttcaatttgtgcacgcaactcggcgtcttcatctggttgttgatgcgggtgttgaacattgtcgggttgttgaaagggacggtccgaaaattcatttggagacatttttgtaaaatgaatgatgaaaaagaatgagtagctttgagaatgctccatcagcttgagtcattatctattttgtcatactgaagagagagttcattgtcagttttctctaattttgcatcattttgttgcgaaaaatattggtggttgtcgagggatatttttcatttcttccattactgtttcggcttcgctgggagagaggtgaccgtgacttttaagccaccgaattaaaacgaaccaaaaaagcaaaaacacaggaaatgcaagaagataatgagaaaaaagcagtacatgcaaaagagtttcattatgctcttctgggggattcaaaatttgtatgtcgggttttgttgtattggtgttattcattttaacattatataataatatttttatttatttatattttatccaagctttgagtcggtcacaatgtgccggttataatcaaccataatcatttggtcgaattcacccaagacaatcatctccacgccaccaagcggaattggtgaattgaatgtggctcgtacgtttgtcgtaccgcttctcaacagctcaaatccacaactgtcgtcaagcgtggaagtcaatggaatgacaaaaaagatccacccttttttgaactgggccattgaaatgtcaaatgaacgttccgagttagccattccgagtgcctcatacatgtcaacaaaggcgctgacaaagtgatcatttgaaaaatttagtttataaggaacagctgggtaaactacgccaccagcatgtaccgaaatctcacgcaaatcaaacggctcaaacatgaagggactcagtttgtaatcaccatgaaatgctgaatttcctaccaacgctattgtcacacgtcgaggaatggttgcactgaatacattgtactcaaattcgtatcgaccaacactgatgaatgacgacttgatttcggtcttgcgtactgcgtacgtggcgggttgtttttcaaggtttttgtaaaggttcatgtttagtgagggttggacctcaaccattttggcataaatcttgacatcgtaaactgtcatcatttgcttttaaagtttgcaaaagaaagacatctttagccttgtaaattgtgaacagcaaatccaaattgtttaaaagataaagctcctggtttcccagatcaaagtcgagacgagagaggaattgtgcattttttccacccttgaaaattttacaacgctctttgaacccctcgtctgttgagtcatcttggtttatggtgtgataataccctgttgaaccaagaaaatttttcttggcatttattggaaagcttaactcattagtgatataggccttgaatgggtataagtttccgctatcgtatacttccgtattgccaaccgtaacttttagttgctggacaaatgtttgaccaatcccttgaatggcagagacactagtatccgcatcatctatcgcaacccatttatcgtttgctcccggtttttcaatggacagttcgagataaagatatatccgagataaatcagtccacaaattgtcactgtacagtcgaaacaggtacggtgattcttgcgtgattgttgctagcggaagcacctgacgaaagaatgaacgtacaacagaaacattggttggtggaactaagaaaatgttcagaccagtgttaattgctagtggactgctgtcgctgattttttgtgggcaagtcatttttttaatagattcctaatgagtcaacacgaagacgtttatttttggtcttatcaaccattggtggcccgattgacgattgaagtttatttatattttttcgccttattttttcaattttgggagccgagtcttttttgtatcgcttaaaatcaaaaccttgacccttctgagtgtttatgttgttggctgctttttcgagaagattctttagtcctgccttactcacactaacgagagactctttgaggttttttccctcagcacattggtgagtactcgatttcctgtttccattccctgacgtccaattgcggagccattttgcttntcatcggcagcaatatctcataagacttctgaacactgc

SEQ ID NO: 3478 - DNA, 2226 bp, Heterodera glycines
cacaaatcgggaacgtactattggcctgtcctcataattaaaacaatacaattttaaattaaagaatcaattttaaaataagaatcaacaattagaaggaatagacaagtcaaaatatgaacacagaagctttttaggcacttgggattgaacataatatacgtttttacaagggacccctcagagggtcgatgctgttgttattcctttctgtcgatgccttttccgccggttgtggcggcggggcaatgcgtgcgggcggaggctcaaacattctctcggtcaaatacccggcaacagaagaggagccaccgctaggaccacctgccgaatgaatgaatggtttacacactagcgaattcatcagaaactataaattttctaaaatttgtccagatagcctattatggcacaccaagccatctaaatttttttttgcgaaaaacagcgacttccgagtgtttgccgacgatctgtccgactcactacgatctctctcacccgttatggcttgtgtttgagtgatggtaggcaaaaacaagtcgtgccgttggtctcggtactgtgcccagatttgcgatttttgtagcaattgcgtgatacgttcaccaaagtgtgcgtctcttgagcaagctttgagtgcgtcggcaatttcagcttttgcagcggacggattatttactcctgaaaagagattaataacgttttaaattgatttgaatttaaaggaatggaaaatgtcccaaaaagagactcacctggtaacgaactgcccaacattttcaacaagtgatcgaccattccgctcaacaacatttgttccgccatttcaggagtacatctttgagagagcattttgagtgcatgggccgactcccgggccaactcgggctgcattcgcatgcaaaccaaaagcccttttggaagagaggggacagcagcgaacgcagaagcacaattcttaaacagcggaaatgaatttaaagcccaaattgaaaatttatgactagtttcaaagtgtaatgaatttgtgtgacaattttccaatcgttaatatttaccaaattttctgagagttggttaagcactctgagagcagatcgcgccacatcatcactgagggtcgattgcatcgcttgacaaaattgtggcagatatccttgtgcagggatctaaagcatacgttatcagaccaaaatcattttttaattttgttataaaaataaaataagaatatacaaataaaaaaaagcaacagtggttcagttgtagaatgctcgcctggccatgcgggcggcccgggtccgattcccggccgttgcaattcttgtttccattattcacatagacagataacttttttataattgaattttaagtcagctatcaataaacattaagatcgcaaacatttttattgtttgtttttgcactgcattctgcattaccatgtcagtggtcgtcggatggtgtgctgccagcagaatcagtgccttgctgacctggtccaacacatttcgccatttttgcacttcttcctcactttgcccctttttcttttgatggggcaattgccaaagttccaacaagcgctctatcaattccgtagcaaattgacgcgggtggcgaacctttgttggtttaaaaatgggaaatgcatcacccacggaaactgaccgcccacgaagggttagcgatgaataagcgcaagaaaatgccaccgactatcaattctccgctaatcacttcctcaaaagcgcaccgattctcaccaatgatggaattctacggaaacaaaaaaataaaaatcagaaaattataatttaaagtattacggaattccacttggcatttgggtctttctgctgggcattgatgagttcgtccaaacttcggcgaagaatttgccgaaccccatctcgcatagtgtcgttccaaattagctcgggattttcagtatttgtatcaaacatttgaatcctataaagggatgaatctaacgatttgaaattggcatcaatggaacaaacgcttgtccaggattgtctctcaacgcatcggcaaaggtacttggcaaaaagcgggccatacatcgtgcccattttggcccagtcaatttatctgcttggagtttggcaagcagttcagcggataatattcggctagcacttgatgacccaggagaaatttctaaataaaaatagaattaaacaaacatttaggttt

SEQ ID NO: 3479 - DNA, 4568 bp, Heterodera glycines
  misc_feature (4504)..(4506): n is a, c, g, or t
  misc_feature (4509)..(4509): n is a, c, g, or t
aaaaaatcacattttaaaattagaagatttcttggagactttaattctgtaaaattttctcgacctttgtgaagcttagaaagaagagtgagcagaagtggcagctgaatggagcaggcgatgtcgctgacgcactctttgttgttggccgcgatcgaaatgatttgcaatgccttcagttggatggctgatagcgaatgaacacgaagaaaagcaaaaatggcggaaaagtggccaattaacagcaattcaatgccttaaacgaaaaataaagaaagaaaggaaggacaaaacaaaacctggattcatcatcagcacattacgcaacgcctcgagcaccatccgaacccgttcctggagaggaaagcgacccccggaagcaccgtttagattaacggtgccaaaagtggaagaatgcgtcgttatttccgggttggaagcattggcgttggcaaaccgtccccagtcgacagccgggtgctcctcttccaccacaaattcggttgtcaaatctattaaatcggcctcttcggttttcgccggcttaaataaacaggttagtatagtagtcaataccaaattctcattgatttttttttctctttcgctaatgccctgccgcccgtacaaaaaatactagatgctttttgatcatttcctcatttaattttttaaattgatggtcctatcctttccccaattcttactactaaacgtaccttgggcctggacagtgttgcaatgttggttccgtttaatgaggaccctgctggtcttgcgggtaaattcaagggtttcggggtggtaatcggtttctgcttcactgccgcaggtcgaacgacgccttcaccgataaggagttcctccacatgtttagatagatagtccaaaaagtccatgcacgtccgttttggttcctttaccgtaattaaggcaataaataaatacttttaataaaataccagcagtctgaattccggttgagcgttgtaaatacgcacgaatatttcgccaaccaccaattctgttgcgtaaatactcagtttgaattcggcaccaaacatttcgctctagataaaaaaagatgaattactaaatttgaattaaattaaattaaatacgttctcgtgtgagtttctttgtttgtccacaaaatcgagcagttcagcacgagtggagttgtcccaaatcagataggggtcttcggtgtttgcgttgagtaatttcaacacaaaatcattacggcactgttcaacattgggcttggcattggccattccctcttcgtcctcatccccattttgcccttaatatgataaattttaaaaatataatgtatatttttgcactttcaccaccgccgttgggagctttggctgatgagttcggctgttgtttctgctttacattctgtgctatttcatcgtcatcaccaaattgtaaaacattaacgggcaaagcaatccgagccaattgcatttgacggcaaatgaatggcgttagcatggcacgcaaactttaaacggtatcataatggagataaattcagcaatcgtttgcctaattgtaagtaaccaccttttttgtactccatcattgtccggcgtgtccggacgaaagccggccaaacaggcaagcgcttcacaacagttgcgggccagtcggttaagtaccgcttggtggttcgtcttctcggaatgggcaaccccttggaattggtatgcgtttattttcaatttggctatatttatttgttatattgccttccaaccaacctccttcgtccaacgtgtaatcgaagcgaaaaagatgaggtaagagttgccaaatgacacccgcttgaaacagttgcgtctgtaacaatgtgcacactgaaaaggcacaaacgcactccgccgcagcgcaagccaaccgatggagagacttaaaagcatactctgagtaattttgagcaaaaagcaaatcacttcgaatctaagcagttggcaaatgctttggaacaacgttttcatttctgcaattttttcacggcacgcatcaaaacgggcagcggtggcaaaacaattgcacacgtgagtacaaacttgcactggcatttcgctttcgagtgaaccagcagtaatcatcggaacacaccgctcaaatgttttgtacagagcctgaacacagcattaggacttatttatcgcacagttaatacattcgcccattagtacatacatctaaccctccgtcccgtcgcaactgctccgcattcaatgacgaactccttagcgtccaatggcataactcaacggcagcaaccagcaattgaccaccgtcctccttggttcgagcaaacaatgtgtcgtcggacgactcgagatcgatggttttgataagttgggtatacccggcatatttgtatggcgaaagcactaaagaaaattataaatgattgattttgcaccgaattgctggcgaaccttgtaagttcctcttgtatacaatgctttgtgcacgaatgatgatcactatgcgattcatgtctggcgttgacgaggaattggctctgaccagcgtcgatgtgaggaattcgtaggcgtagttgatctgctcaaactgttcccgaccatccgggtttttgtccgggtgatacttttgtgctaatttgaagtaggctcggcgcactgccgatgcgtctttccacccgccagtggaatccgtcgtggacagccccaggcgttcacaagcctgctcaacagacattttcgccggtttgcgcgtgatttcatcatgccaggcggagagacaggcccgcaaaaaatcgacaggctcgcgaataggccaattcggaaagcggtgattatcagtcaaatggcgaaggtaatagaaatggcagaacagctcttcttttagttgtggataatcaatgggaggaataggacaatatctgacaaaaataataataataatgggtttgaaacaaataaaaagtttttggttttcaatacctgtaaagtgccttaacatttgaagaaagtctggacgaaaaatcggacacatgaagagcaatcttttcgatcatattccgtcgcatttcactattccaaatacattcgggattctcaaactctcccagaaaaacttcggcatatttttccgctccatattcctagaccaatttttgaaaaagcaatacgaattaaaaattcacctcgaggtagaaaatatttgcttctggcaacattgggcaaagcaccgaacgggaggcgagctccgacttggaaagagttgaacggaatgcttgtctcaaatgagtgtctttgaggaagcgagcaaccggcaaaatgttggacccattgtacatcaagataaagaaaaatatgcccgacaaatacagtctcgaaatgtaagggttgtcctgcatgacatcgttgaccaaagttgcaactcgttgcacaatggacgggtcgtaagtaagcaacaactgcaccaattggtacagcaacacgggttcagaaagcacttttttgattcgaggcattggacgaatgacagcgtctgtctcatctctaaagcacttttaagcaaaaataaaaaattgaacaattgacacttaaatgtaatttaatcaaaaagttaggggtagtctgggaattgaacccaggacctctcgcaccctaagcgagaatcataccactagaccaactacccacatgataagtgcaaaggaatggatttactaatgataatcatttggtgaattattgctgtgaaaaaaatgaaaatttactgatttatcgccaaaccaccaattcgttttattccctatatgaactaatcctctgaggtgtttattggtgggggtttacctggatgggaagaaagtgcacatttggatgagagtgtcgaggatcagtgagcataggtcagtgaggttgtaaaggcccatcggcagtgtcgttggttcatcgtcccttctttctattacggcttcgtccccaattcctcggtcaatggttgatgaagcgcccagttttgcattgccgacacaacaaacggtccaccgaaattgggaaactgacgacaaatggcaccatttgtccaatccttctgcccaaatttcactcttctcaaaaagcacaccgtcgcggtataaacgcttcatctaaaatgacgacaataatttaaattctttattggagtaaaatgattcaacttttttgaacgaaatcggtccttggcgttggccctgccggtcgttgtaataccattcttttggctcagtctcctcacaatgtgccgcatctttggttgcctcaatcacatttgtttggccgtgaagttttgctctgttggtatgcaaatgggccaagactgcaatgtcgatgaaaagtgagatcaaatttgcggagatcaattcacgtacattttgtttgtcaagtgaaagcttaaatattatgggaaattaattaaagaaagagtctgttttaaacaatatttggtttaacattatttattnnntcntctcataattacttataaagctaaattctagtcaaatggttatttttaaataaattttt

SEQ ID NO: 3480 - DNA, 3704 bp, Heterodera glycines
catggttattgggtcgtctcataattattaactaaaccctttaaataaaatggttattttaaataaatctttagagtacatcaaaatggacctgcccacactctacacccatctgctaacatatttccccaaatttccttatgtttcaagctaaaaatgaacaaatgctttgattatgataatactataattattatgaccaaataacatttcctcaaaagtaaaataaaccttgttaataaggaacaagaagtggtccctttcagcaacatttgtgcatttggccaacatttccacaatgtgtcgagtgtcagcgaacggtccaatgctaatgcaatgcctttcgtagacaagtgccatcgctcgaaggcaaatgcatcgcatttcggtacgttgagaaagtaaaaaacgatggtagattttattgaaaaagtcctcggggcgatggatgggcgttgcactgttcgaactgttctcttcggtcaataaaaagcgaagataataatcaccaattcgaatttcgtccaatagtgagtcataagttacctaaaataaaataactttattaaaatgacaattttaatcaaaacggtaaccaccgtaaattccgagtggttccatgatacggtagttccgggttgaataaattctaattcctgctgcaattggcgccactcattctcaattgattgtcggaattcatcccgagtcttttcgttccaaattaaatcggcacgggcgtgattttggccaaattgatagctaaaataagttaatgggacggaaataacaaatgcaaatcgtaatcaaagaatgtaacaaatttacaataattaggcaattaattatgaagcagaagccacgcataccaaaacaacttccaatttgcagtcgctttgaccagtcgccttcgcttgcgaagcacgactggcctttgctggattttctgctgctggtgttcctcacgaattcgattgctctgtaaaaagttgagcttctgttccaaattccaatgttgcagcaacgagtcgagccttgcctccagcgtcacttgcacatttctgaaacgagttgtttttcatttaaaatggccataatccggaagttgctcgaaagacctgaattgatcctgaagctgtgcaaacggacgctctctctccgaattgttggccatttccaaattattgcgaatagtcagcaagtcacgttcctcggccaccgcagaggcaggcacatgctcattcgaatccaaataatcaatgagccctcggggctaaagcactttttaaaatttatattttggcttttttataccaagcatcgttgcagcaaatccttcgctgcttggttttccgcaatccaaagtgccaccaaatagccgctgagttgtttgttggtaagaacgcgaaggtctttgccagtggaaagaagggccaactccaaatgtttgagaaaggctccttcggtgagggccaaaagttgcatttgacgactgatctaaagacaaagttggtaaaaccggattgtttttatgttccgcagtggtccaatagcaaatttttaatttaattttaaatgatttaatttattatgtttaaaatgtagctaaaatgtacaaattaatcattttatgtttgatattgccactccctcctctttttcagttatgtctcttacatctctgcccgactcttcgatgatcgctcgcatgaccatccccgcccccttcacaatggtcatagacggatgctggaaaagtttgtaaaaggttcgtccccgctgtgcgaccatcgccaaaatcgaatcgaacgtatcgcccggggttgtctcactgtacggggcgcatacggtgaatgtgagaaagtccaacatcgaggcgatgaccaacgcacctgggcaatcattttgaaaaacgataactttggttgatttgatttgtttaccagtcccccttgccacgtgttccaccacaagttgaagcaaatgttcaacgaaggcacggctggagagaagtgattgtttgttcagctgctcgatgcgcaagtcgaagttggcatgcattggctgcatcagtgcacataacagctcaaccgtggcatggtcaatcgcttcgcagcgccgcttcagcaccgaaatgaccagcgaaccgagcttctcgcggatcctaaataaaccaaaaattacacccaaaaaagcaaaagctgccatggatattttacttgagaagtcaaacgaattgcaattaactgacccgtcaaccgtagtgaatgcttgaaagcctgtttttgaggcgaagagtctgtgaaggcaagccaattgggcctcaatgcgaatgatcggttcggtagtgtctacgacctttcaaagtcttaagttggtgaattggaattatctcagcagatggcaccggggcgtgcacattgttgaccactcgctgcgtctgcaccaccgtgtcctgctgctgctgcacaatttgttcagataagacagcgtccaaacaggcaacaattgtctttgatttgttgtcggtgaaaaaccccttaagtattgaaaaacgaattaatacccatttccatgtcaaattctgggatagtttcgacccgaagttaaatcacctcagattgggtcgagtgatacagaccattataaggaatattggcattgaaacgtcgaaccatgtcaatacgttttagaccagctgaaaattggtatgtccataatggcaggttaatcaaattaaaaaactcacccggcacattgatgatatgtttgagcagaagaacctccgaatcttcgtccaaactttgtccgaattgaagcattcgcattgcacggaaatgcctttggcttgagatgagatggacttggtaattgccggaaccacgaattccatccaaaagggcagccagcatagaatccctgaaaaataaaaaggaaaatgaatataaaaaagagaaaaccgttcattggaactgaatgtccgctcaacgccacattcgtaaacaatggtgaatttttgcgggtcattaatatcacggacaaggcaaacaatctgaaaaattaaaaaagtcgagaactttagagattcatagatttaaaacatggatttattaagtcacttgagactgaatgttatttggaaaacaacatagaattaacttatataacttaatcaaaaaaattttatgtgatttttttctacaagtctatttaataatttcgatttggtcagtttccataagtaatattattgtcgttgaacaattagtgagggttttgtggaattatttgagttctaattaacaattattggaatgggaagaagtttttctatctaatgaaatcatttgcatacattagaaaacaaaaaaaaaatcgaaagaacccctctaattatgcaacaacctaataatataatggaaatgaaaaccgtgatatgaaaacaggcagctttgatttaaaataaaaaaaagatttaaatataacaatttaatgaacatcattacaggacaacttatgaaaaatgatgccacaaattccctttatttttgttgtcccaccgttcggagtgatctggcacaaatgacagcgtaactgatcgggtctctctctatgatgcacgactcgctaaggcataacaatcgccgcgtggacaacgcattttgtctggcctccgacgacgccccgctgccgcattttgcagt

SEQ ID NO: 3481 - DNA, 1908 bp, Heterodera glycines
ccatttaattaaaaaatagttttaacgatttttgggggccccgaaaaagtgtgtgtgtgccatgccattcacatttcggcactttatgggcctgtaagcccaattttgccgaatcggagaagcacatttaccaaatatatatgcatttttttcttccatttcacccttgggagacatttcgtgtgccttttatttgtgccccgtccgtcggcatttcttggacaaaaataatttactttatgccaagaggggagcttcatcgcatctcatctcatctgcagacggagtcatcttccgttttgcgatggatgaatagacagaccagcggcagagcaataaatgaagaggaaattaaatattttttgtacccattcagaaaagaaatgaaaacgaatttcaaaaaataaataaaaattaattttgtaatattgaaattaattaaaatgccatttttacattgaatggaataaatcatgaaatagacaaaattaatcgaaaatattttccaatggaataaattcaatttaatttggatgaaagagactttttgatttatattctgtcccatactatgtatgtgtacgtacatacattgattgaattgtgataaaaattttttgaaagaatgtgtaaaattatcaggaatcaaatttgttaaaaaaaattctgacgtaaattataaatttatttatgaaaaaatcagatgaaaaataaaaataaataaaaataaaaattacattttttaattttacagttaaaataaatgattattatcaaaaaaaaattgatgaacatataatttccctaaatgttgaaagtgcaaaattacagttatttaaaaaatatgaaattttttgtgttggtaaaagatggaaaacgtgtatgtaataaatgctatttttcccacattggcactgtgtttgttgtgtgaaaggtgtgccaacgaacccactcattcttttgctcccgactcagagcttgggcacattccactcgggaaaagaagactccccgtttttttgcttcgagaagccggcgaaagggtgtaataattcgagaacaattagtgaaggctgctttggcattggcatttttgccttttttcgtggaaaattttttacttcccttataaaaataattggctaaacaattaggaaaataatgcatgagtgtaaaactaagaaaataaagaattttcttggaaaataaaaataattaatttttactaaaaattaagttaaacttttgggaaattttaaaattaattataattaaaaaatatataatacaaaataattctatttgaatgccttaagtgttgcaaaaatgtcttcttccattttggaaaacgtacatattttccaacaaaatcaaaaaaagaaatgaaagggcgatgatttaagagcccccattatccatcctttcacaaaatgactttcttaagcctaagtcgacagcaacaaaaggaggaaaagccctcgtcgcgcttaacacttgcgcttcggcggcacagcggataaacggggggaggggggggggggcaaagggacgacagcggcgggcgggcggcgggcgggacccaccacgggggcggaccattgcgctgacgcattatcgagcggctttgagccgccaagcgccgcagaatggcgacgatgccgtggtgagttggcggcaatggagcgggtgggtggggggggggggagactccggcggcgatgccgagggacaagaaaaatgagaatgggccaaattgtggcagctttacagccaggaaatgccacccctccgccctcccctctttcctcccatccccgatgcctatccgccgttgttcgttagtttttgagatggggaattaacattttgttggtagtgaaaaataaggggtgcggaaatgcaaaaacc

SEQ ID NO: 3482 - DNA, 2344 bp, Heterodera glycines
tggggaaaagagtgaacgacaacggttaaatgaaatattgttgcattgacaggtaccggaagaaaggctctcggaagcgatggttccttttgaatatgcaaaattaggctagttatttcatccgccaactctacttcgttgcgatttgggagaaagggcaatgagtgggggacgggaggaagtggaacagaaattggaataagatggaagcaaattaaaagggtaagttatatgagagcttgggtaattgttagccaaaaggtcagttctcggacgttgactctctcacatttcattttcgcggccgctttcctcgttgcatccggccaaattccttccgtccaccaaatggagcaaatggaattgcaaagggatgggcggcaaattatgggaagaaaacaacaaaaattgcattttacatagccaaacgaagtgagtactcaatccgatggcttcggcgaagggacgcgcggagtgttatctcctccgatttccattaaatccaatgctatcgaatggtgtctcatacaaaacgttgcgatgagactccggcggcgatgccgagggacaagaaaaatgagaatgggccaaattgtggcagctttacagccaaggaatgccacccctccgccctcccctctttcctcccatccccgatgcctatccgccgttgttcgttagtttttgagatggggaattagcatttgttgggagtggaagataaggggtgcggaatgcaaaaaccatagccgtttttgaatttaaatttttttccgaaattgtgtagtcctctataaatttgaaggccgtgattttgaattcgggtgaaataatttttattttattcacaaaacatgcatatataataattaatggtggagaatataaatcttggcacataattagcataattaggatacaaaagatttgtcactaatgacttcgcacaatttttgttgtgttttatttttaattaagaaaaggatagaaaacagactcagaatttgtcagccaaaaaaataaaagtccttcaacgtcaactgaaaatattattggttttaaaggtattttaataacactaattatcggattttctatggtataattaaatgggattttttgtgtagcaattataaaacttttcataaagactgacaaagcgaaaacaattttgacaattttgtcgagagcaatttaaaataaactcaccatgataaaattgatactaattaataagcaaattgatgttgtttcattcgatccgttatttgtccaagacaataattaattagtcacataataaagagatttacatatttatttttatggaaaattaaattatgtttaaaaaaaattggtacaaactcagccactaacgctaatgtaaatttaacggaaaacggaattccgattaacatcaagcatacttaaaaatgattgtttattatgaaaatattgcataatctgataaaatgatattccaaagaaagacaaataaaaaaaattatgcgtggaaaataggaaacttccgagccaacgctaaaatataaataataaaattatttaaaaaaaataaattaaaggaaatgtttatgaaatactccttgaagacagagtaaacaagttgaagaacacgtgaaaaaatcagcaaaaagtctatctgtatatgtgtaggtctacaacaaatttggcagtataaaatagaggggcatttccattagcatctatcctcaaggcttccataaaaatttaaatttcatttttataatccaatttcataaaaagtgatcgtaaaactgatttggcaatgatcaagatcaacgggtcaacctttatcattgtgttcatcttgcacagtttccgtggtaacgccgtctcgcataaccatgtggcaattgaaggtaataaaatatttaaaaatatggggaaaatttcgggtgattaaaaattaaatttttattaaaaaattttccatattttttttactagtttttgacaacagtaaatagtcaattttcggcattttatcttaacattttttttttgtattttacatggggattttccaaaatatttaggaaattttaaaaaactttaataaaaaacaaataaaaatatttttaatcctaaattaaggcaacaaaactgtgctaaattatgtggaaaatgcggtaaaaaatgagaatcagttgcataaactgtcccaatttgccatcgaatgggccataaaccatgcgcttgttgttcgcacaaataaaagattttcagaagggaaagtaattaccgtaatgtatgtacaattgacaattattttttctaaaaatttaatttaaataattttaaa

SEQ ID NO: 3483 - DNA, 1325 bp, Heterodera glycines
  misc_feature (1244)..(1244): n is a, c, g, or t
  misc_feature (1291)..(1291): n is a, c, g, or t
aaatcaaacaggtaaaaaatacaaaatataaattataaaagacaaaattaattaattaaaatatttttgcaaaaatatttgaaaatggcattatacattttgaaggtggaggtgaactgcggtgcaattgccagtttggcattggacagcaaaatcactgatttgcacaccgcgatgctgaaaaaagttggcataaatgcgtccaaggatgttgtgccggtcaacaagccggaccaggagttcatcaacatgttgcacttggcttggtaaaaattaaataaacatttcttactttgtttattaggcttcgaattaatgatttttaattcgagactcgtacttaaaaaagcgggaattttctcgcctctttacggacaacttaaaaagagtcggaagacaaaatgaaatattcaatgaatttgtagagtcaaaaaatgagaatttttgcggccaaactaaggaattggcctacaaatcaagagccaaaaaacaatttctcgcatggatctttagacttcaaaaatagattttcatggattcattaattgctcagctaaaagcatttaagcaaatacaacgtataaatttaggcaaaaattcggtgatccaaatgccatcgttgtgatacttcacttcatcaattcctcgccatacaaccttgattacacaaatgttgaaatggaattggcccgtgtgtcgaatggccaaataaaaatggactttgtctcattgaaagagggcaaaaggtagcaaattcaaattattaataggaatcggattttagatgattttattaagtcgcaaaaataagtacctaaaaaatcaattactaattattagggctgtaaattatatggaagaaaaattttaaaaaatgcgcataaaatatgtaaaaaaaaatcccgaaatatataagaaatatgtacaaaaacctcaaatatgtaccaaaatatgtaaataaaaaattatatggttttttggataaaatttttttttacaatggcgtgaatgttgaaaaaatgccataaaaagatatggttaggctttgaataacgcttcagctttttaagaaatagtaatccctaaatttattttaaaaataatttaaataaattttaaatttcagactgaatcttgaccccgaaacattcacacttcgtttggatggccgtgttgttgctgttgtcaactccggaacatctgcacttggctatctagcgaatcgagccgaaatggaaactcgntaaacaattgaactctcgacggcaattgtaaaaaaaatttagtattntaaatttataattatttttttttcagaaagcgcc

SEQ ID NO: 3484 - DNA, 2340 bp, Heterodera glycines
aaaaaagaaaatttgcagctgctgtcaagcccgcgttttggacgcttttttccgcttccgagtgacgcgcgcacaattgatgcatccgcgaaacattcactggcatgtggcactggaaacagacgaccatttgaccgaaaaaataatacaggtaaaaaaataaatcaaaattaaatttttttaataaatgatttattttccaggatgccattcaaaatcccggcaattatgtgctcaaaccgaaccgtgaatgtggcggaaacaattatttcgatgatgagattccaaaaaaactgcaacaattttcgcttgagcaacgggcggcacacattttaatgcaacgattgcatccgttgcaagttaaagtgggtgaaagttgagcccggcgcgggaatttgtaggatagaaaaattttgaatattcgattttctcttcttaattgtgtccgggattcctaattggccgtaatggatgtcgggtttgtgatcaacgacccccgaaaatcctagaaagggtgtttttcacggcattttaaaatgtttaattttttcgaaatattgggcgaccaacgccagtataaaaaatttttggttccaattgctggaaaatggattttttaattagttttccaaacaatttagaacttctttttgcgaccatacgctaagccaacattgtgcaacaccagcggcgagttgggtgtgtacggttttctgatgggcaacatggtggacggtacggtagaccgtaatgtgcaaagtggtcatctgttgcgcaccaaattggcccatgtcaacgagggtggtgtgattgaaggcgccggtgttggggacacgccatacttattctgaccaacagtatacctcaatgctagcagcaaacaattttgtattagacaaaattttggcatttttcccgatgaaattagtgtccaaaaaatgatgaatattttgtattagtgttgatgttgttttgattactaaatattcaataaacatacatatattgttgatttgccattttgttgttgtgaataaatttggcaaatgggaagaattattttttaattttctttaccattgtgaacataaaaatcaagttgataactaggcatacgatttttaggctctaaaaactgccaaaataggtaggctttaggctctaaaaaaccccaaaaataagcactgtattcaaaaaagtaaaaaaattaggcaaaatcagtattgagataataatttttaaagcacaaattcttgtcaagaaaataaataaataaattttggagatgagtttttgaaaagtttttcatttcttaggggtgtatgtttgaaaaatttcgggtcgattcttaaggatgtattttttgaaaaaatttttaggtcgcttcttaggggtgtatttttcgtttttattgcatttttgttagtaattttgggcaaaatgccaaaataggcaaaaataggctcctttcaaatttttttaggctttataggcgctaaaaataaaagcctagaaaataggcactaataactcgaaaagtagcttaacaacagccgaaaaaacatgtttttcatgcatttcagaccatagggagctcaggaaaaaataggcttttgcctataaatattagccctagtaataacctagaaaatgattattttataattatatttgttgaaatattgatttgttttaaatttattatttataaatcaaaatgaaacaacaaaatttaataaatatataatgatatactacaactaataatgaaaaatattgaaattattataatattttaaatttaaaatttaagttccaaatggcctttatgattatgaccagggctggcagatgaaaattttcaaaagcctcattttgagtcaaaaagcctcattttcacaaatttattcaaaacacatttgaaatgttcaaatgttatatttttgattgtccaagatcaatttgagcaattttttgttagaaataagcattttgtgaaattctgagcacgaaaaatcgaagttgattttttgtggcgcttttttcaaaaactttcagggaataaggggccggcggtgccgataggcgtcgccgggaaaaatttttgatttttattacgatttgttaacaaatttgtccacaaaaatgttcaaattttacggttttgagcaaatttttaagaaaataaaggatttttaaggtccggcggtgccgataggcgccgccgggggaaaaattaagaatattgactatatttttagctgattttcattaaaaaaattcttaattttgtgattttttggagaaaaaaatggatctttactggattttataaaaaat

SEQ ID NO: 3485 - DNA, 5187 bp, Heterodera glycines
ttaaatttcaactggtgaatcatttaggaattaaatcatttacattcttttaaaatgagtgtaatgcttaataccgaccagcagaagcagaatttggacaccaaaacatctcaggtgaagaggacatttagtgatttaaacaacaccttatttatgggtgtaaagtctgttggccagggatagggagacctgaaaacaatgacattcagaaactcgaagtgatagaaaagtgatttaaaaaaacaaatttaggaaaacggccaattgtcagattcacacgaaacggcagttataaaagcgccgagtggagggaacagaaaagtgccaaagaactgctggaagaaggttaacattgacttggagtacaacacgagcagagaaatttcgaggaggcgacagttggcatggcgtggcgaaagacgcggcggcgaaacgtacggacggagggatcagccgaaagagcagaggaagggaagcgcaagagtggcggaagaaagcagcgccaggaaagacgaagcagccgaaaagagggacagaaacgaggcacaaaaagagacggcaggggaagcggaagacggacgagcggagggaggaggagacgaagagacggcacggaagaggacgacggccccgacaggcggcacaaagacgaagaacggaccgaatgaggacgggacggagacaggcacggaccaacaacagcaacagtcgagggactactggtaatggcagacggggaaacggcacggcatttggaggggggtgaaatatggtaattataaataccagtgtcatttgtcaatatttttaatttaagtgtcattaattttcgtttttttgcagtgccgggccaagaacgacaagaatgccttatcggtcgggcggcggcggaggcattggcggaccgagacggtccggcggcggcacagattattggcacaagaaaggcggaggaggcggcagtggtcaatcggggagaggaagtgaagacgacagggaacgacgtccgggcggcagttattaccaacagagaaatgaccgatggcagcggaatcaccacccaaatgcaccgccgccactgaatgttgcacaacgacgggcgcggggtccgttgcccgactgggacgaggtgaactttgtcctttctatgttatatcatttatcgtattgcctcaggtgcaagaagtcgcggaagacagctttgattacatggaaataatggagagccaatattcgtaagattgcgtatcattgaagttaatctaaaatattgtattaaattcagtcaatactatgccctttccgccgtttccccttttgacccttcgcttggagtcattgcttcagtcgcacatccctcgacacctatcatttcgtctgttgccgttaccgccgcgcatgccaacgtggtcagtgcgtcgaccgttccgcccgcctctctcctgtcccccaccggtctcatctcctttcctctgacttctcccactgcgcttcctccgaacgcggtcgtcgtggccacctctgaccaattcccgtcctctacgggcgccactcagttcactcccgtcgttctgactgcgcaattcccttcgaatgcgctattcgccacgcgaccgccgaccaccgctccttttatcgacgaacaaaaactgaaggacatcgtgcggtcgcaaatgtttgtacacctagccaggcccgtaaccgaaaaatggatttggcaagggttttttaatgtcaaaaacccagactggttatgggcctgatgccacgtagagtaaaagtgttcttttcgttaagtgagtactacttctccgctgacaacctccagaaggacttctttttgcgccggaaaatggacatcgaaggctttttgccactcggtttggttgccacttttccgcgcgttcgttcacttacgctcgaccagaatttcattgtctccagtttatgtgacagtgacaacgttgaactgagcgaggaccaccgaaaggtgctgacaattacagtctgatcaacatatttattaattttttgaaggttcgaccccgtctaaatccgcaacaatggcccctcgtggagtcggcgacgcacaccgaagcgcaaaactccccaacgacggcgagcggtgctgttgaagaaattgctgtggacaacgaggaaatggaacaaaaagaagaccagcacgaagaaaaggagggggcggaagagggaaaagagttggagcgaccgcagtcaaatgaacaacagcggcaaccgcagccaaattcatccgaagaaatggagacaacaatcggcacatcagaagaggaacagagacaaagcgagacagtcgaagagataatggaggagccaaaacagcagcaaaaacaggaggagaagggggaggaccaagaagggtggaaggaagtgcgcaccaagcgcggaaaccgcaagaaacagcagccgaacaacaaacagaacaagggcaaggagaacagcacacaccaacctcaggtcaaacaatgacataaaacagagacgaatcatctggaaaagtcccaattttcactttctttaggttatgcccgtcggttgggtgcaaagtacaaaatgattcgaagtttggaaattggcgttatgtgatggtcagcgcgggcaaatattattattttattctttttttgattctgacttgaaatgccttccgttgtttgttttctttccttttttgcgtattagcatcccttccgttgttgacttccatttccattattttatgctgtttctccatgaaattatcaccgctcatcgaaaagaaaaatcaaaaatttaagtcacattttactcagtctttcgagttttctttgctctgtatttcgagagaatgtcatggcaaaacataaattacaaaacagtttaatttatctccctcccctccacgaaaaatttactttcgattgccacccacatatatcatcaatttgaaaattgcctatcattgtataaaaataaataaaaacattgtttgtatagactaaacttcatccactctattgaattcatgttttttgttggaagttttattgtaatcgaaacctcctctggcatttttgaaaagggaattattgacttttaaattagtgctttcttgtttacagtcgctagttcttgttcaactttttatatccaatttaatagccaaagctatttaattttttagcaacaaattaaaatacaattagtgatcattccgaaacgagatacacttcgaagaacttagttgtgtttaaccacaccacaaaatatttgaaacaaaaatggattaaatgcttttattcagaaagggtctggcaacaccattttcgtagaaaattaatcacatcgtgaccgctattcagcggttgatgaaaattatttcctattgtaagttctgttgttgtcgtttctgcgatggtgatgctgagtattccttggctgtgatattagaggtgggggctgcccgtacggcacgtgagactggatttgtggtggcgggtgactagtaatccaattttgcggtgggagcggcggaggcgggggcattgccatctgcccaaaactgaacaacggcacgggctgctgctgctgttgcccgttgtaaaattgaccctgctgccattgttgctgatgttggtactgcatttgatgttgttgttgtggtgagtttgtgctcatgtgccatggaagtgtgtgcgctggtggcgatgtttgcactgagaaaagagaggccggacaactgcgacggttgtcgtttatgtggtggttgagcgtacgatggcccgccatggagagatttgcacgtgggatgtcacgactgtaaatgtcaagtgctcattgtctcacgagacaacaatttgacgatgaacctgaatccgatttggggttggaaggagccgtgccgtcgttggtcccaatcgttcggtttgagcacacgaggcaattccttgatgccgtccagcctgttggctttgaagatgaagtgcattgggaattggggatctcggaactcaacctgtgcacaaaaaatataaatcgaacattgtaaatgataaaaaccgaaccataatgcaggtattctcctgaagagatgcaatttattgaaacataggctatttgtaaaacaactcactttgatgtcgccaaactccaacgaatttctgaacagcgacctatgcgcctcaccaaaagcgagtgcttcgacgtcataagacacttcgccagacatcccatacgctttgactgcgtcgatgtgcacccatttcttttcttcgtcatcgacaaattcaatttcagtctcgaattctaaatctcgatatttaaagaggaaatgccttaaatggcttaccctgtttcggtgcctgttcaggttttgagatagcttcttcattcgcttgttcctcttgtgccgtcgtttcttcggttttcgctatttgttcgctttcacctatttttaattaaaaaacaattttatatggcaaatgattggtagtcaaaatttaattttaatttaccattttccgcctgttgagtttcctcggcttctccttcagtttctcgcgtcccttcgcttgtttcttttgtgtcatcatttgttagttcatcttttatcgaagttgtcgtcttttgggagtgcacctcataaacgagcgaaaacaagttgtgtttattgccgacaaaaagacggtctggtccggtggcattccgcgcaatttcatcggttgtgagagtggcgtacacctaaaatattttttgttttttgaaaaaaaaattgtaaaaccgagtcaagtgcatccaaaagacgtttttcctcgacaaatggcagcagagcgacgccttgccaagcatatttcttcccgttcagatcaatttcaaaagtttccgggtaaaaatcaattatcggcgaacttgagtcggtcatcagccaacgccacccgtcaggaatatgagctctgcaaatgaataattataaaagtgccagtcggggaacaaaacaaaacatatcaacacacctgctagcagaaggaaacacacccattaactgctccaatggcttgaacggtttcgtgggcatgttgaagtcgggttggaaatcagggatcagttcaaaatcggaggcaaacggcgcgtagtgaaggggtagtaccatttccagctggcacatccctaaaa

SEQ ID NO: 3486 - DNA, 3545 bp, Heterodera glycines
tgagtcagtttttaatggcttcagtattcgaatttatcagttactcaaaagagtgtcaaataagatcaaagtgaattgtttgtgtagttttattttcaaataagcatcataagccatccgcgtttaattgctctaatttaaattccaaatgttaaaatgccacctcctgtcggtctcccgccgccaatctgcgcatttcctcgcccgacattcgcttttgctgtccaagtggcattggtgctatcaaattggcattgtacggcataatttttgccattgcctgccgttgttgctgctttcgctgtttctttgattctttgaagcgcaattctttgagcttaagttgcttttgagtttgccatttctgtttaatttctgggccaacctgtctttgtttgaatatttcgtcctcaaccttcccaagtccgcccatgatcttcttcactctttcgatattcactatgccgttttcagtgagccagctaaaaatgtttctttaattcataaaaaatgattgaaatttttcgcacccgccagcctgataaaccatgtccttgtacaacttcacgagacggtcgatggcattttcacggatttctaacgatggcaaatgggggagaaaatcgttgcccacaaaaaaacacatcatgacctgagaatatcgtagtttcagaatagagactttgctttgaattacccaatcatcaatggctctctccaaatcgaacggaaatggcaaatttggcatggaaagttcacgctccaaatattcccgaagcactggcagacgtatgaagatgaagttcttctccttcttcaacgggtccgcttggtccggcccggtctcggcacgtgccaacccttcacaatgttcgacctcgtgcccgtattgaccgcaaagttcgcacggcctcggttgattcggcaaaaactcttctcgaattatgttgaaattggactcgtgggtggccaatccaagcatgataaggtcggcatcggcgccacaaagacagtgaacggtgttcgggtcatgcgccggcgaagcgcgctgacgtcggacgtagtccatgattttatgttcgccctcacccggcacattcgcatcggaaagaataacctaaaaacatttcattgttcaaaaataaaaccaaaacccagtaacaaaaaaagaacctggatcttttgccatgccgggtcgtaggtgatccgtttgtgcacgtaatagcgaagggcaacagaaagacgggccataaacggcgtgccgggtgttatgcaattggagtcaaagtgttcctcttcctttcgcggtggcggcaacggaattccttccgactccaaccgcttacgcacattttcgatgagctcgcgcttctccgccgcttcttgtgctgctcgaaaacgacgacttcgctgttggttcatctacaaagttagggttttgagatctttaaagttttgcgatgctttttatttccactcaaaaaaacctttgctctgggggcgaccccatcaactgccatgtagagaagttttcttggccgaacgatggaaaagaggcggtcaatatactcgaagatcaaaatgaacatttcttcctcggtcttcggcgcgggtcggtcttccggatgtgtgcacggatggataatgccgttcatgtccaagtaaagattgtcaaactcctaaaaatgcatcatttactcattgaatttttcatttgtccaattatctcacttggtaattctcatttggttgagttgcatctattgggatttttactccgtcaatttctcttctgcgctgttccaccgcgtcaacaatgatcgacacatactttcgtgaaagccaacggaaaaaggctggaactcccatgatacttcagcaaatttgagtttataaaataagggtactatcacttaaccggaaacaataaaaaaatattaattgttcaaagtgtaaaaaatattgtaaaacttataaaaatggctataaatatggcattaaaactattttagaagaaaaaaacatgatacaactaaaatttactcatttttagcgaaaaatcaacccaaaaagcgaaattttggcttttttgcttatttttgacataaactaaccaatttaaaaaaaaaaatttaatttaatcaatattctcgacaaaatttcgctaaaaatgactttttggaaaattttctggtctttaagggtcaaaatccaaatttagatgtttttcgtgcgtttcaggcctcccacagtccaggaaaaagatatagatttccatataggtaattggactccctacttattaggtatattgcaacttatgcaataggcgaaatactttttttaggctgaaattagatttttcagcatgatcgattttttttctcttgcagtgtttagaagaatccgtatttttttcggccgatacggattttttacggactacggatctttaatccgtaatcctgatcccgatccgtataaattaagacacggattacggattttttaaatttataaaaaatccgtatctgtatttttcctggatacggatttttacggagtacggattttccggatttttggtccgtaaatccgtatgtgtgcctagtccgtaatcccgatcctgatccgtattttctcaaaattccgatctctaatttccgcattttgaaccaattcaaaaactgttttaaagttgaagcgctttacaatttttgatggcttaatagttttatcagtgtataagaaaacatataaaagtgaatccatattttattgttttattggaatccttttcatccattccccttcaatgatccgtcattcggtcaacaaatgtttgctgccacaaattacaaatcggttgacttccaatttgtccgccatgtgtctttcaacggctgcagctgacaataaagttgtttcaaaatatgacgactatcagaaggaaatgcgtcttaagcaaatcgaacgcgcttttgacgaggcggtgagtcaattgggcttaattttcacacattcgaatttgtcaaaagattagttcagatgcctaaactgttgcacggctcctacaacaatttgatggcgttcctcgacacgaattccttccgttttgaagacaaagtttggctctttgagtcagagtgagtgaattgcgttcttatgagaaaaaactaattaaaacaaaggcaattttagtagggtaatactggagaattggtgtcccggagaaaaataaatttaaatttttcttttctaaaagttgttaacatatttatgggggttttctgggtcgctgatcaagaatatgacattaattttgaccaatttcgaatccctgacccggactcgaacaaaagtcgaaattcaaaattttcacacaaaaaataagtttgaattttcaactttttgtccgggattcggaattggccaaaagcgactccgaaaaccccagaatgcatgtttttcttacataaaaatttaaaaaaatagacaaaataaaataatttctcgaattccgagctcagatccgtaaccagcgt

SEQ ID NO: 3487 - DNA, 1254 bp, Heterodera glycines
cagaagcttgaaggggtttatgcatcacatttctctgatcactgtcgccgctcaattttgttgcacgcatatcgaaacgcaagtgagtgacgcaattgtaacatttctattcatttattctgttttcttttttagattttgaacatttcgcccattttggaggatggcactgttcgccttcgttggcgtatttgttacctcggcttgctgagcatgctgaacttccgcaattttaaccgccagtacagactgaaaaatgtaagtgaaatttggttttttatttttccgcatttcgatcttttcagttgaaatggtacgacggttactcaattttttacgtcaatggcgagggattggtctacaaagtgaccatccagcggacaatgcccgacgactcgctgaaaattgcctcgcttaaggacaagacgaaggagttcgtccaacgggtaatgacagaaaaatggggaaagggaaaatacaatctttaaaatgtgagcttttgttaagatagaattaaactaaaaatttccatttttagaagattttgccgaatccgagcccaaactgtgcgggtcagcaccagcaacaacagttcacttcagcaaattgcgcttcggaacggccgccgcgacaacagagaaacgatgggaggaggaaggaatgagtgagtgaccaatgatactgtaacttttaattgttctttttgtttgattgataaattttttgcttttctacttttctcattttgcccgttttggtatttctataactcatttattgttaattgttcggtcggaatatctgctcgtccttttggctgtctccgttattcgctttaaatgatttccggtcaccgttcggttggcagatgtttgctgtctctgccacaatttgcaagtcggttgattcccatttacggccatgtccaggcacaatgtttccacttcatgaaaaaacaagtagaaatgtactgaattgttaaaattggtcatttcaatgtaaggtcaccgtcgacccagaaattgcaaaactgagagagggcagaaaacggcgtaaattgacaaaagcaatcaagaagctggcggagtacagcaaaaagccggtaccggttgaggagattgaggtcgacctacgccaccaggcaacgaagggacagagggaacggacggacaacggagtacaaggacgagacgagaagaaagaggcatatggcagaaagaagttgctcaagcagtacgcccagtcgagagccag

SEQ ID NO: 3488 - DNA, 737 bp, Heterodera glycines
  misc_feature (18)..(19): n is a, c, g, or t
  misc_feature (720)..(720): n is a, c, g, or t
attgattggactcataannactcaatagagccaattattttacctagagcggacatcatgtggattaaacgttcaattgatgcccaagagaatgcgttggaagtgttgaagcaactctctcccacactttacgaagcggcggtacaactcgacgagcgcttattctacacacaaattcaaggtataggcctgttgtactttattcaccatccaacccttttacaaattaaaaaaaaaattaaatttttcgtgtgaaggtccaccaatcagtccgccgattgacaattacaattgcccagacggggagtaccaagacgtaaccaagaaatgggagctcccgatgctagaagaactggagaagaagttcggcacgggacgattgatcaaaatgccggaatttaaaaagaaacaaattcaaatgatgcgacaaaaagcagaagaagaggaagaaaaaatggcgataaaggacccgtggctgaagaaagacacatcatgtgctgtagaggaacagaacgaaacggaagtacaattggcgaaggcgtaaagcgtacccgaacacttagaaattcattacatgtattttaaatacccatttcgaaaaagactggaattgttttaaaaagccggactaattgtaagttggacagtgcttggcttaatttctcgaaaacaaaaagcgtttctttgaaaataaaatttaaaattaaattgcattcaaantataataaaatcggaaa

SEQ ID NO: 3489 - DNA, 940 bp, Heterodera glycines
cattactattctaataccgtagtctgtccatcccttaccgtaatcattttaaccattctgttataataccgtagtcaatccccccatcatatttttaatgcattactatcctcatactgtagtctgcccatcccttaccatgtcattttaatccatcagtccctctcttaccaaatcattttaatgatattgttatcatacaatagtcagtccctccttcaccgtattcattttattcattactattctaataccgtagtcagtcccatcccttaccgtgtcatcataattaattacagatattataccgtagttagtctctcccttaccatatcttacttaatgcattactattctaataccgtagtcagtcccatcccttaccgtgtcatcataattaattacagatattataccgtagttagtctctcccttaccatatcttacttaatgcattactattctaataccgtagtcagtcccatcccttaccgtgtcatcataattaattacagatattataccgtagttagtctctcccttaccatatcttacttaatgcattactattctaataccgtagtcagtcccatcccttaccgtgtcatcataattaattacagatattataccgtagttagtctctcccttaccatatcttacttaatgcattactattctaataccgtagtcagtcactccttcaccgtattcattttaaccattctgttatcataccgtagtcaatccccccatcatatttttaatgcattactatcctcatactgtagtctgtccatcccttaccatatcattttattcattactattctaataccgtagtcagtcccatcccttaccgtgtcatcataattaattacagttattatacccgtagtagtcgctcccttaccgtattcattggcttccttttcttcat

SEQ ID NO: 3490 - DNA, 6532 bp, Heterodera glycines
  misc_feature (6526)..(6527): n is a, c, g, or t
gttccgatgcctttttttggttctgatataaaaattgcgtaattttgtcaaattgtcgaagttcttcggcatcttttaattaaaatgcattaaaatgccattttaaaatcggtctgtcattcatcggtcccttaccatattaatttaatttcttcattactattatcataatatataattcattttacttttttaattacgaatcgtcttttaccatataattttatcagtctctcccttaccatatcttacttaatgcattactattctaataccgtagtcaagtcactccttcaccgtattcattttaaccattctgttataataccgtagtcaatccccccatcatatttttaatgcattactatcctcatactgtagtctgtccatcccttaccatgtcattttaatccatcagtccctcccttaccaaatcattttaatgatattgttatcatacaatagtcagtcagtccctccttcaccgtattctttttaatccatactattctaataccgtagtcagtcccatcccttaccgtgtcatcataattaattacagttattataccgtagttagtcgctcccttaccgtattcattggcttccttttcttcataatttttcttcctcaactcttttctcttgcacatttcgtatcgatgcgcccgctcgtcaaaatggtaattttcctccaatttgtgaatgatttgtcccaattttatcaaaaatatttccaattgttttgcgctgaaatttttgcgcggaatgtgcgcaaattgggcaatttggacgaatttgacgtcaatttgcacattttggagcccaattcgcatcgatgggacggacgaaaaattatttttggggaatttttggagaaaagttaactccaaattctgaagaaaaaagaaaatttaaaaaaacaaattggcaattgatcaaaagggataaaatattttatggcgaaaaagtgccaaaataaaatgggaaggaaaaaacggaaaaaccagttaaaaatcgacaaaaatgggaaaatggacttccaatttcttaaaattcttaccaaaatattttttttcctgaaaagcttccccagctcgttcatatttcattgataaaagggagtttaaatttaaattaaaacaattttggtttttaaaaacaattaattgaaaatgcaaacttgacaaagtgcgcagtgcagcgaattgtccgcgcatttccctccggcgccgtttccgtcgcaatccgcggaagtgccgaaaattaatccgtggtcaaatccatccggcaaaatacaaattgtctcgaatttgttgtccaaatgtttgataaagaagcgactcggaaattgaaattgcgccgcgtcggactaaaaacgaaaatgacaaatttaatgctaatatttataatttgtagagaccggcggacaggatcaggattttgtatggatttctgaatcctgattccgatcactttaaatatcggaatcccgacaaaatcaggattttaatcccggggatcagcctgttcccaattcctacccctgattatgatctgatcccgtcttttcaaaatttaggtctctctattaattagtgatgttttagcaattattacccattcattgaatattcgtctcagttcgattagcgtttctttcccatttttgtgcccataatccgacgcttttcctcccattttttccttaaaatgattttaattattatttttaattatattttattattctttaatttttaaatttttactttttccttttcctctaaatttgttctctcaaattctttgactgaatttatttcttgccatttttctgatggaaataattgcgaatttttctcactaaaatttattttgtctttcttttcaataaattccgataaatttgtgtcgctttgatattgacaaaaaatatttttgtctaagaatttttttaatttaaatttaatttatttattttaatttattttacccaattttcgctgtttttccgacttttcaatttgttccaaatttctttcaaattcttccaaaattttttctcttttttcgacaatattcgaaagtgccaatgttttctgtttttggcccaatttttcccaattttctattcgtcccttaacaattgcaatgccaaattttcgaaagtgcaattttcccacaatttctttccaattttcccattttatattttcattttcctggtccaatttgtccgatttgtcctccaaattcgtccccaaattgtccatttcccccgacaattccattagcagctgaaaaagccttttcgaaatgccttcataagaatgttttgccgagtatttcatctccttcagtctctcccactgatcggaaatgctttttgttttgtcgctttttctctgaacgtccagccattcgatcgcttccaatcggttggcaatttcgttggccaaaatgccaacatttgccaattcgattgcgcttgtcattttggtgtcatcgttttgctgttcttttgccgatgcattgacaatttcggcatatttcaatgcgaggaactgatcagtggcaaagttgatcagttttgtgccttccttttcgccttcgtcttcctcagtccccatcaacccttcatttggcggttctgtctctttttcctcctttcccttaccatttcctcctttcccctcttctaccgtactttttgttacagtaattgttttcatttgctcttttctttctgtatctcttcccattgcaaaactctctttttcttcttctgctgttgagaatgatcttctttcttcttcctctgtttctctgctgtttttcccattgtccgcttttatttcgttttctttcgtttctttgtttccgtttttgctcttttttctcttttgttttttcttttttgcatttaatttcgcttcttcctttttctcttcttcctcttcttttcccgctttttctttttcatctttttcctctttctctttttctttttcctctttttctttttcctctttctctttttctttttcctctgtttcaaaatattttattgccaatgttttccaaatttgctctgtcgtttctttacccaaatattctggcatatcatttacatcaacaaatgattcataaactggaattaggtaattaaagtaaattttcaaaaaaagaagaagctggttgggtagttaaatcattaaagcgagggttgataagatataaaaaaggcggatatgcctcgcctcgtaagcgcaatggttgatctgcccacggattgggttgacgaatgggttcgattaccacccgccgatgcctaacattttgccatttcttattctaattatctaaagtacaattgagcggtaccggttaggtgccgtgaaaatttttggaattgcgccgatttcttaacagattttcattgaaaattatagcaaaatttaaaaaagagaattattttaaaaattggccaaatgttcaaaatatccctttcccctttcccaaattctcatgaaaaatcagctcggattcacattcttaccagtgtaaatttaccggatagtactggtaccgccgctattagaaaaattgaaagaaccggtaccgtaccaaaggtaattaattactggtactgctggtaacgctaaactctaatctacagtaatctcttgtccattttctttttcttactggtttttaatatttttttgaaaatggcgttttcctccaccaatttgctcagtgtttcaacattcttttcgcccaatttgacttcaaatttcgcataattttccccgtttttgtcactttctttcgcttttcctttcacttttctcgtccctttcttttcgtcgtattttttctgtgctttttcaattattttccgaatttcctcgtccattgctttttcacttttcatttgctttccctccaaaactttttcaaaaaataaattcatttcactcaaaaaaatcgattgataaatttgaaagtttggcatttcgtccagcggttcgtcatgccaacggtcgtacagttggtaaaacaaaaatttgtgccgcttccaaacattggcacattttttccgggcgatggtcgcggcggaattggaaattttggcatcggtccattggacaaaaatgaacaaatccaacttaaaaagtggccaatttttaattttaaaattgcatttaatacctttagttttacattcagccaattcattgatttggtgatggtcaaaaactcaagataaagtgaataaagccgactttcatttttgaacactgaaataatatcatacattttattttataattgttttaatttcttttaattgggcaattaatttttctcttttttatatattatttttcttttttacaaaatgctaagccatttactaaatgctattgtcaataataattaattggtgataattttcgaacattcattggcctccgtttgctgcgttttccacaattctttggccatccaatcgccgtccctaatgtccggcaaaatttcgctgctcaaaaacttccaaaatcgcgttgtgccaccgcttttttcggataatttacgtaaaaattcattgaaataattcaaatattcgtcaaaaaatccatacacttgtactctgaagaacactcggttcttctcaaatgctctttatttgtaaaagaattaattataaaaatatatatcataagtagagaccgactaaaaaggcaccaaaaaccgcgaaaaaggcacccaaaaattgaaaaaaaggcacgaaaatcccgaaaaaggcatgaaaaaaggcatttaaatctttttattaaggacttttagggagcaaaaacacgtaaaagttaaccaaaaaattaattttggtcatttaaatgataattaaatattttataatttttttcgtattatgaaatttataaaactaaaattttctatcaagaaaaaaatatcaaattttggagatgaatttttgagaaatttttcatttcttaggggtgtattttcccgatttattgcatttttatggaatttttctgaaaaaaatgccaaaaaaggcatttaaggcacgaaaatcccgaaaaaggcaaaaaaaggcataataaaagtcgacgtagaagcctcaaaccaagtggaaaatgtgttatttatgcttaatatatcgaaactagtgcgcagaaaaaaaggcatatgcctcaaaagtcggtctctaatcataagagaagtagttttatgaaatttcgccagtggtacggtattttaacaaaaaaaaagattctgtgaaaccatgcccttacagtagtctaatgggggaaaattatttggcaaattagccaggcatatttaaggatacgactcagccgcggataatcgcggatcatttaatgaagctcatttttcacatttatggactgacatatggaacaggagtagtgctcatccagggctgaacgcaattatggattatgaattacggcatttttggacaccttaattacgagtaccgatttccttaattgaaaaaattacggattacggatttccgtaatttaaattcagttagtgcagccctgggctcatcagcacggtgcaaccaaaaaaatcaggaccttattgttacagtactgtgtttctgcccattcccacatccaataaattagaattaaaaaagcaattgtttggcctgctgaactcccccccccccctcataaataacatttttacaatcttaaaaattaattatgagtgacaaatgataaaaaggacaattaagtattaaaagtttagtcaaaacgtagaaaaataataatgagcggctattcgaactttaaattactcagttttattcaatacttaatccaacagcaaaacaagaataattcttctgttttgtttgtcaacggggaaaaccactaaattcataatctatttggaagagccgtgctaatgaggggctcaatcttcttctgtcaaataattttgtgattttttttcctaaaattgtccgcaaatgtctgtaggccctttgaggggtgaggattttaaaatacagtagggtcccgtggtgactcttttgtccaccttttcacatcctcctccttctcgcattcgttcgggtgccaatctttgctgaatttttgcactttttgctccaatattttgcctcctttcaaagtgtcattaattgtcatgaaaagattgaacagcgtacaaaatgccttcagcagcagaacattatttgcatggtttgaaaggtgtaaaatggcgaaaaaatcatttctcacggttgaaattttctcaagaaaaatttcacggacaaattgaaattttctgaaagatttgttttcattcaatgcgacttcttggcttttaatcgcggtgagaagcgagggcgttgagcatcgaatctcgagaaagtcggctcttgaactgccgctttgggagtcaagcgagattcagcaacatattggtgaattgttttggggtcagaccnntgcag

SEQ ID NO: 3491 - DNA, 2915 bp, Heterodera glycines
  misc_feature (2792)..(2792): n is a, c, g, or t
ttttctatttggggaaatacttttgctcatttttggttactgtttggtctaatgtctcattctcgagaataacaactgaatgaaaatttattttgctgtgtatgaactgctcatatattgggacaacaattgtacataaacataaaagtaattcatttatttttataaataaaatttaaattaaaaactctccatttaattatcatttacttaaatataatttatttattttttatttctctcaccgtaatgcataactcgggggaaaaggtcctccaatctcttcaatgcaaagtacgaaatgttcgaaatgatttggcttttaagcgacgaaatgttccgctcggagccattgcaaaaagtgctccgaattatgtgggaatgcgaaattaaattaattaaggagaacaattggaccaatttgacaaacgaatggtcctcgcgtatttcggcaattaattcgcttacattttgttcattagcgcaatttaatcgttgccattgccattggtgttcggaaagtaaaaaaattctcttaaatttaacccattattattattttctaattggccaattaacctcaaggctaatttgcttatccagtggctccgtgcctaattccttgacattctcctccaacagcttcttccattcctcgcttaattcgatcagttgcgcatcgttcactaatttgtgcatgaattggtaaatttggcacagtttcccctccaaattttggtcatcactttttggcactttcatcagtttattaaatttgctcatataaacaacaatttcgtccgcaaaaatgtcattttccacataaaattgtgcatatttaagcagcttttctgccttttgcccatagtataaaagtgccgctccaatttcgacactttttgtcaattcattcatttccatttccgatttttgcttattctcttcccacaacaactgaatgtactgctccatcagtgcataggaatctgaaattaatattaaattgtaactcagtcaaattttctttaaaattttgctaaattttcccgaaaatccacaaaattagcagttttttgataaaaatttgctaaaaatattcaaaattttgtcatttttttgacaaaacctgctaacaaatctcattaaaaattacaaaaattttcccggcagcgcctaatggcaccgccggacccccccccccccaaaaaaaaagtttttgtaaaaagcgccgcaaaaaaagaaagaatttattaaaatttaaaaaatatttaatttggccaaccaaaggtcatgtcaacgcggtccttttctgccgaatgcaaaagggagaactctttgtcggggcattcatcgttcattggcaatattgcagaaaacgattccggctttatttgattattttttgaatgtgccgtgccacctttgaatatgtgccaaaattggtcggccaccacctttccctcgtccaccacattttcctccatgattttgacgaatcgtttaaagcgcaaccgaatgaatgtttgcccctcaaaacattgtctgagctgttcgcttccgttgtgcaaattcacaaaatgttccgtcagatgtatcagcatcgttttcgtcctaattgccgtcagtccgtcgtttgtgtcgccgcggttttccttctccaaaccgtacaaaatgccgtagagcgattcctccaaatttgccgtcttttggacaattattttgtcattttcttcaccgattctgaccatgttcatcacttcaatgaacgatttccacaatttctctgtttcgtccttcttcgtcccttttttgtgaaattcggcaaaaagagaaaatattttactgcaaattatcgcatactcaaaaaagtcttggatattgtttttgccttgacagaaaagcaattcaaaatagccttgcaagactaactcatcctcaaagcctgaacaaataaatacaaaaactaaatggaggaaattttttcaaaatattccctttagtctgaccgactgtaacgggtggtaagggtgtggtggtactgtaggagagcaaaaattggtgttcgtttttttcgactttcttaggggggatggtggtattgtagtggagcgaaatttcagtcgttttggctgtggtacggtaagcgttaacagaccgaacaacaataacattaaagcggatttttaattttaatcccacatttgcctctccttctgctccaaaagtcttcgtcttttttaggggagggaggggtactgtaggggagtgaaattgtcagtcgtttcgggcgcggtacggtacgcgttagcagacttaccaacaacaaattaaagcgattttttgtttttaatcccccatttccctctctcccctacacgctccgaaagtgttcgtcttttttcgacttttttagggggtggtactgtaggagaacgaaattgtcagtcgtttcgggcgtggtacggtaagcgttagcagaccgaacaacaacaacattaagcagattaaaattttaatcccagtgttcgtcttttccgacttttttaggggggggggcgataggtatgtgcgagagtctcggttctcgattcccgactcgggaaatttctcgggtttttcgcttcccggtctcggttcccggtctcggttttttagtctcggaaaccgagaaatttttacactgttaaggatgaccctttcggggagtgggtcgccggtaaagggagaaaagaggaaaaattattgaaattttgaacaaattttctttacaaaattcattaaaaatcccaaanaattttccccggcggcgcctatcggcaccgccgtgccaaaaaattcctcaaagatttcaaaagtttacctaaaatttggcaagcaaaaattggcctttttggtgaaaatctgttatcaagtcg

SEQ ID NO: 3492 - DNA, 1426 bp, Heterodera glycines
caaatcaaaagtgtttactcaattggatttaatgaaatcgttgaaagtccgcttttaaaattgtctaataaaattgtcagctgccaaaaatggcacagattggagagaacaatttgcataaatttatcctccttagcaaattctttttcaatttcttcaaatttatccttaagtattttaatgcgctttaaccaatcggccgactttttcggtttaataattttttcaaattcctcaaaatctttttttattctccggtgcagatgagaagcagacaagcgattgatcagaatcgtttgatcattaattgacaaattgtcatcgaaaagcaatttggcgtaatattcatccaaacgattggtgtcgatgcctgcggaaacattgaaaaaaaattgtttttattaatttattttgaatttataaaaacaattaccgaacaaatttttcgaaaaagtttgacttgccaaaaataaaatataaaaagaaaataaaggaatgaattggcaattatttgatctcatctctgtgacctaaaagaaaatcggaaaatataaattatttaaataaaattattaattaatatatttacataatattcctttgcattagtaataaaaaaattattaaagatggcaaggaaattgcattttataagaaaaatcaattttagtattaaattgttgttgtcgtcacccgtgacgagagaacatttattttttggccaatttttttcgatttattggagattggatttgaaatggatttccatattttccgtattttccatctgtcactttttattcatacatatttcggcttgtcacaagaaaattcgaaaaatccaaagagcaaaattttcaagaaacacattcctaaagaccaaaaattaattcagaattgtcaaaaaaacttttttaaatgttcaactttttctcttccccaccctctctctctctcttttaatctctttctctttcgctacttataagtgatttcaatgggtgctatgtcgttatttaaaaaacatcataaagggctttatgatgagaagctcgaaaaatttgaaatttcgactttgttcgaaatcgggtccggggttctgaattgggtcgaaatggttatcagaatcggattctccgactctgaaaacccctaaagactttatttcgagaaacaaattcttgaattttttttaatgtaaagtcggcactattaccacgcatttttggaaattgcgggattaatcccgcgagatccgagttccgcgaaaaattttgagtttcgatcccgtagtggtatccgcaaatctgttttgtgcgggatctgcggggttcgcattgcgattttttgaatcggcgaaacggatatggagcgatggaaatcttgtatttctttttctttccattttgccgatactttttcatgt

SEQ ID NO: 3493 - DNA, 4050 bp, Heterodera glycines
  misc_feature (75)..(75): n is a, c, g, or t
  misc_feature (83)..(83): n is a, c, g, or t
  misc_feature (90)..(90): n is a, c, g, or t
  misc_feature (153)..(153): n is a, c, g, or t
  misc_feature (174)..(175): n is a, c, g, or t
  misc_feature (178)..(178): n is a, c, g, or t
  misc_feature (184)..(184): n is a, c, g, or t
  misc_feature (272)..(272): n is a, c, g, or t
  misc_feature (301)..(301): n is a, c, g, or t
ccccccccccccccccccccagacatcactccgctcaggaggatccatcgccggtggatcgatattttctttgcngggcattncctgaanggaattgattcattcatttgcccgtcactgatcaaataggctttcatttcactgaatgtcaanaggacagtgcgcacgaatcanncgnccattntggacatttctgatcaaatggcctttcgcataaaacgttctttctgatcgtccccttctctcagccacacgtcttggccaacaaaggncaaatccctcgtcgaaacacttcgcccanttgaccgcccgtacggttcggtcgcaattgtctcgcccagcaaacccatcaaaaggctcgtctttccgcaaccgaccggcccaatgacgccgattagcattcccttaacggggaaaataaacaaatccaattggattcattttttgtacctttttcccgttaaaatggacattggagacagcgcttttagtttcgttccacgcaaaagaattgccatcaagtccgagcagtacttaaacattggcatggcattggtcagtgttcagcaacggaatgaccgctcaccccctccctccgcttgggtgagaatgttttggcgctggtcaccgcaacggatggcgaagaatgcgtcaaagcgtcgtttgctgaccattccgttgataatcgcactgagcacccacgggaaggcgttcactgaagggaactcaggaaggaaagtgatcgaccgaaacaaagacaaagcccacaaggcatgatcagaatgctgatcagggaaagggtcgtgaacactttggcagcggtgagcaattcgcccaaaacgacggaataagtgacgagcatcagcaccatgattacggtaggggcggatgcctacggtggaacatacggtaacagccaacccacggcagcaccaacccaaaggtacacacagacggcgtcgaggtatttcattcccttcaaattagccaattcacgtgacctgaggtggccaattttggcttcgaaaaaggccgtccaattgttcagtttgaccgtacgcattgaccgggacaattcggttactgtattcaaaaaaggaaattaaaaacattgggggggggggaagcagtacagagtttgaccctggcatccttcatttgcatcattttgttggagaattggccgactttggaggcgatgtatttgttcagagggattagcagaagagagacgagaacaccggcgagaaaagccattccgacctaaggaggagaaaaagcggaaatgacaaaggcacaaattaattatttggttttgtaaaatcaaatgccgaagaatttacgtatgtaatttagtaatgctcgagagtctcggtctcgactcgagaaaagtctcgggttttttgtctcggtctcgagtctcgggaaatttttggtctcgagcatcactaatgtaattaagcgtaaaattatttttaaatatgcttttgagcctcgcttcgttttgttctgtgttcgattccagtcccttatgactgaaaaccctcggccttttttgccacttgcctcgcggtaaagcaaataaagcgcaatcgcaaaatttatcggcatactccaaaaagctgaaacgaattttattggccaattaatttgtcacaaaccgtgaaatgcgaccataaggccgccaacacggtcaacatcttcaaaatgacaattcatcagagaaaaagaaaatgaaaaacaattaacccaccgctggacatcaaattgatcaaattgccggacgaaaacttttcggtcaattgaaaggctgggattcgcagcaatttttggtagacggcgagaagaagcgcactctttgcgcgaagagtgatcatttcgatgtaataattgaactgaaagtcgcagacggaggaaacgaacagagagacggacatcagagcggcacaaacgtagcccaaattcttagccaagaacaaatcattacggcacaccttcaaaaagccaatcaccacggattgggaagactcttgaagcgaagtgatcagcaagtgaaggagaattgggcctaaggggggaaggggagtgaccagaaaagattctgctgatcagttgatcagtcagccatttagtccaatcacttgcgaatctgaacgcgtccccagtgaatcggacaacgccgatgagcaaaaaggtacgcccataggcacggaaaagggcttcagcgaatgaaaattcggcagaaagcagccgctgatcggcatggtcggattggccatggcagtccccgaggatgtcacgctgaagcctgggcaagtggaggctgggcggaagatggaacacatcgtccaccttttggagaaaagacaattttaaagggggaggggggcggcaaaagaagacaaaaacaacctgggaaagatgaccctgaaagcccttcctaagcaggggatttgtccagcagaagaacagctttgacagccaattggagtgctcgtgactgcacaacaaaatgatcggaggatcatcgccattctgatgatcggacgaagcatcgccaatcggaagataaccaaaattggaattggacaacaacggaatagaattggaaggacgacaaaggcacaaaacaaattggcaaacagagcaaaggagaatggagagaaagaagagaatggagagagttgaagagacggaggggccaaggaaaagccaacgattgagcgagaggagggcgaacagagcgcagaaaagagcatggagagacagcgaaaagacggacggcacagacgatacactgaaaagggaaaggcattggcaaaagtaagacgaagagacggagagagagaatgagagagagagggaggaagagaaagagagagagatcatcctgaccaaactgatcagctgctaaacacaagctactcattatcaagtgatcagagcagggagcattggtcaatgattgattacccgtaatcacaactgatcaatgaatccaagcgtcaaacaatgagaaccaatcagaaattacttttagtgaaacgaatgctgactgactatcgcagctgatcaatggtaatggcactgatcagttgacaacgaatggcactctcagcctatgatcaccccttaatttaatccctcaaataaattaccaaaatcaccttttctgttggaatgtaataaaataaaagagggcattcactgcccaaatgaaagcgaccaaagaataggcaatgagaaggacagaaggaaatggggaaacaattaattggagaagggcgacggcacagacaaaggcggagagaaaggcgaagagaagcgacgaacgccgggggggaaaagcatcggcagcaggggaagagagctaaaaagggggaaaaaggaggggataaagcaaaaggggggggggatgaagcatccataattagctaattgttggcataaaagggaccgaaacggcgaaacggacaacgacggaacaaagaaatgcgaactggaacagcagaagcagagagaactccctgggaaacggacgaaaaatatcagaaccaaccatcaaaacaattgtgatgatcattagaggctttttggaactgatgcaattagtggaaaaggtctggtgttccttgtccacccatatagccccgacccacccgcacggagaaattggcaaaaggaaaaactgttgctgtcgtttttcgatgttacagtcagcactaccgtaacattggagtcgacaaaaagcccgaagggaatccattgttttgcgtgaattactgagaagttaacttttactgacaagaaaccttccacaagaaaatgtgtttagtcgcaaaatcgactttattccgcaacacttcgctttaggtttaagataaatcacaaaaatttaggaacaaaaaatccgcgcacctaataaataatttagagtaggaaatgataaattcatcgattaacgaactgcggatgaaaatgctcataatattcacataatgactatttggaaaatgtatgctgttgacagacagaggggggggggggggg

SEQ ID NO: 3494 - DNA, 4032 bp, Heterodera glycines
aagcagccgctgatcggcatggtcggattggccatggcagtccccgaggatgtcacgctgaagcctgggcaagtggaggctgggcggaagatggaacacatcgtccaccttttggagaaaagacaattttaaagggggagggggggggcggcaaaagaagacaaaaacaacctgggaaagatgaccctgaaagcccttcctaagcaggggatttgtccagcagaagaacagctttgacagccaattggagtgctcgtgactgcacaacaaaatgatcggaggatcatcgccattctgatgatcggacgaagcatcgccaatcggaagataaccaaaattggaattggacaacaacggaatagaattggaaggacgacaaaggcacaaaacaaattggcaaacagagcaaaggagaatggagagaaagaagagaatggagagagttgaagagacggaggggccaaggaaaagccaacgattgagcgagaggagggcgaacagagcgcagaaaagagcatggagagacagcgaaaagacggacggcacagacgatacactgaaaagggaaaggcattggcaaaagtaagacgaagagagagaatgagagagagagggaggaagagaaagagagagagatcatcctgaccaaactgatcagctgctaaacacaagctactcattatcaagtgatcagagcagggagcattggtcaatgattgattacccgtaatcacaactgatcaatgaatccaagcgtcaaacaatgagaaccaatcagaaattacttttagtgaaacgaatgctgactgactatcgcagctgatcaatggtaatggcactgatcagttgacaacgaatggcactctcagcctatgatcaccccttaatttaatccctcaaataaattaccaaaatcaccttttctgttggaatgtaataaaataaaagagggcattcactgcccaaatgaaagcgaccaaagaataggcaatgagaaggacagaaggaaatggggaaacaattaattggagaagggcgacggcacagacaaaggcggagagaaaggcgaagagaagcgacgaacgccgggggggaaaagcatcggcagcaggggaagagagctaaaaagggggagaaaggaggggataaagcaaaaggggggggggatgaagcatccataattagctaattgttggcataaaagggaccgaaacggcgaaacggacgacgacggaacaaagaaatgcgaactggaacagcagaagcagagagaactccctgggaaacggacgaaaaatatcagaaccaaccatcaaaacaattgtgatgatcattagaggctttttggaactgatgcaattagtggaaaaggtctggtgttctttgtccacccatttagcctcgacccacccgcacggagaaattggcaaaaggaaaaactgttgctgtcgtttttcgatgttacagtcagcactaccgtaacattggagtcgacaaaaagcccgaagggaatccattgttttgcgtgaattactgagaagttaacttttactgacaagaaaccttccacaagaaaatgtgtttagtcgcaaaatcgactttattccgcaacacttcgctttaggtttaagataaatcacaaaaatttacgaacaaaaaatccgcgcacctaataaataatttagagtaagaaatgataaattcatcgattaacgaactgcggatgaaaatgctcataatattcacataatgactatttggaaaatgtatgctgtttgacagacagagggggggggggggggcagaataaatgtgatgatgagtacgtgcaaaatcgacaatcgccattttaaaacacgaatcccacaaacgaagaagctcaacaattcgcagtcgcatttttaaaccgaggcctccaacttagcgtttagaatgtgatcgggtggtagacctgcaaaattgaaagggttatttttaaaattcaatggtaatagttcaacacacattaaaaaaagggggggggggagtcagcgcccaaatggctggctgtgccgataagcggtgtatgggaaaattttttggaaattctcccctctcctttataccccctcccctcggtgtaattttacggcgaatgatagagggggggggggggagatggaggaatcgcctccacactttttgtatgcagtacaaaataaattcaatgtttaacaatgttcataaacctaccattttcatatcgtttccaaattctgtgcaaaaggttctccatgtcggtgcagtactgtttcacatcaaaaagtgtgcttgtggtgcgtgcctgaataacaattttgaataatcacaagacataaattataattaaaataaaagtttaaagtttgaccttccaaactttagcacgcgtttggttcaggctgaaattggaagagcaattatcaaaaacattaaaaattttaaaagggactgacaattccttgtcggtgcccaatttgacggctattccgatgtactcgtctctgtcctttgccaccaattcaggacatcccaacgcaaaaagttggctggaagcaacgcgcgaggccaaggtttccactgaaattcgattgaaataatagaaaaataattattcatacgtggcattgtgaccataggagttccggtccacagaatgtccattcccgttgtgtgtccgttacagagaggcgtatccaaacaaacatcggccagctgaccacggcgaacatgctcctctgaaatggaatgcccaaacaattaatttgataaaggcatacctttggccgcaacgtttgaaaagaccacccttttcgggtcaatgcctctttgcatgcaaaacttgagaatgtgcggctctccgtggtaagggaaacgcaaaagccataaaatagcagacggaacctgaaaagggcatcagaaagatagcaatggagaaaagaaagtgctgaccatcttcagaatctcacaccacatccccagggtaggcgggtcgatcttgtaaagctggttaaagttgcaaaagacaatcgcatcttcgggaagaccgtattgctgacgagaagtcacctacatcgaatgagtgtaatatattagtaaaacaaagagttaaataccaaaattgtctgcgggacttcttccccggttgccgctttcacatgagtgttcagtgttgtcagtccgttttggacaggcactccgctgacactggccgcgattagtccgcttccgatcatttgagacaatggctccgtcgaagtgacttcgacgactggcacgacaacctcagtcattttcacctctctttcgggtccgtgttgaacttcggcttcgcgcacaaatgtctaaaaaaatatttatttccatttttgttgttttgttagcaattgcctcactttgacttcacacgccgcgctggacaacagcgactgaagagcattttgtgttgcgttcaccaaagtcacgcagtctctctccggcaattgtccgtccttgtccttcactatcactctctccgtcagatgagccaacatttgtgagtggtcaccgatgaaaaaagtgtgtggcatataggccaatttttcgctgtatgcataagcaagctcaatgggcgaagtagtctcatcggttatgatgtaatccatgaaaggggcgcccgaagtgccggggtaaccaagccacataacctagagaaacccaatcaaaaaatcattcagaaattcttaaatgtttcaagacctgaattggggcaggcctcagtgcgaatatttcattccttgctcctttcgtgtatccgttcatattctgtaaaaaaatggtcagatatttatagagtacctaatcaaactcacgatcagaatgtggactccatccttgctgatgcgatcagctgccattccattgcatggagtctgaaacacatttaagcattgcaaaagcgtaaatcgaataaagaaaaagcatcaccgcagtcaggagggcaaaatgttcactttcttgcatcaattttgccga

SEQ ID NO: 3495 - DNA, 3976 bp, Heterodera glycines
  misc_feature (20)..(20): n is a, c, g, or t
  misc_feature (28)..(28): n is a, c, g, or t
  misc_feature (52)..(52): n is a, c, g, or t
  misc_feature (1416)..(1416): n is a, c, g, or t
  misc_feature (1859)..(1859): n is a, c, g, or t
  misc_feature (3891)..(3891): n is a, c, g, or t
ggggcagtccccctgaaccngatgcgcncagatttatggggagaccgatccnttccggaatagcttcactatagcctgtacttaaattctgcgttgatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatattttttttcagaaagtgctctaaagcgcaccaaattttatttacaacttaatttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcggggggggngggggggcggtgtggcatataggccaatttttcgctgtatgcataagcaagctcaatgggcgaagtagtctcatcggttatgatgtaatccatgaaaggggcgcccgaagtaccggggtaaccaagccacataacctagagaaacccaatcaaaaaatcattcagaaattcttaaatgtttcaagacctgaattggggcaggcctcagtgcgaatatttcattccttgctcctttcgtgtatccgttcatattctgtaaaaaaatggtcagatatttatagagtacctaatcaaactcacgatcagaatgtggactccatccttgctgatgcgatcagctgccattccattgcatggagtctgaaacacatttaagcattgcaaaaacgtaaatcgaataaagaaaaagcatcaccgcagacaaatccacaaaatgttcactntcttgcatcaatttttgccgaaaatttgtgttgtcattcggagacagcgcataacaaaagacttccacgcgactgcgattgtgcatcccggggatggactgcatcagatgactcgtcggatgattacctaataaaaaaaggggttcaatggctaataattgtcagagagagagaaagccattttgagagaggcattaaatcgtttattaagttttaaagtaagtgcttattgccctatgcctttgattttctaccgaaatcagacgaaacgtatccaatcctcaaccgttggtggcctaaccgaatactcaatttgtcggggtaagtgtacgaaggtttatgaagcacttgaatcttctcaatgcataactgcgcatgacgaccagcaattgcctataaaagcaattttttaaaatttattccaatcactttaaccattcgctgttcgtggcttagcggataaagcatcgaatggtgagggtgcacagaagggagccgtctaaaattggcatggctatggcgaattttttcttttcattttttacttcttctgcaattggtcctcaacaatgctcaccaatttcttcattctcggctcataatcagtcctaatttattaaacaatgacgcattaagtgttaaaacaaaccaatcgcaaataatctggagacaatgtgccaaattgcaaaaagcatccggaaaatcactttttaatttaagcgcagtcgaatagctggattgaatatagaaatacaattaaatcgaaattccgtatcgtaattcccctccccccccccccaatgcacctgtgaattgcctcggggatgtttcccgcatctttgtgaatgcttgccaaattgctgtgcgcgtccgcaaaagcggggttaatttgaatggcgcgagtgtaacattggagagctccgttaatgtcgcccatttcctttagagtgttgcccatatttgagtaagcatcggcaaatgtcggcgaaattttgatggcttctttgtaatgttcaattgcctcttggagtcggcctcaaatttcatgaaaattatactaaaagggatgcatgggaaaccttgctgttgtaaaatggacgccaaattgctgtgagcagccgcgaattcggggtaaatcttaaaaaacgggagattaatgccgaattgcaaaggaatgccgggcagaaaacattaattaattcttttgccactttacctttaatgcttccaagtaaagtcttgtcgcctcctcaatttttccctgttcgcgcttaatgttggccaaattgttcaatgaatccgcatggtttgggcaaagtgaaagggctgataaataaattaaaaatataattagcaatttttgcttattgtaaaccggtattataggcttgttcagcctccgtcacgagtcccttttcttttaaagcatttgccaaattgcaataggcgtcgggaaagttcggctgcaattcaatggcacgtttgtacgtctcaattgccaaatcgagatgggcctgttcgtagtaaacgcaagccaaatttccatgcacgacggcgtggtttggatttaatgcaagagcacgcaaatacgcggcgacagccctaaaggaattcggtaatttaccggaatttatgtattttctagccccctttattaactttacctgtcaaaaattcttgcttcctttagcacatttcccatgttaatgagcgcatcaatgaaattggggtccaatgcaattgctttctcaaaatgatgcaatgcaagccaaagctcgccttcaaaaaaggtttttattcaaaaagagaatattgaagagaaccctgcgcgttgaatacgcagcccatatttgaccaagcaacctaaaagggatgaattctttgtaattttaggttaaagtacaatataacaagcagtcgtgtgaatggaatctcatttaatttaaaaaacaattagttacaatgatttgtttaaaaaaaagtcttacagcaaagtgtggctgcatctcaatggctttcaaataacaaaccnttaaagaaaagttttaaattatgaaagaaatgcgacgacgaacgacctttgcctcctcaaacctattcattgcctaaattcaaat

SEQ ID NO: 3496 - DNA, 1006 bp, Heterodera glycines
  misc_feature (8)..(8): n is a, c, g, or t
  misc_feature (971)..(971): n is a, c, g, or t
  misc_feature (995)..(995): n is a, c, g, or t
ttcctaanagttagtttggctaaatttttgatccccacacatcgaaatacaacaacaaaggttaggaaatcttctacttaacttgtcttggcaaatatttatattgattagctgctatctttcaatggcataaaatagcaaaatgccattaattaattaatttgccaagattttgtgacattatgccaaggaaggggtgatggatagttcaaaaactcactggtcacccaacgcgtggatgcccttcacccaatggacggacataaacagaaggcgcgacacgctttcgcagatcacgcggaagtccacgccgttcatctgcagttgaggattttgttgctgctgctgttgttgctgtaggtgctggtgatggtccaacatcggtggcattgacagttcaaatttggcattttgtgcactgatcaccggcgattggagcgatgccggtgctggcggggaattgcttaggccgaccccacaaccaccgccgacgccatgcgacgatggcatggcaccgccgtcaacggagaaagcggtggacgagccgcgcgaggaggcggtcggcgaatcgtccaactcgaggaaaagtaacggatcagcaccagcagcagacgatgccttaaaaggatgggcaaattgttaaaatggtaaagttagaactgacatttggaaaaagccttgacctggattgcatgtagaagtggacttggatttcccggacaaaaatccaggaaaatcaaggtccaggaaaaatccaggcttgtcatgtttctggacctggatttttttcatattgtatttgacctggccctcgatttgattgactaaaattcagaaaacccaggtgtccgaaaaatggcctggaccaggatcaggaaaaatccaggcctgggccaagtccaggtcgagctctagataaaacaaatcagttgggggttccaaattatcgagagcctaagcgaactcggatntggtgagcagttccttgctcttgngcgccgctttc

SEQ ID NO: 3497 - DNA, 3068 bp, Heterodera glycines
  misc_feature (35)..(36): n is a, c, g, or t
  misc_feature (51)..(51): n is a, c, g, or t
aatgtgccgggaccgatggtgccacaaatgtcacnntgaggagaggggcgnggtgaaagctttctttgaaatttggtagtttttttttatcatatttcattaaaatttcaaaaatttccccggcggcgccatcggcaccgcgggaccccattttaccaacaaaatcctgcttttctaccgggcgccgaaaattttgaaaaagaatttacgtttattgtttttatttttttgaaatttaaaatcaaataaggaatagaaattttcggtaaaaattttattggtttagttttgacacattggctctaaagatatgtcaaaatttaaaatataattaacaatttattcaacaaatcaattttgctttcgccgcgtttaccatcgctgacgacgaagcggcatcatccgagcatgaatggggcggtgatgagcaccgcttgttgttgccaagcggtgcgtaccgactcgttgccgatggttgtgccgccgcggcagcagccgcttcgctgctagcaccgccgctttcacttcctgacgatgtcgtatccaccaaaatcgggtgatggtggtgctgatgatgttgttgtgttgggaccccgccggcaaccgatgccgaagacgatgacgaagacgaagacggcaccgcctgttgttgttgttgctggagacgcaaggcattagccgatgccgcaatttgctgctgctgaagttgatggtggcggttgacaaacgcgagcagtccttgctgcaaattatacgcgctgctattgctggtggcggttgtgttgctgttgttctgctggttggccaacagattgttgttgtggtggtcccgtggcggtgatcggagctacaaaattaacgacaataataccattgtgtcgtgccataaattgagcctattagccggaggcaatttaatcattctaattgacttattgttaattgacatgccaaaaaatgcaattgatccagttgatcaattcttaatggctggctgatgtgttgatcaatggatgcattgaaatttgaacaaatcacgggaaatttaagatttgaacagttttttcttaagctatggctttgaacagcatatccttgagaaatatgttgatgacttctgaccttgatcagatcagttcttattttatcgatcgcttctttgatcgccccctttgtttttgattcgtctattcaaaattttaattgcttcagccatgggaaattttaattttagcaggatactttgatcatcaaacttccttgaactctgtccaaaaattttatcgcgagtcccaactccgggatttgaactcaaaattttattaatccctcaatttccaaaaaaatgcgagattgcggactggaatccttcaaatcttgcgcactcccggcttcgattagaatccttttttgatcagtcttcacttcccctcacccatttgcttacattgcgcgttgccggtgcgtccgcggtgttcagcctccgccgcttcgttgccgcctgttgctgctgatggagcagcagttcattgatgccgccaccgccgccgcttcccatcggactcgcgcaccttttcccattggcattgttctgctgctggtggtgttgctgtctgtataagctggccgccagtgcgttgaccgattggaacgcgttgtggtggccaaatgggaccatcgtcggcggtgccataaacgcactggcagacgacgaatgggcaaagccggcggtgccgaactcttccccggccgctgccgattgcacacggttgtggtggttgtggagatggttgctgcgggacgacccgccaccgccaccaccgcccgtgtatcgtcccgcgccgctttccatcacagctgcaagcgatgatgttggcggcacgtccgttgaggacggcatcgaagaggcggtgccaccgctcgatgcggcaactgccgccgcggccgccatcattgccgcattcattgggcgccgttcagcttgaactgctagataaaagaaggtatttacacggaaaattatgcactagaaaagtctggcaaaaaaaaaaagatttttggcattatgttattttattaaaaaagaaaagggggacaaatgcccgggcgccgccgtttggacccaattgtaagttaatctttacaaaaagttgggaaccgtaccaaacctatcgattttcttagcttatgttaaacatagggtttttccaaaaaatcttaaaaatgcttctatattttcagttaaaaaactcccaaaaaatgatggtgcccatattttgtgattccatttgagggggatcggaaaagagcgcacattcacttttcatgccggtcgacaggcactttttgagccgacaaaattggcaccgattccgatggaatttggtcaccggacaatctttggagccacggcacacataggcaatttgtttgcgaatggaacgcttgaagaagcctaaaaaattactgcctaattaggtaatcaattagggcgatcattcgctgattgaatccgttaattattgagaggatgctgatctttagagagatgatcagcatttaaccaattttggcatcattataggctaattaaattccgtgggactgacctttacatccttcgcaactgatggccccgtagtgacgacctaaagcaaaaagcaaattaaggcaaaaaaactaaatgggattaaaaaattttgtttaataaaaaaggcattttccaaataaatttcattttaatttaataatttattttcggtaatggcatttattaaatttcgaataatttaaaccattcattttttgaacaaaattctagctatgtttaatcattaattgggacggtattttcttaattcctttcactaaattatattacggtactttgtctaataaatgaagcaatgaatggcattttccaaaattttttggcatttttcgctaatttctattccttaccggatgctttgtcaccgcacaccacgcacagttcgcccgacccaatggtgctgccaccgccgttgaccgatgttggcgacccgcccgccgacgactccttgtgcagc

SEQ ID NO: 3498 - DNA, 2431 bp, Heterodera glycines
tgggccatgggctgctgctgtttggcaacaaaatggtgctgatggtgttggggagacatgaaatgatgctgaacggggggaggtgaaaggttgtaaaatgggggcaaaattggactaaattgggtgggaaatgggcaaaatttgtcaaatgtgccaacttttttggccattaaactcgaaatagaaaattaatgacagtgcacgaaaggaggggagggtggggtaattagaaggaaataatttaattattagccataggggcaaaattggaaatttaataatttgcaatttttggaaataaaatttgcaatatttttttatcatttaaaattctcttttttagtgtaaattgcataagtattttggatttttataaaaaaatccaataaattaaaaactatattttttaaatttattagagatgtgctaatctctactgacaagcattgacgtctttttctgctgaatacaaaatttgatcacggaacttaatgacgaatatgacgtcgtagattaaacatacagacaaaagttaaatttaaaattggaaattattttaatgattcaccaccgtaaaatcattcttggcatttgcccctctttttggcattcgaagtacttgaaattttttctctattcaaacgattatcactcaatgtttactccatcgcttcttcaaaatggctttaatggttttaggcaaaaaattgaatttttataaatgtttttttttgcaatttcaaaaagatgtagtacagtagtctgcttgctctttcgaatgaattcgataattctaatcatttctgggattcgaaatgagagtcaattaatatattttaaaaataaattttaatttttaatttttttaaagtctttgtgtcaattttgatgcctagttttattcctttttttcaattttaaattcctatagagaaaagatgatgattgatgataacatgttatcacactgtattctaaaaaacggattaatctgttggttataagccgacgatttttgtaatattttggagagagacatttcataatgcctttgacgtaaaaatgttggacaaaaaaatgccgaaaaaggtaacattatgtgccattttgggaaggcctatgattagccctgaaaaagagaaagaagagagagagaatgtggcacattagacacaaaaattgcattaaaaatgctaatgccgtgcttcttcatcggacaacgaccgcggcacatccaatgccacaatgttgccatcatttaacatcatttttagcagctttttgtcaccatttatggcacaagtccgaatcatatgtgtgtgtgaatgtgttaatgtgtttaaacaaagaatgaatgacgccagcagttggcgttctgcattttcccacaaagttttcattttatttttattctgcgcgagaaaatgacaaaattggaaaatttgttcaattatttttaattttatgcttccatgggataaattaaaaatacataaataattatagtgtcaattaaataaattctcattaagaaaaaaaaacttaatttggccaagtgaaagagggccaacagcagttagcggaccatttaattgcggacattggcacggagagccataattggaaatggatttagtgccaccacatttaattgagagggtgtgcaaaattaagaaaggtgttggttgggtggggaaggaaggacacgtgagcgagcagcaggaatgggccaaatgcttgaatgaaaagaatgaatgaataaattaatgtgcgtgggggcgcgcgaattgcgcaagatggcctccattaaagccaattaacgggccacaaagagcgaagaccgccgtggccaaacagagggggagggagggaatggcatcatcatcagcttatattatattaaatcatggcattagcaggaaattgttggaaggatgaagaagacgtggcagcagacaaaattaatattaacaaaatgatatttggtgcacaaattgcaaaagcaaaagtgggggatgatgtgtactgaggagaggagaagcctttgggcgataattagccgatggacaggtaaaaaatgtgaaaattaagcctaattttaatctttgcatttttatttggacaatttaacagtgaagcccaattaaggcaaaacgcccaatgtccaacggcgggtaattaattatttccacgaggaattcccaactctttttaattaggcggaacggagaaccaaattaaaaaaatgaaagagcgacagaaagccaacaataaaaaatgggggaaaatcactgattggttggcatcatttaaaaaagagtgggggagggaaacggacaatgtgcaaaacggaagataatgatgatgatgatgagccaggcttggaaatgaaatttggacgaaatggacagaagagaatatcggcggaaga

SEQ ID NO: 3499 - DNA, 1337 bp, Heterodera glycines
  misc_feature (1247)..(1247): n is a, c, g, or t
  misc_feature (1258)..(1258): n is a, c, g, or t
  misc_feature (1274)..(1274): n is a, c, g, or t
acacttcccctgccagtcggcgaatccgtcgttttcttcgccggcggcgccgtcgccgccggtgccgggcgatggccgccggtgaggcgctggcaattggagcaaatgtcggcggcagcggcgatagacaaaacggcgacgacgacgatgacacaccggcgctgctgctgggggaagaggtcaaagcgccaatgaaccgacgaaatttaagcaaaattcactctccgccattcatccccgtccattcatccgttcttcattcgcttggtttactacaacagctaccccccccccccccccaaaaagggtcaaaaggacgcgcagaacaaaaaaaagggggggggggagaaattgggcaatttaattatcggtgatcgaaaggaattgtgggaaaattcgcgaaattcctgatcagcagcagcacaaggccagtgattattggctgtggaagatgatcagtctttttgatcagatcaattaatttgctgactgatcattggttgggcagctaggctcggagatgcccggtctcggttctggaaccgtgaaatttctcagttgtttttggatgtataatcatccccactcccggggtcaattctcagtgtcttgatttcttgtatctcggaaaatttgactctgatcagcctaataattgctcctcacaacttatcttattatcactaggtgatctcttcagatgatgggatggagagaatatttttgattacttttcgcaatcttttctgcccgatcagagatgtgttgtaataaaaattacctaacaaatggagaagaattaaaataagtgtgtgccccgtttagagtttcgtacactgaaaacgcctcagggcatggccaattaatggaggtgtgtcatcgcagcagcgataagtcatgtgataaaaaagcaaacaaaatgcaccggatgtgcaatttgaaagcattgaaaagaattagaattgcaattcttggcaccaatggcggcaaattggtcactgaaatttggtcatcctctaatcttttaattagcccttaatgaaatttttgatggattttgcacaattttcaattttaggcgattaattttacacaaaagaactatcagatttgatcaaaatgctgtaatctcaaaaaaccattcgtttagggaggagaaaatattgaaaagacagacggataaagcattagtaatgataatgatatcagaagatgctaataataataataattagtgaaccctattngagtgagaggngaaaggtggtcttggngtcgacacccatcccgcgtggcataattttaaccttttttcattgctcaaattagttttgatt

SEQ ID NO: 3500 - DNA, 3373 bp, Heterodera glycines
agacatttgtttgtaccctggacatggacaaagaatccattttggcaaagtgccgccaaaaatcgagaatattttcgagaaataagtgccgaaaaagcgtgattcgaaaagtcgagaatcatttgaatattctcggcactgatacagaaccaaaaattttttgcaaaatgtcactgtgaagcaacattttgtttatttgtccagcatttcggctttttacagttattaatcatttggcgttttgcaataagcattttcaaatttgaactcactttttggtcaattttttgatcaattgcgcctgacgctctgagctgctccaacgccacaaatgggttctgttgctgttgctgctgatgtgctcgttgaactgcttgctgctgctggtgcaaccgcaaattgttcaccacctgaatgaaaattgcggaaaatttgcaggcatttcatactgtattcattggctgacagattacggtaaaatttttaattaggtgaatgagaatggtaaatgctcattataattagagctaatatttttaggtttttgcctattttttcctgagctcccagtggcctgaaacgcacgaaaaacatcttttttggggattgttaagctacttggcctaaaaagcctaaaaatttttgaaaaaacctacaaaaatgcaataaaaaaaactcctaggaagcgacccgaaaattttcaaaaatgcacccctgagaaatgaaaaatttctcaaaaattcatccaaaattatttatttactttcttgacaataatttgtgattttaaaaattaattatctcaattcgatttggctcaattttgttgctttttgaataaaattttgtcattttacacccctaaatttgagactttttagtgccttttttctatttttagtgcctattttgggggtagagcctaaagcctacatattttggctggtttaaagcctaaaaatgttagccctaattataatcagtaaattgggaagcgtgagctgagaatgagagtgatcgacccattcactcactcattcattcagaggggtccaaattttggattggacttcaaaacgacgccaaaaaattgcctaaatttaagcccatagcgcccaatatagagcgatattattgttattatccttaattatggatgattttatgcaaatcgccgccaaaattcgcgtaaaaatcacataaaattatttatttctttcactacaaaagtttgacaaaaattttgttgtacgatgaatggtaaaattaaagtggaagttattagcgctaatttggtagttagctaattatttctgctcgcgcattttttgaggccaattaattaaaggtcgtgccgtttttatttgtctgttaaatgtgacagaacactgtgccggatttgttgtcgttctcacattttctaattgttagtgcttcgatttttccagacagaccaaaagcggcaattccatcgcctcctggggaaaagagctatgaatggccaaattggcattattaaaatcaatcggtgcaaaaaattaacgcccaaaaaggaaaacgattgatattattaaaattttttatgtaaaacactatgccaaaaagctaagagatgaaaatttgaaattggccaaaatattgtgccaacaacagcgcatacaaatgaaaatggcacaggacacaaaagcgtgccgtctaagccaaatgaacaaaaaaaaacacacaacaaaaatccatttacatattattgatggcatttaaattttttaggcacacaaactatagagtggtatttatggcgtgagaaagcacagctttaatttgtttgggtgcgcaagacggtctcagatattttaaaataaatttttagtataattattttaaaaagctaattcaataatactggtgggggaccagtggcccaaaatttccggaatatagaatctctgatgcggaacttaaaaaaactgaattacaacgaaagtaaaaccactttaatcacccattcattcggcatttaaatatgctttttgtatttttgaatttgccaaaggatgtgataaagcccaaccgattgacaagcatattatttattttatagcctaaatttcattaaaaacacgtaaaaatttttcactaggctattttgaaacaaatttttgtaaaattttcatgctgtgatagatgagaagagagagacctgtggaaatgaatggttggtttctgggaagagaaaaaaaattgaattattggcacaaaaactgacccaatccgtcccataagcaccaccttatgaaggaacggtttctgtgtctcaaaacattttttggcactttgacgttttcaaattcctttcaaaacacaaaaaaaaacagttcctcaaaaaatgcgccgcgtcgttcttttccgcccacggcacggaactgaggtgtggtggcacttttttatatgagcttatttttttttccactgtacttttcatccatcccattgagctgaggccaccagggattaggccaagtgcggttctttggtggcattttttccggttcaaaaagtggcacggcaccaccggcggcgccagaccgagggaggcttatcacacaaaataccaccatcaaaaaacgtaatctaagctgtttaccacctgccagcgagaaacggtgcataaaaaagagaatgccgcgccgcgctcaggtgggcgagtgccatgccaaacgagggccaccaccagaggccggacatttgacgactttgttgtttttgactgactcgtacttatgtacaaatgttttttttgtgtttggcaagtggtcatggcacggattatcttatcaccgtccctccccgggacccgtgcccccgttgcgcctgggggcaattgacagacccggggattatgccaaagggtgggtgagtggcgtcaatgggtccccccatcccccgaggggggagggataaagcaaaacattgtcacagacagagagagagagagaaaaagaatattcagcaacaaagcaccgagttgaactgtgggatatgctaatgtcactacgtatgcactcagtacaaaacaaaatcaaatgaatgactgaatggcttctcactacgacaatgggttttttgttttgagaaaaatacggaaaaatgtagttttccacaccaatgggatacggtagggtgtacggtcgggagtgatttaaaaaagacaaaaaaaaacaatgaacgagaatagtctatttttacttagttttgtatccgtgtccgtttgtataatccgccctattttccaacgttatttttatagattttgaaattggcactacaaattagtgagagatttgtccaacttcatttaaattatattttttaa

SEQ ID NO: 3501 - DNA, 6737 bp, Heterodera glycines
tctattaaaatcaattattgtgattttttgaaataagcattgatgggcgaaaccatttccactaattttttgtaaattaaaaaatgttctaaggaaattccttgtgtttggccggttaaaatatataaaattcatcggtttgactgagttgaatacaacaaaatattttcagatacacatataacaaaattatggcaaagtgtacacttagtaaatagttttactaacccaaatctgaggttagttaggaaataagtttcgtacactttggcacgtgtaagctctatgaatttaagaagtctttacagttgacttaaactttatatgtacgtaaacttttaaaaaaagtaaactttaaaaaaaatgtcagttgagtcaattgtaaagatttttgtcctattcccattttgagactcacattttttatttgtttgcaaatcttatcggtctgctttgcgaccatgatgagatttgtgcacgtgccggtccgctttgcgaccatggcaacatatcggtctgcttagcgaccatgatatgtagtgctcacgccggtctgctttgcgaccatggcgaggctggtctgctttgcgaccatagccaaccgtgtcggtctgctttgcgaccatgacacagtgccggtctgcttcgcgaccatggcacacatatcggtctgctttgcgaccatgatatggaattcaagcccagacttgctttcgccttagcgttgcatgtggctgggatgctctatgggagcaccaatttctggccttgtatcccaactgcactgtttatgaacgaggattgttctttgattaattagcaaagctaattgttcgaaggtccctcaatcgaaacagaaggttggctacggtgggactgtcctctgttcatcagcaacgcgtctgttgttcggagttccctgcccctggccatttagtgattggtgtaaacaaagagctataagatttggttcgctgactagcccttcgggtttatgtagcaccaacgtggtttgctgacattccctacggggtttatgtcgcacaaatatggttcgctgacaggcccttcgggcttttgtcgcgcaaatgtggttcgctaacagggccttcgggcttttgtcgcaccaatgttgttcggtgacaggctcttcggggcatgtcgcactcattctgcactcttgtatgggatgtgtgagtcgatccatggctgatggattcggcgcgacgactacacattgtggcaaagaaagatgtctgataaaattcatatgtacatttgaataaattttatttatgtgtgcattattggttaattttacctcatatttttgccaccttttcatacatttatcattttgttgtttaagatgccttcaaaacaacataatttacgtatgaagatgaaggaggaccgacggcggacggagaaatctgtcagcccaggtcgctcacccgtcccagacgggagtgcagatgagaatggggtggtatcacacccgggcaacgtaacgcccaatattagtgctttgcaattaagcaccccggcttcttccattggaagtaaaagaaggggcagaccctcaaacgccggaacggagtcaattacggcttcgcaacacagtgtgtcatccgttggcacacaaattgcatcggccactcaaaatgatgagtcatcgcctcgcaacaaaaaagggaagatcgacgattttgatcgacccatgtctgctcttgaggcaattgcttcgacgccggtttccacacaaaggaaccgtggagggcgaccatccaaaaaaagaggcggtcatgctggctcaggcaggagcaaagctaatgattccatgagcgagagctcgtcaatggaccagagctctgaagctatcacaaatgtggttgttttgccaactgtgactgataaaataaacttcagcacagtgcaaatcaatttcgcaaccacgcgaaattttgcctgtaaaatttggaagtgggcagcaattggcctttacgaacgtgatggcgaaacagcgcttgccccaaggtctggtccaagattcattgaaacgtgctggaatgatctgacccagtttctcaatgacggctttgctgccacatatttggcatacttggcaagcatatcacaacgaaaagtggtcgttgttgacccaatggtatgggaaaatggcttggaccgtgtcatgcaatataaaaatatgacatttgggtatgacccaaatgttcaggcagaagtcatacttttgccagtacatttccctggacattggactctaattgtccatgatgttcaatgtggtactcattttgccgactctttgcctaccccatatggcagattggatgtgcaactgacggacaaaattataaagatcatttctgacattttgccgtccacagtgttgaccgggattgttgatgtccaaaatcttacggcccaacacgatggaaatagctgcgggtactttgtgtgcctgtatgctgaatcatggcttatgaacaaccgcacatttgttctgccagatttatccatcaattatgaaaaaaagcgcattttgtggcacatcaatgagctgtatggctctgataatgtgccatatcatccaagggaaggggtgccaactccttgcccaattgtctaccgacatgcggatgaagcgcagtcgacatccaaggccgttgagtcaatggaagttgatgacaatgatgacataatgatcatcgaaccacagacaagtggacaggctgctaatgccattctcacccaagcccaagtggctggtgaaaaccaagttgactcgcttgggttggtgtcggagtcttgcgcaccgcaagagcctattgcgcaggctgacgatgtaatatttgtcagacctaagacgcctacaaggcgatcagtgcgcataggtagacggcagtctgcttcgattagccgttctccttcacctgcaccaagacgtcgtttatcaacaaatgctgttgagcaagtcactgcatttacgcagcgttgctaccttgtccacaagggttggtgctgtgctgcagcagcggcaaagcattatccagaatattcaaattctggtaagcttggcgacaagaagtgctctcattgtggggcactactcttcccgcacgaggacagtagcctttgctgtcgtcagggaagagttgttttgccaaaactcaacccgcatccaaaagagcttaaagagctcatcgcatgcgacaaacaatcccgcgagggaaaggagtttgttcggcatatgtcgcgttacaacaacttgctccaattcgcgagtgtttcggctggaaataagccatgccctgctggcggcccgatggctgtaattctcaacggggaattccatcgccgcataagcagcatgcaggctggcacaacacagattcctggctttggtcagctgtacattctggatccagtcgaagccatggagcagcggcgaaaaaatcccacctttacgggagggaaaatcacaaacgatgaagagtttgtgcagggtcatcagcttaatgatgagacccttgaaattttggaacaaatgatccaagaaaatcacccggctgcatctgcttacaagcaggctcgtgaacagctccaagagttgttaagacaacaaaggactgaagagctccggttcttcagaatgactttgttgaacgagcgctcagctccgggtggtttgaaagacccgaagttgcatccccaccaaataatcaccccctcaacgggtgaagggatgtttgcaattcatgcagatcctactggtgccccggcacctaaagggatatgggtcgaaaacaagcaagggcagttaaacgaaatagccccgttcagtccatggactgatagcttgacttatccattaattaagcctaagggcgacgatggatataaaattggcataccatatgccaaacccgcacaaaaaaagcggagaagtgatcaatgtgtcgatctgtttgacactgatacaatgtccgatgatgacatatgcgagaccgagtcaattgcatcgtcagatgccggatctgaagcatcgatgcagtcagtgaccagtcgctatgacaaatcgaaaaaatttgtctccctgcgagattactgcaagtattatctcgccataagggatgaaaatttggagtggcattaccaccacattctatcatgtggcggtggtcttggccagcgctgggttttggaccaagcggccaaaattgattggcaaattgccacttttttgcgccgtccagacatggacctgcgcataagcactccaaaaaatttgctgctgtatttggtgaatcaatacaataagcagcaagctcggcaaaaccccaatgcacaacaaaagagtgttgatgacattggcagcgttgttcgcctttctgagagaaatgtaaattctcttcagtattggaaaaaaatgtatgaagactgcaacaccatttttgcgcgttgccatgacgcaaaaaaggcgcggctcttcatcacattcacgaataaccgtgagtggccagagttcaaggagaacatttacaaaaatggtcaaatgttcactgatcgtttcgacatgtggatgcgtgtgtggtccagcaaaattgctgttttccaccaggagctctatgaaaagagtttcttcggaacaatccttggctcaggcgagtcaatggagttccaagggcgtggtggcccacacgcacacattgtagcccagactgacctggacgcagtcccagaagtcatccaggaatacatatgggctcatattccacctttgccgtgcaaagacgatgactcacccatagcgcaaatgcatcgcgaagtccgcgaactaatgcatatgcaactgcacagatgcagtgatagttggtgtggtccatgtgaccccaactttgggcggtgtaaaaagggcttcccagccccgtactcgaaatgtacgatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgccatttgcaaaactctcgcatcacgttgttcatttgtccattcatttgccaaaccagcagcccgttgtctacagggcattccaactggtgagcaaagctgaggaaattcagcgaggcgaactcccagagacgccatgctctgcttattggaagcaatggcaaaatgaatggcagcatgttccttcgcttaaggacatgctttttgaaaaagtcccagagcaattccgatgggcaaaagaccgatgggttccatataaaaagaagcctgtcaagaggcccccaatcggtcgtgttgtacctgtccctccaacggaccgggaaagatttgcactttatgcgttgatgcgtcactttcccggtgatccagaccacttgaaattggtcaatgggcagcagtacaacaccttcacagaggccgctctacagcatgggcttcttgaagatgaccaaatttggcacaaaacgctcggcgaggcagccttgcatcgctggccagaccagatgagatggctcttcgtgagcatcctcgtctttgggcagccgagcaatgccctagaactgtggaacaagtacaaagaccaaatgtactatccacagggcattaccagtgcggcaatacgccaagcacgcgagcagcaagccttagccgacattgattggcgtttgcacttctttaacttaagctgcgtgcactttggcctgccagatccaccaaattcaaaagccaaaaataccaatttggctgttgaagaatttttctttggtgatgatgatctgaatatgccgcctggccagccaaatcgaaagccacaacaatacaccccacctccactcaacagcgaccagcaaaaggtctttgatgctgttgtgagggcaatacagtcggatccaaaggatcaaactgtgccgcgccgtttcttcattttcggcgatggaggcacaggaaaaacattcctgtttggccaaattatcaagcgcttgcgaaagcccccatacacctacaaagtgcttgctacggcatccactgggtgtgcggctatcttgctgccatatgggaaaacagcccattccacgttccgtctcggcagagaagtgtcgctagacaagcttccaagcattccgcttgaaagcttctttgctagacggatacgtgaggcccaactcatcatcattgatgagatcaccatgcttcacaacactgtgatagaggtcatcgaccgagtgtgcaaagaaatggcaattcgccagcacaaggacctcctcttcggaggaaaaacggtcatttttagcggtgacttcaaacagtcactgccggtcgtgcctcacgaaggcctaactgcacaagttttggcctgctttcaaacctctccattgttcggtcaattcaccacaatgaaattgaccatcaaccagaggtgggccaagggca

SEQ ID NO: 3502 - DNA, 6233 bp, Heterodera glycines
ttaacatctgagtcagtgattatgggtgataagctggtatttgatgagtttaatgaggaagcatttaatattatggggaaatctgaaagtaatcaaggattataatcaatgattacgagttgttaattattgggtaatattaattaagaagcaattaatcattaaatggtgataaattaataacaattttttgtcaaaatgattttacggaggaattttatggcatgggtgtgaaataatattaatgatttatgacaaattaccaataatggtgagtagcggtgtagtggggtaattgtctcattgaccaactgtcatttttaattatcttccttgaaacagtctggtgtaagtttaactaactatcagttcctaacatccaattattaaatttgggaaatttatgaattaattattttttattgggatgattttacataggaagtttatcgtttgggtgagactcttcaaacttatgtgattaattatgacaaattaccaagaatggtttctagtatatgcttgtgaataatgagtcctcgccaaccataaggtctaattagtgtcagtttgtaacgacatgatatatgattcacaactaatcactatctatatgccattgtttttagatgagaaggtgtagtaattgatgaatttaatgatgaagcattgaacatattatgagtgggaagtatgaaaaaatcaaagaattttaattattagtgacagttgttaaatcaatttttgggtaatttaattaagaaccaattaatcaactaatcactatctatatgccattgtttttagatgagaaggtgtagtaattgatgaatttaatgatgaagcattgaacatattataagtgggaagtatgaaaaaatcaaagaattttaattattagttacagtcgttaaatcaatttttgggtaatttaattaagaaccaattaatcattaaaatgcgggaaaattattaacaaagttttgatcgagatgttttacatatgtgttttggtatggtcgaatcccatgctaaaatactccaattgctaatagggtatgacatctgcattaattataattataaccaattattctttaatttttacaaactgaatatttctggggaaagaagggttatgatggaacttaaattatgtgccacatttttgttgtaattcaatgaagcagaatacttgaagctgagacaaaggaaatgatgaacactaaatgagtatgataattgttgacagattaacttaattatggtattgatggctaggaaatatggcaattaattctaaaatatctgaaaaagaatgcaactttttgggtagcgataaaccttttttaagtaagtaactaattattacagccgcaaggattttagaaatgtataaaaacaaggaaaataataaaagatgaattttcggtagccaatactcggctctccggtcaccaatacctcacaaggctcggatctccggtagccaatacctaattaagcttggcccgccagtaaccaatacctcataaggctcggctctccggtagccaatacctaattaagcttggcccgccagtaaccaatacctcgcaaggctctgacaccgaacactgaaaacttcattcttttgactatgaatttttatttttatgcaaattgttatcctcgtggtctaaaatttatatgagaataaaatatacctttcctattgatttggcaaaacgcataggatggaaaagggagtgggtaaactgagtttgcgatggtaaggagcaataatgaccgaatatgtgttggagaggaagggcagagctgaggaaaccaaataagtgaaggagaggggggtgaggtcacggcgtcatcttatcctgtaaatcgattcctctaaaaggaacaaatggaaagaggctaacgccaactgctttcttaacaaaatcctatatttagagattttggtttcgggtttatttgaattattttccttttctctgtaatacactttctctactcttctatatctgtttactttcactgttattccttattaatttcagacctacatattgtctaaataatcgtttccgttagctatttttcaatatcttttcttccaacactatgttttattctcgaaccgttatcttccaagtgttcgtattcttgttctttatcaaactattctcttccctatacattacctaatgtttgccttactaactcacattaaattctcaatatttaatattgactctcttcaaccacatttctgagttctctatctctatctcttacacccattattaattgtcattgattctatggtgcactacaatatcctcatatgatttcttcatttattcctattacaagacctgcttcacgcatacatttagcccttatctaccctttctcgtctgttgcttattataattagaattattttacgttgaattaggcaaggagcattgtttgtgtttatgattaaaattaactagttttatataagttaataaatattatgcagaactttcaaacacacttatcttcaccctcgaaaaaacatacaatacacacacatacgcacacgcatagacacgcacacacgcgcacatgcatacatacacatacacacacacacacacacacacgcacacttacacatatacacatgcacacacacacacacaccccatgtgtaatttttacacatttttgagtaattccttcatttaatcattatttttcttaatttttgttaaattgtatattctattccttaataatttacaaattgtgtcttctttctcttaattctgcatatttctacctaaaaacgacgttcccaaatgcttaataatttacaaattgtaacttccattgcttaattctgtatgcatgttcactccttaattatgcacttttctacctaaaaacgacatgctcgtgcatattttaaaattgtatcttctattccttaataatttacaaattgtaacttctttctcttaattctgcacttttctacctaaaaatgacgttcccaaatgcttaataatttacaaattgtaacttccattgcttaattctgcatgcatgttcactccttaattatgcatttttctacctaaaaacgacaagttcgtgcacataatcaaaatgtatcttcaactcgttaattatttacaaattgtaacttctttcgcttaattatgcatttttctacctaaaaatgacgttcccaaatgcttaataatttacaaattgtgtcttccattgcttaattatgtatgcatttttattaaaaacgtgaataaaacgacaaaataacacaatttttggtataaaatagagaaataaaaggggtacatgtatgtgtacgtgtgtatggggtatatgtttatgcgtgtggaagagagatacaataaatggtgaacaaaatacaaaagggtacatatgtgtatgtgtgagagagatacaatgattggtgaagaaggtattacaatgtgtgaacaattacaatgaatggtgaaaagacattataatgggtgagcaattacaaagtgtgtccaaaattgagaacattataatcggctcctacaatacccttcccaatataaggctgataacatttttgcatagagcttgatattacagatccaccatcacgaatattgggtctaataaagtttgggtatattacattaattggttcaatctctcctgtttgagcataacgtttgacttgctgtttttatatctaaagccttggttgttgatcacatcataattgagtgtcaatccacggagtttaagcacatattccatttccgcatcatgtagaacatttatacgtcttaaagccaacgcatactattttgcaccagcagtgcagaattctacgatttccatcaattaactgcttatagtgtcgatcttattcagctaaaaagcatcgcgtagatgtgagaaaacaagactatccgtgtcggtggagagtacttaacgccccggctatatcatcatttctgaatagttttattacccactttttttattttcgtaggtaatcaaaacatgatacacctttcaatcctcgatggtcattacgtctattgaacgattatcccaaatattctccaaaatcaagtacatcattattgaagtaaagtctgttaaaggctgtaatttcgtaaagaaatatgtcgcacaaattgttcaagcatagtttaacaatcctactcttcttggttcacaactatctttgttgggttaagatttctaatttctctttgcactctcttacaaattcagcttccttctcaccatttccttttatgtcagtgtcaattggtaaatgggtaaccttcttcaaccgtagtaacattaatttcgattgaaatgcagattgctcagccatctcattgtttgtcattatgtttgcatatgtatttacgtctatcctgcctttttgattgtttttggtgcacttcataaataaagagaatcagagcctaccattcactttgacgggcaaaacagaatatcgaattttctaaagaaatcatccaaaactttgagtattgtcaaggggtagtgtttatcttccgggtatttaactcgacttattcattcagcacatgtacattggtttaccaatcgagtagtgtgtagtaaaattaacgaaggagtagagagaaatgaagtcacatagaaattttttcattccgtcttcaaatccactcatttatttgttgctcattaacattttagcgatctcgtagcctaatacacttacaactggatggacaacttgacttcgtataaattcataacgttttacattcctctcccgcactttagcatttatttttttcaattagacattaatatacatcttctaggtggcgctaattgcaggcatgctaaacatatccgcttacttctattgcagttctctctgtttccaactattcatccacagaataatgatcaatttgccaagtgttcagttgaaaagttattgatctagaaatatcgcaaacaggccttatactagtcatacattcctttagtacatcaatgggtactaaaagacgctgccttccttaataatgccttagttcctttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttttaatttagttttatttatttttatttttatttaacatttattttcttttaattttaatcttatttttattttactttttatttgaattaatttgaattttattttactttatttattattcagttaatttaaaggagttgttcagaacctctatccaataaaaggctatttcgccgctcagcacggcataaaaggtactttaaccgtgcaccgtttagcattgtatgatatcctcactattttcaatatttttacttgttttaattgtttatttctttgaaatttctattaatattttacttttgtagtgtttaatgcaatcaaagaacattttaacttgaaatttttaacaaaatgaacttaataaaatattagtagttaattattgtaaaatataatttattaataaataagtttaattcatttattaaaatctaaaaataatgataagaatatatgtatacttcatattatatatcattttattaattaatttttcaatataaaatttctttcttccatcttcttaacgcttttttcttaattattattatttttttcatttattttcttatttttagctatcatcaccattattattattttactaaatttattttaatatttattttttctacaactcttcatctcttcattaggcttgggttatgacacaagtaccatttgccacccctccagtcgccacatgtcaccacacccctcaaataagttttggggttatacgaccaccatttgg

SEQ ID NO: 3503 - DNA, 1315 bp, Heterodera glycines
cccgtcaaggcttcctgatcaatgaacttggcgtattccatttccatgaatcagttcaacaagccgatggaacatcgaatgtagtcaaagactacgttaaaaaactggagaaaaatatcaaccatatggccaaattccactgtgtcaaagttaagtcaaagttcaccatgtcgagttggcctggcacgcctgaggcactgctggctgggatgttcaaacattgtatcgaggaggcagttgctgacagccgtgagcggggcattgaacctacacacctcggctgtatgatcagcagtcctctgctggaagacggagacattccaaccccgatacaacaaatgacaaacaacactctcgacaccattctgagccagttcaaaaaaatggctcagagcaaagaattggaagatgtgatgctgtgtggtgaacccttcaccgtcaccataacgacattggaccgtaatggactgggacgggcctaagaaaaaatctacgttcctatccgtctcaattcgtattcaacttgtgtcacataatgtattgtttttgtctaccctatatcacacgatcattcatttgaacaatttattgagaaaatggagagaaaattcgacaaactccaatttttatgtaataataatgatgaataaagtggtaaaataaatacttagaaaatgctaaagaaaaaatgcaaattgtcatgttgataagtccgggatcaattaaaatatacccagcaaagttttaattccaaatcttaactttgacagcaaatataatttgacggcatcacagtcatcggctgctgcagaatccacggcaagtgtcgacgaagtttgggctttttctcactcattggaaggttcaaaggattagggcgtttcattttccaaaatttgaataaagaatgatttcgatttcttgctgggaataattttggtgcgcaagtgggcgtggccaaagtgcacacatcgtacacccggtcattttcccgattcattttaaaaattttcatctttttttgcacatctgctgttttcctctcctccctcacttgtcctgtgctttatgggggtcgtattatttaatggggattttggggaccgtataattaaaataaatatttttgctgttaactagggcggttgctttaattacaaaaagcaccgtttatcctggcagcaatttgccttttagggcttgaggtctttcgcttgacttgactaatttcccgagtcgtttaggtgccctgtcgtcttgtgcttcatgggtggcggtgtgctgctcttcaggccatagttttgtttatggtttt

SEQ ID NO: 3504 - DNA, 9655 bp, Heterodera glycines
  misc_feature (3692)..(3692): n is a, c, g, or t
  misc_feature (3840)..(3840): n is a, c, g, or t
  misc_feature (9636)..(9636): n is a, c, g, or t
taaaaaaatgacaatcatcccgaaaacgctctctaacttttccattgatcatatctctcgcgcccaaaaagccccgtcaagctttctgatcaatgactcttggggcgtagtccacttcccttgatcggtgcagcaaggcgaaagaacatcaaaagagcccaaggactacgttaaaaattggacaacagcatcgagcacatggcccaaattccactacgtcaaagtcaagtcaaagttcaccattacggatttgccgagcacacctgaggcactgttggctgggattttccaacactgcatcgacgaagcaattgttgaaagccgtgagcgcaacatcgaacctacacacctcggctgtatgatcagcagtcctctgctggaaggcggcgacatcccaatcccgatacgacaaatgacaaacaacactctcgacaccattctcaaccagttcaaaaaagtggcgcagtccaaacaacagaaaaatgtatcgttatggggtgagccgtttaccgtcaccatcacgactctcgaccgtaatggactaccatccaaacggcgagttaatgggggagctcgtcgcccagtcaaaacggccgtccatcaccgaattaatgaccaatgcctgattaaaatccgcaataacgacaaccacttctgccttttctacgcgctgcaggcaacaatggtcgccaaaacgtgcaattggcctcgctggaaatttttcgactatgtgaacgacagaaaaggacaacagggacagctccatcgtgatgcagttcagctaatgcagcaggttaatgcaccaatggacttggatgggtacgacgcggacacttttgtgcctcacgtcgttgactactggaacaacgcgcagcgacaacaccgctttgctgtgttcatctttggatcgttgggacagtataagccgctgtacaagttcattgacaacacttacgacactccgctgctgttgtacttcaatgaggaccatttcgatggtgtgcagaagcagggcggtttgttcggcaggccttattgtctggagtgtgagcgcccgtaccgaagaatgtcagagcacagcaaaacatgtaaagcgcgctgtgtgctatgctcacgtgttggaccgctgtttccgtgtcagccaacggatggattcatcaaaaagtgtaaagaatgcaacaaaaaattcaccaacaacggctgctaccagcatcatctgcagtcaggctactgcaagcggtcgaaaaaatgcaaggattggtggtgctgtttgggatgtagcagataacaaaagaaatggcagaaaggggcatgtttgtggtgaacgcttctgtaagatgtgcaacaactaccacaacacggaaagaggctgtttcatccaacccattgagcccaaggaacgcgacccctaccgcatcgtggcatttgacttggaaaccatgcagcacacaccatctgtaaagcctgagaagcgtgagcatttgccgaatttcatcgctgcgcgtgtcgcatgtcccgactgcattgaaaatgagagctggcaagaggcatcgggaggctgtgaagtgtgcgggccaaacagaacagtcgccttttgtcaaagccgcttcactgaaacaacagtcgacaagcaagtggtggcggaaaatccattggaagcgtttgtcagctggctgataaacgacttgccgttggcctacgacacctacgccttctctcactttggcggccgcttcgatatggtgctggtgttccgcgaattgttcaaacgcggatataacccggacatgttgcgcaaagtaatattgactatttttcaaatttgaataatttttctatttttagggaaataaaatgtacgaaatgcggattcgaaggcagaagaagcgcaaccctaacattgttttccgggattcattcaacttgatgccaatgtctcttgcctcgctggttccatcatttggcttggacgtggaggacaagccattctttccgcacatggccaaccacccagacaactatggaaagcagatccatccaacaccagacgactatttggtcaagggtatgatgccagataaacgacagaaattcgacgactggtatgaacaacaccgtcaggaaccattcttcctcgacgaggcgttggcaagctactgcaccaacgacgtggagatactgatggcggcgctgatggcttttcgtcatgagtttttggatgtgacgaaacgaaatgaaggaatcgttgcggagcgtgcggccttctatgagcaccacgacggcattgatgtgttgcgggagtgcatgacgatcgccggcgcatgtatgaagcattttcgcaccaaccatctgccgaagaagcatttggctatcgtcccggaacgcggctacgacaacgcccaaaaccagtcgttgctggcacttcgcttctttcattggtatgcggaggagcatggtgttgtggtgcagacggcgcattcggctggcggagagaagaaaattggccaatattccgtggatggctgggtggaggaagaaagaagagcaattgaagtgaatggatgtgtatggcacggctgcaaggactgcttccccaatgacaacatgatgatgccgaatggaaaaacggctggagaggtgcgggagcgggatgagaagcggctggaattcatcgaaagtcaagtgtcacgagtggacgtgtactgggaatgtcaaattaaaagaatgctgaaccgtgacccgtacatgtgcgaaagttttggtgattatgtggatgatggcccgttggacattcgcgaggcgttcatgggtggcagaacaggaccactgaagctgtaccacaaggcgggagagggcgagaaaatctcgtactatgactttacgtccctctacccgtacgtaaagtgagttttgtttcgatcattattcacaatttataattttttatttccagtttctccaccacttacccgattgaacacccaaaagtgctcatcttgaatgaaaatgtggagtggacaagagcacgcgacaacccctacaaattgtctctgctcaaggtttgggtgattccgccgcgaaagtgtgatgtaccagtgctacccgtcaaagtcaacaaacggctctgttttccgttgtgcatgcaatgttgtctagactacccgaaaggaggcgttgattttgactaccattgtgaacacgacgaccaacaacgcggatgggtcacaacatgcacatcaattgaattggacgcagcacttgaagagggctaccgcgtgaccaaagtgttccgggtgctgaagtacagacatggcgacgacaaacttttccgcccatacatcgctgagttcatgtcgcagaaaattgaagcttccggatttgacgccagcattaagggaaatgcggagttggagcagcagcagttcatcacagaatgtgcggagaaattcggaatttcaatcgacaaggacaacatgaaagtgaacaagggcaagcggtcgttggcaaagctgtgtctcaacaacctgtgggggcgcttctctctgcgcaacttcggcctcgcccagaccctcatcacagacgacccttcagtgttgactgaatacgtggaaaacagctcaattgacatcatttccgttgatgagctggacgaaaaacatcaattgatcagctacgtccagaagaaggagggngtggaggagcacgagtgctccaacattagtgagattttttcaataatttttgtataattttgggatttttcagtaatctcactctggacaacatcaaaggcccgccttctgctgttgaaagcgatgcagaaggtggtgagaacccccnggatgtcggttgctctacactgacaccgactcgctgattttcgtccacccgatcggcatgaacccgttggagacaggaccacacttgggacaattcaccgatgaatacccaaagcatgaaattgtggagtactgtagtggcggagcgaagcaggttaatttaccgtttatttagtgcataataatttatactttatcattttagtatggactcaaactccggcgtaatgggcaggacgaatttgtgctgaagctgaggggcatcacactgaactacgacgtgatgcagaaccaatccctctgctacgacacattcaaagaagaagtgttgcggtatgcccaaaccggagagtatgagcaaataaatgtgatgtacccaaactttttgagaccggacattaggggtggcggacacgtcacttcaggccccctccaaaaatgttatcgcccatacgtaggcaaagggatagtgggccctaattatgatgttctcaatttcggacacattttgtaaatttatcgtttatcattcattgtatctctcacatacacataccccatacacacatacacacgcatgtaccacctttgtttttcatgttttataccaaaaattgtgtaattttgtcattttatttgcgtttttaataaaaatacatgcataattaagcaatggaagacacaatttgtaaattattaagcatttgggaacatcatttttaggtagaaaaatgcagaattaagagaaagaagttacaatttgtaaattattaaggagtggaagatacaattttattatgtgcacgaacttgtcatttttaggtagaaaagtgcagaattaaggacattaacatgcatgcataattaagcaatggaagacacaatttgtaaattattaagcatttgggaacatcatttttaggtagaaaaatgcagaattaagagaaagaagacacaatttgtaaattattaaggagtggaagatacaattttattatgtgcacgaacttgtcatttttaggtagaaaagtgcataattaaggacattaacatgcatgcataattaagcaatggaagttacaatttgtaaattattaagcatttgggaatgtcatttttaggtagaaaagtgcagaattaagagaaagaagacacaatttgtaaattattaaggagtggaagatacaatttgtataaacttaaaaacgaatttgtcgtttttaggtagaaaagtgcattattaaggacattaacatgcatgcataattaagcaatggaagttacaatttgtaaattattaagcatttgggaatgtcatttttaggtagaaaagtgcagaattaagagaaagaagacacaatttgtaaattattaaggagtggaagatacaatttgtataaacttaaaaacgaatttgtcgtttttaggtagaaaagtgcattattaaggtaacatacatgtgtttaccaataaacgtaagatggttgactgcattcgtagcgaccaccaccatcattgtcgtcaatttcttcgacttcgtcaactcgaccaaggcgtttgacaggaatgaagtcgtcctcgatttcggtaaacaatttgccaagccatcgctctttgttggtgtagtcctcatccacaatttcgagtagctccattgggtagtatctgtcttcgccacacccggagtatttctccacaacacacggcacgtatgggaaatgcagcttgatacggtggcgagcgtagaaatgggcagcaatgttaatgttgtacggttgtctgagtctgccatacgccggggttaaagccgctcccttgtccgatattccgtcgacaaaaaatgttttctgcattccattccggtcctggtatgtcgtccgaaccttttttccgaccagctccttcaatgccttcactcggtcctcaggatgattgagcttgtcgcggagtgatttcggggaacagccgagaatttgggcacaaaattcgattacaaggaccattgtagcagaacaaatgagacatagctgacaaattgccgggggcttttatactccccggaaaattaggccacgcccactttttaaaactatttaagccaagattttctcgcacaatcaaatcagtcttgcaaaatttcatcaacaacaatggcagatcaatttgtacaacccgaaactgcggaggagcaacaagtgaaagctaagaagccaaacgttgatgagcgatttctttggaaaatcacgcggggccaatttgtgcttgcgattcggctgtgctcaggttaatcaaatttctgacgacaaattaattgacagctttcagaggactggaacaatttatttcacaacaaagacaagacacgtcggctggaagatgggcgagtggcgattggactcgagatgtgtgaagaatgcgctaaacttaattgttgtgtcagtgatctgatcgctggccaaaaaaagaaccagaaaaagccggaatgaaattgatttttaccgattaatatttttaataatcactcccactattttgaatttatcttgtttttaataaattatttttgagtttaattcgttgagcaactgggtgtcaatggggcgggttcctagtcacgcaactgcgcagcttttgttttgactaaccctttcgggtgtattccatccattccttgaattgagtcatttgagtgtcctccttataaaatacgcaatttctaaaatgcggccaaaccgtcgtttcaactcccacccaacaaaacggaacagtgattatctatggtcccaattccgtattcgtcggcacctgaaaaagcaacaacgacgaaatcttcgacatcaagtgcaaatgcatgacatctcgatggggttcgaaagaatggaactatccgcctcgttacctggcggtccgtcgaacggcccgactacattcggtgatcaagttttaaaattgcttatctgattgatcaacatttttaggcgaagcctttttgctggaagaaatcaaaaatttaaaaatgcaactgattgcgaaggtttcgaccgttgaggaaaaggccaagcagaactcaagcctatgcatgttggcctcaattcgtgaccgactacaaaaatttacggaggaaattgaagaatgtggggagtgaaaggtgcaatttggattctcgtggtaaattttgggggtgatgggaattacacaattaattttataattggtgatggccatttttttgaatatttttttttttattaaaatgaaatgttcgatctcctaaatgtattgagtatgatattgttcattcattcatttatccgtcgaccatcagtccctcattcttaatcttccttgtcctcctgttcattgtcctcctcttcggggatgggggtcaaaactgtaaacatttttactgtaattattaattgatcagaaatgtgggagattaccgtaatgggacttgtattttctttccttcggcttcggcggcaaaccatcaacgacgtttttgtcactcgtaacaccggcatcgagcttgaatttttattaaagaaaaaatttcaaaacttttaaactgaggggtctacctcacggtccgttgagtcggaaatccaactatcctcaatgaatccatcgccattctcatcggttgcctctggaggagcagtgcggtgcttgaacggaggaatggccaatggctgattaaaaaattatcagaaaaatcacactgaattttaccggaaaattgcgacgatgctgaacattggtgttggttttgcggcgttgcggagaatgaaattcggcctttgaaaaaaaaaattaaattaaattgagtgtggaaaatgtttaaattaaatatagaaatttattgaaattattacccaccattttgtattcgctttttggcggtgaacggtgcacatttttgacagaatggagacgacgagtcatcaaaaccatcaacagcaagatggacagctgaacaatgggtgtaagttagaaaagaaagggtgattcaaatttggacctcaagcaaaagcaagaacacaagtgtgacccaaactttcaacattgggtctgttccattgggaacacattgggaaatagtggtcgggaaattttcgaccagaaaggtgggaacacaaactattgggtggcggtaatcggctggtctaacgcaaacattcaacggagctacacattcgcactggggcacgaccacccaagtcaaatttgaaggatattccatttctaaaaaattgtttggaaaatgaaagaatgaatggccatagaccaactccgctgaatgaatggatatggcacatcttcaaagaatgaatggcccatacaattgacccgtccagatcataacaacaacaaatgacccgccactatagcccattcagtgcttatcttatggacgatctccgtttaacaaatgttttcaccaaaaatatataaaagatgatatttattgaaaacgaaaattgttgagggtttctaaaataattaaaataagtgaatgttgtgcaacggcttgatgaaaattgtgtttataaaatgattaaaatgagtgagtgtgagcaacggattgatgaaaatgtgtttttaaaatgagtaaatgtgtgcaacggattgatcaaaatgatattaaaatatttaaaatgagtgaatttttaaacataattaaaatgagtgaatgttggattgtcgaagaattgcatggaggagtgtgaagcagccgaccgacgaatgagcgaagccgagcaaaacggtcagtcactactcgaaaattttctcagctaccttgaactgtataagagaatcgacggccttaaataattaaatcaatttaaaaattatgtcgacgaattttatagttattattatcagattaatgaaacaatcttaataagagaggacaaccaatatgaaaaaaggtcagccatcacttaaaaagattgtgagaaaataaggatccccactctggacgaccaacacaaaggaaggtcagccagagtggggatcagataaaaatgagagacaaaattgatgattttaatttatttaattcatatggacaaattattattcactttcgtccgttgcgcttgtgtggtgtccttagcatagacgatgtttgttgtggtggggagtgggtcattggctttgccgagcagctcgcgcactaattttatttgaattattaaaaaattattttttttttttttttgaaaacccacatctgacaaacaacgggtgtgttgtcaattttacgaccaattgcgcctccactgcctcctcgttgagcagtgccttcagcacttggttgatcgttagatcttcaatgaagttgacggtcagctccaatgcttcagaccaactcgaccgtacccaactgtcatgaccgggcgatcctataacccaaaacaaaaaatgttttcaattttgtaaaatacaattattaccacagcatgccaaataatacagccgttctccagttgtcaaaactgacattgctaatatggactccacttcgtacatctgctcctcctccgcaccgttttgctcgttgtttgtgatcggctgcacgcgagccgggactttccctcttggcaacttgatccttgttttgggctgtaaaatgaaaaaatttttaaattggtacaaaaaatcgtgaaatattaacaaactccataaaaaggcaaaaataggtattataaaagtcatcgtagacacaccaacccaagtggaaaacatgttttttttttttaattttaatgttgcgttgattaattaccanaaaataatttctattaata

SEQ ID NO: 3505 - DNA, 1039 bp, Heterodera glycines
  misc_feature (1007)..(1007): n is a, c, g, or t
aatcaatggggacggaaaaggaagcgaacatccaccaaaccaaaggaaacaaatgaaaaatacactgagccatggattcaatggggggagagaacatttaaatgatttgtcacttacatcgattacgatgttaagacccaataaagcagcattcgtcagcgtctccctttccgtctgaggaatgttggcatgttgtaacagtttattaaggttttcatccgttatccctgaaaataagatcactgtttataattgtactagcacaatataataaacagtaccgtttttgtggaaaatataaagcaaaatgaggcgcaagcgatcctcaagtttcactgacgggtcaatgagcaaaggaaccatcagtttcatggggtctttgattctctccccatcagcatccattccaatcgccaaatcctaaaccaaatataattcggacgaatttggtaaccggagcaaagacctgttcaactttacacaatttgtcgactccgtgcttgtaacgattcatacattcttctgccagatgaaaatgagtactaaaaggtaaataagaaagaaatatcgttttttataacgataaactgtttttttttgttagataagccacctgaacttattcaattccttttgatattgcggagcttttttgatcagaagcgaaaggtcctttattgatctggcatcacttggcattttcttattttccgagaattttttcaaaccacgagtcacctgaataaatgggtattatgccagctcgagttaaaataaaataagcatttgcttaatttaaccccatgttcaatacttcttgcgaaacaacagcaatgtgcttgtgacggttgtccgcccataggtcgtcgttttcatcaagtagcacctctttgtcaacagattcggctcctcccgtttcgtaacggtaaacatcattctcgatatttaaaaggtcttgggtcatcgcctgtaaagtgagttcgtgcagcaatggcgagattgcgtcnaatcacggtcgatgataatcattgtgatcgcg

SEQ ID NO: 3506 - DNA, 2900 bp, Heterodera glycines
ccgcaaaaaattatttaagaagcataaaagccaaataaatttggagtgtgtcagcataaagcccaataaatttgtggtgtgtcagcataatggaaaagtaccaaagcttctatagaccttaagcttttgtttaataccaagaatataggtattgaccaagtaagaaaaaagttatggcctaagaaactgggtatggtcattcacgggacgcataaaaccgactagaaccttaatgtttgacgaacaaagtaggtaataaaaacctgagattcataaggagtgaatgcaatgttaatttccttaagggttcgaatgaaacgcgaaacaggacttctcgaaagcgtagaaaacagctgatcaggacaggcttcagtgaagaaaacatgtgcacatttgtaaagattttggccggagaaatctctaaccaatttgtctatcgattcctaattaatatttagttaaacataaatgattgaagaaagttttacttttgttggggaaatcaaatagacagcgtccaaagcaggaagaggttcacggcgtttgtttaagtcctcgactattgttattccctggtccataacatcgtgcattttgcagcatgcacttaacattcgcatagccaatcggtccacaatcagtacattccatgctccgcccttctgcgggttatgaagtggttgaagaacttcgttaatgagttctaaaattttgttaattttttttttttaataatacagttttttactttgtccaacaattgctttcagtgtcattgtgtgtgaattaaacaaaaaaaaaagataggtagataaactaaaaaaataagcgataagctatgcatatgcatacataacagaacagagaaaaaaagatactctaaaatagtacgagttgggtttttaccataacaatcacatattgtgtgttaaatgtaaaaaaaaagaaagcgaaaataattttcctttttgttttagcacataaaaaatgcataaacatctggtctgtacacatttgcttttatcttatcttcaccacgcaaggaattgaattgatttttctttctttttcggctaacattaacgtgtttgggtggacagggaaaaatgttagctcggccaaagggaagtgaaaagaaaacccaacaaaatatgtaggtgcatgtactgagctcattcattattttgaaatgataaatctcaagttgaaacaaattgccttactttaaatgtaattctgcgaggatctaatagcttcaaaaacgagtaatctacataatatttacaaagacaaaacattttgcaagtattcagtaaactaataaaatggctactactatacctgggtcgttggttaacaaaacgaagaagcattttttgggtatgacggcgccggcaggttatgtggccggagttggtcgaggtgccactgggtttacaactcggtccgacattgggccggccagggacagcacggacgtccctatggatgctgctatggcttcagccgcagctgcagctgctgctccagcgccagggccgccacccaaaaaacaaagaaatgacgatgaccatgatgaagctgaggatttgaatgatgctaattacgacgaggtttcccacaaaaaaccttttgaaaataataagatttattagttcgaaggttatggtggaagtctgtttgctaaagacccatacgacaaagatgatgaggaagcagacgaaatttatcatgcggttgatatgaggcaggacgaacgtcgtcgagaataccgagagcgaaagtacaaagaggcggtcgagagttaccgaaaggagcgaccgaagatccagcaacaattcagtgatttgagacggcagttagcgactgtgaaggaggaggaatgggctgcaattcccgaagtcggcgacagcagaaacagagcaaaacgcaatccacgaggagagcagtatgccttgccaactatgatttcttctgagtcaagctttaagactaactcctgtccccgactccgtaattgcctctgcaatgagctacaaccaaatgaacacaatgcttgacaaaaatgtgcagaatgggatttctactccatattccggcttccaatcaactctcgggggctttcaatccacgtttgggttccaatcaacttttggatttcaatcgaccctcggaggatttcattctgttctcaatggaggacagatgacgccagggtggaaaacacaaactggctcctcaactgacctggatttgcgcaaaatcggacaggcaaaaaacagaataatggacattcgacttaaccaggtgagtgttttattttaataaaagttgatggttgccaaatgatgaggaagtaaaaggtctgacgcccattaactgtgcattaatggctgttgaaatgcattcaaatgttttgtgcgattctcttgtctgtggggatataattttgcattcccttaaattacttgctaaatgaaatgtcactttagtgagctaatcaatgcacatttgtttcatttatctaaacccgcaaagacactaatgtcatgaaatgtacaactgagttaatgaaaaggtggttgatcacgaagttttcaatctgatggcacatagcaaaatttgaacatgaataattttataataattcctataaacattgcaatttttaaggtgtccgactcggtgtccggtcaaactgtcgttgaccctaagggctatctgactgacctccaatccatgatccctcagtttggagcagacatgcaagacattaagaaagggcgaatgctgctgaaatcactgcgcgagacaaatccagaaaaaccacagggtaagttattatttgagttcgacaatgaaaaaaagcctggaccttccccaggtaactctaattatta

SEQ ID NO: 3507 - DNA, 1663 bp, Heterodera glycines
  misc_feature (1593)..(1593): n is a, c, g, or t
  misc_feature (1620)..(1620): n is a, c, g, or t
attgtgctgacgccgaaaacctttggctgatgcatgcgaaatcgcgttggcaaggcggcgacgtggagggagcacgacagatcctttcacaagcattcaaacataatccgaactccgaggaaatttggacagccgctgttaagctggaatcggaaaaccaggttaattcgggatgaatgaacgatcatttagactatcttaatttcttatttttgttgttttaaggaatttgaccgtgcccgaaaattattagaaagagcgcgcaattctgccccttctccgcgtttttggatgaaaagtgctcgattagaatggtgtctagacaacttagacagagcaaatgaattactcgctgagggaattggccgttaccccgactttgagaaattctacatgatgttggggcaaatactcactcaacaagcacagtttgaagaagcaagaaaacaatacttggaaggaacggtgatcactaagcaagcattttatttttaatcctttcaaaaaattttagcgtcggagtcctcatagtattgcaatttggcttctgctgattcgcttggaagattcgcgtggtcggcacattaaagcgcggtcccaattggacattgcgaagaccaaaaattccaaatgtgaccaattgtggctggaagggatccgtatggaattgcgcgccgggcaaaaggaacttgcacagtcaatgcttgcacgggctctccaggagtgcgaacattcaggcaagtagcccattaattgcttgtttaaattttaattggtttaggtcgtttatgggctgaagccattttcatggaacagcgacacgcgagaaaaacgaaaatagtagatgctttgaagaaatgcgagcacgacccgaatgtactgctggctggttccaagcttgtctgggcagaaaggaagactaagaaggcgcggagttggttccaacgaaccgtgaaggtcgatcccgactttggcgatgcgtgggcatacttttaccgcttcgaattgatgcatgggactcaggttctgttcactaatgaagtttccatcttttgtctatacaatgcatgacccttttgaggaagagcaggaagaagtgaaaaagcgatgtttacaagcggagccaaggcacggcgaattgtggcaagaagcatcgaaggatgtgaaaaattggcggaggaaaacccttgaattgttggaattggtcgcatccaaattggaaatcccttaatttttcttgtttatttatattcataataaacaatttttcatagtcattgtctgacaaattggtgtggctccttcacatagttactttttcgataggggtcgcaaatatttgaaaatttccagctgtggaaaatgcttgctctgaagtcgcttttgggtaggagccctctggtcaatcctttggttttgtctttgcggaacagatccatcaaaaaagtgaagaaaaaacttgctgcaggggaaacactcggcggtccggaggattatgcgtataattgtgagttctgaaattttccccttgtctcgggttaatgaaatgaaaacattcttcttcggtgtcgtggtaaaaatgtacattaatanaatgagatatttagaattgaatagctnaaagcttttataatgggagaaatcatgcgacccacgcaaaatt

SEQ ID NO: 3508 - DNA, 4829 bp, Heterodera glycines
  misc_feature (53)..(54): n is a, c, g, or t
  misc_feature (64)..(64): n is a, c, g, or t
  misc_feature (66)..(66): n is a, c, g, or t
  misc_feature (76)..(76): n is a, c, g, or t
  misc_feature (94)..(94): n is a, c, g, or t
  misc_feature (104)..(104): n is a, c, g, or t
  misc_feature (108)..(108): n is a, c, g, or t
  misc_feature (110)..(110): n is a, c, g, or t
  misc_feature (113)..(113): n is a, c, g, or t
  misc_feature (125)..(125): n is a, c, g, or t
  misc_feature (128)..(128): n is a, c, g, or t
  misc_feature (130)..(130): n is a, c, g, or t
  misc_feature (134)..(134): n is a, c, g, or t
  misc_feature (143)..(143): n is a, c, g, or t
  misc_feature (151)..(151): n is a, c, g, or t
  misc_feature (156)..(156): n is a, c, g, or t
  misc_feature (159)..(159): n is a, c, g, or t
  misc_feature (182)..(182): n is a, c, g, or t
  misc_feature (184)..(184): n is a, c, g, or t
  misc_feature (187)..(187): n is a, c, g, or t
  misc_feature (189)..(189): n is a, c, g, or t
  misc_feature (191)..(191): n is a, c, g, or t
  misc_feature (195)..(195): n is a, c, g, or t
  misc_feature (209)..(210): n is a, c, g, or t
  misc_feature (227)..(227): n is a, c, g, or t
  misc_feature (232)..(232): n is a, c, g, or t
  misc_feature (234)..(234): n is a, c, g, or t
  misc_feature (238)..(238): n is a, c, g, or t
  misc_feature (254)..(254): n is a, c, g, or t
  misc_feature (263)..(263): n is a, c, g, or t
  misc_feature (267)..(267): n is a, c, g, or t
  misc_feature (282)..(282): n is a, c, g, or t
  misc_feature (284)..(285): n is a, c, g, or t
  misc_feature (287)..(287): n is a, c, g, or t
  misc_feature (292)..(292): n is a, c, g, or t
  misc_feature (295)..(296): n is a, c, g, or t
  misc_feature (301)..(301): n is a, c, g, or t
  misc_feature (307)..(308): n is a, c, g, or t
  misc_feature (311)..(311): n is a, c, g, or t
  misc_feature (314)..(314): n is a, c, g, or t
  misc_feature (322)..(322): n is a, c, g, or t
  misc_feature (328)..(329): n is a, c, g, or t
  misc_feature (331)..(332): n is a, c, g, or t
  misc_feature (335)..(335): n is a, c, g, or t
  misc_feature (337)..(338): n is a, c, g, or t
  misc_feature (343)..(343): n is a, c, g, or t
  misc_feature (347)..(347): n is a, c, g, or t
  misc_feature (349)..(349): n is a, c, g, or t
  misc_feature (357)..(357): n is a, c, g, or t
  misc_feature (367)..(367): n is a, c, g, or t
  misc_feature (370)..(370): n is a, c, g, or t
  misc_feature (372)..(372): n is a, c, g, or t
  misc_feature (381)..(381): n is a, c, g, or t
  misc_feature (385)..(386): n is a, c, g, or t
  misc_feature (390)..(390): n is a, c, g, or t
  misc_feature (392)..(392): n is a, c, g, or t
  misc_feature (395)..(396): n is a, c, g, or t
  misc_feature (410)..(410): n is a, c, g, or t
  misc_feature (413)..(413): n is a, c, g, or t
  misc_feature (415)..(416): n is a, c, g, or t
  misc_feature (421)..(422): n is a, c, g, or t
  misc_feature (426)..(428): n is a, c, g, or t
  misc_feature (433)..(433): n is a, c, g, or t
  misc_feature (435)..(435): n is a, c, g, or t
ataataatttaacttctgttaagggatgaatggtggactcccaaagaaagatnnattaaaagantnaaatagtggnaccctttttagtattgtntgtttgttgnattnanttngaaaaatatttnaangngaanagatgattntttttgtnggatnggnttattgttagatattaaaatttntngantnanaatnagaagagttaattnntagtggttgtaaaaaanttttntngaanggaaattaaaaaattnagtgtgttnattnatttgtttatttatntnngntgttnttnntgggnatgaannatnatnaataattntttggnngnnttngnnaggtnatangnggtttggnaagtggagtnaangntaaatggtntggnnaagnantgnngggagagttgtttnatngnngtttnnattnnnaaggnanagttttgcactctgctcgaacgcatgtacatgtcggggataacgccaagaatgtggacaatgtgatggtttatctacaaatttggtgtgtcggatttacaaacaatgaagaaactcaccgaatcggcgtggaaaagtgcgttggattcggtactcgcaccaccgctattgtttctgttggatggcgcgttttggaggtccaacaagagagactttattgcgttggttagcaattccgtctcaagaatcaaattgtccgggaaaactacaacgtagatttttaatggtttatggatggtaattctcaaaatcagttcaatttttggagaaaaaagaatcaaaattctattaaccaactcaattgaaagaggattctaaaactcaattgcaaagaaaaggaaataacgcagtcaaaaggaacccaggagaatctgtatgcttacaattagctccttccattctaaaaaaattaaatgcttactttcgccgttgaaaatcgcattcgtcgcgccataagcgcctttttgagcggaagggtcggcgagtgaattcgaaggatgcgtcgtcggcggctcgcaggcatttcgaagagagaacttaaagcgttttaaaatattggagcttggcattccattgacagaccgttgctgaacttgcgccatttgacgcgaagacggggacggttttctcaatggacgaatgcccagcggttgttgtggcgctaccaaaagatttttgtcgttgttgagaacgttgagaaccaaattttggcgctttttgatgaatggcatttgccattgaagtggccgaatgggaggagggatggtggggagggggcaaaggcagcatttgactggtgcaattggacgacgatgaagcagcgtttagaggggatggacgaacgccgctcatccgagcggacggataagtgtctaaatgggacagcggcaaaaatggaaaaatcaaatatagcaaatttcacataaaaacctcctttctgtacgccagcagtcggaaagttttatttggtatggaaaatggccgagtattaaaaaatccatcgtagttgattggttttaaaaattcactatttttatgcaaattattgaatttacccgtggaatattgatggagtgattgcacttggttctgttgttgggaaggacggatgagagtggaggcggacattacaatggcaccgatttgaggcgggggaatgcccgtcgaaagagtcggattttgttgaggtgggggcgtcgacacgcactgaaacaaaaatggcagaaatttggaaccaattttttcttgagagaaataaaaaattttagccgacaggcgccgcaggagggaaaatttttagaatttttaatgaattttgtgattaccgcatttggaatggacgaagcgatcgtttgaagcggagaaatgacaccgttttggcgttgtttttgcttctgttgtgcattaaattccgaacgaatgtccgcttggtccaattgcaattgttcgacggtccgttgaagaatttgcagggcactgacagaaaaggaaaatattattgtaaaacccgaattaaaacacttcaaaatctgtgcatttgaagaaccaaattggtccattctctctttggtctccgcccacttttccttcagttccaaataatagtccaaagaagaaagtccgtcgttcatttgctcatccaaaaatgccgattttacgggcgaagaatgccttacaaaacaaaaagatttggacaatccgaagtatcggaaaaaaactttgtgctgttcgaagagacgcgcgatttattcgacgcgtttaatcgctcatcggtgggcactctccggcgcagccattcgcagtcagctgaaggagagagagaaaaagtcaacgaaagggcggggaaaaacaaaacgcactctctccgctgatttcttttccattttgggaatccgtcgctgggaggggcaaatttaaacgccgacgacgaatttctttaagcaaatcaataattaagtgggcgaaatcggccgaagagaatttggcaagtttttgtctgagttggtttcgagtggcggagagtcgcgggttgggctgaaaaaagaaactcagtggaagaatttgtgaaaatttaggtttaagtggggaaaaaggtcgaaaacatacgggcaaaaacatggccacgtgttggttggcacttgcggtggggtgatgctcagatgcaacggcactccaatggccattcaattcgcgtcggtcgaccttaaaatggaggctaaagatgtttccaaaacaacaattaacagccaattaatgcgtttggtgggtttttgttgcggtttggtcacctcgtcataaacgtcctgaaccattcgttcgagtatcaacccactgcttctctgaatggaatccttgaactgtttgacttggctgtttttctttgaatcgacgagatccgggatgagaaagtgttggttttctctgtgggagggtcgccttcctttgatggaaattttaaattaaaaccaaagaaatgacaaatcaagacttaccgcagagaaacattgaaaagcgatcggtcatttcgtactccaattcgacgagtcgttccgcgagttcgttctgaaatgttaaagtgtccgcttctccgtttgtttgtttgcccccttttccaccgttcccttacaaatccctccgttttcgccaattccgccggcgtttgccccgccccattccgttggccaatgtccgccccgtacaaccaaagcaattccgcctgcaaattctgaccctctttggccgcgacatgcaacggagtgtttcccttctcagtgtccgcgtaatttggacacgcgccaagcgccaaaagccttaatcacgtaaatagggcgaatattagcaaataatctaattatttaatcagtttattggccgtttgcttaattatttcagctaataaagcgattcacaattccatcccaattcattcacctcaacgcggtttcaacgtgcgcagtgcgaacacacgaccaaagctggcgattccttccaaagggacactttctgctgaaattgcttcgaatgcttacaaatcgtccacattgaattcgtccttggccggtctgatggcgaatgccaattgcgcatatttcgccgtaataaacgcctcctttttgggaattatcggatcacttaaaggggaaggaagacaaagttatgcgcattgcttttgccaaatgtcagcccacttggagacgggcttcttcttcgcccgacctgcgccccccaacgaatcgatcagcgaatgctcccaaacattgttggcgccattacgacagagcaattggagcagagccaattgtttgtcgtgccaaacgccttttgtcagtgaacggacttggctgaagtgacggcctaaggagaggaacaattggaaaggaaaaacgaagcaaaattagggagacagacccaaatttcgatgtacaaaacaacaatcggagcagatcagcacgccgtgattcagcgaagcccaactcggacaagaggcaccgcaatcggcgcaaacagtgccagaaaattccatgggaaaggcactttaagaagagggatggaaaacatcagtacaatttttacgaataaaaatcccgggtctcttcaatgtcacgaacgatatttatattttgaacgctgaacccacatcaaaaaattaaagcgagaaaagacgggaccagagaccgacactttgggtggtccattcatttgtttagtttgaccattcataacgacaagataaattgatattttttccgcgttaattcaaaaaaaaatcgcttctttccaaccaaactgaacgtaactcgtgaaattgctaaataatttgacctataggaaacaaaagccttgtaaagggaaagatgaaatgtgttcagttttgcactttaattcataaatacagtacataagtttggttgcttttccaatacaccaaaatgtgttaactattatgcctccgcctcgggtgggcatcgaacccacgcctttcacaaacagagcaaaaatgttataatatgcgtataaaatggcaaatggctcttatcactagcgaatttgggtgataatctgttcgataactttctttttgctgtctcttccgccgctgattactttcgcttgcttttcttttgtcatttgctttattaattcacaatgtactcattccatgcttattttcccattttattatttctgctggtttttcttgccacttttgcgctgccaattggcgcgtacaaagtgctgatattcagccaaactagcaccagaagtcacgtgatgctcaatgcgcgagtctcggggggtttggcggtggatgggcacaacgtggtaaaagagaag

SEQ ID NO: 3509 - DNA, 4002 bp, Heterodera glycines
  misc_feature (3990)..(3990): n is a, c, g, or t
ctaacgcaattcttgtgaacaaagcggaagcctaaaaatttaaaatttttagattttcgacctttaaaatttataccgaaaaagcgatgaaattcaatctttccagaggcatttcgtcaaaattcgaggccgccattggcatattggtaaagagaatggtgccaaaattgttgaaaagtgccgcggagaaggcacaaagtgcgcaaagtgggaacaaaaggcgccaagttggcggaccttatacggtaggaagggtaattagtagttattttgaaaaaaaaagttactcaaaatgccagggacagtctgcccccagggttctccgcacgcacccgaaatttttaagtgtaagaatagtagtaatttgctgaaattttcgtttttcattgttagtaccccctgaactacctcatcaaaatctcccagaatttttggcaaaaattttcccgaaaagccctacgaaattcctgttttttgttgaaaaactattaaaaatagagggttgcactcaaattttcaaaaaattttctggcggcacctttgtcacctcgggtagggagcatactgagaccgtccctggtaaaaacatacagtttgccaaagttggcagatattgaattgcttcgcggtcatcatcatcatggtcaccattttcttcacttttttcggtatttttgctcatccataatgatggcagtatcagaagagcctttgaaaaaatgaaatttttttaaatgtttgtccaaaaaaaattcaaaatatttaatgccaatttttaatccaaaagttcaaattagtaataatttttattgtaattagtccatggatttgtttgagtgtgtttttgttaatatacacctgcaaaaaggcaacatcaaaaaaactgctgtaagcgaatgccaaactgaatggaaagcggacaaatgccaaaactgaaaaaattggtgattgcaaattattaccatttagcagactaattacaaatttttggtgtttgttaatgtgttatttgtattagtttaaataagtaacgatgcaaaaaatggtccaagcgatgtgaaaagcaaaagctaaaaataattggagtgaaaaaaataaaaagagaaaaattataaaatttattttttaactaaaaataaataaaaatttataacttttttatttaaaatcttaattcatatatcggcgaaatatataattttttattaaatttttctaggattatgaatttattttccaatttttttttggcactttgtttacctaccgtaaacaggtggtaccgttgttgtgccacggcttcgtcccgttttgtgtcaataacttgggttaacaacagccgttgctgtagcccgtcacaaatgccaacaacaaacaatggcacaagcagcaggaatagcatcgacgagagcactccaccgtcaagaaaacagtaaaaaatggccatggaaaacagacaaacggttttggccaagttcgacagaaaagcgggtggacactgctttaatctaaaatatttggagaatttaatgaaataaattttaaaaaattagttgtgtatataagagcattttattcgtttataaatttgaaattattcttatttaaaaaatatttatttaaacacatgaaatttgatcggactattttttaatacaaaattaattgaataagttaatatcatctaaatggataaggaagaacttttgaagcaccctaataaaatttgaattaatttaaaattattaaacaatcgaaattcattgatttaaatttcttatattatgtacaaaaaaagaaaatatttttaatcgaaaaaatgcaataataataaaatttataaattaaaattttaattgctttacgccccaaatgatgtaaaaaaataaggcaaaagccgcggtgtgaaaaatccaccgtcgcacagataagccaaacagcgaagatgatgatggcacggcactgtgaccgagtgtgccgtgccgacaaatttgcctttctctcgcccccccccccaagggatgatgttggggaggggccgtgaagtgtttgtgccgagaccaaagttattgaaacgaaaaaatggggattttttgacactgatgaaatgccattattgccgatgaaaaattggagggagagagcgagaaacggattaacagcggattggcactgctaatgatgaaaaatggtcgaaagcatataaagaaaaaaaatggtgaaaatgttgaaagtgaaagaatgtagtgaagacaaatttaagaatgaaatatggaaaagaacacgaatttttctgaaagtaattatcgaaataaaagaatttttgactgtaacgcaatttttaattcaacgattaccaaatcaaaattttgatacttttttacaaatagtttaaagagaaactaaaataaggagcattagctttttctataatttctttaaaaaaaaaatccctttaaaatttacaaaaccctaacaattaataactttttaaattatatgcttaaaaattatattatattatattcatattctatttaattctgtgggactcacatggactgaacgcattctttggtgggattcaaatggtaaaccttttctttgtgctgctgctggtggtgctgctgctgctcggccggttcaaaatgcataaaagggcagacatttaccggcaatgggtcatttgcttctctcattcgttcattcatttttctctgcttctcattcgttcatttttcctccatgacttcccccccccccctccctttcccctctctctctctcctccttgcatttgattggttcattcattcctttaaaacattcgattattttgtgcacgcactttcatttgaataaatttatgttagccttttattgtttgtttgtttgtttgtttatttgttttgctttgtactcatttcattcgaaagctctaacatgtttagaagaagctgttttgtatctattggttggcaattagacaattaccaaaataaatagttataacacaaaaattgccaaaaatccaaaaaaattaaagttttttcttcataacttttttatattactaaaaaaattttgtgctttttgtaagactaattgagcatgtgaagcgctttctaatgataccaagacaattttgatttagttgaaaataaaaaagttatagccctaaaagttgggctggcgccaaaatgaccccattcattctccctttttgactgttcgcttttcatttgtgctgccaccgctgctgctgcggccgggtccaaagtacataaaagggcagacattgaccggcaatgggtcatttgcttttcctccgttcgtttttcctccatgcctttgcactccctttgcccctttcccctctctctctctcctccttgcatttgcttattccatcttttttaaaaacattgattattttgggacggcacctttcattttaatcagcaggacactgcacggaaatggacggagaaaaacatcaataaatcactctggtacgaaatagtgcaggacagtgattgcctcaggcaatttgaatggctttgcgctcctgttttgcctgaggcaatctctatcatgtactatttcgcaccagagtatattttcttttcgtccatttttgtgcagctctcctgatttgaatgtgtatttgtttatttgttttactgtactcatttattttctttttagagttcagtaaaccctcttaattatccaacatttggtcaccatccgcgcgtcctttaaagcattgacacaacatgaatttcccggcgaatattttggtgggtttattggtttttttctttccatcatatttctgctaacaatttattggatattctgtggcttttttcaaaaataattgtaaatttatttttgttttttttaatttatgtaaatccattttttattcaaattgtttttaattaagacaaattatttttctttaaaatgccatttgtttttatngtttttggctcc

SEQ ID NO: 3510 - DNA, 911 bp, Heterodera glycines
ctcctccttgcattgtgatggttcattcattcctttaaaacattcgattattttgtgcacgcactttcatttgaataaatttatgttagccttttattgtttgtttgtttgtttgtttatttgttttgctttgtactcatttcattcgaaagctctaacatgtttagaagaagctgttttgtatctattggttggcaattagacaattaccaaaataaatagttataacacaaaaattgccaaaaatccaaaaaaattaaagttttttcttcataacttttttatattactaaaaaaattttgtgctttttgtaagactaattgagcatgtgaagcgctttctaatgataccaagacaattttgatttagttgaaaataaaaaagttatagccctaaaagttgggctggcgccaaaacgacccattcattctccctttttgactgttcgcttttcatttgtgctgccaccgctgctgctgcggccgggtccaaagtacataaaagggcagacattgaccggcaatgggtcatttgcttttcctccgttcgtttttcctccatgcctttgcactccctttgccctttcccctctctctctctcctccttgcatttgcttattccatcttttttaaaaacattgattattttgggacggcactttcattttaatcagcaggacactgcacgaatggacggagaaaaacatcaataaatcactctggtacgaaatagtgcaggacagtgattgcctcaggcaatttagatggtcttggcgatccttttttgcctgaggcaatcactatcatgtactatttcgcaccagagtatattttcttttcgtccatttttgtgcagccctcctgatttgaatatgtatttatgttagcccttcaattgttttttgtttat

SEQ ID NO: 3511 - DNA, 1733 bp, Heterodera glycines
ctttggccatttttcattactattttagttaactatttcgagatttttcattaaaattaaaattaaggtaaaaataattttttttttagatagtgggtcaaattttgttataaacattattttattattttctatttatttcacacttatccacacattcattccaccttgaaatcatactcatgctccaacttttgatcctttaagtcatttttgtaacaaatttgagggtttttagttttgcatattttatattattatttttcgggatttcagtggcatttgtcattttaattttagtacaatatcgcatccattactggtgaatgttcttttgcatagtatacaattattctgcttaatccttacgctgcccttttcactcaatcaaaatcgtacgctaattgcttatggtcactcctttgaacaatgagcgaggattaatcgggaacaaaattggcatgttccatcatgcaggtcactcgctgattaagccatctgatcagctccatctcagcccggattatgccacaaatgacgacgatctgctgctgctcacagagaatgagaagaaggatatgaaggaggtggcggaggtgccatatgcagaaattcctccgttttggcaccaaaaaagaacaaactcatcaaaaacgccatgccggcactgacaacaccaatgaatggcactgctgaaggacaacaacgacagttttggctccctaatgagctcatccatgagctgctcatatgggtccggcccagctatttttggcgcgttcggcaaatgcttacaaccagtgccattctgtgccctttgcttatgggtggcaaacatgccatcacttggcatcagccttacgatgttggggtaatgcgttaaaaagtgatgtccatttactttggtgcaattgaagagcgttaaatcttattttgaacttagtgaatcgaatttggtaaaatagtgactaaaaatagaaataaatatgtaattagttgtaaaaaatccttagatgtttttttcaaaagttctgccaattaaccagaaattaatttttgccattttattttatttatttaacccttatctaataaaatttgcttaaaagacttgaagcttaatttcttattaaaaaataagttagctttatccttcttatatctctgagtgggttttattcttcatcttattctctgccttatcattcatttgcttattgcctagcgcattatgcgctgttaaattttcatggctttattaccatttttatatttaaaaaaataaatattttaccttttatatttaaaaaaataattcttttttcttttcaaatttggtaaaattgctccatatataaaaaatataataatatatataaataaattttgatttgatttatcaagaccaaagagatgagtcacgcggatcgtacatttggaagcgggaaacagtatgcgctattatgccgatcacattcacaaacgctacccggcaattttatgcgataccaaactcactcaaacgggacagtgactgtgtatgtgctccttatacttgatgagagcaaatttgaatctccagctcaccttgcgcaatcggtgcgtaaaatgagtaaaaaggaatatttgtttatttatcctatttaattttatttaaatccaaatatgcaaaagactttctctcttgaattgttattttactttggcatcagtctaattaattgacatttttt

SEQ ID NO: 3512 - DNA, 3236 bp, Heterodera glycines
tgctcttgcgtggactattttgtttttgaaacaaattctatttaatttttatatcctttaactgactcattttttgttcttgcaaaatctgcgctgagattcgttaccatttttttattttgcatatattaaaacacatttttctctcccaaatcacattttctccgaatacgtgtcgaattagagcgattttttaacaagtaattttaactatttgggatttttgtcaattgccacttatatattttggcttgtgaaatttttttaaaactttttttttcaactatttttgcttgtgaatgcaaactttgttatgaaaaacgcaatcaaattaaataaaatgcgccctgagaatcgactaaattttaaaaaaacgcacctaagaatcgacttttcaaaaagcaaaaatcctgtccatgatgaatggtgggtggataaacgaaaacattttactccagaaaatcttaaaatgtttttcagtttgttagcgacttgttaggtatctatctatttctctgttttatcacctaaaaatcctagacttgctaatgaattaaagcaccaaaaaatatttgcgatagcatatttttgcttatggtaaaatttttttaataaaatccgaaaaattcattcggagtttcaaaaaaaaataaaattaaccattaaaaaccttttatgaaaaacaataaatatttcaatcataaaatatttattaaaaaattttaataattatttgactgatcgcttttttcaataggcgaggattaattggaacaaaattgaaatgttcttttcatgcaggtcacttgctgatttagccatctgtcagctccatctcagcccggattatgccacaaatgacgacgatctgctgctgctcacagagaatgagaataagactgtgaaggaggaggcagagatgccatttgcagaaattcctccgctccgttttggcatcaaaaaagaacaaactcatcaaaaacgccatgccggcactgacaacaccaatgaatggcactgctgaaggaaaacaacgacagttttggctccctaatgagctcatccatgagctgctcctatgggtacggcccagctatttttggcgcgttcggcaaatgcttacaaccagtgccattctgtgccctttgcttatgggtagcaaacatgccattacttggcatcagccttacgatgttggggtaataacacagtgagggcaaatataatggaaataggtccatattttggtgatacttgagagcgttagattcagtttatattttattttgaaccaaatttgctttaaaaaatcggagatcaaacgattaaagcttgaagaattggttaataaccaaaaaataattttttccatttaaatttttatctatttaacccttatataataaaatttgcttagatgactttcaccatagttttaaggttatgttaaatgcgggactaaatgcgtccttttcacatgactttagctttattttttaccttttgaaatttaaaataattctttttttcaacttaaatttggtaaagttgctccaaaattaatataaaaaataaaataaataaattttgatttgatttatcaagaccaaagagatgagtcacgcggatcgtacatttggaagcgggaaacagtatgcgctattatgccgatcacattcacaaacgctacccggcaattttatccgatacctccaaactcactcaaacgggacagtgactgtgtatgtgctccttatacttgatgagagcaaatttgaatctccagctcaccttgcgcaatcggtgcgtaaaatgagtaaaaaggaatatttgtttatttatcctatttaattttatttaaatctaaatccaaatatgcaaaagactttttctcttgaattgttattttactttggcatcagtctaattaattgactttttttgggggggggggggggggtcaaaaagtccaatttagctgctgagggccgttttaatagagatgtattggaaaatgccaaaacatggacataaaatatggataaaaatgccaaacataaatttggtttttttagcgcaacttccttgattgcagtggctcgcttcgtgaagggcaccaaacacttgggcagggaattactagcatgacttttgttcgttgtcctggtgaggtgcgtaaatattacaattctttatttaatttcaaaaactataaatcttgtcaatgatttttccttttttaaattctgattgagttttggatggtaaaaaaataacttttaaaatttgcagtcaaacaaattatgcataataaattttgcttttaaaataaattttataaatttaggaataaaaccaattattttgtccccaaatttacaaatattacaattccttgccaaaattataaaattacaaataaattggacaaataaaacccaatcgatcgggcctctttcgccttttaggactttgatctggcgaagattaaatgcgatgctaatttcgaccttcgtctgatcatgagctcgcttctagagatgctccaattatatgcaaaacatattgacaatgttttgccgaatgagttccgtgctgatcactgatcagcaggaggaggaggagggtgtttgaattttaggaattgttggcgtatgttgggttttttgttgctttgctatttcacacaaaattacattgtttggataaagctgttagtaaacaataattgagcacgaacgaattttgttaattttaaagcatacatacaaaatttataaaacattattttttaattttcaaacattactgccacatatatttgcaaaaaaaatttctgaattttcttttttatttaaattatatatatttaaatgaattgttttaaataatatttaaatttttaaacccgaaggaaaaggaataaattaatttataactactttttttaatgtttaaaattattgttttttataatccaataaatttcaagtaaatatataaaaaaatttctaaattttcatactataatttaacatgtatgtacatatttgtatatcatttttagtatttttgcttttttgaggctctcttcgtccattgacgaattattttgctgagaaaataaaaatgatgcattgaattcattaaagaaattaatcccgccgcttaaaatcattttcaattattttaattaattcattgccgacactttttgcttttccaccatttattta

SEQ ID NO: 3513 - DNA, 2121 bp, Heterodera glycines
ctccccactcccccctctgccaagacaaccaacccaatgaaaactgacccatggtaaaaaaacccccaaaataggaatttcttgttaatttcctgctggatacatccatcccctggtcccttcccttccttttccttcccaattttcacttcgtttgagtctttcattgtctccaccgtttctcggcccaatttctccccataaaattgctccattcgcgcacttatctccgccaatttcgttattgccggctctttgtacacaaattctttgccgttcaattcgccgaatttgacgccgtaaaagcgcacccgaaaataagtgccgaaacagcgtttgtccattctgtggcattaattattattgatcatttccaatttgtttttctgttacccggccaatggcactgtcagtgccgtcgccgtcctttgcccttttccatgaactgtaatttctccgttttcccattcgtcaattagcatcggcgggtcgattcggctcaaacagctgacgatttgcgcgtgcgcctgaatcagcttgacatgcgcgtgcgtgcgctcgaacagcggaagaaccaattttaacgcattggcaaccaattcgaagagttgggccctaagggaagggcagaggttacagtacccaaacggacagttcctgcctccctgggattacagtactcaaatggacagtccttcccacccaggggttacagactcaaatggacagttcctgcctccctgggattacagtactcaaatggacagtccttcccacccaggggttacagacgcaaatggacagttcctgcctccctgggattacagtactcaaatggacagtccttcccacccaggggttacagacgcaaatggacagttcctgcctccctgggattacagtactcaaatggacagtccatcccacccaggggttacagtacaaattgacattctctccctcccccgtcgtcctttacctttcaaataaattggccattttctccaccatttttatgaatgccgaaagtgtaaagttttccgcgccgtccgtcagcctttctttgccccttttgtcctcccattcttcgctaatgttttcgctcaatgcttcgaatgcttcgaacaccgaacgcggcaacaattcgtcgtcggcggtgcccgcgttaagcaaagtcgtcgccacaatggcacaacagtgcaaaaaacactgggctaaacacatttatttttaagtcatttgacaaattcaaattatttaattgatcattaattcgcctaaaacattgattaattatttcgtaaaaataatttccgcttaattcattaatttataattgatgaattatccggctaatgaattaattacccgcttccgcgtatgttttcctttcctctaaatgctttcgcgcaatgcccagcagccaagcaatcctttaaatttaatctaccgtcattcgccccctccatttgccaccgtttctttcccctaccgtatacctcaacttggggttgttacggtatccgtgtgcaattcgatgcattaagtcgacactcatctcaaaatcgtcaatatgtgcgctcagtttgaacgtgtcgctcagaatggcgttcagattcaccacgagttgttccaattggctcataaattccgccttttcgcttttcttcgcttcgggcacaagcgaattaagcgacgccctcagggcattgtcgtccaatgctttgccagaggcgacggaagttgagacgagggaacacagagcagaggtcagacaccgattcagacggacgaaacccctggcaattaaaggtgattaattaagagggatggcaattcaaacacagctaaattcaaaccccttcgagtgccggaatgcgattttgagttgtgccaatgcactggtggccgcctgctgccgcacttcggcattttcggccgccatttgtctgagtaattgctgacaaagtgcggtaagcaattgttggtcactctcgacgaggagaaagtcgggaaatttacggacgaaggcacgcaaagagggaaacaaatggaaaagggacggcaaagaatggagtcaaacgaaagggaaaagcaaaagacgaagcaaatcgggcaaaa

SEQ ID NO: 3514 - DNA, 1287 bp, Heterodera glycines
tcaactaccaaaggcaaattaatcgtctaattaaaatcataagggagggggggggagaagggagtaatttggcagctgctaactgtttttggtggcttcgactttccttaccactgttgttgcgccttctcatccgccatcttattccgtctgtcgctgctgtactgcttgaattcgttgcttttccattgccattttcctccgttaattcgtcgcccttcggcatcgtcccattgccatttgtgccgttgtcccctaatgtgctgatactcattgtttccatactttgtcgccttttctccgccaaaaagtgttgggaaaagtcaaattcgtctgttccttgacaaaaatggattccgccgatcaaatggacgaaagaatcgacggaatggcgacgaggaaacgccggaggggcgagttgggagaaagtgaaaaggagcgaacggaggagacggacgaagcagtggaactgatcgggggaaaacaaacgcaagtgggcgagcagagagggcatgggaagagaacggagaagccaacagacgcagagaagaagctgaacaggggcacagggagtacaaatcgacgagatgccaatttgtggccaaaagattgccaaaatggcaattagttggcttaattattagtaacatggtccgttgcctctctcggctgccaacctttttccgagtcgtttcttccgctttccccgccgttccttctgctgctggtgccaactctcggcggctgttcagttcctcctcttccgccgatgccaatcccgagtctttgtccttttctttgtctctctttctctccctttcgtcactttccggcaattccatctccaatttgtcctgtcccaattccatcgccatggacaacaatggcgagtacatagcagcgactcgttgtcccaacgcgctgttctctccgttcagtcgccagtcgttttcatgagaggcaattagcgagtggaggagactgacgtaagaagcgcaaagggacgagcgaacgcggagcaaaaggcgaagttgggagaggaaaaggaacaggggaaagtgacgaaaacgatgatcaacggacagatcggaaaacagcttcagcgaaaaagcggaatgacaagcggagacaaaagacgaagtggcggaagaaagggacggcacggaggacaaagagacggcactgaacggagggggaggggggtcaattgggagaattgcatgggaagggagagaaacggtactggaagggcggatggagggtttcgcggggggggggggggggggg

SEQ ID NO: 3515 - DNA, 1930 bp, Heterodera glycines
cattccgagtgcctttctttgccttaccttttcgtcatcggattccctcttccgccggcgttgtcccttttgcttcctccgccatttgtcttccctttgggtgaatttatttttctgctgtttgccaaattcgtcgtcgatttgcgcaaagtgccaaaagcgccggtggaaaaaggcgcggcacaaaacaaattttgaaaatttttcgtctttttgttttcgtcttcggccgatggaagtgaaaaatcgaagggaaaaggaaggcaaaggaagagaaaatggtggtgggagaggagaagacggaagaaggacagtttgagggagagcaactgtgcacagaacggcgaatttggcacgcaaatggacaaagcactgacaaaagtgggggcattttgaaatttggaattggcaaaacgattaaacgttggcatttctataatttggcattgtgcccactcactcaattctcgcgtccatcgtgttgcaatagtgcttcatctgttcaattatccatccgcgcgacaataatgcaaccgattcgcgcagaaactgtgcccatgccgaattgatcgcgtccgcttgtgccgtgttttttgccgccctttccaatacttcgccgattagcaattcgccgagttgggaaagttgcctaaggaattcggaaccaccgaagcgcaatttgcgcggcaatagatggccctgtggcaaatggaacttcgtactttggactgatcagagtctctttacttgcgtctgatcaatatgctcaacaagcgatcggtggatgagcgagaggagaaaccaagcggaagaacaggccgagtcgcgggcatggcccgaactggagacgaacagacggacaagctgaacatgcagaagggcctaaagaatggcagaatgagtggtcaattggcatctgccgctgaagcccatacaaagtcggcacttgtccctgggcttttccgctgctcttccgttggcatttcctttcccaattgaccgttggcatttgccccggggctcttccgctgcgtttccgtcggcttttccttcgccttttcttttctttcgcttccgtttctgttgttccgctgctcttcgttctgtttctgttccctcttcgtccacacttcttcttcttcttcccctgtttcattttcctttttttgctttggcaatcgctccaaacggacaaattccaacaataattggctcctattttgcgcgtccacctttaattggggtttggcattaattatttcaatttgctatttatacccgcccatccaaaagcattgagctgatcagtgccaactgacaaagcgtttcaaaggcaccgtttgcaataagcgcagaagacgattggtccaaagaagtgaaagaaatgctgaacaaaaaaaacaaaataataataaaaaaataatttaaataatttaaaataataaaaataacatttccaaaattcggtggagaataatgtggagaaaggaaagcatttgctcgggagaacatttgagcacatttcgaatggaagtcgcaaataaatcggcggaaaatgagcgaagaaaggcacgggaggaaatcagaaaggcattcaaatgggggtcctggaaaaagtgccaaaagtaagcaatggatggctaattatgacttgaggctgaacactcgacacgcaaaggacgcgcaaatgaaagaggggccggtgggaatcgagccaacgaacattcggcacattgacatggggcgagaggaagcaaagtgccggcagaggggggtccagcgaaatgggcagccgatggtcgccggaaggaaaagcggcggttaggcacgaggaaaagccatccgccgattggaagggcagccaggagaagctgagggggggggggcttaaaggagggcatatccaaagcgaagccgatggaacgtcgac

SEQ ID NO: 3516 - DNA, 1919 bp, Heterodera glycines
acgtcgacccatttgctggtgccaaattggcccgacttttaccctattggcgttgtgcacatcgttttcgcgtcgtctcctcggggcttgcacgaaacatgcaaaaaggtgaagcgcaggtaaagtccgtccctcccgcccctgggcatgatcagcttccactcggtgccaccaaattgggcgtttcgagagtgatattggaccgtcgagaacacttcgcccaccaatttcccatcaacaacaaatgctttttcgattcgactttcggattttccgctgaaaagttcggcctaaaaatgacaataattttccccaacaaagaacacatttctccgcactttcaccgaaatattccgcgcattttgccccgtccgagcggtaaaatttgcgctttgcgggtaaacaaaaagcaaatggagtggaaatttgtagacggaagccatccgacagatgggaaaagggagcaaatcaaagcaaagagacggcgtaggggacgaaaaatgaggcgaagaaaggggaggagaagcagggggaggaggagaagaagcagtgccatcggtggcggaagaacagggatgagagacggaattggcacggggggcaatggcggggcaaccgccgctgggcaagttcagctggacaagttctgacgacaacacacggacattccgcgcggaaaagtcgtccatccggacagtctccaatacgaaatgaatatccactggaaactaaagcaaaaggaaagttggcaagagttgagaatcagctcgaaccctcttggctaattaccctttcccctcggggctgttggtgtccgattgtcatcgatgaaagccaatcaaagagttctgtgtcgggcaagggctcagaacgcaaaaaagagtttattcggacggaaattggtcgctgaaacaattggcgaacccaaccgaagttgggttgggacggaaagtgatggaaattgtcccccgtggctgcggaaatgaaagtccatgaggaggaattggcgagacggggcggcaccgaagcgacggaagggtcaatggcagaaaaggaaaagcgatctgaaattgaaaaaggcattcaaccaatgcgctaattcctaaggtttatgtttattgcgccataaatttctaagattgtcttattttcaataattttaagaagctggtcatttttctaaaaacgcattatattttttccaaaattttatcggtgaacgccaacggcaccgccccctcccctccttcacaatatttttttttttgaaagaaaatgcgccgtaaatgtaaaaaattttgagctaaaaactgatgtcgtgcatttttaatgatcgctcccttggcttggcattctgtccattcccccccccccccaattcgcctgctgtcaaagtgctgctctcgctggtcgagtcgtccgccttaatgtccaatgccaaactgttcgcttgcaccatcgaatcagtgaatgagcggacggatcggcttaattcgtccggtccgcggagtgtggcattcactaaacgagccaatggcacagcgacgaggccaatttgctgacgaaatttcgccggatgaattgcgcaattcgaatcggcacaatttccgtcattggaagagggcaaattccgtcctttggtgttctgttcgattaagctttaattttcggaagcagcgcatttccctttttgtcacctgttgccttttcgaaaagggctctaaaattgcgtccattcctccgcgttgaagcgccttttccaaacgaaacgccaaaaccagcgaatccgcgccattttcatcgctatcattcggcagagagaacagcgcttgcgggggaacagcggtggaacagaagcgaaagtcttcggacactttccgacgctgtcgaacgtcgtaaagggcggccgaaagaacaaa

SEQ ID NO: 3517 - DNA, 891 bp, Heterodera glycines
  misc_feature (23)..(23): n is a, c, g, or t
ccgtctctcccacaaaatcactnttgccactcaaaaaactcatgcaaaaatggcgcgggtttcttcactgtccgaatttggacgtctttctcaagcatttcccttagccttaaaccaaaaaaaaagcatgaaaatggatagttccattgctatttctgcttttttacctttgtggccccttaagtggacattgaatttcgctgcgggcgatttgccgagacgaaagaatgtcctcaatgtccagcggtgattgactgccattggccatcgtcgccttggccataaaccaaaggtaattaaaaatccctccaattgccttttggctctgttactttttgcccttcttccttcggctcctctttctgttttggtgccgatgttaaagtgttatgcagcaaaaagttctgtgcaattgcgctccgtcgaggacgcaaatttttgttggcggtgccattggccgctgtgccaaaactaaaaaagaggggggggggggaggtgcaaaaaaagacattttgagcatttagagggcatttaatttaaacagattttggtattttgtgcccaaattgggccaatggatgtgctgaattgctgtcccactttgttcttctgctgctgctcccaaagttcgttctccgcccgtcgccccctccgccgatttgtccatttccattttctgttctcttcccggccctattttttgtgtccgatgagtgcattcagcgccaatttttatgagccacataaacaaccgcaaatgacgagcgatggcggcccctcgggcgacattctctgtgggctctgagatcgacgacagttggaaattggaaaaagctgctggggagggaggggaatgagaaacgaaggaagggagaaaaagtgaaggatgtt

SEQ ID NO: 3518 - DNA, 1615 bp, Heterodera glycines
  misc_feature (71)..(71): n is a, c, g, or t
cgggcattaaatcgtttattttaaaaatatttttaattaatttgctaatcgaaggtgaaaccaaatcgacntcccgacaattggcttctttggtcaatgaattccttctccgttcggcagacattctgaacagattttgtgctcaatttgaaaatcggatgatggaattggactttcgtttggacacttttgaacgaatgttggcacttatggaaagaaaagtaagaaatcactatgattttcaaataaatggagaaatcattaagaactaattaagcttgaaaatgttaatgttgacgaagtgaaaaaacaatcggcggaagagaaagaaacggcggagaaagcggagggaatgacgcgcaaagaaaaaggggaagaaacgcccgaagggacgggggaagaaaaacgcacagacaaaaggcaggggaaggaaacggcggcggaagtgacaacgaaggcgaatgaacaccccaaattggccaagtatttcaaaatgctcaaaatggtaattggttcagaatcatggaaaatatttggaagaaacaattttagggcgtgcctgaggcggcggtaaggcaaaaaatgagaagtgaaggaatggacgacgcactcctaaagtgagccttatttgttagtccaaattgagtggaaggaatttttacgcggactttattaaatgctcaaaaaacggtttcagtgacccagagaaggaattgccattggaatcaccacaaaacaaagcgcaaatggtacatgatgcattggcagaggacgacgaatcgtcctcaaactcagatgaatgatttcctggccttcattcctttttatttaattttataactgaagaaaatttgagagatcatttttatgtaagcaaacgctaataaataagtgatgggagtcaaataaattataaaaaaaagtcactgagatttgggcaaaagggaagcgacaaattgcagttcgttctccaacttctccaactgtgcatcaaaataggctttctccgcttcaatctgctggtccagcttggcttctgcttggccaagccgcgcggcgtttcgtttggcctcagtcgtcgccgtgcgattggcgtcccttccctgacacagtgtcaaatgaaatattaaatgaaaacagttttggtgtcataaagataatgaccgggttttcggagtactacctgctccatttgcgcagcaatggccttcctctcttcctccgtggcatgggcaaatttgctgccgcgcagtcgtggcttaatgtcactcggcaccacaattgacatatcggcactgacaatttccttctaaactaacgaattatgctttattgtactgtttcttgaggaattgacttcgcgtgcgctcagtgtctgtttcctctgccgccaattttgagtgcgctcatttaaacgagtcgaatgttcttccacaagttcaagttgggacttcaaatagttacttatcatattgctatgatagctaaatgtaaaggacttataattttgataaaattaatttaaaaaaaattcaattatcggtaaaattgaagaatactgccaatactagaacgatgggttgtccataccagggttcggggagtgtccattgag

SEQ ID NO: 3519 - DNA, 8994 bp, Heterodera glycines
ttggaaaagttaatatttggtgaaagttggaattaaataaggcacatcggagtctaagcttagtcaaatacacaacaatttttggtgccacgacccgggagaaggtcaaaaggctaagcaagactagctgaagcagttcagctgtggtaaaggctttgtgcccaaaccaaatccatcaaatttgagctggtctttgttgtgtactaccagccgggctgtttgtgccaatcaccaaatttaaaggagctggtcaagtgtgttttccagccgagctgttgtgctgaaaaaaggactaagtgtcttcaaaaaaaagtgttttaaaaaaaaaaaagaaattttggaaaatggctgagcaaaattcttttaattctcaaaagggcgaaaatgtggtcctacagggacaaattggttcggatttcgatccaattttctttacccctgaggagaaccaaaatctgaacaatgtactgactcgaatgcgaacattcgaatccgctatttgccgccaatttcgtaaattggagcgagaatttgcagagttgaaaattgtggctcaccaatcagacgataccgatcgaatggtcaaaattgaacggtcaataattgatttggaggatcgagaagaaatggacaattttcaaatggaagaaaaagtgataaaaatggcagaaaaggctgaaactctcgaaatacggcaaaattcatttgaaagattgaccaaagtcaaatttaacaaggtggtggagaaaatgaaagtggaaatggcaaaaataacagaaaacattgacgttttgaaaataagagtggaaaatgaaatggagagttgtgaaataatggtttctgacccatttttgggcggaattgcaccattggaaatgtttgatggaaagccaagtgtatccttttcacgttgggcatcaaaatttgtggatatgctttctctgctaccccaattaacggaaacccaaaaactgagcagattgagaatactcttaattggtcaagtcagagcggaatatgaagcattggacccaccacccgaaaatttaaccaccgctttgaatcatttaaaatcaaaatttgaaaacgaaaatacccgttccatagcgagacaagcgctttcgatttgcaaacaagcgccaggcgaaagagtgagttcatggaaagactcattcccgagctccaatttgaggtaaaggcgggaagaccaaacagttattcgggtgcctacgaactcgcacaacattttgaactgtttttggcatcccggagaacaaatcaaagttctgtagccgactctgttgcagaattatcctcaaaagttgaggcattgagccttgggcaatatcaaagagaaaatgtcaaaggagggcccgacagacgaagatgctattattgcgtcgccctgggcatttggtgagggactgcaaaacaaagaaaagagatgaaaggcaaaatagccgcgggccacaaagaaataacgaatattatgggaatgagagacattggaacacatggccaaatggtggagaaaattctcgttttgtgaacggaagggaacaaagaaatgaacgagaattccgccggtcaccaactccgaatacgcaccctaggggatacagtaataattcgggatcccccgggagaagagtgagctttggtggaagatttgctgcggcaagaattgccagcccaattttaatggcatttattgcaattctgtctctctttcccccaaatatagctgctaatactgcagttagcccaatgatttgcctatcggatgctccctcaagtctctggtctattccttctgaccccttttgcccaacttggaccccaacagtggaaccgattcccgcaaattttgccatttttaggcaaaatacaatacagtacaaaactgaggctacggcttgtaaatgtgtgaaaacaagcatttcaagaagaatcggtttctttggagggaaaatcgaagaaataagtacaagcccagtggaagtcccaacagcgatttgccaccaaatgaaagaaatgaagcattcacccgccggagacttaattttttacgagggaaacaaaacatttagggcgacaaataattcccttgaggtgggatggtcaagctggcctactggcattttttggacaacaaatgaagtgacaaattgttatgtctatgagccagttgtgttcacccggcacggaatgccagggataagtacaccaataaatgattgtaatgcttgtgtgtaccaatcgggaaattgccattgctcacaaattagcctcatttggaaacctgatcaaacccaccaatgtgcttatgttgaagtcggaagatggggtggagaatattcaacgaggatttggacagcaaattacggagattttgctttaacatttctaaatgcctcgagaaaatcagattgtgatggtacggaatttgtgatttccgaccaagcattcgcggtcccagcggcacaatatgatgaaataattaagagaagtggtgaaccgaatgagaggcgtaaaagagaaattggcttagtgtactcttcacaattgtcagctcaattaacagcgcttagtgttaaaatttcacaaaacacacaacgattgttcacagaaacaatcagacagatttgcatgagtctaaaatttttagccgatcaaacgcttgcacttgctgaagccatccccacacttttggctcgtttttatttgggaaatccatttcttttggcaagattggtaacaaaagaaacgttggaaattaaaccgtgttttgccgttaatgaaagggaaatgcattttaattggcaaagtgggccctgttttgataagcttcctattattttcagtttgtatggaagacaaaagcacggctttttggatccaaatacaatgataattcatcagagagcaggggaaatttattgcaatcatgcaaaacatttgtacatattaataaaagggagtattttacaatatgaccaaatgacaggtgaaatgactcatattccgtacgggtcattacaccagctctcgagacacggaaaaatcgattttccagaatttccagtgcaatttttcaaaaacaaagtcatggcaaatttaaccgaattgtattccccagagaatttcaatgaaacaatggaagtggccaaatttgcccaagaaatagcccgtctctctaagcccaaatccccggaattgggaacagcaacaccccttcaaaggtctctaagatttaaagaaaatgaacaaagagtggttcaaattgcagttgccgaaacaaattgtgaccccaattttcggattgctggaatggcaaatgacaaaaaagtaatccatttgttggatacgggtgcacatgtgactttgtgtggcatacagacagcaaaaagacttgggataaccgaattggaaccagcagaaatcagtggagtaatcggcgtgagcgggaaaattgtcaatattttgggccaaaagaaaattgaaatgcaaatttttgggtgtactgtagagacagttatttatgttgctgaggcagaaattggtggcgttggcacctatgacattattgttggacggaaaactttccgccaactaccattgctgcttgacctgcagacgggtactttgataaggaaggaagatggccaaacatacaattgtgaaaaattcaatgaaagagacgtttatttttatgagcccgaaaataacagagaaaattgtggaaaaatcagagaagaattggaaatttgtttggacagaaataaaagtgtttttgctaggcatgaatatgaccttggcacatgtgcctattgcgctccgcctattctaacaacctccgaccttccggagagggttcggccttaccccgtaccaaaaaagtatgaggaggaattgaaggcacaaattgaaaaaatgttaaaatccgaggtgatcagagaaagttgcaccccgtgggctcacaacattgtccttgtcaaaaagtctaatgggcagttaagaccgtgtgtggatttccggccgctaaataaagtcacggtcccagacccttatccaattccccgaatggataaaacaattttacgggcagctggcaaaaagtggtacagtaccttggatttggcctcagggttttggcaaatcccattggacaaggaaagttcatacaaatgcggaattttgactccttggggactgtaccaaatgctgaaaatgccgttcggcttaagaaatgcccctagcattttccagcgggtcatggataaagtgctgaaggacctcccaaatgtcacggcatacattgacgacatattgatacacacagattcagaaaaagagcatttagaaacattggaaagtgtgtttaagaaattggaggaaaatgggcttaaaataaaaaagaaaaatgctatttctttaaaaatgaatgtacctatttggacatattctaaacaaaaatggttatcgcccatcaataaataatcgggaagtcattgaggcattcccagctccgaaaaatgtaaaggaagtcaaaagatttttgggaatgatttcatttttcagaaaattcatcccagaatttgcagtgatagcccatcccttaaatcagttaacggaaaaagagaaagaatttaactggttggaaaaggaggaagaggcattcgaaaagttaaagcaatgattgcttaaggcaccttgcctgagggcaccgaattataaactgccattttacttgttcacggacgcatccgcagtcgcatatgcaggcgcactaatgcaatcagctgatgagaatcaaatgcacgctgtcggtttttggtctaggactctaaactcgacagaagctaaatttcctccaacacatggagagttggctgccatcgtccatgcagtccaaaattacaaacccataatttatggagcagaactgattattttaactgatcacagaccgctcactttcctattttccaagtcaagctcaaaccccaagctgaaccggtggttaatgtcattacaggaatttgaacccaaggttgtatatttggaagggaaagcaaatcgggtggcggatgccttgtccagagtcccgattaaatgggaccaaattgaatcaaaatgtaaagaagacattccctttttgctggtgacagatgaagaaaatggttttgaaattaaccgggagaaaattgagaaagaaaccagtttagacccaattttgtcacaaattgtctcaaaaataaaggaaaattgggccgaaccaattcaggaagagcttaatgtgtattataagcaaagagatcaattatatttggagggaaatttgatcagaaaaaagccactgagacaaattgtaatcccggagaaaatgcgaaattcggtactaaaattggtgcacagggcacattttggaattgtacgaaataaggcaagggcaagaaaccagatttggtggcccgaaattggagatgatgtcgaaaattttgtaaaaagttgttggatttgtcaaaagaatggatctaatccacccaaaacggatgctgcttataaatggcctgattccaagttcccattcgaacgggtccatgccgacttagccgggccaatttggggaacaaatttttttattttggttgatgcgtattcaaaatttccattcgtttaccaaatgaattcgactcattcatcggcacttattaattcgctccgtgaattatttggaatttttggatcaccaaaaacgttggtaaccgacaacggcactcagtttgtgtcaaatgagatggagacgttccttcaaggggaagggatacgccatttgacatctccgacataccatccttcatcaaacggcgaagccgagcggtttgttcgcaccttcaaagaaggaatgggcaaaatgttggaagatggaaagagcatcaaaattgcgctttattttcctgcaggagtacagagcgaccccttgctctgcggcagaaggacaaagcccttctcaaaaatttttgggaagagaattgcgtacggagttggacaaaataaaaatgtcagcaagtgccattgagcgaaaaaggcgtctgttgcccgaggcaaatcgtgaaaagaatttggttacgaaaaactttgagcccggagacttggtttggataaaagagccaaatggcaaatggacgcctggtgttttattgcgcccaattggtgaaagaatttgggaggtggagcatgagggatgctccattagcaaaagtgcccatttggaccagttaaaagcgcgacgcgcagtcactcgacatcattaatacagcacgtaaatgcaatttgtatatattcaattccccccccccccccaaaaaaaaatataaataaatataaaaaaaataaatttaaaaaaaataaataaaaagaaaaaaatttttgtttttgtgttccaattttaaagcaaaagcatttctccaatttgaaaactaattaaatgagcaacgaaaacactccgcccacgaatgacctggaggccatggaaaagaagctcttggaggggaaaaagctgcgcggaacgcatttggggagttgaagcgcaatttggagcaaatgagcagtgaaattcgagccgcaatgaaagaacaatttgagacgatgtgggaaaaattggagccacgtttggttggccaagaaagggtcacagctgcgttatccgatgccctggatgagttcatggccgagaagccggtgacagtgaacagcgggagagacgacaaggacaaaagtcaatcgttggaggatgacccaccggaagagggtggagagcccgaggtggcggctgaaccgtcgccggagctagtggcggcacagggacagaattttgcgcctcagggaagaggcaggggccagtcgggccttggtcgaaaggaccattggaaaagtcgcgcaccaaatcagcaaaagcgcgtgaactacttggtccgccagttggagaaggaatggaagggtgcaaacgtgccgcaaaactgcgactgttggagttgtcgccgtggacgcatttggaaccatcgtggaggccgaggcagtggtgccggacgaggttttggacgtggcgcgtacggttacggacgtggacatgatcgcgaacaccaccatggagcgggaccatcgcactttgctcattgacggaggtgccaagaaaatgtgcgcgggagactcatggaggaggggaggaatgttgggtttcgattcagttcagttttcattttggatttttcggacattttcccttttctcatttttgcccaaaacatttcctttgccattcatccacaaatccatcactcaatttgacccattttcccatttctctttggccaaccattttgtaatgtcactcgcttggcccctcccattatgtcagtatttaagctccccaattgcctctcgcttttaaccattcttttcccattctcatcctgacccttactcatctcacactaaaccaatttactttacttttcatcctttttcctttgcttaattcttaaacacaaataaaccaatcgcattcccccttttgtggacatttggaaaagttaatatttggtgaaagttggaattaaataaggcacatcggagtctaagcttagtcaaatacacaacaaaaactttgcgggaaagagggtcgccggtgccgataggcgccgccaggaaatatttttgaaaattttgtcaatttattaactgattttgtccaaaaaataactaaatatcatttggcattttgtcattaaaaattttcaaaaaatcaataaaatcctgcacaaattttcaaatttgcggatcccgctgcgggatttgaactcaaaattttgcgggacgggatcccgcaggtataaattccgcatttcccaaaaaatgcgggattgcggattgggatcccgcaaaatcccgcgcaggatcccgtcccgcgccgagctctagtattgactgatatcctatgccgtcccatacattgttctccattgtcagcttttcgttggttcgtccgttcaccaattcaaatggttcaattgtcgatgaaccgtaaagaacaaagtcaattttgtagccgacggaagtgcaggcacagagaaatttctaagaaaaaattgaaacgaaaataaaggcaataaaatcacaaataaggccacccacacacttctttgaagttgttgacccagtccattgtttttaaagaagaattacaacagcaatgcaatcgctttggctgcccatttttgctcggagtgtgcaaccaattggataacagttggccagcagttggagttgcatttcgccgaccaaaaccatcaccaatcacatcgtgaagcagtttattggtttcacccaaacgatcagaaaaaacaaagctcaaatggcgaatatttggtgcaaaaatgggccaaatttcacgttccaaaacatcccaaattgcctggccttcagcggtgttgcacaaagaaggcatataagcaaaagtcaaatgggtgcctttgtcaaaaatttggaggaaggcaggagcaaatttgaggtcggaacggttgggtcaatggaaaattcccatcgtcagcatgttcatacacatagagtggagtatggggagaatttccgaaatgagtataatcgttatgcgaatgatcaagtgagtgggggcgtaggagagagagtgcatggggacttgggagaggggcgataccattgtcaatgaaagaaagagagggacacggtcaaggaggaggagcaaggacatacaaacggagttgaaggtacaaagggaatcgggaagagagagagagaagtgagagagagagatgagtataaagaaaaagtgaaaatctgtgggagatttcaaaaaatagcgagtaggcaatattgtgtgaaccggaggttaagtgcttgcgtaagggggtcggggcagcagcgaatagataatatgtcagtgttccccctctc

SEQ ID NO: 3520 - DNA, 1333 bp, Heterodera glycines
tttttgctcggagtgtgcaaccaattggataacagttggccagcagttggagttgcatttcgccgaccaaaaccatcaccaatcacatcgtgaagcagtttattggtttcacccaaacgatcagaaaaaacaaagctcaaatggcgaatatttggtgcaaaaatgggccaaatttcacgttccaaaacatcccaaattgcctggccttcagcggtgttgcacaaagaaggcatataagcaaaagtcaaatgggtgcctttgtcaaaaatttgctgattggcacggagaaattcgatgacggaacggttcgggcaatggaaaatccacagcatcaaaatcccatacagttagtttcggttttgttacaatttccttgctaagtataatcattctccaaattgtcaattccgttttggcatcgaaatgtttgtccactaaaacatcgaaacggggagaaatcagtgccaatttgaggccgagttgggcacggtcaaaaaaggggaacattaccatccaaacatcgttacaaatccagctgaaattgtgaaaatggttagttaaatattgaaatgaattctttaactttttaaaattaattacttaccgccgattcatttgtatagcaattagcacactttgccgtttcaattgattaatttcactgtattaacttaaaacagagacattaggaaaaatgacagtgaagaaacacacacaaaatgaagcaaacaaaaagaataaaggattaaatatgtaaattaaataaaacagaaaatccttaatttttcttaaaattttgcactttttcttatatttcaaaattctggtattttttttaaatgtaaagccttatagctaaacgtcgcaaagtaaattcattttttctctattaacagagataaagaaataatacaccaaaatgagagatgtttttttctcagcactatctattaatggttcacttagaatttagaagtttttatcactatctttttttacagttagacattctctttaattattagtgctgctcgagaccaaaaatttcccgagactcgaccccgagaccgagacccaaaaccccgagacttttttcaaaaaattttcttatccccttaaagatcgttaaaaacaattggaaaatattgatcataggccccaaactcaaaaatgcttaaaaacggtcagaatcgatgtaaaaaggtttgaaatgggttggaaaaatagaattaggggcgcgcttgccctttttcaggatgaaaagtgccgaaaatggagtgccaaactcaactgggactcaagtgaccgtgctatataaagcactcaaaataca

SEQ ID NO: 3521 - DNA, 3514 bp, Heterodera glycines
taatcaatccgaatcacttatgcaaaaaatgcatttttctgcaaaatttcaagtcattccaactccattagacaaagttacaaaatcaacttactcgaaaatcgtgtaaaaaattcggcacatattatttactaatagattctatcattttcaaaaaaaaaataaataaaaaattcaaatgtggccacttttcaaaaatctgaaaaaatatgaaatttttgatttcgcgccgaatattccacaataaagacattgatcattagtcaaagtatgattaattgtcccaatttttgttttaagtataaaaggacgattggctaaaataaggacggatcttagaaacaataattttctccattggtcggctcttgaaaaacatttaattgaaagaattatttttatttggcattcattgtttaatcggttcatttcagattaatggcgacttgaagcctgaaaatacaaccatttttattgacaacggagcataaaaacctttcttttaattaaaattattgtatattataataataatgataatgaccactattattaattgatcttttggtttttttaatatttcattctttttattttaatcttttcgttgataaaaatgattaattcatttggttataaggccattaatgctaacacttataataataatttaaatttgccgtaattatttgtcacttatttaataatgccaattctttttcactttataaaaagtttcccaagaaattaacttatttgagtcacattatttttcattcgttttttctgaattttcatttagccattgtctttttcgtattggcatttttcacttttaatttattttttttcacctatcttatcggtgccaaatgctttcgttgcctttttacttggaatgaaataaataaatgcctttgcgcttttataaatattaaatgccaaataagcatttttatttgaaatatatataatattgatgatcatgcattactagagcttggatttttatgtgctaaattcctgaaatataataaaattttgctaaaaatgctgaaatatgtgctaaaaaccaaaaaaaatgccaaattatgtgcgaaaatatgattgaataaaatcgtctgccaatttttcggatgaaaatgttctgggtgtacagacattttattattaaaaaacttggctttacgtggctgcttatttctttaaaatgtcatttgtcttctgtttgtgtcccctccccggcggaaaatcaaaaacatttttattattcaaaatggcattaaataaatgccaaaacattcattcaaacgcattgaaactccaaagtactcagaatttgccacatttgttctgtttgtgttgtatgaacatcgacatttcaaattcatttctttaatttaatgtcgacaatttttcttcccttttctcagcccgaggggacgatgaataataataattagtgacaaattaattggggcagcacaatttgttggcaaaatcaccagccaaatgtgcgtataaaagtggtgatcaaatggctgtcaaatcaccaaaaacattcattttatttattattttattgcgccttttcctaaaattcaatttccaaaaatggttgccaagcttcttccagtcatcctctgctgcttgtttttggtatgtttaatcacggtataaaatactgtaattcgagtagaaaatgagggattacggtatctataaagacaaaaaaagaattcagtgaaatattttaaataaagtaataaagcttaaacttcctttttaggcttctttcgccctctgctcgcccaatgctgctgatgtgctggtaaatggctgaattttttggcattccgtttcccaataattagaaatttaatatcttgaagtcgtaaaactcaatttcgcggattcagttgcaggattaggattcaaaatccgttgccggacggatccgccttattaatccagcaaaatgccaaaaaatgcaggattgtgggcccaataaatcttacaaattcttccgtctccactattatccatattaaaattgattttttcagaaatttaaacgagaagcggcgatcagcagttgtggagctgtaagacatatttaaaacaatagaaatattcgacaaaatattcatggaggtcgcttaatccctaaatttgttaatgaaatttaaatttatttgtaccactaaaagcgttagatgttttttaattagccatttttgtcctgttttctattttcggcacttttagggacagtttgaatacgggggcggctgttgtacgacatgcacaagcgatgctgattgtacgggcgggaaggtgagttagccaaattttgagaagcatttgccactgttagaatgggattaatcacagatttaagtgaacgattattaattaaatcattaattatgtccaatcggagtaaagtttgacaaattttccaactattttttgtcttaactttttcaattattttccactcttttaatgtaaacttttaatttgtttttatctaatttagctttgtgtgcccatcctcaacttgctcagcgtcagtctgtgctttgccccatgcggaaattaagacagaaaagaaagcagcaaatgagggtgttgatagtgtgataaattgataggattaaatggaaaatggggagttaataattacttaaatgcatttaaatagtgattgatcaataaatatttttcggagttaatttgccttaattacctgaaaatttgactccttcgcttttgtctgcgatagagttgtttatacttaatgttcattcaacttggtgaaatgggttaattaatccgagtgccgcggcacggcatatgaaagtgcaaataataaacatttgattttttacatttactataaaagaacattgaacagattaatgtgataaatagggcccagatttatatggacgaaaaaatcgcaaaatatggacaaaaattttcttaaaattggttcgaattttttcaaaaattcataaacccataatttttttttgtcaagaaggagaaaacctttttaatttatcaattatagaattccagaattgagaactcatatttattatttactcatattagttagaaaaaaattacaaaaatatttgtaatttttttgttgaataattttttcatctaacgaatattcattatacatattaccaaataaaaagaatgttatggcacttcatatttgtaataattgtttttgcttttgcaattaaaactggcaaaattcgaccaaattttgatgaaattttcggcaacaaatgggacaaaaatgaacacgaagggaaagtgataaaaattgagcgaaagcgaaatgaacgcaatgagaactcacaatcagcagcaggttgatcaaatgggtgaagaaatggggacagacccaaatgatcaagtgggcgaatattccaatcaaagtgttatgaaaagtgatcaaaatacgaaaatggaactaaatgatcaacaa

SEQ ID NO: 3522 - DNA, 3564 bp, Heterodera glycines
  misc_feature (3538)..(3538): n is a, c, g, or t
aacactcaaataatcgtcattttttctgcaaatctacaaaaaatttaagtatttgaatctaatttaaaagttcccggacgtgcctttagccataacaaaccctttgttcttaaaatttgtttaaaaaagcttgaattggatgttgccagtcctatcttttctgcaaatcaaattaatttcttttttaagaagaacataaacaagaaattaaagaattggaagtaaaacaagacacattaaaaagaaaaattcgccttaaaaatattcattcgccttaaaatattcattcgccttaaaatattcattcgccttaaatattcattcgccttaaatattcattcgccttaaatattcattcgccttaaatattcaattcgccttaaatattcaatgacaaaaagaccctgccccgaaaccgaatattctccaatttcacaaaaaaatggtatccaccagttaattgactctcaaatgagttttgtcaagactacagtggaagcattgaaacaactccagacctcttttacctccgaccaaatgccaatttttaataccctaattaccactttgtcctctcaaattgacctgcttaatggatcgatttcccaactccgctccactgctctctccactgaaggcatgccaatttcagcggaggaattggaaagacagagaagtgtcgtcattattggcatgccagagcacaacgacagctcaccagcaaagcgggcagagatggaccggtcaaaaatcaattgcttattcgattcgctggggatcgaatgcggtaccattgcctatcgcatgggtcgttcctttaacccagcccaaaaaagtcctcgcccattgaaaattctcttgccttcccgtggcttccaaaaacaggctctcgctgcatggcaaaaaaaacaaaacaccattcgggctgctgattcgtctctgcaccatgtccgtctccgtgaatcgctgacaaaggcacaattggaggaacgccgtcgcctgcatttgcaatgcgttgaaaaacgacagaaagatgggcaagattggattgtgtatgctgggaacgttattttgagagacgaagtgcacatcttccggagtcagacaattcgtgaatcaaatttttaaattttacaccaaatcacaaaaaaaaacaaaacacttttacaaaaagagtagattacactttccggtcggaagaagaaaattcttaccaaaatataaataattctaattcactaccactaaacaaaggggatattaattctttagaaggttttatctgttgcttaactaatattcgctctataatgaacaaaactgatgaaatttcactggctttaataaataaaaaaattagcatattattactgacagagacatggacaaaagacaatgagggaattcctcttagtccatggattaaggagaattataattatatttttgcatcaagaaaatccgaaaacagttcacgtggaggtggttgtggtattttaatcaaaaatgagatagccttttttgtaaaattttctggtacaaaatttaattgtgaaattttaattattcaattacaaaatctgaaatcaataagatttgcattgatttaccggcctcccaaaaccactttaaaacaaacaaaagaactttttaaatttatacaaacattttggtgtgaaaattatataatcttaggagatctaaatttgtcaaatcgagaattggtatggaggcaaggccaaccacacgctataaatcatattggtgaaatattttgcgacttttttaataaatttacatttataaatgccacgaatgagcccactaggggtaaatcatggttggatttgatcttatcagcaaatgataaaattgtaaaacattgtactgttgaaggtggcatattttcatcagatcatttagcacagctttttgtgctgagtgttccagaaataagagcaaagcctaaagaaatttgcctaagacggtttactccgtctaatgtatcacatttaaatgctgtaatttctgctagattaagttctctttctctttcacattttagtataaatgaaaaatgctgtgccttcaatagcgccttgttgaatgccttgaatgagtgtattccaataaaaaaattactaaaaaaagatttagctccaaaatatccacaacatttattggcatccattaaagaaaaggcaaaattatatagacagtgtaaaattgatccaacaaaaaaagcactttatgatagcattactttacatataaaaatccaaaccaaaaaaatacataatttaattgaacataaggctatttcaaagggaaaaaattcaatttttaaatacattcaaaaacacaatgtcaatccctttgaaataccaaatttagtttttgaaaataaatgctatcatgaaagtgaagagaaatcggaattatttgccattttatttgcaaattcatttaataactccgaagttgtcctaaacgatttaagtttggacaactcctatggtaataatcaatgctttatatcggacataaattttaacatcattgagactcaaacactgttaagaaaattgccaaataaaaatggaacttctccggataacatttcttataaagtcctaaaaaattgccatttttcattggcaactgttattactgagttgtttagactatcattagacagtggttctcttccaaacatttggaaggaatcaattgtctttcctctttttaaaaagggggataaattcaatcctgaaaattatagacctatttctttaacctgctcactatgcagagttatggaaagaattctcagcaaaaatatttacaattttctattaaaaaataataaaatttcagagtcccaatttggttttattagaaataggtcaacaacaaatcaattaataacagttgtcgaagattggtatgaagcaattattaatggaaaaaaagttactatatatgttatattgacaaggagtttcgtttcaaaaactaattccggccggccgaaggccggcctgggtctgaaagtggtggaagggtcttacaactttttgaggagaatccgggaaaactatagagaaaaattcagtgcggacgactgagtcccgggaagtgatttctcattttttcgtgcatttgggggcccgtaactttttttctaaaacacgaatcaaaaagtttccgctggtagggacctaagttgaagtgttttctaaaaaacaaaaaaaattccaagcctctatctgcaataggaaaggctgtaggttcgtgaactttttcagtaccaactttgtccagttcagtcccggttgaataactcattagggtttgatctgagcggggggtcgccagcgggactattgtagagcttgaaaagcttgatttttccaaatttaaaaatttcgaaaattttcaaaatttttcgagctaggcctaaaaaactgttttccgggtttttgaattttaggattttttaacgatttttcccagagaaaacgagaccacttccaanacatagtttttcgagctctatcgatt

SEQ ID NO: 3523 - DNA, 1113 bp, Heterodera glycines
tgttcgggttcctttctccgtcctgttcgcgtaccatggtgatcagcttacggcacattccaaccatttggttcacaggtccaagcatagcagacgcccatgaaggtgcacccgtaagacttttcgacagcaggacttttcgacagaagaggcgcccatttcgacagcaaaggacatttcgacagcaaaggacttttcgacagaaacacaaaaaatagtggacttttcgacagtaaacataaaaacaaataatttttattaaaataaattatattgcttgttagttttactaaatttcttttaaattaacatactataatatgtattgctaaatcattattactagggctaatatttttaggttttaacctaattttttcctgactctcattgacctgaaacgcacgaaaaaatgtttttttttggttgttgttaagcaatttttcgatttcttagcatctattttctagatttttattttttagaactttaaattaataaatttttgcaaaaaacttatgaataaaaaggtaataaaaacgaaaaatacaccccctaaaagtcgatcaaaaatttcaaaaaatacatcttaagaaatggaatattttaaaaaaatcatctccatttatttgtttacattcttgaaaagaatttttgaatttaaaaattatgtatctcaataattatttgacttaatttgttgcttttggataaaattttaagattttacacccctaaatttgaaacttaattacattttactgtcgaaaagtccactgtcgaaaagtcccctccttaaatttaaaatatttctgtcgaaaagtcctttgctgtcgaaaagtccttctgtcgaaaagtcctctgtcgaaaagtccactgtcgaaaagtccggcgcccatttaaaaaaagagaaaaaaagaggaaaaaagaaagtgaagccaaatgatttcttttgcttacagcgcttgcttatatacacattgacacagcgcaatgccagcactatgggtcaactccctctcgttttggcgtactattttcatgtctctaacacatgaaaaaagatgaaactcgcaaattcgaatagttttggttacaagggcacaaaatcac

SEQ ID NO: 3524 - DNA, 6145 bp, Heterodera glycines
ttttctcatatttgaataattttgattgtaattgccgcaacttcctctgttaaaacctctcatgacccctcttcctctgctattattccctcttatattcgaattcgtgaatgttctgttattattcgcttctctgtcatatttattctggatttcaattgaatttacttgttcctttaattctgcaatttgttgcttaaactcttctcccttttcgtcattttcaatttcttctttcaattggagtaccttttttgtctgggaaattgcttccactaaagtctttggtttttgcataaaaaataattttctttttaaatttgtgggaagaccattgagaaagtagtgtacggtttcattctcgcgtgcatcgtttgtataatcgggatcaggagacgcttgctccacccaatcccgaattttatttgcaaattcggtcaccgactcatgacccattttcgcgcgggccaacatttttcttgcccacatcggcccatccaatctcttggttaattcggccattctttctgtcagatcccgccaatttttctttttatcagcgggaatattttggtacacttctttcgcttctccttctagaaacaaaggcaacaatctgacacagtcagggccatgccagtttgatgctgttgccaataaattaaattctttcaagaatttaaaaaatcgctgttaccgtcaaactttggcatctttatgccagaaggcaaagcaatggctttattaaacaataatttatcttcaagttctttaactcttttttgtattgtttcaaattttgtctccaaatccattttcctgttttctttttgtatttgttctcctttcctttttctctctctttcttggtttctcttttctctctctctatcgctttcacctttttctttaaatcttttctgtaaataatcgggtgtgtttgttggaggaattttgaaatttgtttaattttaattcggcagttttgcttttaaatttgtgtctaattatttgtatgcagagtttctttatttctccgcttattctctttttattcctttattattgtttatttgtactaatttcagattatcaatttatttttatttaaattcatatgtcgccgcccaccgttaaaattgtcaaaatcctttggcctgatgccgacgaactgccacacgtctgctgcacttgactgtccccttgccaacggcgttcgttcctctcctttgttggggctctttggcgacgagttgccagaattgttcacttggttttgattggtcaacgactgtctgataaagtgattgacaaaattgcactaagtgatttgagcattttaaaattttaattttattaaagtttaaagtccgtaatttaggcagtatcgtttaataattaaatcgcattcagtactgttaccgtaattcagagccgaattgttttaatgctcgttatagttgttaattttatttggacaatttaatttgatcgaaaaaatggcaagaaaaattaaatggttgggataacgccaaacaatcgcaccgccttttattttcgcattttgttccggaatcattaattaattagtttttgttactttcgttcactttttctcgctttccgtgatcacttgtttctttaatttccctcttaattcaattaacagttgctcgagcaaatcatttaattcattgtttatcattttctaacgaattctctcgctttttgggttatacccccgggcatccaaaaatctcaggtgacgcctccccagaaagattccgcctcgaccatttttcgcttaattgccacttgacttatgtccaaagttcattaattcgaaaattaagaaaaaaaaaagaatagggacaactgtgattactatcatttttaattaacaaagttcgtcgggtgattttaattaattacttatttacgtagttcatttgtgttccattaaacatcccgtgacttaagcacttttctccgaaattgcttggccagagcaatttcgccatctgtcggagatttaaaaggatcatattaaattgagagagaaacaaagtgtcagagaaatggaaaataacacagtaaaatgggagaaagcttgtcaaagatttcctttgaatatattaatttattgacaattcgattgagaggaaaaggagaattgaataatttttggtgtttgggccaacgacacatttggccatcatttcattgctcagaccaattcatttcttcaaaaacttacccaaattttcatatttgttccttttattaacttttccaaaatgacttcctgggaagttcgagttgattgtccaattctctgtgccctcccaaaagtatgttgggaaccgacaacgtattccgcaccacaattgtgtttggcgcctggagtgaacccaaatatttttgaaaattatctttccattagtgagggaaatgccctcattcttctcggcctttctctcaccattggcatccttttggggctttgtttctgctttttgttgctgatcggcttctcggattgtcttttccgtcgccgatcactccgacaacacaaaaacgttcgcaacaccgaacattccatcgactcaaatcggcactcaaatgctcggcttaatccctctcttccatctcgtcctttgttcattagggcgactggcactcctgtttgagtgagtctcttacccctttggctcactcatcgagtcattccgtcaacatctttatctggccattcattcactttagtggccattggttcatgtctctgctgttgtgtgcgctttaccgtttaaagatgattttatctccttttattttgttctcattttaaaatttcgatcaatatttgggcaaatattttccgcatttattttcgatgaattttgtcaaaatccaaattatttgcccttcaatcatactatgatgatttccactatttattaatattcatgaatacactataatcaataccgtatattttaaatctatccgttttattataaaataattttatttattttccattttattaactaagtgttcacggcaataatgaatattttcctctccctttcccgtggcgggacctccatgattatggtgaagtgatgtattatccctaattggcgaataatagaataatgatctttattgcgtaaggacaaagaaatacatcattgtgattccccaactcgtaacgggaaaggggaggttggtcgggatccggatccgacaaaagtgggaaggggagttcaaagggaagagtttatataagcggagtcataaggggcggggagagtacaaagggaccgcccccgtaaagcaaaaatgtggaaaagcaggaggggccaaactaactaaagagtaacaattggtcatcgggggccccaaaaattgaccgtctcggtcaaaacacaaaatcaattaagctaagaaaggagatgatggtttaatattttttgattaataaaattgttttattattattattattattttttttttttttttaaatattaaatattaaccatcatcactattctatggtcggtatttattcgaatcatctttaaattgatctttggtcaacggttaaatgcgccacttgttgatggttctgattgtgaatgatcatttctggcccatccttcattcccgcgccagttgtggtggtatgggcgctgtcgcccgcgtccacggctgttgttgacccatctgccgaccgtcccacgattacggtagcggaactcgtcatgttgtcgccaagtcgacgtatttgtgttggcaaatcggttcgaattcggatgaaattcttccgctttttccatttctttttttgcgattttcgtcagttcatccatttctttggctaattcctttaatcctccaaaagcctctgtcatttgttgttgaatttggtttattttttggcaaatgctgttctcaattttcttcattttctcctcttttgtattttgtgctgtttcctcccaaacacaattggcaaactgcccttgagttgccggtgtttttgctgcgaagcgttttctccaactcttcttctgtttcttttgcctccaattcgttccggactggaatttgtttcctcattccttcaggttgaatgatctctgactgcaaaatgctcttttccgcacttcttatgcaattctcggccatacgtcggccgttaaatccaagtccgacttttccaatgacgcttaatcgatcttcctttcttatgtccagggttgtcgttgttgaaacgaaatcactccaccctctgtctcgctcttctctcgttagcaagcggcgggtccaaacgtgctctttttgactcttggggtgcttcttcttcttcctcctcttcttcttcgtcttcctcgtccatatccaggacaatttcatctactggcctttgctcattattctcacttctctttttctccgcctccgccttccttttttctgtttcttccaatcggtgctttaaatcctcaatttcattcaaaagtcgcactttttcggcgatcaatccctcttcattgaatggctcttccgctggagcttttggcgcatccattgtctcgctgctaaaactttttgttataaaatccatgtttttatgacattcattagattttttgtcattaatttttaattcgtttttgttctctgatttttctcctttttcattattaatttcttcatttaaatcgaatatactcatgaacaaatctttttcagtaataacatttatgctctgtttttgcattaaatccccattttgatcactgtcccttttattttcaattttgctttcattacgggagattaatatttcgggaattctttgaagttctaaaatttggccgttaaattctccaactttttcccaatacgtctcattttccccattggttttcgaagtccactcatcattaattagaaattgttcacgaattcccaacaaaattttatcagcttcattgttcaaagacaattcaaattctgtcccaaaaagccacgcatttaaatatttttttccaaattcgtttgtgagtactttccaatgttcttttatgaaatttgttgggattgacgaattcaaaggaatcaaatttggttctggccagctcgtgtatgccaattttacttcaccctccaaaaatatttcggtaattgtacatggtaataaattttcgttaattacttcattttcttccaaaatttcgtgttcatcattttgatcactatcttccctctccttcagaaatgaaattttgggttgaggttattcgaatggaccctaagcaagtacaggcagtccaaaattttagaccaccgaaaagcctaacggaattaaaatcgttgctcggtgcacttacctattttcgaagattattaaaaattttgcccatatagcaaggccactccaaactttaacacaagacaaatttgagggaaaaatcgaagaaaattggggaaatgaacaagaagaggctctggaaacacttaagaaaatgttgacttctgccccggttttacaatccccaagatttggtaaaccgttcataattgagtgcgacgcgtccaaaaaagcaattggagcggtattactccaaacaaatggcccagtcgcatatgcttcgcgcgctttaaacagacatgaaacaaattacccgtcaatcgaaagagaagcattagccttagtgtatgcggtcaaagaattttcgccttatattgttggttcaggcgtaactaaaaccattacggattgtagcgcactgacgagcatgatgaaagccaaagaattaaaagtgcgactagagaaataccagatcactctccaaagttttgaccttgagatcgtttaccgccccggcagcaaaaacaaggcggccgattttctttcacgttataatataccaggcaatgagtccgaagacacaaacaaaaagggtaaaaaagaaaacaaaataaaaatttcaagtacagaaaataaacccaatagtgataaaatagtacaagaaaccgacaaacggacgaaagtagaatttctttaatgccaataattgatgctcaacgtaaagtcaaagaatagtaaaaatattttatatcctga

SEQ ID NO: 3525 - DNA, 2036 bp, Heterodera glycines
  misc_feature (1963)..(1963): n is a, c, g, or t
tgagggagcaattgtagtattatcatcacacttaataatatgaaatatttagaaaatgcccaaacaatcaaagtgatgcacaataaagaggatttttcaaatgtacagtaccaccccgacacatttctaatacagtaccaaccacaattgaataagtggtatccccttagaatacagtaagcctcacataataatttggaaaaacccgcccatcaattaagtcgagtgaaacatgtaccctcaactcaccattgccttgcacattttggtcaccgtgcatttgtcgcaatgcccttggtaagttccagtgccacaaggcgcaatgccatcccttcaaaatctttgatgaatgcgccaagcggaagtgcctcgtcaaagttagctgctgaaagtggcccattttgctgcatcagagctgcaaaaggaagcggaaaattcatcgagtactgtattttttaaaatcagatactgtagcgtgcaaaggtagagagagtactttatttagctgtccttattacttttgatagatgaaaaaataaacaaatatttttgtcaattcacagcgatgcttttttaattgtagatagtacctacctaaatgcaaatcgctaaatctacagtatcacgcatactttactgtacgaaataatacaaaatgaaaaaaatattattatgagattggacctttggcgaaattcagctccaaaaagtcggcatcgctgaagaattccatgcccaatttgccggataaattggcgctaaaatgttaatttaactaaaaaataggtaattaaaccgaaaaagcactcgcctgagggatgattggaattccaattgcccgtcactttgtttggcaatcattaagccgtgccatccgccgttgctctgattaggcccatcattttcggcacatttcttgctcaattcctgcaagtccacctttgcaactctcatccgtccattggctttccaatttccaaaatttttggccaatttgctcgagtaacagatcagatgactaatattaatttaattttttataaattaaaatatccaaaataaaaaatttgtacaaactttttacagcctttgtccagtctaatgattgttgtgccgttttcaatcggttcacatttgtcccaattttgcgtatccgatccttggattttgtccaattttccatggtcgtccacgtccgcagttgctaattcaattataaaaattaattagtttttttaattatcatttacctggattttcctttggctccgctttcggtgcattttccgctttgacgaagagccgttgtcgcagaacagcgctgtccagcacactgatcagggcgatcaacacactaaaaaagaatgcagaaagtcaaaattatctaatcagggtttcccatttggacaccatttaaaaattcatttatttaatttaattttttcgatttggaccaattgaaaagcatttgaaatcgttttttatgattactgatcaaagtttacagggaattttattgactcattcattctatgattaattagtatgtattaaaaacccccaattaattacttacacaagtgccaaccacttgttcatgttgaattatggaaaggtgattgctttgaagagttttgttcttcgggattagaaataaggaaaataaattaattaaattcttaaatttatagcaaaattaaatacacaaaaatatattaaatcgaaaggtttcttattatcaatcaaactcaaatttcagtgcgaaaattcaaataattccaaaaaaatcattcaatttttctaatcgctgtcccatttaaaaaatgctttttctttttggctttttctgttcccttccccaattttaattgaattctatttaatattagctggaaatttttttggaaatgaatgatttttcgctggccgatcagcgcttaaatgcggtggtcggccgtgccanaatgggcggtccctgcggacagaagcggcgcggccaatgggcgggcagcgcaccgccgcaccgcacacagccc

SEQ ID NO: 3526 - DNA, 3214 bp, Heterodera glycines
  misc_feature (3058)..(3058): n is a, c, g, or t
agattttccaccgacaaaaaaatcccgaaattttggcgcgatctttgacctttaggtcatttgccgttatcattttgatgatactcgagttggtcgggacaaatgagtgggcggacagagaggcaacggagcgagtgcagtagtgccagcagggcgggcacaattttagatgcttttcgccaatggcactcgcgcaaaagcatgatggaaagcggaaggaacggcagcggagcggggtcaatggcataaagcctaagcttaactctaagcctaggcccgagcaaacctaagcataggcctagcctaaagcttagacctaagcctaagcctaaagataaaatatgtgctaaaaatgctaaatttgtgttaaaaatttaaaaaatgccaaaatatgtatggaaaatttggacatttgtctctgttttttgaccattaattaacacatcactcgtccactttttacaccttcaattttgatttgtttaattattcatttatacaatatttttctaaattaataaatattttcgttcgtttatttatttataaaaataataataatttattcattttattattattttttatctttttttccatcaatggaatttccacacttttttatgtttcattcatttgaatgcataaaattatggaagcaaaaaaaaaaaatgttgaaattaattaaatatacaattttataaaatattgataattaaataaataaaaatagaaagttaaaaaattaaaatgcggtgtttttaagcacaataaataaatgtggggtaaaatttaaaattgataaggagccaaaaagatttcaacgttttttgggtttaaaatgttttcgaatttcgtatttccgttataattttatgcaaattttagtcacccatatttttttcaaaagtgatcacaaccttacacaattttaatcgggatactccggaaatctctgaaaaatcttaaaaaattatgcaaaacaaagagatgaaaaaatttgaggtattggtaaacccccccccccccccatttttcgaaaaaaatatatttttttaaagccatgaaaacatgtttcgtggggttttcggtgtcgctgatcacgaatagagtatccatttcgatcaatttccaattcagatccaaattcgaacaaaaggtcgaaactacaatttttagaatttcgcattattgatttaaaaccggctttaaaacaaagaaaccaactaaaaacatcaatgcttcaataaaaaaaagttcaaaccatttttagaccaaaaatgcgaaattctaaaaatttgaagtttcgactttttgttcgaattcgggtccgggtttgaaattggtcgaatggcattcgcgtcaaagaacccattcctttttatacccgacaaaagcggggccaggccggttttcgcgtggggaggggtttttggactataactttttttctttgccgaccaaatccaacattcttggtatcattcgaaagcccttctgatgctctattagcatgcaaaatttcaaaaaatttcgttcagtatactggaaaatttggttttttgaactcttctgaccataacttttttgaaccttaatgaaatttttttaaattttgcaggctaatagaggacacatagggctatcgaatgatatcaagattgttggatttggttgacacagaaaaaagttatagttaaaaaactcgccccacgcgaaaacgacccgacccgacaaaagccgactccacgactttcccaccccaaattgctaggcaaatttttagtataaagatgccttttttcttctcaatcgcctcattccattcattcattcattcgtccatttccggtcattctgttcctgcaaatgtcttcagaaattctgtacgtttatttattgtttcttttttttctgattttcggcatttcttttgctcaatttttgaccatcagaattgggagatgaatgaaaatttttgaaactaattttgaaggcttagcttaatcggcttcaaaaaaatcaaaaagaattaaaatttcacatttgaattccatcattttgatacttttcctaattcatttttcagatggtgtgccgtgtttcttcttctattggttgtctgtgccatcattctttggttcttttttggccatgtcaaaaaacgacgccctcacaaaaacgaaatgtaaataaattaatcaaaaatttcgaaaaaattctccctatttttccagctttatctgcggcgactgttggcttttggtgttcgattttcttgcgccttctcagctcggcctcgaaattgcgctggtcaaccgccgctttaactgcatcgtcgacgaacacttcaaaacacgcaaatggaaattgggcggaatgcaaatttcccacaaaattggagaaaatggcaccaaacaaatgcaaattgtaaattccgatggaaatccattgccaatcccgcaaaatccgttgcccaacaaaatcatcggattcagacgcattcaaattttgtagaaattgattaaattgggatttttcatctaattttctgcttttcagctacatcgatcaaaatgtcgtcacatttctccgccgttttcaccgttttttcgccttttcttcaatattcttggtcatcactgaaaatgtttgcgtttcggaatttgttttgctcaacatttggccgatgcttcgtcattcaatgcgtgcgatgtttttgaataccatcgcttttcgccgtttccgccaattggccccgtcattgctcaacgattgtccatctcttcacactgtcattttcaaagatgccattctcccggaatttccgcccgatgaaagtgccaatgcgacggatggtcaagcggtggtcaaatggctgttttcgccttgtccggacggtgtgctgccaaacgtgttgcatttccatgacttttcggttgcacaatggtcgtcaacgattgaacagtttaaagcggtgattatccatatttaattggtttttatctaatttttttgccccattttccaagcatttttccaatgcttctttctccgntacttttcgcatttgttttcactttccgccgtcttctccacttgactccgttgtgccaattgatcggatcaacgaagtgactggagagaaattggcacttggacagtcatcagcaaatgattttggctcatccgttgtccaattgcgtgggatgag

SEQ ID NO: 3527 - DNA, 892 bp, Heterodera glycines
  misc_feature (28)..(28): n is a, c, g, or t
  misc_feature (44)..(44): n is a, c, g, or t
  misc_feature (64)..(64): n is a, c, g, or t
attgtcaattccgatggaaatccattgnccatcccgcaaaaatncgttgcccacaaaagtcatncggattcagacccattcaaatttgatagaaattgattaacttggaatttttcgtctaaattttctgcttttcaggtacatcgatcaaaaatgttgtcacatttctccgcctttttcaccgttttttcgccttttcttcaatattcttggtcatcactgaaaatgttcgcattttggactgtgttttgctcaacattttgccaatgtttcgtcattcaatgcgtgcgatgtttttgaataccatcgcttttcgcccatttgcgtcaattggccccgtcacttctcagcgattgtccatccacttcgcggtgtctctttcaatgatgccattctgcccgcttttccgcccgatgacagtgccaacgcgtcggatggccaagcggtgaccaaatggttgttcacgcctcgtccggatggtctgccgaaggagcttcaatgctctgctaatgcaccggttggtcaatggtcgtcaacgatggaacagattaaagcggtgattatccctatttaattggcttttctatgattttttgtccgctttttaggcattttccaatgcttcttctccggttactttttgcattcacttttggtcctcttctccacctgactccgttgtgccatttaaacggatcaacgaagtgactggggaggaattggcacttcaacaagataatgcacatgattgttgcctcttccgtttgccaattggatgggataaccgatattgggataatgtgtgggaagaaatgattgctcgacagaacccaattgacattcggatcaaagacggcggattcgacgacgggtgaacaattttaaatgctta

SEQ ID NO: 3528 - DNA, 3541 bp, Heterodera glycines
attagagtccggcgggatcgggactcccgcgggattttacgggattcccgctcccgactcccgcttttttcggtgaacgggattttttacgggattgggatttttacgggattcccgttcgggaatcccgtcccggaaaattttgaactcccgatcccgctcccggaaattttacccaaaaaaacgggagcaaaaatgcactggtaagaattggaattttttgaatttttggcaaaacattttgccaaaattaaaggcagattaatatttacttgtcaactttctcatgagaaataaatttttgatcttctttcttccaatttagttaagattttaataattcataattaatggcgccatttcaccctatttggaaaattgggttgtttgagaagagcaaggaaaacgacaaactggcagaatgcaaagccaaaaaacagccaaaataccaattcaagctttccgacgggagcatatcatcattaatttgtcatttattcagaagaaataaaaatatccaacgaaggggtgaccacttacacgttagattttagtaaagtaatatcaagtccaaggagctcttttacagactaaatttttgtttaactcaatccatttatttattcgttttttgaaactgtcaacagatggagcatctgttatatctttgttgagtttagaccatattaaggccgttctgttgataaaagaatttgaagttttactggattgtggttttaacacaactttacgtctaagattgtaagggatgtgaccagaaaattgggggaatatgtcttttttaagatgagtgagaccattgatgattttgaatgcctgaactaaatcaattgtttttctcctttcttctaaagtttgaagtttgaataaatcaagtctttgttcgtaaggtatatacggaagcctacatttaaataaagcaatttttgtaaaatatttttggcatctttccaatttatttatatcttttttgtatgtcggattccaaatttcgggcgcatattctaaaagaggacgaatgtatgtcttgaatactttggtccaaatacgtatagagcgggtttttaaaattttggcaatattgcgaatccttaaataagcagctttaataattttagtataatgatttgaaaatcttaatttattatcaattaaaatgcctaaatcactaatagattcaacctcattaataatattgttgaaaaatttatattgttgttttgaattatttttgccgagaaataatataaatgttttattttgggagatgtttaaaccaaatgcattagcccattttccaatattgtctaaagcaacatttaatttgcttctttcatcacgagttttgtaagaaacataaattttgacatcatcagcaaaaagcttgatgctaactcccggagggattacctgcgggaggtcattaatgtatattaaaaataacagaggggccaagaacagacccctgtggaacaccagactgaatcggatataaattagaaaatttgttgttaattttaactgtgtaaaatctgtcctttaaaaattcagataaccaacttagcagttttcccctaatgccaatgttatgaagtttatttattaaaatattaataggaagggaatcaaaagctttccgaaagtccacatagatacagtcaatatttttcttcttaccgtatatgctgtcgtaccaatcttctaatactgtaattagttgagtattagtagatcggtgtttaacaaaaccgaactgatgttcggatattaaattattcagatgaaggaagttataaatgctttttgcaattattttttccataactctacatagacagcaagtaagagaaatgggtctgtaattatgtggatcatttcggtcaccttttttaaagagaggtataacaatagattttttccaaatttcaggaattttgcctgtgtccattgatattctgaaaagttcggaaattacaggagaaagagtaaggtggcaattacgtaagattttaaaggaaatttcatcgggggatgtggattctcgattcggtaaattttttaaaattttagaaatttcatcggcattaaattcaacatcagaaatagaaggtccattgggattggaaggacaactgctaatttgtggaacatctgaatttgaaaaggattcttggaaaatttttgcaaaagtttctgcttttaaataatcatcaaaaataatttggttctcgtaactaagagagtggatttgttcaaaattttttgtaaatttatttatatatttgtagatagcattttttcctttattcagaaaattattttcatttttagtaacaaagttatttatttgaatttttatatgtaatgaaatgctatcatacaaatgcctatatttatcacggtttattttttgtagtttataaagtctggctttttccttaattgacagtttaagactcaatgggtagttaggctttctggatttttgaccgacagtgattttaggcaagtataattctacatattctctaaaaagaaggtaaaaatgattaaacttatcttcaatggtaaatttttgtagtaatttgtagggtaaaattgaagataagtttaaatttagtagattaagtttagtagaattataattgcgtactgtaaatgtgtttgttttagttctattactgggaaaagatagtgaaaagttagtggtaagatgatcagaactaaaaatatcctcaattaaaacattattaacaaaatcaggtttagaagagagaatcagatcaagccaagcactaccacgagttgggccgttcgtcataaggaataagccatacttattaaaaaattcacaaaaaatgtttcctttttccgatttagcaaaaggtgttccactggtccaggttatatcttttgcatttaggttaaaatctcccataatgataaaattttcttctaaataattaccaatgaggttcagaatctttttagtgagactagcagaagtgtttggtggcctataaagtaaaactattcttaatttttttgccccatttatctgtacaatttgtatttcacagttgaatttagaacaggataaaacagaaaagaatttaagttagtttttatcaaaatcattactccaccaccatttttaccgcttctgctagcttcatatattttgtaattgttagtgatatattgttggaaaggtattttttcttttgcccaagtttcagttacaaaaaccaattcaaaatcttttagagctatgatagcagaaaattcttccagcttattatttaaggatcgcatattgatcaatgttgagtataaaagattttgttttttgtttaaggtaattggattttttatggggggttcgtattttctattagtttgtaaaagagcttgctttttaagagatttcgtgttacagtggtcaccaattacacattaagagtcatcaacattatgcatatgacaaatacatttaaaagagtcggggttggatttgtaa

SEQ ID NO: 3529 - DNA, 2831 bp, Heterodera glycines
tgctgatcagccgccgccccttcgacatttcacggcgtttaaagccaatgcatcgacatccgctgctctctttaagacgcccaattctctcagtcagtcggtggcactcaaacaaaggcattttcaaaagaattccaaggattgaaaattaaaaaataaaaaggcataattttttcaaattattcggttgctcgtccattattttccctttgctctctcaggagcaacagttgtccaagcggaagctgattctgaacattcaattcgccagtttcatcccaaaacgtttcgttaatggcggcccttcccaaattttcttgcacttttcgacaaaggtttatttttatgtttattttaataattggaacgttttgcaggtgagttcgcttagtacgaccattgtcgacggaagacacgcgaattggcaagagactttggcgatggaaatgggcagagagaaagaggacgagggggaggagggcgactgtttggaggtggacatgttcgacgtggaagtacggcccatggaaagtgacgaccgcgagagggacacgcggcacgagcgcgaggagcggcgatggttgggcacggcacgggtgcccctcagggcattggtcgccctgggaaaggccgacggacatttgacacttcagtcaccgatttttcacaccgattacaggtcgagcaaatgctccgatttccgttcgttctgctcaacccccccccccccttaagaagtcatccgtccgatcgtccgatcactgtccgacttttgatcagcatcgatccgtccccaccctttccgctccaatcgccgtctgttagtcaatttggacagaatgacaatgtgagaacatagaggaagacgacttcaatttttcgtcttttagctgctttccgagggggaacattttgaaaatcgcttccgccaacgctttccaaatcgccgcgtgttggcaaatgtttgctccactgagggaaaacggttcactgcctcgaggcaagcagaagcttaatggatcaattgaggccataattattcgatatggtcgagcaaattgagaggcggagaagggaagggtcggtagtcagcttgttgaaccctgatttggaagaccaaagacaccgcttcaaagttgggcccatagtttttccctaaaaagcttcctcatctaattcatacagatattcaagctaaatccaaccgaatttcctttgcctgaaggtttctccgtccggtggtccctcccgcccaaattgtgtcccttttctccgctaaccctaaaaaagccgtttcggctgcagcgcaaattaccgcctgtgttccggtttttgtggattctgacgaattggtgcccacaaggacaccaatttggagcacaatcgacgaggtttgccccttcccctgccatttgaccatccattgcctttccgttagattttgcactttggaactgcttctggcgatgagctcggcatccttttgtgctgttggcttctcggtctccatttgtctgctttgctccttctcggctcctctctgcccgatgggcccaactccgccgcggtttacgtcaaattccccgacggcgaccgatggctaatcattccctcaaatggtcgtcattttgtcctgctataaaaggctaatcacatttccgctaattatccccaggccatcattttgatctctccgattcgacgtgtccatttctctctgttggcactgttttgtctgacaataatgtttatgtgaacctccaaaatgcgtctcatccgtcccaattggactttgacttggccaaaagggccaattgggcgcctcttttcccttcctccgctctcttcccatcccttcaggtttttccatcaaaatctgtttttacagttcaaaattctccttacccaaagcccgaaactgtgaactatggcgaaactgacgaaaatcagctgatggaattgcggacgaacttggagagggacattcggctgcactttgaccaggcgcggcccttcgccattccccaatggaatttgctcggctcgaggtcaaccggcggaagggacaatgtttaggaagcgtcgcttctctgtaggatccttcgtgaggtgctaattgactcgttggggtcgtcccccgacttcgccgcctccgtttcccttccgttggacatcgaatcgcgcctcgagcagctcaaacccgcctttcgtctgtccgctttggccttccgttttccgttcttttctcgcgctcaaattgttcgtcaagtgttaagatcccaagtaaaaacaattaatggtaaatgaaccgattaagcggtaattaactaaatgcgcaaccatcgattattgaattatatacttacaattagccaaacttcaaaggtccacctcaactcagaaccacaggcccaattcgccttggcacttcattttcaaccgatggtcggcgacgccattttgggctgtgccgttgccatttgcacacttttgccgaacaaacaaatgcaaactcaataaaaaaaacaaagcaaatgatgttcaaattgttttttaatatttttttatgacgatccgaaattgaccagtttcagagtttgtatagaaaatataagaggaaggattgggactaggtgaattttattaattttttactaattataagcaaatcggctcccggaaaatgcgtcagtgacgaaactttaatgcaataaaaaacacgggttttcgatatcgctgatcatgaatccgacatccatatcggctaatttctgactcttgcccgaactcgaacaaaagtcgaaagtccaagttttcgaatttagcatttt

SEQ ID NO: 3530 - DNA, 2007 bp, Heterodera glycines
  misc_feature (1896)..(1896): n is a, c, g, or t
ttcgactttttgttcgaattcgggtccgggattcggaattcagaacgaagttcttgtagaattttttaaattttattagataaatctacagaaatttattttagaaaaatttatagccatacaaaaaacggattaaattgtcactgatttaatcgtggaatcaactaggcaaaggaagtaaatcataagaaagaaaaggttgttggtgattttcgacagtattcagaaggaaatggggggggggaagaacaatcggaggaaaagccaaagtcagaaaagcgatttgagaacatttaaaacatttgccaacgaaagaatggcaaatgaatagaaaaagcatcatttgaaggagaggcagaaggaaaggaaaagccgaaattggggggggggggggggggaaacgaatggcaaatggtcgaacattcgaccgacgaacaataaaagactaattgggttggttcggtgatcacagaccaaaaaagaggatcgggaggaagagaagcgaccgaatgccgaaacattcgttcgttcgtccgtcgctggtcactcgctgtccgtccgtttcgtcccgtcactccgttcactgcttggctttgccgcgtctcgcttcctgctgtgggaggagcgcctccgcgcccggcgagtaccgctgccgcttcgtccccgcgttgggcctccgcgcggtgcctctcgtgctttgtcgcacgcccatcgctggcgagcggtctctgtccgccgccgaactcgtcgtcgtggtcgtgctgtaaccgctcgaactcggaggcgacggacgcggcggcgattgaacggcggcggcggcggaggacggacggagagaagcggcagaaaacgcctttgagggaaaggaaatttttaagggacgaatgacaaaaatgaaaattctttttttttgtgacaaaaatccaccaatttttgggaaaatatttccttttctcctttttggagtccaaattatttccgattactttctcttctttccatctcctcccttcacctccttttcttttcctttccctcttcctttttccctgacatttcctctttttctctccctttcctctctctttttcgttttcctctctctttttcgtttccctccctcacattttcctagccgttttttctccctttttcccatttactctttttcttttcctcttccttttttcctctcatttcctctttttctctcccactctctccctttcctctctctttttcgttttcctctctctttttcgtttccctcccacacattttcctagccgttttttctccctttttcccatttactctttttcttttcctttccctcttcctttttccctcccatttcctctttttctctcccacactctccctttcctctctcttttccaacctttttcgtctcgtccggcttctcctcttccgtttcccttgctcttttctctgctgccgtcgcttttttccgtgccgccgtctcttccaacttttgcttcttctcataatatttgaagcgcttctgcagccggcgtctcatcgcgcggaaatcctcaaaaattcttcaaattgccaaaagcgtcgcaattccccgccaaaccctctccgagtcgacgtcatcgaaggccaattgccaaagttgttctctgctgcacaacatgcgcatcttcaggtactgctccacaaggcgcggatcagcgacggtttcgcattggcgctgaacaaaaggaaatgtgcgaatggattggcaaggaaaagaagtgaatgttgtttgatgcggttattaatttcatttaatttttagctttttgggactgaaaaacggccgatttcaaaaaaaatcttttggcattttttgtgttcgttcgctttgcacatgatgcccttgcttanactaatggtcaatcaaatcagtggccaggccattctttgcttctttctccgccgaacgtacgatttctacgccctcctcgcttcgaaacacgcggtgaatgcgcaatttcg

SEQ ID NO: 3531 - DNA, 2544 bp, Heterodera glycines
cacttttgggacggaaggggacgaaattggtcggtttgatcgaaagtgaaaagcaatcggagacaaaaaccaatcacaaaattgaataataaaataattcaaagggatcgattctcatgaaattgccccaaagtgaaggaattctttggatttggttcgaattcgcagtcttctgaagaagaagtgcaaagtcaaaagccaccaaatgactgaacaaaaggaccgaaactttctttgctctcccaaaatgaaccaaagaatcaaaggaatggggggaatcaacaaaaagtgacgaaatctgtgcccattttccagaagtcgccttctcgtgagaaacgggggagcaaagccaaggcaatgctccgctcggcattcattttgctcataaaaaccctttgaatgttagaaaaacagactttccaccgtttgtctgaattttgaaaaactacgaatgaaaaatggagggggagggatttgtcaatgaatgaaataatcactctttgaatgctaactgatcggaagaaggaaagacctgctggtgggggttggatggacttggagaaggcggaggaattgtgagaccatcgcaatccaacagttaattttaagcatcgtgagattaatccgtattgaaaagcggacagtttcccctggtccttgccaaatggtccctcacccctccccttggtacagattcatttttaacttgaccacttttacattggtgccgtagagattggcaacaaacatattcagccgatgttcttttaaagctaaatcacagtgtaaaaaactattagttctcaagatctaacatacccaaacagaactattttcgttgcctttattaaataattgctgcgataccgtacttcttgttttctcggatgaaaaatctcgagtttttagagttgacttatttcaccctttgttcattcatcattaaatactttgataatttcacttttaaatattaattcaaagacattgcagcattttctttgatggacgaagaggcgaagcaggaaaacctggcgaaagagcttctaaagctcacttcttctctcaagcaaaactttacgactgccggttcggtgctaaaggaagacaatgcggtaagccacaggaaaagaatgctgcaaaagaaggcccaaatatttcagacattggatgttatgcaaagggtcgccctgtccaacaaagaaaatctgataagggagaggggccgacttggccaccacgcctaccaatcgtgcttcaactgtgtgatggtcatgacagtgattgtggtcatttggtcgttcattgcgatgattattatgatgcgaatgttccccaaaatttaagtgttttatattttctttggataactcaaaacgggcccaaaccaacaaaataagaacgattcacttctgtgattgcttctgagctgtgttattctgttttgtttatttatttttcgtcatttaaatttgtttttctttaatttatttcttttgtccgttcgtttgcctgtttttaacccaatttttctcctaattattgtttttttctgtttttaatttggtgttttagaaatggttgactgaatgaattgcgtgccttttttcctttcctttcgttgcacttccctttcctttcccttttcccgtcgttttatgactgctcaccaagcatccgtcgcattgcgtcccttttattttgctgtccatcccgacagattcgcgacagaaccgaacattcgaaataacaatgagaaggcgctgcaggtgaccgatgcctttagactttactttgcaaatggtcaggtgttcaacgggtatctcagcagccttttcccgaggccaacagcccaacaacagccggtccaggttcgtcgaaagtgacgcttttgtgggactcaccaaccgattaaaaaacaaaaatgggtgattcgcattttatttgatttcgaatgcatccgtttttgaatttatttttttaggtcgatttctttgtccgagggaaagataacaaatttcggagtgttcggctgtcattgtccggctttgatgttgagcaaattgtcaggtgcctttttaagcatttcttattttccaactttttcagcgctttcattcccattttcaggaccactttggaattgttcgaattaaacaccgacactttaccaacaataaaagcgaaaaatgttccagttgagtctttttcggcatcatcaaaagaatggtcagctcatggattggacgaagtttggcaggatttgcaagaaaatgagcgaatgcgaaggcaacaaacggaaagttcggcggacgaccttttttgtggcattttggtgaacagagagaaggcattgcaacggttggacaaccaccggagcataatggaactgatcagggacgaaatagagcacatttgcacaaaaacgggtgccacacaagtaattccaattcaaagaatatgacagtgggggtaccgacaggacaatttttttttaaacttagaaggatttggtgtcgaagagtaagaaaaagctcttcgctg

SEQ ID NO: 3532 - DNA, 2191 bp, Heterodera glycines
aagtaagcgcagtgaatgaaaatcagtcattactttgtccacgaaatgacaacgcaattccctttaattgttcttctctctgccatttttctttagccaattttctctttttcagaatttgttcgcagcccaaaaacgaaagagaaatgctaagggcacttttgtcgccggaaatcttcgtggaaattgtgaattgttaccaggaactgatggtggtcgaaggctgtcttcagattccctgctgcgtggagtttccaccgctcagaaaatttgtggctgccaatgcgattcgttctcggcaacttcggcaggaaaatttggaacggaaggtgtgcagagaacgcatcaaccaatgcacatttgccattttaattaaatcattttcctattttcttggcacccttttcaatgctttcttcatttcagtggcatttggagttggcccgtgatgcatgtgtctcaaaattggcactgtccgaattgtcttgggacgcgagcctttccttcgaaactgtgagggtttgcatggaaaaactacgacggattggcccggaaaagtctgcccaatttgctcgtcttagcattcacctttcgaacagtccgaaattatttgtgatgttcaacggtcgcctctcagtgcctatcgattgggtcaaagaactttaaatgcaactgataattagttaattagccaataatacacttctaaattttccactcttttccattcgcctttatttgactcaatttgcaaaaatattacgcaaactgtgaaattaaaacaaattaccaaaattaatgcatttcaatggccatgccggtgattctctgttctcatttttgttttgattgtttgaaataaatattttaaataaaattatcatttcttacaattaacttgatttatcttcttcaaatacttagcctttttcaattttttgttttttacattaacatttgttcgcaattcccttttctgctcattgccttccatcgcttggctttgtttgtttgctccattaggtgggtttgaaattacaaaaaataaatacaaaatcaaaaaatgaaaatgcgttttgcggggtcggggtcattttggcgcagacaagtttaaagattcataactttttaattcgaccaaataaaaataatgttgatattaatcaataggtctaaatgttctttattagcctgcaaaatttcaaaaattatattaggttttaaaaaagatatggcgcgctgcgccaaaatggccaggaaaaatgcaattttttgaggttttggccataacttttttgtttctcagctaaattttttgaaactttgcaggttaataggcactatcaagccacttaaaatcataccaagattatttaattttgctgtgaaatcaaaatgatatagagtcttgcgccaaaatggcctgcgccaaagtggccggttcccatgaaaaatccgttccttactccgggaaaatctaggcctggggacctctggatccacgaattctgcacggaattttgagagagtgtaaaaaaaaaattgtaattacctaaccccaataaaaaaatagtataggtcagggttaccctttgtccttatttgtaagatttgtccttatttaagctctttgtccttattttcatcttattttttggattcagggagaaatttagatttttaatgataatttttgaaagaaatgttttttgaagcgaataatatgcaaaatcttgacaagattcaattaaatattcaaatttttctctcggcggtttcttattctcttaaaaaaattagctcaaaatcgtaattttgtcattttttgaacaaaatcgttaagaaatcgcattaaaaattacaaaaatttttccggcggcgcctattagagcaggggtgtatctgttcttatttctaagaaatgttctgatttggggtagtgtcttattttcatttaaaagaggaaatttctgaaaaatttggctaattcctaacaaaattcattaaaaatttttaaaattttcccccagcggcgcctatcggcaccgccggctccccaaaactcttagtttttcttaaaaattagccaaagatcgcaaattttggtcgagttttggacagagcttgttaacaaattgcattacccgggggggggatttccctcggcggcgcctatcggcaccgccgaact

SEQ ID NO: 3533 - DNA, 3277 bp, Heterodera glycines
  misc_feature (39)..(41): n is a, c, g, or t
gtccatgctcctgcttttactgttgctgctgctgtgtgnnntgatgttattgtgtttcacgttgttcagcagtgtttccgactcgtcgctcagtgactcttcgctggccaattgcacccgcgagtccaccgtgtcctgctccgccactttgccctcgcagcaggtggacgccaactccgccgtcactgttgtgctgcgcatgcacagcattccctccgtcgaccttccgcccgtcctttcctcgtcgtatttgctcttcgtccgttccgacttggctcttctcagcattggtcgcgcccccggcccagccatccccccgccggcgccttcgccccgttcggcacgctttggcacattgcgtatgaacgaatagaactttggcgtgatgtaatatgcctgagaatgagaaatttcgcttttgaattggtgaactcttcttaatacccttaggcatggaaacttttgcataaaagtgattcgataatcgcttgagcacacacagaaaatgtaaaattgggcggcgtgatttgtaatttccaaaagattggccatggcacggaaaaccttaaaaaaattccaaaattaaaaaacattaagttggtcaaattgtgcctgatagtcaaatcgctttttgacagtttcattgatgaacaacagattgatggcagccggaatattgcagacgaaaaactttaaatgcaagcaaaattgtgaactccttgactttgaacatcaaaggcattaccatggctgcgatgccacccaaaatgtacagcaatgtgtcatcacgtgcgatagtcgtttggtcgcgatttcgcaatcggttgaacatcctttgcctgcgtcggaaagccaccataatttgagagttgagcacgaatagaatgacaatcggaaggaagcggagaaggccttccctggtccacttgtagatctgggaacaccgttttcatggcgattgaccttttttctttgcatttggccatttctgctcacttgccatcccatcgtttttgacacggcactgtcgtccgggtaataaagcacgtcgccattggctaattcatttcttttcacgctgtaccgtccgatgccgtaggggatgtaaaagaaagcaggcagcaaataagcaacaattatagccttcattgctcgctggggcgaattccatgtgcgaaaatgcagcggaaaaacgacagacatataacgctccaggctcagcgcgacaacaatcagcacacccgttgaaagtgtccaatttataaacttgaccgaagaaatgagcaatgaataacccattcgatacccaccgaaagcatcatatgggcctgatagaacccgaacatgggttgtctgtcgatgggcacaccggcgacctccttgagcacctcgaaagtggcgaacaacagcacaaaacacatgcagagcaggtcggcgatagccaatgctcgcagatacatataagaaacagctcgaagtcgagggctggcaagtgtgatcacgttcatcagattgccgatgatacccaacacgcagacaaccggaagaatgtagcaataggccaccaatttgatggttttgatgtcttgggcggctgcagcggttgatggagtggtggaaggcagtaacaacagtggcgagttcgtagatggagtcaaagaggggaccaacgaggtcgaaacttgctggagcaaagccgaaacatccaacagcggaattgagtcgttgttcattcctcctaaattgggggggggggcaaatgtcttggttttgttggaataaattgagaaatttgaggagaatgggagtggcgggtgcgggttttgtgctgattttggtggttggcacgacagcgtcggatgggcaagggaagggattggtggtggacggaggggtggagtgggggcactctccggaaggaagtgagggcaaagccaacttagccaagcgggaaacggattttattccgtttgttcttcaaaaaacgaatttgacattttataaaatttgcgattgtttgcatgaaataatggaaatgaaagtgaaagaaaaataatggaaaaatatttaatgggatcaacagaatgatgagacaaaaagcattttgacagatgacggaagaggagaacgaagtcggacttccgcagaagggcgtcaacatgatcatcaaggacgccctcccggacatgcgtatcgccaacgaaacgcgcgaattgctcaaccaatgctgcgtggagttcgtccggcacgtgtcgcgcgaggcgcaacacatctcatcaaaggaccagcgcaagaccatttaccacgaccatgtgcagaaaggtggtgggagtgggcgattgtgatgcgttgaggaataatatcaataatgggccaatgggtggcattttcggcattatgccctcaacctcccccctcccccttttttttgcttgactaattattgggctcaatttgggggttgtgtcgcagagggcggcaaagcgcggaagtaccggcgcggaagggactgttgactcactttgtgacgggcaatttatccgaattttcgcctctgccgcgaaatcccccggggaattggtgggatggcttcccccctcccccacggcatttcgctgacatttccattcatcgtctcccgtcaaacccgcaaaaaagcagcactcccaaaggccaaataatcgcaatgttcacttccatttcacgaaacatttttccatggatttctcctccaaattggcttcaatttgtgattttttttcgcttgttggcactttcctttttttaatataaataataaatagtaaaataaactaataaatgttgagaaaaagggagcgattgactgcgcttttgattttaaatttgtggaaaaagccctgattttgaacattcgtaaaacaaaggattaatagcctttcctctcaagtgattaaaaccaaattcggataatctctcttgcaattcctttctcattcgttctgtcgtctccttttagcactcaaaaatcttggctttccgcgtgaatatgtggacgcggcgaactctgtgcttggcgagtgcaaaattgcggctgagaagcgcctgaagcgcaaaaattcgcgactggacaaatgcggcattcccgaggaacagttgtggcaaatgcaacagcaactgatcgaaaaggtggggaagaaaaaggaaagcggcgatttgccaatggaatgggcacaaagtgcgaggaaatggggttgaattggggggaatggcgaatgattaatgataatgaatgatg

SEQ ID NO: 3534 - DNA, 1237 bp, Heterodera glycines
  misc_feature (80)..(80): n is a, c, g, or t
tcagatttccatcggagggcctcagcagggcatttttgggtaattatttcatattttatttattttttaatgatcttccncaatttgctaaggctcgccttttgccacggttccttttacgtttgctcgctcatccgtcgtctgcttgacaatggcgcgtacaccgaatttgcacaacacaacctcgtccaagcgcaatattggcagtgagtttgaaaacacaaaactggcactcattaatagcaaaacaatttttgatttcacactaattacttcattaataaaacatttaatattaggaaaaatcaattttttataatcaacttgatcaaaccaatccttaatggacgtatcccataaaagagcttaaaaatggaaaattctagaaaaaataaggtcactattttctacagaagtcctaatttggacagtcattttttcaaaagttaattaatccactaatttgtgtctaatttgtctgccaaagtgacccaaatttggccgagggctatcgccgcgcgaacattttcctggccgacgtgaactgtgaacggagctgcgacagcacgtatcgcgacaacatggccaaactgcgcaactttgtgctggtcggtttcagcaatgaccacaaattggtgccgaaggaaacggcggtgggttcagtggcaaatgagcaagacaaattagcaattcataatcagccaaaattggaggaatttgttaatttactatttaaataccagacgaggggtatacaatgcacaaaaaagttcagaagataggcctaattaatttccggaattccggtcccaacaaccccaattttttgtgcttaatgcctaggctcctattttgatggcctatttcgctttacatataattttagtgtttttggaaaatatctgcaaaaaattgttggtttttagttgtcgttattcgaagtatttaaattaatttcatttacaattatagcaaatttattttttatgtgtttttaaattaataaaattttggtcattaattaatctttcagtggttcggtttctacgccgacaacgacacacaaacgatagtgccaatggagcagactagtagttaaccatactgatttgtcgggggtgtcgggggcggttttcccgcacaaacgccagggtgtggggcgtttttgggctttaatgttgccgccggcggcgggattccctttgagggtgccgccatcccgagggtattgggcggt

SEQ ID NO: 3535 - DNA, 4730 bp, Heterodera glycines
gggggaatggggaatgcagcgcgagttatcgcaatgcgcgaaaacaatggaaatgaatgagggggagtgcgctgggtggcggcggtgacatctggcaacttgtcgtcgctcaacggaattttgacaggatgcggggggggagagagatgtcagagaaaggatgaaagggtataatatgcagtggattttgctgaggggggggggaattcaatggaaaatttggagaaggaaatattattaatgtgaagctggcggcaccgtcttttgtatatggcggccattgttcggacacttctgttgatcgttgacagaattataagtatctttgggagaaatgggtcgcttggacatcactttctttccccaataaacatttttgtacttttttttcgcttttccaataaattcctaaagagaaatgaattaccctactgatttttcttggcttcccgtcaacaattgtgtttgtcctgtgaaggacaatttatgttatcactttcccggctacaaaaagccggttatttgtgcccataaactggtgcaaaacattaccgcattcctttcaactccccctcacatttctaatggtattttttctgtttgtttatgatttaatttttcaaacaattttccagaatcggcacctgcgtctctttcctcgggctccgtgttgatgctgcttactgtgctccaaattttcatcattttgtttacggtgagtaaaaatggtttatcattaaatttaaaaatattttaatttctttaagatggctttgtgctgctgtttgattgtctttgccgcgcgaggccgaacttacacggtgaatggtcgccgttccactcggcgccgagctgccgctgcgactttgagcgccttccaggcgcgcacttcgggtgggaattttaaaattgttataataaaaatattcattatattcggggaagggatgaatttcgaatttttaaaaaaatttttttccattttcagcgcttggtcttggcagtgctgctggtccattggcgattccaaaccgccccgcagggtgcacttctcatcgtgtgccgggtagtggggcatttcacatttatttttttttttgttttaattttcattcattatttaggctgaatggtgtcagctggtcaacgaaagaatgatgtgtgaagaaaaggcggataaaatttaaaaaaaaaggaagatcgaataatatttttctttttttattctcttcattttttttccaaataacaatttaaataaaattttgggatattaactgaatgtactaagtctatcagcttaggttctgcaaaataatataattatctacccgttaaagtttatacacaacaatatgttttcattaacccgctcttcctcaaacacttccttgacaagcaaactgaattttattaattgaaaaattagcattacaaattaatagtattatgtaattttgggtctttttttactgttttttcggatttattcgatgcgcttctttgctttcggcggcgccaaaatgtcggttgcgcgaacattggccagagcgcattcttcgcacagttcaaaattgacagcgaaacggtcatcatccttgcgcaacaccctctgcttgttgttgtacaatttgttccaatcatctgagatttataaatatttaacaataaaaaataaatagttattcaccaacgcagaggtagaagcccagcatgtattttcctttggcgagtttccacaggtctcggtcctcgacttttcgttttttcattgacggctgctgctcctcaccaccattcattcccacattttttgacggctgcttacgggtgggcgctttcaaggaaggaaccacaaattcagcttttccaacattgttctcctttttgatgggggagctttttgtcggagagaatttgcttggggaggacatttcgatagaattttttgaaaattttgcaaatgaatcctgattttgggtgggtgaaggttgggaagcgaaaaatgggcggagcttcgaactgtcgaaaagtgggcggagcctaatcgaatgaaaacatataaaatcggcacgcttttgaacttccgccaaattttgcaaatcattcatagttctatctacaaaaatggccatcaacatgagcgacaagcggggcttgctccgacaaattctcggcgaagcggaaattaccgtgacaacatcgggcctgacgattagcggcccccgtctgtccactccacggttcctgccgtttgacgagagtggccgctgccgctcatgtaaggcaactgaagtggaggtcgacacaatggttacgaaggagggggtcacgatttggtgcacacgcatcgacaaagtccaattcgtgccattcgatgtggtctacgaattgccaggtcactgcttcttccgactgaagaacaagtcgcgtgtgttcaatcttccatacggcgaccttccatctgaatccagtgaaattccgctaacccaacacgtggacgaagaacgggacctcaagagaaaggcaaaagctgcgctcgaattggtggaggccggactgattgcggacagcactgtgcaggacggggcccgtttgaaaaaagccaaaactgcgatgaaagtgatcagtgacattctgctctctgaaccggtgggagatgatcaaaagaagacggttgaagtggcagttgtcgacaagcagccacaagagcagcaaccagcccctgtacaagagaagcccgtcacggcacccgctgtggaacagaacactgttgaagtgaagacggaagaagaaaagaaggatgatcttggtgacattgacaaaacactcgatgaattttttgcgagccttaaagccgcaaccaccagtatgtaaacgaaaacatatttaaatccttcgaatttatttgcgcaccatttcacttgatcacaataaaaaatgttaaattcacaagcgttttcaaataaagatatttgttttaaattgccctttgggttaattatttcggggccctcatcctctggtaaaacccaatttctactaaaatttattgccgagtcctccgagttaatctcacccagcccggtctccattctttattgctttggtgaaatgaactcagcggtgcccgtacttcaaaaagcgggggttgacgtttatgcgggagtcccgtcagaagagttgatcaaacgtttgcccaagcctcttttgttgatactggatgacctcatgctctccatggacgagcgatacctgtcagatttgttcaccaaaaaatcccaccaccatcaatttgcggtagtttttgtcactcaaaatttgtttgagaaaaagctcaaagtggcgcgcctatcctcccagtacctggtactgatgcgagcacccaactctctgttgtccatcagaaatattggagtccaacttttcccgcgtcagctcgacttctttctggatgcgtatcgtcaagcgaccgcccgtccctacggctatttgctgatcgacatgcatgcatcgtcggacccatcgttgcgtctgcgcacaaacatatttaaggaagagcaggaggaagacgaaggcattgttgtgttcattcccaaaaatggaggaccttagtcaacaacagcaacagataaaaataggacagctaataaaagacaactcggactggctgtgtgctttggcgaggaccaaatcctctaaaaagtgtaggaagattttacgtcacgcgaacagcgatcagctattagcgctagtggaaatttgtctgaatctcgtcgcttcacgtttccgattgactacacgacagaaaaaaagattgatgccctatgttgagactgtgcgaaggatgagcagagcgagaagtgaacgcggcgcgagacgtgtgcttgttcagaaaggatcgggatttggggggttgtttgctgccctcctaacacccgtgctaattgaagtagcgaaatcatttgtgaccaaaaacgcataaataccccacaatttgttgttcacgctcacatttttgcaaaatggctaataaatttttgcttgttccacaagaaatttaccgagggctaacctcagcgtcagatacgggagtcattaatttggatgcggtaaggcatgacctggagcgtgccaggcgtgaacggactaatccaacaacaaaaaatgtccggtacaatcaacagcttaggcgttatctgcaaatgagaagggagcttgccgatagacctaccaaagttgagttaaccaagggcttgagtgttttgctcaagcgagatgggggtgttgatgatgacgacggcgaagtcgtcaacactcagccacggcctcccgctccaccaccaccaccaccaccaccaccacctcctccacctcctcatcaataccaccgtcaccatcccagccctcccgatgagcaatcttcctcgtctgacgatagtcatccgcctcgcccccctcgtccaccacgtcctcagagaacaaagaaaaaccatcaatcttctataaaacatggtcggctgaatcaatggaagcaaaggcgtcgtgacttgcaacaacaaccggtagtacgtgatctactcgctgaggcagcagctgctcctttacctgaaagtgacgatgacgatgaacaaatgctggaaggtgggtatctgctgccaacaccatcacaaaaatatggagacatgccaatattgcctgactatgcagatgaaattgaggaaatggac

SEQ ID NO: 3536 - DNA, 3471 bp, Heterodera glycines
ggacggacccatcaaaaaaccttgtccctgccttgccccgtggcattttgccagtgattcgggtctttttcagcaacttctccataaaatattggctccgttcactttttttcgcgtcgctttgcctgcaaatgttcgccaaatggcaaaactttgaaagcgtcgcttttttcgccaaattgtcaaatatttccatttgccctttcaaaatcaaatgccattcgttttttatgttgtcttttttctaactaaacaatttatttaagcctttctttctcattttcctcctttttcaagtgcattccgttcttttgtaggcatcggccgaaggcacagcgaatggaatgccgcacttttgttctcattattacccccccccccctcccattgcgcactctcccaaagtgccaatggcattcctctccccgttgcactttcccactttggcataatccccctcctttccccctttcttccgctgtctcatcattcgtcctttcgttcgtccgtccgttcgtctggcttaaaatgtccatctgttttttgtagccgaaagataaaccaacggacagaaaaagctgatcactttcgtctcgtcttcaattttacttccctttttaaacatggaaaaatttacggatgaaaaggaaaaggcaaaaatattttcgttagggtccaatgactttttccattattttgttaatcattcgccattttgcgttgtgcctttgtaatttctgctcattaaaattgcgattttcacttcaacaaaacgtttctgtctgaaaatgattttttttgtcggattattttccaattattttgtccaaaaaattttacatattaaaatttaaaaaaaagtttctttttttgtaccagtgatcatttatcatctacggttaataaaatgctatttacaaattataaaatcacctaagtgccatcgtttttggttctcaaagtgacttacaattaataataatttccttagcaattgtgccatttcggtaattaatgcctttgccgttttaattaaatgtccaataatcagtgaaaatggcagacaaaagaatcgaaaattaaataatgtaattaaacgcatgggaaaataaatgaaataaatgtccattttcggcttcaatctcataattttctcagaataaattcttacgtaaaaatggccaaaaataattaatgggagaagcaaattaaaaacaaaataaaaaaggaattaaaagggcacttttggcgcttcgtaaatttggccattgacccccccccccccggcggacccttcgcaaaaatttggtcgattctctcccgccccacacttttttttaatgtatgcaccgcacactttttgtgttactttttcatcgttatatctcttactctttttgttctttctcatattttggaaaagtttaaatttgcaccaattgattctttcattgggccaaatgaaaataatttttgaattttatttgcaaaaaaaaaaccaagaaaattaaaataataaaaagttttaaaaatcttcaaaaggccccgcctcttttgcctgaggcaattgtaaggggcggagttatttatggccgagaggaaaagccaccgaacgatatttaaatggagaaccatttccaacaggaaacattcgcactttattatttactaagctaacaataaggcaatcccttgcgccactctgtgcccaaatgattcacattctgatcagtgtggacgacacgggggccgcccaattcggcgactcgcgtcgggcgcgggcatcgcacgcgccacggcacggccatcggagggccgagccaatcgcatcggcacggacgacgcccctcgccaaggcacagaccgcgcaggggacaaagcgacgacaatgctgacaaagtgtcgacaacaagggaagagatcggcaaacaaacgccgacagagcagcaacaaaaatgatcaaccaatgatggaggacaaaccgatgagaaagtgccaacggatgagagagtgccatcatcgcttttcattgttggcacaatgccaattctttcctcgtaaagggcagtgtcgaaggcttcagatgatgctaagagataacatcagagagatgtcgctttttcatttctcttattatttcattagtttttgattgcatttcactttttcaattcagaataaatgtttcttttttgtctgagtgtgtacagtaactaacatttggtccctttgaaatgagtacggtttttatatgctatcaatgcccccctccgctcccctcccaattccctttgattggcaaattcctcggagatttgtttcagaaaaatattacgcatttaattttaaggaatttaatttattattttaatattgggttttctttttttgttttgtttttcattttttgttctttttgtgcctttttgtcattaatttcggcggaagtgccaaatttaaaactttctctttttataaacaaaaaattagcaaattcaaagcacgcaattttctgacaattgctaaatcgacggaactgaccacaaagagaaaaacgacaaaatattttaattaaaataatttattttttattttaatttattttttcttttttattaatttatttgtcatttcattaaatggacgctttttaatgtcaatatgaatatcaaaattggttttctaggtcaacaaactttttaattaattaaaatttattaaattcccacgtttccaattttacaatttctccataatttccattaatttacctaattgtgggtcattattgacgcaatattttttattttaagtgacacttttttttatttttgtccaaaaatattttttgttattattttgaatatttgtccattaaggggaagcgaccagtttaaaaagccgttgttaattttaaacaattaaaagcattttttgtaattaatttttgcacttttcttaattgctttctggccctttgaacaaagatttgcttttatttgtccgttttttgtccacccacaaaatggacaatatttactaattaaagcggattaatttatgtgtttccgtaataaatcacaaaggaatttattaacagcctttttattgcaaagacaatttccttccgccgtttgtttgtttgaaattgaaattaaaacaataaaaaataaaaaatacctcaatttatcgaattgtttgttcacttttacctaagttttttgggtacgtttgatcaccgccgtttcagtccctccccccccccccccgagttcatttcattttcattttgcccccttttctgttgcaaacaccgcgtgatttgtgtcgtctttccccgctgatctctttccctcccatccatcaaaaaatggcaaatttaaaaatcattacccaacgcaacaaaacccaaaacagccaaaattaacaacataagtagtaaaattgaactttttgtcgagacattcgaac

SEQ ID NO: 3537 - DNA, 1807 bp, Heterodera glycines
  misc_feature (1787)..(1787): n is a, c, g, or t
tttgtccacccacaaaatggacaatatttactaattaaagcggattaatttatgtgtttccgtaataaatcacaaaggaatttattaacagccttttttttattgcaaagacaatttccttccgccgtttgtttgtttaattgaaattaaaacaataaaaaataaaaaatacctcaatttatcgaattgtttgttcacttttacctaagttttttgggtacgtttgatcaccgccgtttcagtcccccccccccgagttcatttcattttcattttgcccccttttctgttgcaaacaccgcgtgatttgtgtcgtctttccccgctgatctctttccctcccatccatcaaaaaatggcaaatttaaaaatcattacccaacgcaacaaaacccaaaacagccaaaattaacaacaaagtagtaaaattgaactttttgtcgagacattcgaactctaagagctaatgctcagaaagggatgagactttcgaattccaattaatcctttaatccccgtctcccattctttcgctcattaaaacctctacttatatacacactacggatgatgttcaaagttgaaacggaatgaacgctatctgccaataatgtccctaatttgtaaaagacggagttgacttgacaaaaatttgtttaaaaaatggttaaagtagagagcaaaaagtggcaaatgcaattaaatatttattaattttaattgaaattaagtacaatgttttctaattatattttaattatctttttaattaatttttccaaatttgtgcagaatctaattaagtgaccaatttgctaagcctcacgcccacggcatacaaaaagtgaggattcatccccacaattattgccttaggcgttctttcattttcctagacgaagcccgcaatttgcccgcggggagggggggggggagggggagagaggggcgtgtccaataaaatattccccgcgtgaagcgaatggagggacctcccggggatataaaagcggggcaattagacgattctttcgctcccaaaaccaacaaaagaaataaaacaatcccttgtttgccctggcaattatattaatagactcaaatcccttgcgccactctgtgcccaaatgattcacattctgatcagtgtggacgacacgggggccgcccaattcggtgactcgcgtcgggcgcgggcattgcacgcgccacggcacggccatcggagggccgagccaatcgcatcggcacggacgacgcccctcgtcaaggcacagaccgcgcaggggacaaagcgacgacaatgctgacaaagtgtcgacaacaagggaagagatcggcaaacaaacgccgacagagcagcaacaaaaatgatcaaccaatgatggaggacaaaccgatgagaaagtgccaacggatgagagagtgccaacggatgagagagtgccaacggatgagagagtgccaacggatgagagagtgccaatggttcggctcaacgcacttgggagaatgatcgactggacaatcaccaattatcgcatcagttcggcgcaattttcacttaagacgatggaaaataagaacaatcggagaaaggccaacgaatgactgaagttaattgcttttggatatattattattttttcttttttgttttttaattaattaattgtttttttttggttttatttttccattttttcttttctcatatttattatttgtacataaggaaagaacaatagttttactggcaaattcgaaataatcaatttgaggcaaangggtcatttagaggtcgttt

SEQ ID NO: 3538 - DNA, 1481 bp, Heterodera glycines
aattaattttctcctttattgtttttgtattaaatttaatggcctagaatttatttgtccaaatttgcgatgaaaaacgaaaatcgtaaaaaataaatccaataaatttgggagtcagcgcagtgccacaaattcaaatattatttttttagtaaataaaaattgaaaaataaaataaaagtgtaagttgaaatcagtcgaatgaaaatggtcggcgaaattcgatttttttttttgaattttccgatattggcgaattgtcctcccaaatgcccttttccgctggcgaaggaatttcacttgcgcaccaaaaaacaactgacagtgccattgttttttcagaagaaacactcagcgaatggcacaggcaaaaacgaaggtacgaataaaaactaaagtgaaaatacaattacaaaaacactgcttttgttcgaatttcccacaattggtttaaatgcgtgtcctttgtccaccattgtcgacactttgtcagcattgtcgtcgctttgtcccctgcgcggtctgtgccttggcgaggggcgtcgtccgtgccgatgcgattggctcggccctccgatggccgtgccgtggcgcgtgcaatgcccgcgcccgacgcgagtcaccgaattgggcggcccccgtgtcgtccacactgatcagaatgtgaatcatttgggcacagagtttcattttttttttgcttaaccactccttttcaataaaatgaatgtttttgtgcttttggccccattttattccctttggggcggcggataattaaaaagtgataattaatttagaattttccttttgcacgttttgtaaatttaattcactccctcgccaatgtttacactttgtttgcccaaacgtgaaaaattaattggttgtgaaggtggaaaacaaagccaaattatagcttaattacattcggaccattggaaatgccaaaacggaaaataaataaataataattttttaattttcaaatgattttccaattttttaatatttttgtaaggaaattttgtggaaattgagcaaattttaaaagtttaaaggaaaatcaaacataaaacattgtcatcactgtccatcacatgttcactgacggggaatccgaggataatccgtgccaaaggaacagaagagactttgagagattggcacgaaacggacgaatttgaggagggaattcggaggaaaagaagcactattcaaatgttgattatgtaatgaaagaatgccattctcaaaacaagggaccaaatgaggggaagggaggaattggacaattaaaaacaaaattaataaattaaatattaattaattaattgtatgagaatgagaaaaatgatcaaagaatttagcaaatcagatggactactaattaattaattaaattgcattttaattatacaaaaaggcgtgtcttttctccttttgttgtcgaacacttggtggcccggggggaggaattt

SEQ ID NO: 3539 - DNA, 3153 bp, Heterodera glycines
ccccccccccccccccaaaaattttttttaaaattttaaaacctaagaattttttcaagaaaaaaacgcgattttttccacaatttttgaatattaagttttttctcaaaaaattttcaaataaatcgctgaaaaaatttttcaaacttttttcttgaaaaatttcgagtttaaaaataaaaaaaattttttccaacgatatcggggaaacggcggaggggggggacgaactgtttcccaattatattgcatatttaaattttttttttgcaattaataaaaaagcacccaaaaatcacagaaaaaggaatgaaatatgcaaacaacaaaattacacaattattctccttccatcccccgagggtgggtaaatgtttcaataaaaataggtatgtgaaatttgcctcaaggggaaatcactaaatggcaaaacaaaaaaatagtgatgtcttatttgttttgccctcgaattaacaattaatgaatggattaaaaaaaagtgacgaacgaactcatttattagttaattaggtttctttttgagtttccaattacagtagcatttgccttggattttgcagagtgatactgttgaagagaaacccttttgaaattgcctattttggtccaaaaaacctaggaattgattccgagtccgttaccagcttcagttcgttcgttatttacgtatatatatttataccgtaaaataaaattccatgggacgctaaaaattttatgggacgcaaattctgcagtagaaactatttgtttttggaaaatttatatttttatgtgagttttagatgcagaaatttcaattccttcacaaatttcatcatttttaaaattcccagtcttcccaacaccgtatgttatgggtgactgatctcctaaccatagtagttttaataaaaatctttaaaaaatttggcttaattaatttccccgcagcagaccctaaaaatactttaattttcttaaaaaaattatgacacccgggatcgggatccggcaaaaccgggatttgaatcccggtaacccaatcctggcctggtgccaatcacgaatcccgactttttcaaaatccgggctcgactgattatttaataattaaaaatcattattagaatcataatttctctttttattaatttgcattttaaaattgactctttttcggcttatcgtcatgggcgtaagttattttcacataattcattcgtcggtcaatggaaattcgctctcgttaccgttcaccttaatttaaatatccatttgttttctttttaattttggttcgttcttggcgtaataatttttgccaagccaaagactttcatcgaaaccaaaagaaaattaatttactttaagaaaattcgtgatattattgttttactatcaatagatttttgaattgtatttacctaaacttttttttttctgctttagcgacaaaagaaaatggtcaaagacaaaaaatattacgacatcctcgaagtaaacaccagtgcaacagaccatgacttgaaaaaggcctatcgaaaattagcgtatttacttccgcgttatgactttattaatcgcccctttttaggcttaaatatcatcctgacaaaaatccgaatgaaggcgaacgttttaaactcatttctcaggttttcttttctctgtctttgtaagctgtttcatttttcaggcttacgaagtgttgagcaaccccgaaaagcgtaaagtatacgacgaatatggagaagaagggcttaagggtggcggagaaggcggcggaatgcacaatccaatggacatattcgaaatgtttttcggcggtggtggtaagggttggattcatttgtccttgtttaactgctgttgcaaatttttaggttttcgtggcggtggtgaaaaaccgaccaaggtcagagatactgttcatcagcttaccgtttcgttagacaaactgtacaacggatgcaccaaacacttgcgcatcacaaggtttgcatcattgatattttcgaagattttctgacacggtctgagaagaggggtaatactatagatggtaccccccctttttgacgaaaattttttttgttctgaaaagtcttggaaacatgtttatggggggtttcagggtcgctgatcacgaatatgaccttcattggaccaatttcgaataccggacccgaattcgaacaaaaagtctaaaactcaaaatttaaaaaattctcactttagttcctaaattgattaaaacgtgctaaatttggtcacaaaccattggaatatcaaagaatggtcattctatacagctacgaacataaaagtgaattttcaaaattttgattttcttcaaaaaggggggtaccatctatagtattaccagaagaggaattgggttggggtggcatttgccattttgaaagaaataatattttttcgaccccttaatattttcaattttgttcaacacttaatttattattcaggcatatcctttgtccgaaatgtaatggtgtcggcggcgctaaggaaggggtcaaacaatgcgaaaattgtcgtggacgcggactggagattcacaacatgcaaattggtccgggaatgattcagcgaattcaaagagcttgttctgaatgtggcggtgagggggaaataaatcgcaacccgtgcaaacactgtggcggcaaaaaacgggtgcgttatatcgaaaatagtccactaaaactatacttcgatgaaaaaatggtggggggggggactttcaaaaacctcggaattttttgctcttttgtctgatagtttctctttaaaggcattaatttgttttacagatcaaatcagaagagacaatcgaagtgcatattgagaaagggatgcgcgacgggcagcgactgatgttctacggaaagggcgaccaacagccggggctggagcctggcaacgtgatcattgtgctggacgaggaggagcatcccgtgttcacgcgaagaggcaccaacgtcaccctgaacatgaaactgacgtgacagaggcattgtgtggctgcactaaacatgtggtgacgttggacaaacgcattctcagctttactccgttgcctggttggccactatggacacaaatgccttgaccattttcttttctttt

SEQ ID NO: 3540 - DNA, 6138 bp, Heterodera glycines
  misc_feature (37)..(37): n is a, c, g, or t
  misc_feature (81)..(81): n is a, c, g, or t
tcctcatctaaattttaaagtaatgttgttgttattntattaaattattcaattactattagtttgagtgaattaatcatntaaattgtaattttcaataaaatatttcatgtcatctgtttcgttacatttattaacgttatttttgttttttgttattaattaattgaatcgataattcataatggttacttaataaaattttatatggtcataacgataatttttcttaataaaaatttttacatttcttaatttttttctcgtggtaatagattttgcatcttgatcgctcttgtcatcgattttttttattagtattttttgcaataattttttaatattaacatccctatagggcaaattatccattttaaatctccataaaaaatatttttattattttgttttaaattattttaatgtgttttttggtaaatttattaaaatgattgtaaattaacaccactgatgatgatatcactgaagaaatttttgtatattttttaatattttatttgtacagtattcattgctttaaaattcttaaaaattagtaaattgtaaaaattattaacataatgttcttaaagttcctatatttgatttcaaattttttaaaatcgatattgttttagtttttaatttaaatcaaaggctttatatttttaaaatttatttatttttggtttcagttcaggtaattcaacgtaagatttattaagttaccatataaaatataatttttaataatattttattttaaattgctagtaaaaataattgaatattctcctttatttcaattgaaattttattgtacctatccttctcgcccttctccattactatcggtgatcatcttgttcgggtcattgctctacccgaagtgctttaaaataagtttttttttatagagaaagaatttaatcaaattgtatcaaaattttattaatcgtatttattttccatataatataaaattaataattttttataattttgttttaaaaattatatgttaaaatatttatttatttacttcttcatctcttatatcattttgctgtaaatctaaaaataaaccatgtttattatcttataataatattttcagcaacaatttatttttaaatattaatattttcagcaataatttattaatttcgtccatgaactgtaatcttcccatttgataaatggtttaattggatttgtagtcaaatttgattttgttaattgaatttctaattcttcattaaactcttcatttatttcttcaggagtaaaatcttctaattgtttatatggccatttatcaattggtaattttagccaatttgggccataccaccataaatcagaattttttatctcagatacagtcatccctcgggatgcaatatctgctggattttcttttgattttatatagtgaaattttaaattaaaaactattgttgcattttttatttcattaactctattttttacaaatgtaggcaattcttttttatatttaagccaacttagaacacatttagaatctgaccataaataagtattttgtattttaattttggtttcatttataataaatttagcaattcttgtaccaattaataaggctaatagttctaattttggaatagttaattcttttactggtgctaatcttgttttagcaaaaattaaatatatttcatttgattcaattaatttcaagtaggctgtggatgcataggctgaacctgaagcgtcagaaaaaatgtgcagttcaactggttgaattaaagaattgttaaatggaaaacgtcttaaatgaatttcctcttcataagttatttcattccagttttttatttcttcattactaagttggtcatcccaatcttttttagatttccataagttttgaaagaatcttttatgtggcaaaattacgggtgaaatccatcccattggatcaaaattttttgcaattaaatgaattacatttcttttagttgttccaattgaaatagttggaatttttattggtattgttagttcatcattttctacgttccattttattccaagaagcttgcttatttttggcatttcagagccttcaattttctgaatttcattattagattcttcatgatttgaaataaactctcgtaagttcattgacgcaaatttgaaaatttctttactccaataatgcttaaattttatttcattttgatcttcacacatcattacaaaattgtctacatatgcattttctgttaattctttacataattttccaaatttttcttttttatcctctaagtctaattcgatgtcatttgtatttatgtttttaaaattttcatacatttcatctatttttgatagatgtaattcaattactgctgccagtaaaaatggtgacgcatttacgccaaatggtattcttgtaaatcttctaatttcaacgtctttcatttcaatttctcggttggatttatttaattcatttaataattcattcttaatccataaaaatctggtagtatctctatcgagaatatctaatccgatttgtagaaaggctttttctatatctccaattaatacatattttttaagtctaaatctcattatcattccacataaatctggcattttctttggaccttgaaatatttcatcattgagagaatgattgcctcgtaatttagctgaagcatcaaatactggtctaatttttgtcgtattcgaactttctttaatgactggatgatgtgccaaataatgagttaaataactggattcaaatggtacaatttcattaacttccatttctaattggttttgtaatatctcgtcatactctaataattttttattttttattaattgtttaagtactccttttaatcgaccaaaacataaaccaaaatttgttggaatttccggttgttcttgtttaaatggccatcggacgatgtacctattattttcaaattttactgttttattaaaatgtataactgataaatcatcatcgtttaaagaaggtgagtcggatattcctatactttctaaattccagaatttttgtatagttttatttaattcttctttttcttgttgttttacggaagcataattagtttttgttatttctactgttccttttccggaacaaatatcaccaattttagtagaaattcggaaaaatcctgatggtaacgatctgatttttgaatcagataacataaattgccaataatgatcaattcctattagaatatgtggaattcttaatccaattggcattttacttctgccgaaatcaattgttttttgtagatttacgtttattaaatcagttattttgtcaattgtttgtagggtaacggtttcataagacccatctagagttttaatgccaatctgaacaatttggctttcaataattttgggttttgtttcgttgaatgtagaaagtgctaatgtttttttagatattattggaagatttaattttttagcaagttccattgttatataacttttttgcgaaccattgtcgaataaaattattgaatttaattcagtattatcattaatatttataattggtgcttcaattgtcattaatatttcttcaatttcttccttttcaaattgctttgtaattgaaaaagtttgggtttcatataatttttcttcattaattagattagtacgggtttgatttggtctaatttgtttctcattattattttgttttttctttagacaaaggagactattatgtttatttttacaataaaagcatgtatatggtgatttacattctttcacgtgatgtcccttttttaaacaattaaaacataattttaattcgcgccttctgctatttcgtgtttctatgtctggataaattttacaatcttttgatttgtgatttgttttttcgcaaaaattacaaaacaattttatttcatttgatttttggtctgttgttttattataatttatatttaaaactggtttagattgagttgttaatgctgatgttggaaatgagtgattattatttaatggattgttttgaaaatttccattaattcgaaaatttttatattgttttgaataattatttttattaaaatttccattgcgaaattgtggtttattgctataagcattgtgattcattttatcaatttcctcaatattttgaacttcttctcttgcctgcgtatattggtctaagaaattcattaatttttttgtattgaaggtgccaagttgttcacggactttgatccttatattatttggcaattttgtttcaattgattgcttaatttgaggatgatttatatcttctttgtatgtttgaagttgtaaaattattcggtttatggataaaatgaattttcttaaatcagatattgattctgatggctttcgtaaattacgtaattcattatgcaaattttctcttaagagattttcatttccatatctggattttaataattcaattacaattggatagttttgatttgttatgggatatggacttatcattctatatggctcatcatggagcaatcctctcaaatatttaaatttttgaatattttctaattctttatcattatgaattgatgatttataatcatcccaaaaagatgtccaatttgaatatttgccattaaaatgggttaaggattgtgctggtaattttatttttattctatgattatttgaagaaaaatttgaatattcatatgaatttaaatcagatttaatttcggaatcatttgtttgatcagtaccagtttctttttcttctttatcagttaattcttcttctgtgttttgttcatcatttggttcgtcatcatcatcattttcatcttcgtgttgatcccctgaattatttttcttatttctttttaaattttgaatagctttctttacctctaagttaagcgactttaattcatcgataacactatccgcttcttctaaaatttttaaatagtcatgtttttctgtgtaaattttatatatttttatctcagcatttttatcttcagtatttaatttgtttcgtatctttttccattttttatccaattctattaaactatcaaacgttttttcaaaattaaatatttcttttttaataaattcatataattttaaacaaccaggtaaatcattggaatcaaattcatatttcccttgttctatttgttcataatatttttcaattttatttttcaaacttttaaccaaaataggaattcgggttctaatagttccggacattttcgtaagtttttaaattatatactctttgtggactaatgaattaatagggtgtaatactatacttctttcagatcttctccacttttttaataaactttttctttctcttgataaaacttttagaatgaatttgacaaatttcagtcgtttttcagggttagagttgagtgtttctcttacttttaagtaagcttctaaaattacttcctgtgatattctttccaaagaatcggctttatctaggttatctaaaatgcagtatggaaaaatagttattgtcaaagtgaatttatatacggttttgttttggtatgtgaagggttcagtttttaaaatttggttcgttaatttggaaattcctgggtaaatatgcactattggaaagggaaagtttgcccttctttcaagctcggtaacaatttcttcgggtgttaaaaccggaatttctacaataggtacaaattcttcaacttcttcaataatttcttccaattgatcaaaattttcaaaattttcttcttccttttccagttcagaaattagtttctttggccgacacagtttgacgtttatttggaaatttttttttttattaacaatacgatcacagtatcaacaatagtgatcaaaaatcttggtatctgatcgccttcaaataatgtcaaaaaaaatcaatcttttttctccaaattgttcgcactagtggacggttcgtcttctagcgggattttatatgtctttcggaggaatacagctgatttctgttgtccaatcaactaacttgggtgatgagtatggttgtcc

SEQ ID NO: 3541 - DNA, 3484 bp, Heterodera glycines
  misc_feature (3477)..(3477): n is a, c, g, or t
tgtcaatgcttaagacgcggtgctcgaacagagtatcgttccggactgaaagggaattgacaatcattgaaatgcattgtaattgggttagaatttgcctcgatcttgtgcgaatactcagctcgccctcgcgcacttcgtccgcggaaaccatccgacgcgcgcgcccactccatcggcacgtacccttaagcacgtcaaccaatttgaacaacaaattttcaatgaatttaagggtaaacaaagttgaaaatgtgcgggaaaaataagggcgaaagagacagaagaatgattgtctgcaaattttaaaccattcaaaattagaatgcaaaattcctgtctactgattgaatagtggttacgaaggttgtacggcacgggaccggggacccggctttttctgtccccggacagatgaatacactgagccggggatttttcttgcccggaccggtgtatccccgagatcggttgtggacactggacctatctattgacctcgtttctgctgaccgccgtccccgctgctatttgaggtgtagatgatatgctatgttgttatcatgatgagtcgatgatttataatcatcccaaaaagatgtccaatttgaatatttgccattaaaatgggttaatgattgtgctggtaattttatttttattctatgattatttgaagaaaagtttgaatattcatatgaatttaaatcagatttaatttcggaatcatttgtttgatcagtaccagtttctttttcttctttatcagttaattcttcttctgtgttttgttcatcatttggttcgtcttcatcatcatcattctcatcatcattttcatgttgatcccctgaattatttttcttatttctttttaaattttgaatagctttctttacctctaagttaagcgattttaattcatcgataacactatccgcttcttctaaaatttttaaatagtcatgtttttctgtgtaaattttatatatttttatctcagcatttttatcttcagtatttaatttgtttcgtatctttttccattttttatccaattctgttaaactatcaaacgttttttcaaaattaaatatttcttttttaataaattcatataattttaaacaaccaggtaaatcattggaatcaaattcatatttcccgtgttcgatttgttcataatatttttcaattttatttttcaaacttttgaccaacataggaattcgggttctaatatttccggacattttcgtaaggttttaaattatatactctttgtgaactaaagaattaatagggtgtaatactatacttctgtcagtatttttccacttccttaataaattcttccgttcacttgataaaactttgagaatgaatttgacaaatttcagtcatttttcagggttagagttgagtgtttctcttacttttaagtaagcttctaaaattacttcctggcaaatcctttccaaagaatcggctttgtctagattatttaaaatgcagtatggaaaaatagttacagtcaaagtgaatttatatactgttttgttttggtaggggaagggttcgaattttaaaatttggttcgttactttggaaattcctgggtaaatatgcactattggaaagggaaagtttgcccttctttcaagctcggtaacaatttcttcgggtgttaaaaccggaatttctacaataggtacaaattcttcaacttcttcaataatctcttccaattgatcaaaattttcaaaattttcttcttccttttccagttcagaaattagtttctttggccgacacagtttgacgtttatttggaatttttattaacaatacgatcacagtatcaacaatagtgatcaaaaatcttggtatctgatcgccttcaaataatgtcaaaaaaaaaaatcaatcttttttctccaaattgttcgcactagtggacggttcgtcttctagcgggattttaaatgtctttctgaggaattcagctgttttttgttgtccaatcaaaaaacggtggtgatgtgtaaggttgtcctgcagtttattcacaatgattaatgctttgtcctttccagcgcgactgttgtatgaaggactgttgatggcttttgccaactcggtgagtagtcccttgttgaaattttcagctttgatagcctttcccacggcttcaaaaatattttgcgtttgtttggtaacagagtttatacgcttttgttctgctctctcacaatcggccacggcacgattgtagatatcgtcgtgtgttgattcaagagagttgagttcttccaaaaatttgttgttaatttctggagagaaattcgaatggaagttcaaattgtcagtggcttcgtcctgctcaggaatttgacttgctttctgtaaagctcgtgaataactaataaggtcagtgttcctgttgaaattgattgttgcttgaacttctcttattacttttgacaattcttttgcctgtacgattgcttcttgttgtctgagtttttgtaagacaaattgagtctcctttgacaaggatgatgtgtctacaaaattaaaatttattcagaatcagaagtgtctgaacgtttgaacaattcagaatgctcaaaaattttggtaaagtaaactctggcctcttttctttcagatacagaaatgctactgggatgttttgcttttttcaacaaaaattctggttttttaccagttttcggtttttgaccttcttctgattttccttccttctgttgtgctggtttttgctcaggtttggactgtttcgtgtccgtgtcgggttttggctcttcagttgattttcttttcactaaaatattcgtattttagtgtttttttttttttttttgtggtttttgttttggttgtctgatttaaaactcagcgcttaaatctgacttttggttgaagcaccgcagctgtcagaagaaggtttttcagatgattttgcaatgagtttttgtagaacagatgaccggctttttgaacttttgatcgctgatcagtcttttgttattgttggtggtgttgtcgtttgccttcccgggtcgtggcaccaaaattgatgggatgcactggttgatccaatcaattaatttaatattttatttgggatggggcgacaaaggacacaatgtggaaaatttggtagatttctgatcacaattgatcaatatccgcgatgcttcgaatgcccgagttgtgatgtattcagagcgagttgttgtccggcttgttgagtgaagagaaccgataggctaacagagtgaattggttgaagcatgcttaaactgaaaacccttcccctttttataccaaaattttttggttatttaatagcattcaaaatttccacattatctttttatggttttttcatttctaaattattttttatcgttttagttttttcttcccttttatttaagaaaggacccntgcaggc

SEQ ID NO: 3542 - DNA, 1311 bp, Heterodera glycines
  misc_feature (42)..(42): n is a, c, g, or t
gaaagcggaaaaagaaagaaaggaacgacggatttaaacttnttcattatttattttgtgtatttcaaagtgattgatgattttgaatgttcggaaaattattgtttttcattctttgtgccggttttatgcatgtattgggcaaaatgacagaatctgtgttcatccccccccccctggtgagaagtctcttttgggacagttcaaaatacagtaggtgctgaataacaaaagttagaaaccaaaaatcactgtcatttgctcaattcggcattgattgtgagttctatcagacagtcccagtcggaaacaattaaacaattagcctctaataggagaaaaaaatttggcatgcctattaacatatgtaggaaggcttatttggtgcagtgataaaatagagaaaggatccaacgacaaatgccccatagagacaaataacccacagacgaagcaggacagctgtaaaaattttaaatttatttggcaaaacgtctcataataaatccaataaattattttgggataaataatcaaaaaaatttgttctgaaattctaaatggcttcagcaaccggcggaaaagtcactttcaaaattactttgacaagtgatccaaaattgccgttcaaagtgtgagtgaaaagtataacaatgcaattcggccaactttgcttacgtttgtctgttcagactgagtgtccccgaaaatgctccgttcactgccgttttaaaattcgccgctgaggaattccgagtcgacccatccacaagtgccataataaccgacgaaggtgatttctttcagaaagtcaaatccacatttatccagctcgggataaaattgaaaaaccagccgaattcgaattagcgactgattgaaacataaaatcaaaagcaaaatcgcattttcattatttttaggcgttggagttaatcctgcgcagaaagcatcggacattttcatgaagtacggctcggaattgcgactgattccgagagacagagttggccaaggcgaatgaaagaggaaatgggtctaccgacacacgcggacatatcatttggcaaaaagggaaactgacaggaccgtctattgagactattgtgattgtttctttgttattttttggtagctaattattcggagaggctgggaattttaaaatatgtttaaattcgttaaggaaattgagattccgcttctaaaactcacataaagcaataaattttcaaaaccataaaattcatcaatcaaaagacaattttcgattcaaaaagtcggggtcataactagggcatccaaaatatg

SEQ ID NO: 3543 - DNA, 3007 bp, Heterodera glycines
ccggaatttcaatccttgggcctgtttgaattttttgataaagcaatatagtaaaccatcggatataccatcagtttgtcttgcaccgccttccagtcgacaccttcgggaacgcgtacggtggtgagacatggcaaacgattattcttgacaatttttttcggatatatagcaaaacaattaactgccttaattacctctttttggacaaacaattccagtcccaattggtcaaacgcgtcatacaaaagttttgcattgattttgtgtcggtttaccatgtgcccaattccttcctgggcaactgctgaaagaccttcgcgtagcgcataaaccaacgaaatgggcgccgtgtgatggtatctataaattgaatggtttattaaacgtcctcaaattttccgttttttgtttgcattttgcaataaaaattgcaaccttctcggctcgtcgaaacagccccaataattgcccaactctaacgcgtcgaaataaaatgagggcactcgcgttttccgcttcgttattttctccctgaattaaactttttttccttaatatgactaatttttacagtgctttttcgctgaatgaaatgggagccaacccgggcgggcagtttaacactttttgagttgcggcatacacacaatcaacctttcaaatataaaaatgcaagaaaattcgaaaaaagggagaaactttcagcgcatcggcatggaaaggggcaccacaaatggaggcgacggtgtccacgaggaaaagaacgtcactaagggggacagattggaaagtgtggatacacgtaaatggttttagagatttgatagtttgacatgaaattacttactatgcattgcaaatatcgccaaaacgctccaagggatggacgactccggtcgaactttcaccatgacaaacgaatgccacttggggacggtagttatccacagcctaagggaaaggcagcataattcatctgcagatttttaaattcctacgaacctcggcaaaatcgtccaattaatcacttctccctccggtacgaccaatcgatgcactttaatgccaagtctctccgccaaattcgctgcccgcaagccccacactccgttttgcaccaccaaaatggtctggcctggctccagcagattcaaaatggcacattccatcccggcatggccagtgcccgaaacagcgaaggacagcgcattctcagtttgaaaaatgtatttgatgccggatttcacatcatccataatctgaaagaaaagcgattgattgtaagaaatcaaatgagtcacattcgaataactcgggatgcatatgtccgagcaacggatgaacgagtccctcctggacgagtgctggcatgatactgggaccaggtccgaacaattttttttcgttgatatgcaacgaacgcataagccgatgaggaggcgcaactgtggcagtgaaagctgagctggacattcactaataggggaaaatctggtaattaacaaaacggtgaaatcaaaaaaaaaaaaataaattgtattttcgaagcaaatataaatttatttgaataaataaatattaattacgttatttattatttgctaatttgaattaaatcggcgcaagtagtttgggattgaatttgaattataatacataaaaggtattaactgtgataaaggaaatgtaatgaaatacaatatatactagagattataaaacacaaaatttgataagaaatgagttaggagaatcaattaaaaagggacgccgaattggcgagtgactgaccccacggagaagaccaacgaaagtcgcgcctttcctcaacaattttttgtttgattcacacatccgagggacggcaacagccgaggacaacattcgactgagcatttttgagtgggacaaaaaggacggacaaaataattaacctgcaaaatatacataacatccacaaaattcgatttagaaacaaatattgtacattcattcgaatgagaaattgcgtaaatattaatgtgaatttatttgttgtgtggaaaaggggaaagacgaatgaatgaataatgcaatgaatgaatagcagcaaaatggcctggtcctctctttctgtgcatatgtacaaataagtaaataacacagctagcaaaaattaaataaatgcgactggtggctgagaaaatgactagaacattgtgagctgacactgagaatatgactggaacttatttataatggatgagttggaagggaagggatgatgaaatggatgaaaggaatggagtagcagagggaggggtggaggaggacattcccacgacgacacaacgattacccgcccccccccccattcccctctccttcctgtacataaattattcttgttccctgttcagttgcatcaccccatcaaaattaattagataaataggagagttaagtgtttactttttaagaacgattgatctgtgagtttggttgaacgagtggttaggaaaatgcgaataacgtttgattgattaccgtatattctctaattatagcccagtctctattaatcccgcagtctccaattatcccccagtctacgaggtgttttgaaaaataatccctatatcataatcccccagtctctaattatccccccttttctgaggaggttgaaaaataatccccatgggctataattagacatatacggtaatcaaattaacataggtgtacgtacatgcatttaggggctttttcataattaaaattacctaaataaaaagatgaaaagagcaaattattaaaggacagatgcagggaagattggtcgaactcaaaaattaggccgaaaaaaagaacttataatacatacagtatacatagagtaaccgaccggttgtgttgggagtgtttgcactttagtgtcacttccattcgcaactttcgtgtcactccacccgtagctggggctgtccctctcagtgcactttcactgttatttagcacaaaa

SEQ ID NO: 3544 - DNA, 1366 bp, Heterodera glycines
  misc_feature (22)..(22): n is a, c, g, or t
attggtgggacgttaagcgatntaaaaggaatgaagccatatttgctaaggccaacagaatactcacccgtcttcgtgttggggatgttgagcgagtgtgtcgtccgggtccggctcaggagggccaagacgatcaagcagttcagtgacattagcacgacgggccgggtctagctcaagacagcgctcaatgaactgcttctgctcgggctggtccaacgagttgagcgccttgtgcaccatctcctgggtgaccacgtgagagcatactgaaatagaagggaaattttatctgctaataatgcgcattaaaattacaagttttcccggcaccgccggctcgccttattctcaaattttttttttgaaaatgtgaatgctatttgttacgaaaattgactataaaattcaacaatgtacccataaaatttttaaattttcattaggggggattcaaaaattttttcatatttgctggaaaatttttaaaaattttaatttcgtggcaaagcaaatcgaccatgctgtgggagcagctcgttcccccccccaccccgaaaatttttttaaaaagatttactaacttgtaatttttcaagaaaaattcttagaaagttttttataagaaaattctaagaaaaattttcagctattttttcttgaaaaatttctatgttagtaaatttaaaaaaaactttctcgcagtggggggaaacgatgtgggggggggggggggaagcgattagttatccatggtgaacatgacccaagagtgcataaaaaaataatgtacaccgtaccgggtccgaacctgccgccccccccccctcctcataagggtgcctcagaatccccaatcacacagggattctgaggccttaaccatgtcgaaagtaaaatctgattacgtattcgtgatcagggggccaaataacccctaaagacatattttttgaagatttttggtgaaaaaatttttcaactcaaaaatcctatgctcacccctttggtccataatcccaaaatcggttttatttttgtaacaattcgtaagaaagtgataaaaatgtaaaataaaatttatattataaagaaaaaaattgcggatttttgtagtattttaagtttcaaaaatttcttttcagaaggcggttatgaatttttttctgagaaatcgaaaattttcagaaattctggaataacttgttttctttttaagatagaaatcccaaataaatcccataaaattctcctgatttttctctatttttataatataattgcacgaaaattgatccacccttcgatttgttatgaattttcaaatattaggccaaaatcccgagggccaaaaaattgccaaaaa

SEQ ID NO: 3545 - DNA, 5670 bp, Heterodera glycines
gtaatgatgtcacagctgatgcagtcgcggttggccagttgctgaccgtcgcctgcagtgtaccggtcgaggctgcggatgccagggaacaaccggtgccatttggtggttcattttcggtcaccgctcctctgtcccgatcggttgaaggcaaaggcacagccgtcgcatgaagcggaagcgacgcgaaagaggcggcggagggtggggcgacgctggcggacgatgccatgctggacggaggagcaccgttgaaacagccactttgcagtgcacccgtggtggccatctgcaaaggggtggaatgtgtccgagttggcaacaagaatgcaaaaaaaaacgcgtccaatgttgagggggggggggggggggaattgaacaaacatgctaaaatttcggctcgacagacgttaccagaattttttaaaatatttttttcgtccggaataatttttttctgcaacttcctcccccatcccattgatgaagaaatagcaagtgttaattaaaaataaaaaaacctcaagagcgcagactccgaacgaataaatgtccgcctgaattgtcgtctccgtttggtctaaatggaaaaaaatcaattcattatttcgggtaataaaaccttttaaattaaaaaaaaatcgcattgacaaataccaagtgggggggggggggggcggagaaaattcgaaaaagtaacaaaataaaaatttactaataacattagtgtaatcctgttccccatgtaaagcacttcaaaaacataacaaacacttacggtcgtattcaggcgccagataatgaacatttttgatgttctcacggaatgtcttcacatggtggtgaatggtttttggcgcgactaaaaattgatgggaaagtgtgctaagaacgtccatatggaacatgggcattgtaattcattgggtttataagaaattctaagggaaaaaaacttttcgaaaaatttgggtaaggacccggtttttctgtgactgaataggcatttaccgcatccaattttgaccagtccgttctgttggatgaacacggaattgcacgtgaggttggcgtgcacaatgggcgggtcgcacgagtgcaagtaggacagtgcggtcaaaatttgacgcgtccaactcttccacgcctaaaaattcaggaagataaatttcaagggggctttgatcactctattacattatatcaaccaaaatcccgaaccttaaaaaaaatttccgaatttcgcaattatgtccaaatccggttaaatacaaagaaaaaaagaaccgcttgaatcaaaaaactcaacacaatctcttgctttaattgttttttaagaagctttttcttttcattaaaaaactcatttctcccactttttctttgaccaaaaataaatggtaaaattagatggattggaatttcggtacgttttcactttacgccacataaaaaaaaatatttttatttttctgggattttcggggtcgctgatcacgaatatggcattcatttcgaacaatttcgaaatccggacccaaattcgaacaaaaaatctaaaatttaatttttcgaatttcgtctaaaaatggtttaatgatcttttattgcatgagtggatagctttcagtttgtttccatgtgtttaaatcgtttttagatgaaaaagataaattggataattaaatttttgattttttgttcgagtatgggtccggatttcggaattgttcgaaataaacgtcatattcatgatcagcgaccccgaaaactccagaaaaaaaattaaaaattattttatgtggcgtaaagtgaaaaagtaccgattttcctggacaaaattttagaatttattatttcaagtgaccgatattttttcaagttttcaaaaaatgattaaatatatttaaaaacaaattattattgtaaattagatatttttagatgttcccaagcaattaattgaatttttcaaacatttttttgatttttaaaatgagtttaaaaaaatccaggtccaggcctggatccaggtctcgaagagcctggattttcctggatttttgtccaggaaatccaggtccaggtccaacatggaatccaggtccaggtccaggcttttttcaaaataccgagctctaattgccacttctccatttttacacctattttggattttttataacttaaaaataatatcataatatccctagtcatatgtttagcatcaattacaaaactatttttgtgggcctaaaatcctaaataattcattctgttctaacttttattgctgatcaaaaaaaaacttatccaacttgatcagatgatccacttcctcatagtgaaacactcctattatggatgaattgagtataaaagagttgcgtaagatgagttgggtctactccatacatacgccaaacaccttcattattgcctttaattttgcaatagtttaggataatttaatttgcttttttctcttccatatattcacaaactcccaaaatggaattctggggaaaaaagaatcaagaaaatggcattatgagaccggctctgatcgtttcgtcctttcctaacgactttggaatggaaattgccaatgttgtttatgttgctcctgacgaggttgcataataataatagaccgactttaaattaaacatttccatccttttgtttttagatcctttaccctgtccctcgttcgttgtacactttggatccgcttcagcatgcgtacatgtcaaaatctcagtgcaataagatgaccactgttcagtcagaagactccgttgtcactgtccaagttgattcgaaagcgtcgaaagtcacttgtatgatgaagggcgggactggcttatttggactggataagcgcgggtcggattggatggtaagcggtgacaattcgtcgtaatacacttaaaataaattccgtttcgcagatggatgtcgatgtggccgtctccgatgagcaacctcgtcaagtctttgtttgttctccttttttgccgggcactctgatgaagactttgatcaacttaaacgacgtaagtgggcagtaaatatttttgtttaatttacctacaaaatgtctccgttttaagtacttgccaaacaaaccatatagaggcactgtcaaattaaatgtttttcatggaactattgcaagctgggcttctaagggaatctgcagttttgtttggtggcaaaagcagttcaaagaggcagacaggtacacagtcatatatgaaagccttttgagctaaagatattcatggtagcctcaagtttgacttaggaaagagacccaacgatggatccccggcggaactgtcactatttaatgttttctcctagggcttgtttcgagttttctctcacaaacatttacgaaaccgatgagccgaacattgccgttgtatatgaagcggtaatatattttatatactaactacaaaaaaggagaaagcttttagtcatggcaaagtgtaaagcgttcaattgtccttactcccgcgcaagttggcgatgttccagatgacgaattgaatttattgctgccggtgggacatgtccatcccattgataactgtcaagtaattctattttcttttacaaataaccaatcctttttaagtcgaaacaagggccgtgtgtgaaaaagtttattgaaaatattggcaatcaacagggaaaacagccgggctccatcgttacttgcgttgtcagtgaaagcaatgggtcggacaaacaacagaaacagaaagattccgtgatggcttgtcatttgactgatgactccctcagaccagtttctgagattctttcggctggatcctttaagcagatcatgaaggttgtcaacggggattccggtcaaaatgcgtagatgaaaaaggttaggaaatttgtatacctcttacagttagctatttctctcaataagtcattttctgttttaaacaaattattcaggtatccacagtgaaattggatgggaaggatggaagagattacactgattcgccttttattattatataaccttttgccattttattggttgaaacacattcacacaaaatacaacaattggaaagtgaaatgaaaagcaccatggcaaattaaattttccaaattcaataatataccaattaaatgccaaatccctcatgtttgctgtgactttttataggtttccatctaaaaacataaattcgtgtcctctggtttgggtttgctatttattgctcgacctgttcgttgtaacggacccttcccacggcagcgcacaatttccagtgttccttttcctctgctggcaattctcgccactcttttgcgctgcgtttacggccatccgtgttccacagcatatacgaattcaactgacaaaaacattggttgttcctttgttttattcctgtcatttctcaccggtctctttggtggtttcgtccctttgtctctcttccttttcctccccctcgtctcagttttgctggttccattcgccaattgacgcaatactccaccaaatgcgtgcacagcttctgatgagaatagattttcaatgtgcagatggattgacgaagacgcagaggggtgggtggaagaggagggaggggcttttgacttttggttagggtcggtgttctcatccacaaccgtctgagtgctctattaatactggcttaacattagaaagaaaccttttcttgtcaattaccatatcgataagtttcttttgttccggcgcttgcgtatgagaaaatgtcaaacgtcgatgtgtcttgggaagaaaatttgctgctttggctaaagcagttgagcaaactgacggaggacgtcgacaaatcggggtcaacaacaaaggaagctaaacgacaattgaaaagaagtgaccgccaatgaatccttaaattaatttgggtatctctcctcaccttcgtttgaaccattctttattgggcgattcgtgttagtaacggacgaacaattcaaatcgactgagaaaggcgaggagctgcgacagttccaatcatcgaaggccttaactccgatgaattttccgattgtagcgcaaaaattattcatagagtccggagatgagaaacggacgcgaaacttcacagaaacatttccatcattctaaaattatagaaagggaatcaatttcaatattattctgacctggtctttgatgcagaacaaaattcgctggtctctgcgcaccaaatcatggggaaaagcgagcggatgaagcaaaaacatttctaattggtttccgttatggtaaacgaagagcattttgatagggtaatccaattgtaaaaataactgctcaaaaggacccctttcgatcgtctaaaaatggtcaaatgaaacattcaacgcactaattggacaaccatttaccaattgcatattacgtgtgtctgccaatcgactgtacttgtccaaagtccactgcattaatgatgcactaacgcaaaatttttccttttgtaaaattactaaaattataataaaaagtgttctgcattaaaatttttcgattctgatgtcattatcagtcactagaaatcactattttggcgactccgtcactaaaatagtagttaaaaatcactattttggcgtcgtcactatttttca

SEQ ID NO: 3546 - DNA, 6692 bp, Heterodera glycines
  misc_feature (45)..(45): n is a, c, g, or t
  misc_feature (152)..(152): n is a, c, g, or t
tgacgcggctttcaatgttgtcagcgcggcaataccggatgcgtntagaaacgcaacggtagtgctgctggccgggcttcagtcggtgattggcccgcaaccgccacctgtttgaatcggcgaacaacggcgaaattttgacagacgcctcngagttgttctcgctcggctccgccagggatgaccggtgccagctgtttccagtcgccaccaatgatgacaacctattgcaaaaaattcaaacgttgaaaaagcaatgatcaaatttagccaccttcccagcaaaaggcaagtccttgaactgttgcgtggcaacagaacgcagaagccggtcgacaaactcgaggacatccctgtgctgcatgctgatctcgtcgatcaggatgccgtggatgttgcggagcatgttggcaaagttgctctcgttgtcaacattgggcgaagttgacgaatcaacttgcttaagccggcaaagccgcttgtgcacagtctggccctcgtacagcagttcggcagcaatgccggtcgacgccatgggcaggaagttgatgccagcggacttggcgcgagcaatgatcttctacaaagaaaaaggaatttatgtggaaaaataaggaagtgatctcacattatacgtgaacgttttgcccgcgccaccttcaccggtgaccatgaagagacgctggatgtctggcgaaaagtctgggcattgtccatcgatgacttgttggacgtgctccagcgcagtttgcacagcatcaatcagctgttgttgctcttcattgggcttgggaccggagatgtacttttgaaggtagtcttggcgcatttcaccgcgtcgttgaccgtccggaaggaagtccacatgaagatgctcgttaagcgcatcatcacggaagaaggcgagctaataaaggcatatggttttcacataattggtaacagttgcagtaccttcatgaaaatgtccttggtgagcacaaggccctgaggacgtggcagaccaatgtgttcgcaagcggactcataggtgccatcctccctcggctccgagtcgggcgttatgccattggcgagcaggaaccattccatggcattgaggacgtactgcttctgctcttcggccgaggctctcgcaacgcttgtgtttaccagccacttgtccgcatttgcaagaaccttgtccaaaattgtgcaaggactggcgaggttcgctgtcgcaaagaagactgcaagccatcgaatgcgctgccggatggacttcttcattctgaaggcgtcatcgatggtcttcatccagaggtcttcgtcagtgaggagtccacgttcttgcgcagcttcaacaaaggtcgggaacacgttgccgttgacggtgcgcaatgactcccatccctttgggtcaagcacaaccaacagaagcagtcgaattgcctataatagaaaaaaaaagatcaaattgttaatgtgcttggcgttctaccaagagttcgcggttgctgggcgaaacggtcttgagccggcagaactttggcactggcgcatcaacatacagcttccactgcttcttggctctgtcatagcgcaacttcttgtagcagttggcatacgaaaggccaattggcgggttcgcttcgttgaacgcgaagtatgcggtcagctgagtgacgcgctcttcgcccctcagccttcgctcttcttcggcctgggccgcctcgcaaatggcgttcaaattctcctcttcatcgtcaaagccctgctcaacggcaatccggtgcccgctcggaccgtgcacgtccaattcgtccacctaaaggagcaatcccataacatgtgggtgtaataagcaaactccgtacctcatgagagcgtcccacaagctttgtgccccaaagcgagaggatcgcttccatggaggtgatgtagcgggcaagacgaatctggtgaaactcgtcgtagtccaccttctgtcggacgtcgggtccgccttggacttggatgaacgccatgtcggcgcccttcatcacgtacttgcacagatattttgtgcagccttctccagccacaaactcggtgttgatactaaatgaaggtgaaaaagtaaaaagattcaaccaaaatttgatttactaactgagctttgtatttggaagtgaggaaggggttgaaggggactacgtaacggttgtcaacccgaatcgtcttgccgcttttgtccgtgtactggaagtcgcgtccatattgctctgggtgtcgagctgctgccctggcgtcaggggcaggaggacgtcgccggtaccgcgggtaagcgtgttcgttgtagacattgtcgtacgagaatggcttctaaattgatatgcttgacaaccataaaagtgaagtaaaatattgactaaccggaaaacgtttgaggcactttccgtcaaccaaacatcttcgagctgagcacgtgtggatgtgcttcatcctcagtgttttgtaaagctctcgcttgagcaacacttcggatgagcggcccgaggggttgtccgggatttctgcagagatgtactgctcgatatagtcttctggcgtgttgatggtgccgccacttcggattctgtcccagtccaaaatcagtgcgaaatggacatgcgggaggccactaaaaatgactcataaatattcaaaaccaaaggactcagtttaccgtttctgatgctccaatgagtagaaccagccacggacgggccccatgacctccttgacggtaaggtcatgacgcagctctttgaatttgtcgacaaagagacgacaaatcacatccggacggtcgtaccactgctggcggtggccatctgggtcagttggcagcatctcttccagttcatcacattcgggatccatcgtcagagtgatcaaaaggtccggctttccaacttctctgcagatggtcatgcagttggcgtactcgcgctggtagtactgccgggacccgcggaagtgctcgtcggtcatgtagactcggccaatgtcgcccttgtaccctaaatagcagctatttgattattaaactcgaaatgtttgccctacctttgttgtccctgagagcgcttagccagttgatgattgagcctggaaggacaagacgtcgtcttccctgcagctgcttcatgtactggactttttgggcctccattcggttgttgaacgtgatggtgtagagctgggccagagtgcgccagtcccacagccagtgtccatctcgccagttggcgtgcgggcctctgatgtgagccatgtagcggaaccactgcgatcgcgaggtgttgtcgcggcgatggaactgctgctagagttcagagccgaggaactcctcctcttcgccaaggtcttcggcggcatcaagcaggacgttgttgtttttgtccctgatttgcttgtacgttgagtcgaaacgttcgtgctcccgcaacgccaatttagttccatattctataaaggaaaattgcaccaatgcttaaccgttacaaaaaatactctaccgtatccaaattgttcgaaggaaaaaatcagtgggaaatttgcaggatcaatgttcctgttccaccacttcatgtacacgattttggtgcgttctcggcccgtgagcaccacgtcgtacacgctcggcggcatgatattcgcaccgcagtccaaaaaaatctagaaaaattgggaactgtttatatgatgaaatcaagcgccgaagcttacttgagccagaaggcgacttccagcctccgtttctgcctcaagccgtccaggatggatgtgcttgaggttggcccggtcatcaacatgcaaattgtccggtgccggcgcatcatttgcattcaatttgcgctctgtgccccgctggttagtatccaccaatagcattcgaaactgcactcggtcttcttccggcagctgacggtacgtctccgctgccgtctcgtaaaccacagcaagcttgtggtttgcgagaatgacgctgtaaagggcctccatcagttcttcctgaagtagtataaaaataaaaccaatatttttgaagcataaattaatcttacgtccagtgaatgttcccgagaaatttcacccaggcgagtacgtgcatcggctggaggaatcgtgaacagttgtccgtgcagatggggtttgccaccatcgggtgggttgaaatcccacaacatgtagtttatcatgttgttgcacttcacgatccgatggtggtcgatgcgctcttcgcttcgggtgatcttgatgtttccgaatgccaagttgttgttgtatcttagcacgttgcgaaagagcgaatccctccagcctttgtattgtcccgccgggttttggagtatgttgtccaattcggctggccgagcacgaagcgctttgtagcggtccgccaagttgacacgtccttttgcgcagcactttgaataggcggttggtccaatcgcttcggaaggcaaaagcaaagcattgcagtgagggcaattgtgttgtgcctataaagaaagaacatgactactgaattcatatttggaactgacttggtcccgaagcgagttgtaatatgaaggcagatggtttgcctttttcgaaccgcagccatatccaaagtgagcggaccgaatggttccgcaacagtgcgtcactggagcaatgggcttcggcgccacaggactgggccgattgcttgcgatggacgcttgtcggctgatccgtgtgctgcggcgaggagccaacgatggtggtggcataagatgcgagtccgtcagcgcttgggattcattggcggaaacatccgaagccgcggccgtcgtcgtgtcaacagtagatggaatggactctgtaggagacgcagccttggcatttttcagcgggcgtgcaccaatgatgcctcttggctttggaactgcacgcaacggagcagcattttcgacaccacaaatttgactaaaatacaaatgcaaatactagtgaaagaaatgtatgagtcgtcgcttactggtaatgcatgtcctgaaggccttgccacggctttgtgcactttgctgggcagctctgcttcggtgcgggcgaatacctaatttgccaaaaggaaatggggtaaaaatccgaaatgattaaacactaccagcattcgaagtgagtgtaagagtcacagcaaggcaggaacaccttgctctgacgaagcccatttgcctgcagcttgaacagccgctgacacaaaatgcagaagccagggtgttgcgtgccgcaatctgggcattttccaccacttgctttgagcctataataaaacaaaaataacaaatttgcattatgaaagagcacctcgcttccaattcatccgcgtgataaactggtgcagatgcgtccgtgcaataacagccggtttcataaatgcccatgccaattttttgccgacagtcaccgcatttaagaaatgtggtctttttgcaccaacgaaatttgcatttcttattcggcacatcggtatacctatgaatcgtttaatttaataaaagtaatagtttaagtaccattcggcaaagggctggtcaaagtggcacgaatgtccgcaattcaacattgcatagccatcagcatcgttcaaaggaattgtgcaaaaaacacatttgttcgacttctgtattcttctggtacttctcgattgtttcgatgatggagtgtctataatgtgggaataaagataagtgaatattggttacacttttaccgaagccctcatccagttccttcagtcgtacagcagcacttgtaagctcgctgtcgccagttggatcaccagcagcttccagttcctgcggcgcttgcagtggttcttccgactgagccgattgcgctggcgacacgctttcacgggctgacgaactgcgttccgatgttcctaatgaggtaaacagaaaatatagcttgaaagcggacaaataaaaaactcacttccgcattggttcaatatgatctgtccgagtccaaaattcttccaccatcgaccataagcttgcggtgaaacagcactcttgccaaagcgttgcttcagggctttgaatgcttcttgtttttgctctggacttcttttgaagaagtccaggaggaatgcatgttgttcttcgttcctcgttggagttcgtaacggctcgctttcaccagttgggtcgcctgcagcttgcaactcctgcggcgtttggtgttgtttttccagcggaaccgcctgggctggagacacactttctcgaccggactgggtgcgttcggatggtcctattgaataaatagtgttttatcatgaatccgacagtatataacaaactcacttccgcgttggctcaaagtaatcttgccgcgacgaaaattgtcccaccatcgaccgtaggtctgtggcgaaacaacattcttgaaccgctgcttcaacgcttggaaagcttcctgtttttccgttggacttctttggaagcagtccagaagaaaggcgtgctgctcttcgttccccgttggagtagcgcttcggctcgattcacggccgccgcctcgctgtcgtttaggaacagcttcggcagtagtcagcgcacttcggtcagctttaattgagcccgttacgcctttgctgatgatgaaatcggcaaaaggaaaggagcgagccgtcgcactaagaggctttttcg

SEQ ID NO: 3547 - DNA, 2198 bp, Heterodera glycines
atgatgaaatcggcaagggtaaaggagcgagccgtctccccccgtggctttttcgtagcttcttttagcgtgcgggctgcttctgcataggtcttctgcagaatcggcagctttggtgcgttgggcgttgtcgtgatgttgttacgacgcgagcccgtcccgacgaataagcgccaattcggctcctcactgaggcgtggagcttcaaaacgcagcttattcgcaatgccgggtgcactggcgaccacagcacgtggcttgctcggaagcggcttcgttaactaaaacagaaaaagctatttgcaaaaagaaagaatgatgattacagcttgagcgtagctcatcgatgacgacttcaaagcgggagcagaagacgcaaccgcggaagtcgttgctttgatgtactgttgaagcacataaaagcacgggacgacgaagctgaccgaagaggagttccacacagttcttctgtggcggacggttggcggcactttcttcaccacgtcgggcattttcctggccttctccatggccgattttgggatggccttaaagtgaaaaaaattcagtaacgataattgatttaaaaaacacagaacacacctttcccacaacgacgaacatttcctcgctcggttcgcggagtaccggtttcggcacagcgttcaaaacaggacggttttgaagcgctggcttttcggctcgagcaattggcgcgtagccgatcggcacgcgtggcttgtcgatcttcgacagctccaaaagcttgcttgacgcgacagcctgaaaataataggcaaaaaaataaaggattgcaattcgcactcagttcaccttgcccttaacgatcgtatggtacacgtttttgggacgcggcatgtcagttggcaacttgcgaagcggagccaccggcaactgtttcgcaacctaaaaaaggaaccaatattttgaaaaaagaaaatgactgaatgtaccggagccagtcccggaatcggccggccatcattgttgcagagccaaggctggcgcttgtcagtcaccacctttggaagcttctgcttcttcggcttacgcctaaaaatgcgggttaaggaaagaattttgtgaaaaagaaggttttgcacacactcacagttcagcgatagccggctcagcaacgggcgatttttcctcacagcccgggatggtgacgcccgtccaaccatcctcctctgccaccggccacggctttggcacctggacggcgatgccgacgccacgagagtgggccaagttgtctttggcaccagcggcaaacttcttcatctccttaatcaggtgacgaaggcgggccaatgcgcacgtgtcgatgtgctctgacatggcgcccatgaatgccgcacaagtggcacagtcctcgctccaatctcgaccctaaatttgagaataatttaagaaaatgttgtttaattactgactacaaacataaggcaatcggctttttgaaaatccccaagtcgatgtccttggggagattcggcggggcgaggatgtccttcggccggtacgagcggaccggagacgcagcaacacgaacgccagttggagttggcgaacgtgggcgggcaaggcgccgtgcgggcccaatgaagccggttgccgagaccggggccgggacaaatttggctgtaaaaaggtatatttgagattatttacacaagaaatgctgctgacctttcttcgatggcttgccaaccgtcaaacggcaagtcgaagaaggcgagagagagagagagaggggggcgggattagctctaaagagagctgtttgggataaggaaggtcgtggcgaaagtcgggatagggggtggggctggggaatgatggggagggaaaggggagaaagggagcccgaaggcattgggtcagacgggacaaatgggggagggacaatggaaaacaaatgaaaaataaatgaaaaacaagagaaaatgaagaacaagtctgaaaaatggggatgttattagttgggaaaaatggcgtagacacagcttaccaataagtaaagctgagaacaatataaatgaacgtgagaagaaagctgtccaaaatgggaaaattaattatgcaaataaatacgcaaaatacctggctaaaaagggaaaaaattattaataaatatattgtgaaaaataatgaaatggttaaacgacaaaata

SEQ ID NO: 3548 - DNA, 1598 bp, Heterodera glycines
ccatcgcatacaatgaattctaatgggacgatggcccaatctaacaatcagcagcagaaggcgccactgagcagtgcgcctccgcctccaccgcctccgccggacttcaaaaacttattggctggcaaacaacaacaggcaacctttgccgacaaacttagggatgtcaaactccgaaagtgttctgcaggtcccttgatttagcttagcacctcccgcccccaccttcgcctttttaggaaacggtgtccagaaacgtaccgtctcgccatcaaatagtgttggctcttctaacgggagtgggtctgtctcgtctaaattccaaagccaagatttgatcagcgaactgtccgatcgactaagcaagcggaaaatgactgtggaagcttcgtcaagtcggataagttatttgatttttaaaattgccaatttagatgcaaatggcaccccaaatcaaccgaattcacagactcttcccgtgaacaatgcgaaaggctctcaatcagcgattcctcctttcggaaagtcgctttttggaaatcagcatttaattgataaaaaaaaacactcattcttagaatcggcttcgttgttgcatcgtacggagagacaccggcgacagcgggcgcagcctccgctgctcaagactcacaattaacttgcgaaacggtggtgaaaggcccaacacaattaacttgcgaaccgatggtgaaaggcccaacttcatcagctcataatgacattgccaattccgaggctcgaccaaaggcgacgactacgagcagcgatttcgagcggatgaaaggcgaactcctggaactgttctcgaacgaactgcagaacctcaagcgggaacttgcgcaaacaatccgagacgaagtggccaaattgtcagccgatcggagatgactcaacttgttcagaatatgtctctgttgtacattgtcttcctttttaatgtgcagtcactacgcaaacccagattttggtaaaacttatctttgtgattcattttaaaaatcatgcaagggcatctactgtatcgcttaggcaattgcattacatgtgtaaaactttttaatttcatttgggacgcataaaatgcgatcggacgcgtaaaaccgattagaaccgcaatttgtttaagaagctatggtccaaaaattaatcacgcgaccttttgtcgattgttcccgaaatgtatctttattcaaaggactaatttttaatgagaatattaatcatcatcatccaattgaataacaatatcattgttccgacgaatttctctttcttttatcatttctggagaagaaaattgtccgatggagagttcacgtccttccgtaatcaacacagttcctccaatcctattgatctaaatggcgactgtgtacagtaataaaagacaaagggaggctatttgtttatctgaatacctacagagtgggtatcaaacaaattcatggcaattgtgaagataattggtcccgaaattttttaatttaatttttttatcttaaaattttttaacacttttctatgggtgttttgaggcgctgagcacgattccggcctccagttcgacggattccgaa

SEQ ID NO: 3549 - DNA, 4026 bp, Heterodera glycines
ataattttgaattttcgattttttgatcgagttcggcttcaatgttcgaaattggtaaaatgaatggcagattcgtgcttagaaactccgaaaacactaagaaccatgttttaaaagaaatttatacaaattttaaaatttaattctcgaaaaatgttcgggttagggattcggaattggtcgaaatggaggccggattcgtgctcagcgcctcaaaacacccctagaaaattgttaaaaaaatttaagataaaaaaaattaaattaaaaaatttcgggaccaatgatcttcacaattgcccaaattcattcggcttatgtgaaattcgaacagttcagtaattaatatatgaaaaatcggcctttccaagacttattttaaattttttattctaatattgtgttctcgcgattattaccctgttaaccgatggaaaaaagttctggaaaattggagtttcgccattatttggttgctgaatgaaatcacattgcaaattgtctttggttgtcagttcagtcgaacatttattctttgaattgtccggtgtgtgcagagcttaatttcgagtttaaaaagattgagattttttcttcacttacggttaaatggaatgacattcggcgagtgatttgtgcatttggtgggaaaaattttctgcccgattgatgtagcaaaggacgttccattcaaatgttgtttggtaactcaatgaaagaaaaccgtagaagaaattaaatagaataagacccccgccccaaaccctctatccaccaaaaattcgaaaattttttccaaaaacaatattagaaattgtggtgaaactgttaaattgtattaaattttctaaaattcttccggaccaggcccgtaacagaaaaaaatttcgggagtggcaacccgcgccgccggggaagtttttaaatagaaaaacgcgacgcaaaagtagaagtttcttcaagatttaaatctttttctttcaattcaggttaactttgttgaatttcgggtttggagtatcaaaatctgtgatctctttgtatggtaaatttaaaaaataaaaggctgactcgcgatgaaatacctcgcattttgtttggtgctccaaattcattcacattgtcatcagaaatgtgtcttttgaggcctctttcgtaaatcggacctgcatcaccggtgttcacagaagcatttccaatcacacagtttcccatttgttttcgatgtccaagaaagtttgaagtcacagtttttggtgtatttgagcaatgatttcctgcacagatgcgcttatttttagtgactgttccttccggaggcgaaagcgaagaattcgttgccggaatactgccattgtttacgagaatcgaattgaatgaccttttcccattgtctgtctcccgtaacgatgtttcgcaaccatttttttgtgcactgttctcattgtcaatagccactattgaactggaagaagacccacctgaaaggcaacaaaaccactcaaacaattgggaaagtcctaacttactcttcttgcgattgctcagaccagaaaagtcctttttgcattgtccattgatggaagtcaatccagaggattgcaagttctcatcgaaatttggatgcactttacttttcttgttgacctctcttatttttataaaatgttggtaaatcttaacatccagcttcatttattaaagagataagaaacaaatcaccatattagcgactttgtcgatctgactgaattcctgttgtttcaccaagtcaattttcaccggcagaccaaattgtatacagaaatccttgtataaattgctaattctgctcatctcacgtttctaagcacccgcaaaaaattgtttaaatcatattttggttgtaacctgtttttcaaacattttgtaaatgtcgtaaaaatttcttgccagcttctctatggtgctaagcaactgttgtcgttcagtttggcacttaacatctaggcatttgtgacttttgatgtgtagatttaacagctaaaattactagtagaatacataaaaaataacaaaagatatattaaaaaacctttgaaatttgctgtggagtaaaatgagcgttttcatctttcattggaattattgtcttttctttttgaaatagaaaattttaaaaaaaacgaaataatttgtttttctataattgagggaaaatttgatacatttttaatggatataaaaaccaaaaagaaccgtcgatatgaaaaaattaaacatttgggtgaaggtcaggtaagtaaaacaaaagatacaagaatagttttgctcttttaagttcgcaaatgtttaccaagcaaaggtaaataaataccagaaaatggcaaatttttaattgacattaaaataaaaataggtatgtagacttgtttaggtaccttttaataaaccttttataaaacgacatatttgtttcatattttaggacattgaaaccgggacgatagttgctgtgaagaaggtgcaactctcagcattttattgcaattaaattcaattatggctttatagatcaaacttggctcaagacatgaagcgcgcgatggtgttaataggacggcaattcgcgaaatcaaattgttgatggaaatacgccatgacaacataatcacacttttggacgtgattggtcacagaacgagcatccaattggtattcgactttatggagacagatttggaggcgagttatccaaagtgactttcaaccgcattttgccttatgggcacttcatttagcgttttaagaagcggggattctcccctttctcattgtcagccttccctcttgatgagtttcccgtgaataaattttctcaggtttagaatgttatcaaggatagtgaaacaattctccagcactcccacattaaaaatatgcttttgcaagtctttttgggccttgaacaccttcatttgctcttcatactccaccgagtaagcttttacaatttatttattcgttaaattttatttccaggatttaaagccaaataatttgcttatgaatacttctggtcgcataaaaattgctgattttggccttgcccgttattttggctctcctaaccgttattacactcaccaagttgtcactcgatggtaccgagcaccggaattgctctacggggcacgggcatattcgacgggtgtggacatttgggcgatgggatgcataattggcgagctccttttgagggtgagttggtttcgcctttgagtcagttttgacgatattattcctttctaataatttttttagggcgcgaggtgtaagtctgaaaacggttttttttcaggcgcacttttttcaaaaaaattttgtcttttaatccgtttttcggcactgaattttacttcggagtccgtaacatcgtcttttaggttcctgtttttcaaggcgagtctgatcttgaccagctgatgcaaatttacaaagtgcttggcattcctacggaaacggattggcctgtctgtctgtttttttaaatttgttttaaaatcgcttcagggcatgacttctcttccggattatgttcaaatacaaaattgtggtccaggacatgaattgactgccgtttttcctgccgcgagttctgatctgattgagttaatcggccaatgccttcgctttgatccgttgaaacgatggaattccacccaagcacttcaatccgactattttcgctcccagccattcgcatgcgacgactccgaattgccggttgcaggcagacgaaaacgaaaacagcaatcgttgagggagaatgttgaagcgggtgatgagccgccgtttagtcgaaggcgtttggattttgcttaaaatttcctttattttattaatcaattttgtgacttaaaatttataatacattgacttttaaattacttttgtttctcaacatttcatattaaatttgtgattttgttttattttaaccatttcaactgcaaaggatgctttatcccccgaaagtccctgtga

SEQ ID NO: 3550 - DNA, 2254 bp, Heterodera glycines
  misc_feature (50)..(50): n is a, c, g, or t
  misc_feature (74)..(75): n is a, c, g, or t
tccaatattttttaatcagctatattggattataaattattaggcagtanaatgtgagaaatcgtcgagaaggnnaggagaaaagtgatttctgatcatttttctgctgattttgcgtttgaaacggatgttgaaattgactctgagtgccaaaaaggggaaggcgaagggacggatggcacgacggtggaccaattggatggacttcgacgctttctaaagaaaaacagcatacagacgaatttggaagagaaaatcaaacaggaacgaagatggatctggggaaaagaacgggggaaaaaggtaatcactgaattcaaagggattttcacaaatttacgattggataagcttaagggatttttaattttccaagtcataatttttgctcgttacaggttgacaatgatgagtttattgttagcagtaataaatcccgcaattctgatgcgaattgcactgatttgtttgatgacggagagaatgaaattgagttgttgcaagaagctaccgacaaaacgggtgctttttttgttatttatttggtaactaatgaagagttaaatattttcagatcaattagatttgaaattgaaaaacaaaaagtcaaagtccgttgggtccgaccactttttcgatgtccgttcaaatcaaattgctgcatcagcaaattgtgctcatctctctttcaccgatctgaatttgagccgacctctgctcaaagtcggcctttcatccatttccaccttattttcccgtttagtccatttctgaggccggttttcaaaacccgaccccaattcaaacggcttgtattccggtcgccttagctggtcgtgatatttgcgcaagttctgcgacgggcaccggtaaaacagccgcttttatgctgccaattctcgagcgtctgcttttccggtaggaaacggatttacaaaattaatatttttctgttttgcttttagtccctcacggcgaacttctgtcactcgtgtgctcgtgcttgtacccacacgggaattggcaattcaagtcttccaagtcagccgacaacttgcaaaatacactcaagtggaaatttgtcttgctgcaggtcgaatttttaaattattattgctttttaatattcaacgaaattaaacatttaaatgttccgattgaatgttatttttgttttgttatgcgcttccgatttgtctatgttgtgataagacttggcaaaagggtcctcagccgcgcgttcgtttgttttgcgtacacactgatgtagccgatggtaatgagcataattagagcacttaattgttcaaattagttggtctgttggtgcttctttcttcgtacctcgtgtaaaaggcgtaagtgtaatgccaataattgacgaggtgagaggtgtacaggggcacaaggaaatgcgcagtccactggaccatcgatgccagtccggttgcctttcccaaatcactcggctggactgcactgaaattgttggcaactgattgtgattcttgtttccctttgagtggatttgcctcgtgatttgtgtagacgattccgcataagcaatggcataggcacccgtgtgaattgcggttattagcaaatattggtacagtgagttggtcagtgtgatgccggcgtacgcacacagttgagcaaagcatgccaattgcaaaagtgtttttgggcttacgtgtctttgcagaaatggcaaaatgatgaattgcgtgagcacaagtgacacactgaatggccgtcactgattggcaccgtttaattactattattattaccccattgtgaccatcacttccgcgttgtcactagtcgcgtgcatgtacgaacgaagtacaaaattccgcgcaatcagttcataacaaacatatgcaacgatcaaaagaccgcgcaaaataagtccctcgcgcaatgctccatttttggttgtcataggccaataatccttgaattttgtttgaatttggaattggaaaatagagagcagttgcctgaggcctaagtcgtgctgtggcaaggcgaggcactgaatgagtggtgggaaggaaaatcagaatgaccgggatgagaagtgtggccataacacagccattgacaatttgtgagaaacgcagtgttgtataaatggcgatttttgagcctaatattggcccgaaaaacatcgagaatgcctgtggtatggtcagaatcatcaaagagccggttctctcccgttcggttgtcactgttgcgagataca

SEQ ID NO: 3551 - DNA, 916 bp, Heterodera glycines
ataggacaggtcgacgatggagagcacctcgatggtgtcccattggaggaaagagaccaaagttgtggtccaatttgtgccgaaatgccagataccgtatatgaggcataacaccccgagaattctgtgcttcttttcgaagttccagtacattttctgcaattgaattgttggttattgtattgcaacatgggatacacaacagtaagctgtttcaaaaatagtctgatttttgggatgcataagaaaagggcagtttggtgagcggtgcgatttgctgctgaagtggagcacgaagaattccgacggacggaggacactgcccggcggaccggatttcctctgccttttcatcgcgaacagaggcgacagtcgcgcgagttctttcccaatggatttccagttttatccccgctgatttatgtgaatgtaaaatcgatcgccagaagaaggaaaagtgttattaggagttgtggagggtgacggcgatggaggagaaaaaacgaccaattataatcgaaaccggttgacaaaaaaataccagtcacaaatggccgactctgatcattttttgatgaaaagaagatataagcaaaaaaataataaataaaataaattaggtgtttatatttcgtttaactcacttacaaatttaaaaatgattcttcagggggactggaccttaaggcccaggaggcggctcttcgccttggcctggacattgtcatcgcaacgccaggccgactgattgaccatcttcacaattctcccaatttttcattggcaaatatcgaggcaaatttgtcttgctaataaactaactttatttaatttcgattaaggttctcgttctcgatgaagcggacagaatgttgcatgagcaatttactgaacaaatgaaggaaatcatcggact

SEQ ID NO: 3552 - DNA, 4328 bp, Heterodera glycines
attatataaaaaagattgggcttgtgaacgaccacttgtatctattaattttacaatttgttgtcttttttatcttggttgcctctcagctttgatcgccaggaattttcctgaccgttgtattcttttcatgcgtaccgaagggactgtgaaaggatgcatattttgcttggcctttttggtgtcaaaatcggacgattgcacggcggaagaacgcgggcgcaacgtgtctaatgtcttcacgcgttcaaaaagcaacaaacggtgggaagtgctctgtgccacagatttggcagcacgcggctgatacattgagggagtgacaacggtgggaaatgcgacggactgtcctctgacggcaaagggtgtcaacccaaaaaacaaatgagatgattccgcaaattgtagcgtgtgaccttcagaatttcctaggctttctgagttataaagtacgactttgcagcgggacggtcccaggatttggcttgaaggatggtacccggtccttggtgatatcccttttttacactattttttgcatattttttcgccgagtgaaatcccttgtttttttagattttcatctctaaattgctaatttagttgatttttgaaaaaatttagcaaattgattggaaatttaatgagggaggtcttggagggggtaccattaagaattggaaattttcgtcaaaaatactatcccccccttgtcgtcttcttccctccctcaagatatttacattaaaattaattcagctttcgtatatcctaaaccttttaggtcatcaatatgaatatgccggccactttacagcattacattcaccgagttggacgaacagcgcgggccggcaaagcgggccgctcagtttccctaatcggtgaacatgaccgcaaattaatgaaagaaatcacaaaagtgaaccaaatctctaattcctttcaacttatgcaacggaaaatcgagccaggttcgtctttacaagtcaacgtcggactgtcatcattaaacttttcagatgttatcgaggcatactgcaaaaggatccaggaaatggagccgagcatgaaaaaattaatggaagaggagcaaatggagaaacaattaataatggcggagaattcaataaaaaaggcagaaaaacaaataaaatcattgggcggagatggcacgcagccgaaggtattttcaattgaaagcaaagttaggctggtcgaaaacaaattttagttgtattcacggaaatggatcggtggcgcagaaaagggacagaacgccacagaaaagctccgaatccgatcaaaagggaagagaagggaggcgaagaaacggttaacggaagcactccctaaacgcccaactgctgaatttgcatccaaacaacaccaaaaaagcggaaaaaagagtgagcaaatacattcaatggggctttattgcaggattaattcataagatttaactttttttgaatgaagtttacgatgaaaatgcattcaaatttaagaaacgaacacattcagaaaatctcgattagtcccttgaaatttccaaaaaatagtcctgtaaactgcaatagagcctgcctttaaagcaaccttttaaaccaattaaagaatctgcgttcttcactactgaaatcgcgagtgttagtcaaagggcgataaaacgcgtgaggaatgggtgagaatttgtttttaatgtttgcttaaaggcttattttagtccggatgacatcgactttaagcgagcgaaaagagagaaacaaagggatggtatcattcagaagaggacaaaacggaagtgaaacgaaacggtcgtttataatgttacaatataaaaatcaacaattctttgatttggtctgttgttctatgctaattttctggataaaatcctccatttcttgatggtacacgaaagtgtctttgctgaaggcctcctttacagtcctcttcagaactttgaatccgtgcatccacgcgaaaataccttaattgaccaaacagtcagttgaagtatatttcagcattagttcacccgcaataactgcaattgtcgcaacatggggcttaaacggaattgcagaaatgacacgcctgacgatcatccttccgcctccgaacttcctcaacaattgcctaccaaatacagtcatttgctacaataagcaaatgcaatttatttaaaaggcaagggaaatgaaagaacaaaatttattggcgtggaagccaaaagaaaggatcgaaaaccaatcaaaaggacaaatgtttatcaaaacaaagcatcgaaacaaacgcaaatcagtcgtagccctccacaggcagaaacggaacgggcttttcaggattgtaagtggagtgattccatcgccaactcccgcgcaaatgcttcggcgcgtaaagaatggcagtgcacgggtgctgcccttgcatttcgcaaatgcattgctggcaatcaaagaaagcaattttgtaatttcgtttgggtttgtcaatgtaaatgtgttattaccctttcgcagtcgcagccgaattcggccgggttctcccttttgtaactgtccattttcattcgcttccgtacagtctctgtcatgcccaatgttccgattaatgcttcgcttatttgctccctcgtacggcactccaaatcaaaaacaacttctctgccatcgcctaaacatctttatataaatgcaggttttcctctaaaattgtttctgtcgaatcatttttacctaagaaagcttgcgcaaatggcgtcacacaaacatccacgagtttcacgaattgaacgtgagggttcttgaattggagttgggcccagtgccaaaatacgaattctttggccccttcctgggccacgtttgggaaattgtggaaagcaattgcaaagaccttaattcatttatttatttaaattaattattcgtctttcatattaaagccaaatgttaaaaaaaattaccttcacttcctcacgcaaatgtatttttccctgagtaaagaaacaaatatagaaattgttcggaacagtgacttaatccaacctggccaagataataaaaagtccgacggagcggcatagtgccacgcataaaaggaccacgcatttttagtgtttgtttgacaatgcaaagaaaattagaatgaatcgacctgtaaatttaaattaaataaatacccaaatataaatggaattatttgttcgagttgagcaccgaagcaaacaaatttgggtaatgcgggcgataaaacagtgtaaacgaactttgggtttgggtgagttgcgcatgactctatttacctatatttctgtttttggcaaattttcataaatatttttgcattttttaaagcccccccctaaattagagccctaatgcccccggcgtttttaagtgtgggtgttattccgcaaagtggaaatgatagtggtggagatgttttcctaatatacctattttttattttcaaaatttatgtggcgtaaattaattacaaatcaaattaagaagtagcaacagcgggatcgagccaattccctaccggccaattccctaccggccgattccctactaaggcatttgggccatttccataccaaaagtgttgaatattgataaacattgagattaaaacatacaagaaaatttattcactgctttttagacagctcgtcaagagctttcggatgataccaaatttatcaagattcgatcgttttaaaaaagttagaagtgtcaaatctctcaatttttcgagttttgaaccctcctaaaaataggttctaaacccatttccgcaactcccggggaacccgaaaccgggctcaaaatcccggagctttagggacttcggattcgtaaagtacctgcttgtatgaaatttgaataattaaaccccggccttacttcctaattttcggacccctggaagtcctacaaagcgatttgaaatcaattgtaaattcgaaaaaaaattcacgatccaatttaagaatccggagactggataaagctgctaaaatagacaaaacactattttaaaatttttacttcgatttgtgaaaaagtatgaatggtcattgttttgaagctttgtacgtttctttttttgttagaagtattttcattttcttctctgcaacattaaacaaaaaatttattgttttataattcacgagaaacatcaaaatgttgaaaatcccctttctgtttttgaaattttccgaaaatttttgaaaaattttttggtacgaagatggcccaaatgccttagtagggaattgccggtagggaatcggccggtagggaattggcggt

SEQ ID NO: 3553 - DNA, 3314 bp, Heterodera glycines
  misc_feature (1267)..(1267): n is a, c, g, or t
  misc_feature (3306)..(3306): n is a, c, g, or t
ttgatcatcggaccgtttgcattttcaccattcgttcctttgtgggtctctcctcaacattctctcgtttaacttccccctttgctccccgtcgacacattcgaaatcatcgtccaaagcttccccataaacgaatcattttcaccagcaaccgaatgttggaaactcaaatccatcttcaaatgtaaaggactgttaattgtccatgtgtacccgttggagagaaaatgctctctcttttagtgttttttcatccttacactttggttcggtccgtccgaaatggcactggcattcaatggacgcattccggcacgagacgaaatgctgagtcgagcccggctgaatgtaaaggtggcattaaaatcgggacaaaactacgccaccttggaagtccattggttttgtattgagatgttgaagggaccatttgtgagtcgtcatggatggaatagttgccgtccaacaaagagccgttctgtcgagaagtgtcatgaggggtcacagaatgtcgcgggatgagcggagttgcacttcgggaaagtgacaaatcgtcttccagcgcttccttaaacaagtgctttagatcccaacttatcccgacaatagccatttactcacgcggtcttggcacggaaccacgccgatcatttgcccttcaaaaatgctgccgtttctgcccaacgcctgttttgcatggattggagtggagtagcgaatgtgcacccaattgccccgttttggagtctgaaagtcaaatattggcaatattttctagttttgccatttagcgattgaccttttgtgccattatatcgccgtggcgagaaaacagttccaaaatgtgttgtaaatggtcaggagaaaagccaaagacggtcacccagtagcagctgtcctcctcctcctcctccatttgctgctgttctcgttcgtccagcatttcgacagaattcgaacccataaatttttctcgtttttttaattccgctggtgaaatggttgcgctcgttcgagtgcccacaggtttctggttctgatacatcgtcaaatcagtcgatgaaacattgtcgggtcggaacaatttctcaggagggccgacgacgtcttcgttaagggaacggagaggggggcctggtgaaaagaggaaagtgtactcaacaaaaagggaatttcggtgcgaattcgaccgattttcatcgctctcttcccaatctttccattgtcaattgaaaagatattccaatgcaaatgtctgaccattccnaagtccggaaggcgtttgcttgtcgctttgtgccgaatatcgagcagaagcgaacttcttttcatcaatgggcgatttggagcgctctctcacaagcaccggcgaccaatgcacacttttgccagtgccagaagcaatcccttcgcgactcttcaaaattcctggtgatccatagccttaaaattcaaagaaatgaaaaattggttaaaaactaaaaaaaaaaacaactgacagtaaacttttcggtttgtcggagtcccaaaactgcgccgaatgtgcgccggttgggagccgaaaaggaaatttggcgcaaattgcacttcctgtgagtcagtgacagtctcaacgggggaaatgttagacgaaggactggcggaagcgaaataattagctgtctgcgataaagtcgagcagggagaactcacattttgagtggaaccaaacattttgcttggataaaaaattcacttttatcataaaggacgagaaattatggcaaacaaaatatgtataagttaaaaacccttttttataagaaagaattgatggcaaattttattgcaaggcaaaaaatataaattattttgttgttatgagatcgtaaatcagtgaatcggcgaattagatgtcatttcgttgtcagaatcggcctctaagtcctcaaattgctcatcttgctctattatatcgacgaaatcctcctcctgttcctcaagttcaacaattcgtacaacagagcgaaattcggcattcctttgaccattcgcctgggttgtaattgccttcgatccttaaaaaccgatattatttagtctattttcgtaattttacttggagagcatgaagtgatcgtattccaagcataagctaatgcatgttgagtggcttttgacgcgtaatattgagctgaagccatcaaaacttctcggttcggctcatattcctggagaaatggacttacgaactaaaagaagtctaaaatttaaaaatgccaatatgtttaattactttttggtaaatgtgctcgtaaccgacgagataagtgtaaagaacaacagaaaacttcagaaaggagtaagccggaatgaaatagggcaacgaaaacaaattggccacagattcgaaggaaacccatgctgcgaaaacaatccaatattttgagagaggaatcttaactgtcgaaaaattttaataacccaaggaaatgaagttcactcactaattgtcttgatttgcgactcttcaaaaccttccaagtacggaacatcggcaagacggcaccaagaataacagtggccaagtcgaaaataaacgacaacattgggccacaattaacttctttaatgaacggattgagctaattaatgaatgagccataaaacaaagatttaaaaaacagttcaaaatacattggatatggagcagtagaacagtaaaaggctggctggttgacttaaaccgaagaacgaagccggattttttaaatattaaatttaaatggcataatgttttcatgccaatttgcgccatgccaagcgccaaacctaaaataagaaatcaaattttttttaacgctttaaggccacattcccaatccaattggctttctacagttttataagcttcatattttaattaattatatttaatttagcgtatttctaaatggtgcgaacacgactccaaaaaacaaacaaatcgaaaaaaactggaggagaagcgaagagcaaacgaaagggagagaaaaaaatggaagaagaagaaaaccaggaaaaagaaagtaaagaagaaaaaagggaggaagataaggaaatgacaagtcaagaaacaaaggacatcacaatattgaagacagtttcaagtacggatttggaagaggtaaatgaagtgttaaagtcaatcagatgaacttaaagaatgaccttttaaggacgggaatcaaaaggaacagaaaatcgaacttacgaacgaatcagttaatgttgagaaaacaccgtcgagttagggaaaattgacttttggggagaacttgaaaaaancggtggaa

SEQ ID NO: 3554 - DNA, 2573 bp, Heterodera glycines
tacgaaattatctctagtgtgtaataaataaatattaacctatgaaaactaaaagaatattttttaggcgggaaatgaacacaactgccaaaaaacagctgaacaaccgaatgacgcactcgaaaatgacattgacaaaaaagtgaccgattttcaaacaatggtggaaacgacagaggaggacaaccgaagtggcactgccaccttcgaaagctttggcaacagtgccgagccgacaccaatggaaacgacaatttaccattcggcaaaagaatcctcggaaattggaacggacaatggacttctttcaaaaatggcggaaagtccgccgaaagtgccgccactcactcccccaagcattctgcgaaaagtgaactcccctggtggcaatggcgtcaaaaaggtagcgggaaagggtgaatttggtcaaatgcttcaatagattcgacgcgtccaattcaaagaagacgaacttggtcccggcagaattcgttttggtcgctccttttcggcgtcaccatacccaaaacgggtacaactgaaaacggatgggcagggcactcatagcattacagttttttatgcttttagctgcttgaacatctcgaccaaagcacaagcgaaggcgccgccagtccatcggctgacaatgagtcacccgccaagcgaccgatgaaagcgttcggacagatttggcccatcgccagcgccggtcgaccatcgacgaccactccaacgcgttggtccaagtcggccagaaggcttttgccaattcatggtgatgccattggccgttccaaataaatctcatttttcgtccattttagaaaggggttcgccttacgatgcgccggagagtgtgcaaaaggcgcagtcgtcggacaacaaatcggaccaatctgagaacaacagcaacgacaaacagcagcacgtggacgagcagctcgagaaactgccacggatggacgagcagcaaaaagacgatgaaatcgttttggttgggtcggcgaatgtttgcgttgtccttccggaagaggtgagatgaccccgatgatattataaaatcattggaaaatttttttaaaggaagccaacgaaaacagacatcagcaaaagcgggatttcgagcaaccgaacgaaacgatttcaaatgattctgacaaaacagcgaccgatttgggcaccgtttcgaaggaatctgaagagaatgccgtgcaaagtgaagcgatgtttcataagaaactgacgacggacaacaaatccgaaacatttgagagaatcaaaaacaaattggacgaacaacaagagaaattgaggcgacaaatggaggcattggtggaggagtcgacgaagcgaatgttggcaattgttgcggaagaattggcaatcgctgaaggattggccaacgcaatgccaacaaacgacggacaataaaaggcggacggaataattccgaaaagggatttgacaagacttaacaattcattgtgcccttctgatactttctttgaatattcatttcctttctccgtttttgacgtgtctttgtgctgtttcctatatatttgattactgaccaaccaaatgtacgacaaatattattatataaatagtccgcacttttatgtactagctagaaaagacttaataaattaattaaagcagcttcaaagtgaaaagtttatttaccttattgggccattattatcctgaaattcgcataaaaagggcaggaaagggggcggactttgtactttattgtaaatggtcataaaaatggagtaatatcaactgattgcccattgtctgactgagaaagacgctttttgaatgcattcatcagtctcgaaatagcaaacaaaaataaaaaaacgtgcgggactgaaaatgatgggtcggtgaggggctggaggataaagtcagaaaagaaaacagggaaatccattggatttatttggttggttcgcttttccattggtttatggcacgccgttggtgcaacactttttggaagccatttcggaaaattagcatattgaggaaaaagctgaagatacgtacttctcgagtgtttcttaaatttgttaaaatattttttacaaatcaaaaatggatgtttatgtaaattcttttttcaaattcgccgcgtttcctttcgttctttggcattccgtcccttccctttccttcatttctctttcgttcatttttcgcttatttgtcttatcagttccgcgatccatttagatgccaatgcgccgccttttgccgctacttcgagcacttcgtcgtgcgaaacttccacggggtcatcggagtcgacgctggagcaattggtgatcagagagaagccgaacacgcgcatgccgcactgccgggccacagtcacttcgtggcacgtggacattcctaaaaagggggagggaaacgatcactgagagatttggaaaaatggaagaatttagtgatcggacaaaatgatcagtgagtgggtgatcggataaatgcgaatcagtgtatgatgggacaaacaatggactaatcaatgagtgatcggcaaatggacagtgagt

SEQ ID NO: 3555 - DNA, 2243 bp, Heterodera glycines
accgacggcgtcgccgcccatccgcgcgattacttctaattccgctgccgtttcatactgaggacccgcattcatcacataaatgccctcgcgcaacggcactttcatttgacggcccaaactcatcgcctttttcctgtgaaaagcgaatcaattaagcggaaaaggaacattgattgcttgtgagcagcaggactcaacctcaattctttgtcgtacgcattatgaagagagacaaaacgcgagccgaaacgggggtcggaaatgccaagcagcggagagtaactgaagggggaggggaaagtgatcagattgatcattgggatgaaataaaaaacagaaggtgatcagaatggggaagaagaaaaagataaaggtgatcagcaaaaccgaggaggaaagtgatcagagtatatcgaagagattattgttttaagtgggcaatttgcttctcacccggacagtccgggcagaaagatgtgatctttgatgaccattaggtcgcccgtttggaagtcgccgttcagtgcgccggctgcgtttgagacgatcattgtgcgaacgccgagaaaagccatcagacggacgggcatcgtacactgaaagggcgggacagacaatgagggatacggtaggcaaaggaaaagcgaagcgaaagctgaccaatgccatgtccattttgtgttcgtaggggtggaaacggccctgaagacacatgcaaaagtgaccaccaatccgaccgaacaccaaattccctacaaatcatcgacaattaatcaatcgcctctgatttgttttgcctttgtgcccaataacactcggctgtggaaagccgggcacctcggagaaaggcaaaatccgcgccccctccatttggtcggcaattgcgcccaatccggagccacagattatgccgaactcgggctgcaaagtgccaaggtcggccatggaacggatgagctcactcagacggaccaaatggtcgaagtttgtcggactgaaaaagccaaaagtgcgttttcccattttttaagcattttcttaatagcaaccccaaaacccaattattttgaataagatccaaaggcataaaatattaaatgccactcattgtgccgcctcactcaattgggccccttcggcggtccgattgaatgtcttcgatggaattattgttgcagtcattggccgcggttggcattggcacggcgtcgacaggcgaaatgccaccagcgaattcggacaattgctgttgaggatgttcggcatgcactgcttgtgaaatgccgaacagagctataaaaaagagagagattttattgtaacgaattattttattttaaaataattttaaatgttcaatcttttcatgcatattaaattagaatatatttcaatttcgaattcacttttctttttcctccgtccgccaccgccggtggatccatttttattgacgagaatcggctcaacaacagtgccaattccaaaattgttcacttttgcgctgtccacaattgatgccatcggcggaatgatttgaataatttacggatgaattaattggcttaaaattttgggaaatatccaatttttgtgtcaaattgagtttttgtttgatgatcggagaatgtacaaaaaaagtaatagaacaaacaaatggaagagaagaaataaaaaggccgaccgattcagaacgaaatgaacaatcgaattgttggccccgtcaaatcattagtaaaatgaacggattaaaaagaatgaatggtaattggatttaattgtcggcagatcaaacgaattaatttgaacggaaagagaacgaatgaagcaaaactactgctgctgcggttatttgggtgggcatttaccattttatttatttattttctttttgttgtgctgacaaatgaaagttacggaaaaaatgcaaaggaatttaagtgcaaaaatgatgaaattgacaaaaaaaaaactgatcagtgcgtgaaaaaatgataacaaaaaaaatgcaagggtaattagctaattagaggcatttggggggtaattaaggggtggtcgtttgggagagggggtaattagaagatacagcaaattcaatcagcagcagtaacagaataatatgcgtatgactatagtgataattttaactttttttttggtcataaaataactgataaatgggcgaacggatgaattaatgaatgattaattaatgaatgatttgatcaccaatctcg

SEQ ID NO: 3556 - DNA, 1765 bp, Heterodera glycines
  misc_feature (879)..(879): n is a, c, g, or t
atttaattcaaatttaatttgaattccgtcgttttatttcgcttcgtctgtccctcccccaaatgattcacttcgcttttcgacttgtgactttcccctaaaaagggcatgatcaaacgaccaaaatctgagcacatgtcacagtcattctttacaccgcaaccgaaagtccaaaatggtctcaaaattggcgtgacaaatgaacaaattgaaaagggagagaaatggccaaaaacaggtcgacgaaacaaaaaataaaaaataatttattattaattaataaccgaattaattataggaataataacaataatttttgggtattacgaattaatagaatagaagaaaagatttttaaaagtaagataaaaataaatgattactgttaagtgttgttaagacaaaacatcgacagaaaaaaacactggggaggcaatggccaaattaattggcaacggaaaatgataattatggtaattaattactttgttgattaatgtaacaaaatggtgactcgatcatttattaatttaatttttattttttatatatttaattttaatcctttttgtattcaatggacaaaggaaagtgaccatttatccgtttgtcgctgtgctgtccttcttacgcttctcttctgactgtcccaaagatcatggcttagaaaaaatggccaatttcattgacaaacgatgggaaaggacggaaagcgcggaggaaaagcaaataaaaaggggagaaaatgggagacggacgaggggggggggggggatttgggccgaaatggacggggcgatattcacaaattggcatcggcacatgagggacaacacagtttaaatgtaatcctcggaccaaaaattaaaaaaagacatntcgtctcacttttcggcgaatgccattaaagtgcaatgattggatactctgatgagcaaattggggacaatgttatcatatcatcatatcattgccatggtcactttcactttcgcatcattcggtgggaaatggcggcgaattcgccgatcgataaaaaaaaattgacaataattacaaatcaaaatttacacaaagaatttccgaaacaaaatgccaatattcattcagatatgtaatttttatcgctttttgccatttaaacccttcgctgtgccatcggtccgtacatttgcccgatttgccccccgaaggaatgtccggtgccgaatccgccgcccattggcattggcatcggcattcgtggcattgctccacccgcgaactgtccgcctccgttcaaagggcctacacttcgtggcggaaaaccaccggaaatgagaaaatgatgtagattaagccattgtcaattggacatttcggacctccgccgatgactccgctgggccaacccatccacggggtggaagcgccggaacaattgcagtccaacccatccgccaaggacagcacttgggctgaacataacgccaatttgcaaattcaaataaaactgaccaacggacacattcactcaccgaattgttcaaaggccgtctttccctgctgagaacgattgatctgttcttgcaatttgcgcacttgctcttgaagcttcaaagaaatggaaaattaaattagaaattgcgattagaaaattggcgaagggatagaaagagaggggtggagggagagacggaagagaaagaagggaagagagagaaagggctggagagagaatggaaaagggagaggggagggagaaaggaacggagaagggtgaaag

SEQ ID NO: 3557 - DNA, 1190 bp, Heterodera glycines
agttcaccaaattgttctctttcattctcgcctccgctttacccggccgcctcatgcggcggaacaaggtcagttcagaaggagatgttgtcgtatgccaccgattggagaagcccttttctctctcactctcttccggagcattggcactttccaataaaacatttgtccgtcattttgccattcccatggattccctccccctcccctctcatcagtcaccctttgctctttccccccccccccccccgccttttgccgcttcctttccctctgcccttgcgatttcattatcccttttaatctcagtgccaattccatccctccaatgttttcttatcgactcccctccgcataattatccttttcgtcttcctttgagggagtacgtcttggcaaattggccgaagagtgaggaaagaacccctccggggtttgctttgactctttcattgccattgctccgacaaatgccttccggtaatttactctctctctttttctaacctttcaaacaactaaacgccagataatgtttgaaatggcaaaaaagtcgatcgatttgtgctatttgctgcggactaatgtccaagaattcaattagagagcgagaaaggcactacgaatagatcggcacatttggagggggcaaaaggggaagaagcgaagtcgaaccccgagacacatcccccgggggaggggcggcagataaataaagggaaggcgaaacccaatttaaggggcgagaaatgtgcgatggaaaagccgacgaaagggagggcaaaaggtgaaaaattaggaaaagttggaaaatcagagagaaacaaataataataataggcataaattgaaaatttatcaatgaacgaaagaaaacacacaagattttatgaaagtcccaattaaaaaattaatcaaaaaaaaacaattaaaataatattacaaattttattcttttttttgtgttgtcttttcactcttctcttcccttaacattcccttggaagggtaagacaaattgcaaattgaattgaattggtgccgtcctcagggaaaatgacggaatggtcgagtgaacagagaatgactgaatgccctccctttccttctgacggggggggggggggcgtgaagggcgactctcagcaatgaaacggacaattcaattggggaattgacgtggcgggggg

SEQ ID NO: 3558 - DNA, 4049 bp, Heterodera glycines
  misc_feature (6)..(7): n is a, c, g, or t
ctgcannggtcttgagaaataaaaaactaaggaattgaattgtatggttccatttttagataaaatcaccagttaatttgaattcactcattttaaaactagaaaagcactgtggttactgtgaatagaattccgaaaaatactgtaccaatctggctggtatttgttggaaatattcatatttaatgaattgtttcaattttttttcaaaggccgagtttatgtgcaaggcatggcagatgatgaacgatgcgcaaggaattttgcatcaaattcggaccaatccaaattttcgatgatgattcagaacggggattgcaccagtaaggaattagctatttaaattattgtaaagaagttgaaatgggcggtaaaatttcgaaatccataaaaggaatggagggagggcgtgccacccggtagctcaatggtagagctgcccacaaactcggtggaggcgtgggttctattcccatccgagcctgagagctagagattaggttaatctcaagaatggattaaaacatggcacagacgccgagaaaaagaagcgaaattgtgaaaaaaaataatttaatggcacaaattcagagacaacatctctttaaattgcggggtcatcattgtttaaatagttaatttatacatgtgagaaaaagaattttttgtcaattagatgtcatattatgacttcgttttatgaatagaacagaaaagtgccaaaaaaagaatttttattaaaatttttagttaaaattaaaattttcttaaaaattttcgttctgagattttttattttgttagtgcaacgccaacgcgtcaccggctcgctggagggcatgatgctttcattgaccattgtggtgtcatttcatggcacttttgtcacacgttcggaccgtgcctatcgctgcatgtgcttcttccgtaacatcaaaacattgacaaatgcaattgacgtgaacctggcggccaccacggaattgttaggtaggcaattttaaaaaaaaattttaaatttttaaaatggcgcgctctggcattttgcagaccctgccaagaccccgtcaccctttctttccttccaccatcagtggtggcctggccctcctccctagtaaccatttgaatgttatcccaaagggttgtccaggggaagaatgaaaggcgggggaaggaatgggctgcaaactctcaaccgcctcgccattgccccacggcttctccccccccccccgcaacccattttatcttcgccttctccgattcacaaaaattgctgtcccttggcatggaatgggctccgacttccttcaggtgttctcctacttccttgccaatgtgtccgattttgctcacccctggggtcagtcattgtgtcaatctgtcgccactaattaagtcgcttttcctacccaaaataattcccccatcattcgtttcgctttttcattgctccttttacgttaagcctatcgcctgcactgtcacagctgcatgagtccctatttggaggatcagttccaattcatttcgcacctctaccgacggcccctcgtgttcagtgaaaagtgcgaccacggccaattcgactggcgatacatcgccacgaaaaactgttcagatgcatgtgtaacactgcgaatgaacgacagagtgggcggtgagtggagacggacagacagacagagacaaaaagggaattttagagagaggggaaaaaaggcaaatgaggaggcgaaaagaatgattgataattcacacagttttagtaattgcttctgttttcccaggccggcgccgtttcggctttatgcgcgggtgtctctccgacattatccaccacaatcgaacggctgtccgatttggcgaactcgccaggacagcaaagtcgggcgcaacaatatgctcggctatccgactaagggatttgttcatctcttcggacaggtcataggcaatttctgtcgaaattggcataaacttatccattgtttaggtatgccttcgatgcgcatgatcacatcgaactttgtgcttgcattcggtccaattgcaattccgccaccaaaaaatttggcattaaaaatgccattttgggagtgatcagcacaataatcagcttcatgtttttaataaggacatcgtacggaagtgacggaacgaattcatcccaaaatgaatttaatgggaagaaaaaagtcataaagaaaataagtgaaaaagagcaaaggaaaacaggagaggacgagaaaaggagaaatgaaaagaaaacaaagaggtggaggaagaagatgcgagagaaaaaggacgaaggaagaaagaataaaggaaaagaagagacggcaaagacaaaaagcaaaaacagacgaaggaagaaagagtaaaggaaaagaagagaaggaaaagacaaaaagagtaaaggaaaagaaggaacggaaaagaagagacgaaggaagaaagaagagcagaggacaagaagcgaaaacgccaaaccaagacaaagacgggtcgaactttgtaaaaagaagaagtgttatgttcaaaacctcaaaattttaaattgctaaatttattttcattcttttttattttcacatgaattaaacatgaaccagaatgtttaaattatttttgcgagtcacaataattccccacatcgacttccatttttcctttcttttcaaataatgaaaatatttattaaacaaaaaaaatgcaacaaaatattgtcaatgacttacgaaatcaaaggctgtgtgtgctttatcagtcctttggctttcatttttgggccccaatttttgcctttattgtcctgaaatcgaagcattccgatgaatttgctctttgggatggaatccggatgggtgctgaagttgatttcacacctaaaaaacatacgttcactaataataatcatggaatgggtcggtcggacttcgtttccttcgccaaaatgcgactgcgcggactgtcctcccccgcctcggccattcctttggctgtgattccgtttcgttttgcctgcaaaaatggaacggactgatcatttgcatcggcactctccgcgtgctcctctcacccattcacggcacacgtcccacagaaaagaggtcggcgcgtccgttttgactgcccgcggattgcagtgggagatggagcagcggaagcccgcgttgagcagggcggaccggaagacgttcattttgggcgaggggcacttcatgacgaccatcagctggtcgtgttcgtagaagaggggcacgtcgggcagttcctccgacagaaccgtcagaaggccctccaggcgttcacgagtgccaagtctcagctgccccgcattcgggcctttcaatctgaagccaatcgcatccgaattagtaattcattgacatcaccgacattgcgagcagtttcccgacgaattcggtgtcccacgtcggcgccacccaaatggggccgcccgtgtgaatggccgtccccccacaatgcgcgcatttggccaccattcgtccgtccatcgacgcgtcggactgtcccgcggggagacgaaccaattcggactggaaatgggcggtggagaagcgcacgctgggcccactgacactctttttgagcagaggctgaaagtccaaactttggcagatgccgcagcagttcacattggcgagttttctgaaggaaagacggagacttattattttgtgcgtttaaaattttcgttttttccttattgggtacatcttccaatatctcgtgtacccaaattttccccataattagcaattttacagaacaattaaaactaaattttataaatccggggaccatcccagatttgaggggccgaaagcggggggggggggggcttctcccccatgaacttcgttcgtatggactcggatcgaccccaacttttcacaattaattagtgctacaaaaaatgagtcagtcaaaatcccctaaatttgtcctcatttttccctaaacgtccctaaaagacaaaaagagaaatgcccacgtcacgctgtctttggccatcgcag

SEQ ID NO: 3559 - DNA, 995 bp, Heterodera glycines
  misc_feature (40)..(40): n is a, c, g, or t
  misc_feature (966)..(966): n is a, c, g, or t
ttgcgatgtgccatcatcaaatcgctgaaaggacacaatnccaagcgaaattaagccgaaaagtcgtctctcaaacattgcgtcggaaaagaccgcctcgacttgtctgggacgccgttcagctgcacattccgacggattgcttcgaatgccttctcggagaagtcattggccaccactcgcgtcacatttggcacttccaacgcgaagcgaatggcgcgcagaccagaagcggacaaggcatcgagcacagaaaaggcacggggctgctgggaggcgaaaatgggcactttcaatgactaaaaaatgcttacggattgcgctgcatttgcttcgggtgcttttccctcgtccattttcctctgtttggcttttgggccctcctcttccgttttcggctctttttcgttgggtatttcggcagcgaatgccctcaaaacgacgaccctaaactccttaaggtggaaagagacgcgcccttcgctcggcttttgaagccttacgtcaagtctcggttgaactcctgcactcggttgtagaaagtctcgccgccctccgccgtcgcggtgattctcgccaatccctcggtgacttcggccaatttgttcgcctcacaatcggccgcgactgatggaccaacgccatttcctttctcagttgcgcactgcaaaatgactgattcagcaccatccattttcgtcaaatgtaggtacgaaatgggtacaaaagaaaataacaataaatttttcggcactatattgaaagtgacagtttttgaaacaaaaggggggacccttttgttttgcaaaatttttttaagataaaaaaccatgataattttttatccggggttttaaaggtcgctaatcacgaatctgacatgtattttgactaatttctaatccctaacccgaactcgaataaaaatcgaaattttgaatttttaaaattatgattttttgttcnaatttagattaggaaatcggaattgatca

SEQ ID NO: 3560 - DNA, 2877 bp, Heterodera glycines
  misc_feature (2830)..(2830): n is a, c, g, or t
tttcagaaaaaaagggatttatattttctgaatcctaaatttaatccaacattaaatttttcccggaagcgcccaatggtatcgcctgatcccgaacttttaaaaaaatgtccaaattttaggcgtttaataaaataaaatacatttttcatcgaattttaatttctgtttaaagaatataatatgggtcgttgaagtttatgaaattacaatgtatggtttaatatgcttgtgttggcataactttgaatttcaataaacaaattcggtaagtcagcatacaaaaattccttgtaaataatttttaaaaacttcggtgggtctcttctcgtgattacctcccgcagattccgcattcaatcaatcaacaggaatgtctaaataagcaaacgatattttattgcttctttgtcagtaaagaatcgactcgagattaaaagtgcattgtttctctccatttcggggtgtccttcccctccccgtctcgtgttttctgtcccctcaaaaccgtacttaaattcttcatcaacatcttccaccagtgctttgttgggcgatcctggtcgagcaaattcttgaaggtgtcatccttaagttggtccgggagacattgggccaacgcctgaagagcacgattattttcggagagacgatgataacagcggatgaggtgtttgagcaaacgatgtgaaggctcttttgacaattgaatgaccatttttccctgagaaaatgggaaaagcctaaaaattaactaaaattcaaatcgtttcgctcaccaaaacaattgcgacgtgggagaaacgttcgtacgtctgacaaacataagaaaggccgatgtcgtcgagaaggattttctgaagtataaaagttgcgacagtgcgagaaagctcagtgccctgctccataattcgtaagcaaatgggaatgatttccgtggacagcaagaatttgacaacctaaacgaattccaaacaatcaaacacaaaaaggggcgatacgtacatccttttcatccgttttcaccagagcgccaaggacaccgagcgaagtgagacggaggtactcaaaaggacgagaatcgctggtggtgtgaaggaaagggtaaaggtacaacggaaccttagctaaaaggaaagaaaaaagagtaagcgaaagaaaacaatcgaattatccagcattgaaagaataaattttgatagaatggtaaaacatccaaagaaacatagtgttgatgatagataaaatggtcagactaactccttcgggtgaacggaacccaaaaatgcactgaaaacgggagtatttggttttctcccatcgccccaccccccttagaaacttttgaaaaacaaatttcttaatttaattttctaacttcctttccaataaaattaattttagatttttaatagaaaaaaatatgtcattgtctgatcagatttcccttaatttgtatttcatttaccgtccagaaattgtttgcgggtgttccgatgggaggcaatgcattgcattagtgccaatgcgttgcagacgcggtttgactgggcagcggtgagagtgggcggcaaaatgaacgggtaaatgctaatgatctcttggagaagcacgctaaaagccgaaggaaatgcagtttcagttggaatcaaattggagcagcacctcactgtcccataagagaaccacaaccaaacggcgaggtcctccactccctcgcgacgtttgctgaacaaaatgtgtgattatttaggcatttgaaaacggatttttgaatttggaaaaaacaactaccaaattcatcagttcttttctttttatttatggatagtgggaactaaaattttattaataaaaacaaaaaactgttcacattttaacaggatgttttttattatgtcgcattcatccaaaatttttataaaatttgttttggcttttatttgacagagtctgccttaaattgcgttaaaaagaacggcaactccccaacctaaccttatctgcaaaagtgcattttctcgcttttcgtgctcccttagttcgcgaatccagtgacaaatttgttccgcgtccttttctttgctattctcttctttattattggacgacgctgttgctgaagttgtcgttgtcgaggtcgactgagcattggcaatatttggcgatagcaatttctccattcacttatacaaatccgctgaaaagaaaatggaaatgatttttactttatttaggcgatcaaaggctttttaaaggaagttgtttatgtcagaccatggggtaaacccaactcatccaaacccaactcatccaaacccaactcatccatacccaactcatccatacccaactcatccatacccaactcatccatacccaactcatccatacccaactcatccatatacccaactcatccatacccaactcatccatagcacgatacgagtcgtcaccgtggcatttaatgccacgactaagactgtacaaccaaaaaatgccacgaccgagaccgcataatcaaaaatgtccacggtcaagaccacataagcagaaaatgccatgccacgacgatgactcgcagcgttatggatgagttgggtatggatgagttgggtctatggatgagttgggtatggatgagttgggtctatggatgagttgggtatggatgagttgggtatggatgagttgggtatggatgagttgggtatggatgagttgggggtgactctcagaccatgtttaaattttgttacaaacaaaaaatgcaaaaaaaagcatcatgccaaaaaaagtatatttgctcaataattcaaaacaattncaacttttaagagcttttattctcaaaacagattaggtatacctaat

SEQ ID NO: 3561 - DNA, 886 bp, Heterodera glycines
ggaggaggaaaggaaggaatgccaaagagggggaggaggaggaaaggaaggaatgccaaagagggggaggaggaggaaaggaaggaatgccaaagagggggaggaggaggaaaggaaggaatgccaaagagggggaggaggaggaaagaaaggaatgccaaagagggggaggaggaggaaaggaaggaatgccaaagagggggaggaggaggaaaggaaggaatgccaaagagggggaggaggaggaaaggaaggaatgccaaagagggggaggaggaggaaaggaaggaatgccaaagaggggggagagggagggcagaaatagcgatgccattggaagaaaatgccaaaagggtgtagaaaatgccgttcaattgaggcgtggatgaggggagaaattgtgcggcgatggagcgaatgtgcggaagcatcgcacagaaagaaattatggacgcattctgcaggaaaacgtgcaaaatgtgctgaattacgaagagaattctaccgaaagagaagggaaatccatccgaaaaaatgcgattaaacccaacagtcattagcaaattacatttattaattgttctgttgaacaaaactcttttccccctctctcaacgaattgcgaaatgtttttgcattaattaaaaccctcgaggcattgaaacggtttatcccttcacaaccaattattaattacagcacataaattaattttgtaaaggaaataataattattatttaagagagggtggtaattcaatttgttcgaatttttcttcccttttccaaatgatattttttccaaaagttggcttcattttcttttcatattatttgttcatcttcatattgttgctgaattcaatggataacgacatattatttc

SEQ ID NO: 3562 - DNA, 2093 bp, Heterodera glycines
cagcaaaagtggacacttgcgccgctcagcaaagtcgacacttgcgccgcggatatttgcgccgctccatttgcgccgcgacatttgcgccgcccagcaaaaatggacttttgcgccgcgctgtcaaaaatattatattcataaaaattccactattatcaataagttttactaaaactataagccatcgacaaaaataactaattgaaaattcgaaaaaattactaatgacattcaattttttaaccattaaatcttaacattgaataggttcatcaaagatatgaaaaaatgattaagaatacaaactaacaaaaaagtgaaaaaaaaagaattttctgtagaaaccccaattatttttttgcttcgaaaaaagaatgaaattcaattcctttgtaattaatttgctcaataagttattttcatcgattttaatttaatttcattgaaaaaacgcactgattttcaattttcgttcctattttaccatttttcgcattatttcgcaatttttatgcccttatttatttacctatttttttcgcttaaaatccgccgcttaatgatcaggcaatacgaaggcttgttatcgcatatggtcccaatgaaaaccaaaatgatcaagatttgatcaatcattacgtgcacttcaatatggaattgacatgaaaggcttcgaaacaggaattaataatgaatatctatcaattcttattctataaagcacataaatttattttaatcagagcgcaaatatcttttttcgctgtacggcgcaagtgtcgcggcgcaaatggcacggcgcaaatgtccgcggcgcaagagtcttttttgctgagcggcgcaagtgtcgcggcgcaaatggcgcggcgcaaaagtcggctaaccgtgaaaatcttctgaaatttgtaaaataaattttatctgaactgcgactttttgatgattttagatcaaaatttgacaaaattctgaagggaaattttcttaacaaaaatgggcttagctttaaacttttctagaaagtgaaaatttatttgattaagaaaattttcattaaaatattgccaacagttcggtgatttatccaacaaattctaagtccgatcattcatccattcactttgctttctctcctttctgttgtccgatcgtttgtccgtcgattgatcagatcagcgaccgatcaaattccatcggctcaatttgactgtttccattgctgtccatgtggccaaaccattcactgttctttgccaaatggtcagccgaagtgccattctttgtctccaccaaatatgcaatggcttccttcatcgaaatggcaccgcttttgtccgcatcaacctaattaattaatattcaaaaataaaaattagttttaggggcaaatacaataattaccgtatcaaaatgttttcgcgcagtttccaccttcttcaatgaatatacaaatggagagttttcagtgagactaaaaattgtaaatttttatatgaaacgaatgctaataaaagagaggtgtataattatgtgaggggaagtgaaggagagaaaagagtgagcgctacaaaagactcagacagttagagaaaaaaaacgagagacacagagtgtccaattggacatttggacaaatgatgaattgcgaattgttcaaatatttactacccaaatgttcacttttcaaattgtacactgtccgaatatccgggatccacccgctcccttaatgggatcgtacccaattttaaaagcagatcgtatgaaggcatataattatataattttcagttttttcactaatttttagaggggggacattttgactcattcacggaatcccgatttccgaacttctaatttcgcgcatttttgggggtcggaatgccgagttacgaaaaatttttgagcctcgtaatgacatctcttatacccaatctctctactttacttgctacttgcgagatgcgaatttggcttgttgttctcccggcaaccgccctcttcgtccttttggcaattgaggcacccttgtggacagtatttggcgtactgtttgtcgcaacagtaataacaactgcagcgtgttg

SEQ ID NO: 3563 - DNA, 2332 bp, Heterodera glycines
aataaataaagaccggacttttaggcacgaaaatttctcaaataggcacctaaaataggcacgaaaaatgtgaaaaaaatgttcaaaatagaaaaaaggataaaattcgatcctgttgtgttcttgccaatgaacacacaaagaataaacaaatatttattgatcggtcggtggacaatgcaaaaatataataaaaacgaatgaatgagggaagagacaaagaggaggggaatggtctccttataaacacaatgagaaggggggaaagggcgtggagaacaaagtacaaatatgaaaataattaaaaaggtcaaaacgccaatttaacattcccaacacctcccttctcaagcttctaactccttcagcggccggaaggcgagaagcgaatcaccggcttcggcttacgctgcgatcgtcgaagagccattgtcggcgggtcatttgcggcttgttgatcagtccgttgatcgaccggatcagcaatttgatgcgccaaattttgagcttgtccgttgactggtggaattggctgctgatcgggaccaggattgtgtttcgaattctcttcgaaaacacaatttcgacgaagttggttcgaatgtcggtggacaattcgaccaagaactggtacatggactcggtatgtaggcgagttcctgactcgctctacaattgtaccatggagccaataagttttttggttcctgtagttcaaaaggaggactggttcggcggggaaaaagactttttctttggcaccatgccgttcatcgaattgttttgccattttattcgaatagtcctttcttcttttgtcgcgctgaattttgtcgatgttctccgaatcgtttcggtgtcctttcggaaggaccaatgccaatttcgttcggagtttccgtccgaagaataattgatcgggagaatagccatcaatggcattgtttggcgttgtcctgtaagcgagcagcaccttttcggtccaatttttatcgtcttttgaacactttttcattgctcttttaaaggtgtcaacaaatcgttcgacttggccatttgactgcgggtgaaatggcggtgaaaaggtatgcttgatgccgaattcttgacaaaaagcggcaaattcagctgatttgaattgtgtgccattatctgacactatttccttaggaatgccaagacgatggattatcgatcgaattgtgaaaacggtgtatttggccgtaattgaagacatttgatagacttctggccatttggaaaaggcgtccatcagaataaaataaacaaatccatcttggcagggtccagcgaagtcgatgtgtacgcgttgaaacgctttgtcggtgactgtccatggggccaatggtgccttaatcgggcatttctgtgcactttggcactcatcacattgccgtacgactttctcaatttccgaatccattcctggccaatatacatactggcgtgccaaggccttcatttgcacaattcccgggtgcgcaaaatgcaatgcctttaaaattcggccacgcaattggcttggaatgatgacacgacttttgtagagaaggcagcccccaatttccaaaatttcatttcttttcggatgaaatggtgcaatttcgggttccctgcacttcgttggccaaccagaaataacaaaattaacaattttctggagtgtctcatctttggttgttgattccgcaatttcttgtgccgttactggaagatgatcggtttgcgactgtaaaatggtgttaatataacagtccgtttcgacgcaaatgttggcaatcaacacatcttcctcaggctttggataattggctattagccttgagaggacatctgcttgtccaaatgatgctgtattcgtgtatttgatgtcgaaatcataatttgccatgatcaacgcccaccgttgtaatcggctagcggaataaaccggaattccctttttggaaccgaaaatggcaagcaaaggcttgtgatcagtaaataaggtgaatttcctgccgaataacattcggtggaatttctgtactgcaaacactagagccaatgcttctttttcgatctggctgtaattttgctgggaatctgacaaaacacaagatgcgtgttcgatcactttctcggacttatccggaaaaatgtggccaatcgttgcgccaattccgtttttggacgcgtctgctgccacgatgattggaagagaccggattataatgagtcaacagcgagatcgagatgtcatgatcttcttcgctttttcaaaagccttctgttgctcttcgctccaattccaattttcgtcctttcttag

SEQ ID NO: 3564 - DNA, 4842 bp, Heterodera glycines
atccctcaagtccaaattgagaaaatatgacgctccattcagtgcggcataaatatcgtccggtctcgcaaaagggtgtcggtcaattcgagggcattgttagccctgtgaaaagtcgatgcaaacccttgttttgccattcttctttttcactgcgagtattggtgcagcccaatggctgaaatcaattggcttaatggcaccgatttccaaaagtcggtacaattcagcgtttacggcttcagttgcaccgtgtggaattggccgtgccttgcagaaaattggcttggcatcctgtttcaggatcagataaatccgttttcaaagcctcaatcagtgatgcttcatccttgatgtttgcctttggcattggtgccaatgtggcatggatgctgattggctcgcacatctctttttgctgaaccttaggaaacatgacttcccttgggatcagatcaaaagccataatccatggcaatccaaagagattgtaattgacagcactgctaacatatgcagttagcctttttggcggcttgtcaaagcaactgacgacacattgaaacattccttcggtgggaaatggttcctcattacaattatgcatttcaatgtccgacagttccaattttggtcttcccaatttaatccatgtttggattgtgatgattgttgcttgggctccggtgtccccattcatctcacaatcattgtcatttatcttcacttgaagcttccaccaatgaccgcgattcagtccgacattcaagcaatggcttgtcactttgactgtgtgcacagcccgattttgacgtcttgaatttgatgtcgaagctgatctttggggacacatctttgctatgtgtccctgtttttggcatttatgacaaattgcactgaaaaatctgcaatcagatcgccaatgatcagaatttccacaagcgccacatgggtagatcggctttctttgatttgctttgcctcccgttgtgtgctggtttgctgtcgttttcccagaattgtaattgcctttctttgatttgggctctctccattgttgtggacgaagttggatggcatttgttgagattggcggtgaaagaagagccaatgcactgtccttaataagctgcatggctttcaactcttcttcaatttgtccgagagaaatccgtgtgccacttttctctgcctcctccaacattttcaaacatttttgtctcatgtcatggtggtcatcgctcaatgcgattaccaaaatcatgcattttaactgctcttttgtcaatgacaaattagcattctcgcatgatgcattgatgtgagcaattaatgtcgacacgtcttggtttggctgctgacgaatctggaaacattcataccggcggacaaataatgaccgggtttctgaaaacaaacccttcaatttgtcaatggaatctttccaattgactgtgtccggttgagttggactaatgctgtccctatatttggcgtactcgccgtcagccaattttccgagcaaaagtctaacttttgctgactccggtaaatcctttccgtcctcttctatcaggattccaaaccttttaaaccattgctcaaaggtatttcccgactcagagtcgtaatgaaattttgaaattcgtccatcgattgagctcgccaaatttgcatggcttaggctctcagaaggtccaacattttgctgcgcattcatcatttgttgaatccgcttttcggattttgccaaaactgcatcgagaatttgcttcagttggtccgcgtccattgccaaattgttgaaatccaaataaccacacctggtggctccctacacttgctgagtgttaaggatttttgaagatttgaagataaaaccgcgtattgcggaacctcaccacaattgtgtcttttggtttttagttgaattgaactgctatattagcagacctcacaccacctgggtgctattggttttcgatgaattgcagtgtcttcagtagagaagatggctgctgactgcgccaatttgttgtgttcctccaattgaacacacaaagaataaaaatatttattgatcggtcggtggacaaatgcaaataataataaaaacgaatgaatgagggaagagtcaaaaaaaggaggggaatggtctccttataaacacaaagaggagggttggggcgtggagaacaaagtacagatatgaaaataagtaaaaaggtcaaaacgccaatttaacatctccaacaaacaccgtacagtggttcaattagacactaatcagcaaattataatcaaattacttattgtctgagcattagacaatgaaatgatcaaattatttttctggaatatgcaccaacaaagaaatttgatcattttatgatcaattgatcagtgatcattcaaaatgagactagaaaaaattcagggaggggagtccagagactatgttctcttgatcataaaatttgttctcaataaatttattcaaaatttggtgccaatggagaaaaatagcaaattaaactggcgaatattattgcccaaattgttcaagtcgctatcgtatccctccctgttttgagtgtttgatcaatcaatttttagtctactatgtataccaattgagtgtctaattattggagtgtctataaaggttgtcgtcctatttttgagaatttgatcaacaatgaattttgtttggtctaccgtacccccacattgagtggtgatcagatcaaaacctccacaattccctcacattgttgtgttgctgctgtgccaacaatgctttcgctgcaatgccaagtgtgatcggttcgcatgcctgcagttccttctccaccccgtccatccattcgttcagttccgtgtattcggcgtccaactctttgcacagcgcgaaagcctaagcaaatttagggatgaaatttaaaaaattttttataacccctacccccatttattcgttttccaaagggttcgtttgaaatttttaaaaattcacaagttttgcaaggaccaaaaaaatctatcaattcgtagtgtttaatttatattcttatcagtgggcccataaactgtcatgtcagatacgtcttcataaaaacccgtcataaaattgtaaacatttcaaaccgtctcctaactatcgtgacactgatgaaaagctagcaattaaagccattaaagcatactgtatcggggtatcagtgatacagtaatcagcaactatgagaaagaaggcaaaatgccttaaaaattatatggaaaccctgctaaatccatgttttttgtaacaaaattaattctacggcttgacatacacagggcacggcatttacctgctccaactcggccacccgctccgtgcccagctccatcgtctcgtcagccaggcgcttggctcgctccaccttggccatcatcgcgtcttggccctcttggccgccgagggtgctgctgagttctcgcgcaacttttgtcgcctcgacgaccatgtcgcgcagtccgttcttctccgcaacaatttcctggttcagcgcgtgttgctggcgcaactgttggcgcaactgttccaggtcaaccgccggtttgtccgcctgagcgacagggaattgtcgtgtcaagactctcgacatgtcatgaatttcgaagagttttaattattaaaagacttgccaggaattttctggcaaatgaaatattttattttttaaatttgtttgaaatgaattttcgaatatatttttataaaacaaaaatagaatacataattacaaagaaaattaattttttgagagccttttcttggattatggaaaataaaatttttgaaaaaaaattcaaaatttttgtaataaatttattaatttttgggtaagaaatttaataaataaaaaaattcttttaatgtctatcggagagagcgagctgtccgtcctatattggatggggcatgatttttaattttagttgttttatcctctcggagtaaataattctgaatttttggttgttattagataatctctctgctctcgaccgacagtcaattaagggtaaactatttcaaaaaattcattttttgctgggaaaatttaaaaatcaaaagtgggtttaaaatttaaatatttgaagtttaaataaattttgcgaattataaaaaaaatagaaaaatttttctccgcatcattaacatattttggtaggttctcggcgaagaacaccgttcccgaattactaattgctcttaatcgacaaatgacgctttgtcttcgtcattcacttgcctgcacaatttgctcctgcacgtcgttgaaccaatcgacccaaaagtccaacacgtcaaaggtgtgccgcgattggcgttccgcttgtcgcagttggtcagctttgcgtgacacctgtgttagaacaacagttaattatgagaaagttaaaaggcaattaggcaaataattaaaaaaaatcagaggtgatggggggaaggaaagaaaattttaatttttgtgacataaagcaaccaattttaaggggttttggccaaatttagaaaaaaacaaacaaagtaaactgctaataagaatcatcgagaaaaactcgaaaatttagcgaatttggcaaaaataaataaaacgaaaatttcaaaaaatttatagacagggggttatcatcaaatttcaaaattacgcaaattaataaataatcttttaaaaaataaaaataataacaaattaatctaaataattaattttaaaaccaaattttccgggcacaaaagtaggaaattttctattgaaaaattatgggagagagggatgaaaatggcac

SEQ ID NO: 3565 - DNA, 1212 bp, Heterodera glycines
ttaggcttaggcttaggctttattttgtaaaatacgagttgccttttatacttttgtacgagttgccactgacccggaatatggatatcatatgggcaacgatgcactttatgatggacctttttttgagatttgtcaaattccgactcaatttttttcaataggatttccaaattattaatgacaaatttcaaaaatctaatttgcaaaattccaaagcttaataaaagcattaacttcccccccccccaaaaaaataaaaataaaaattccctccgtcggtcagaaaaaggcgcgttcctccaccttttccgcctcccccgcctcgcgtggcatttttccgcgcctccaccgttcgctgtcctcccagcagcagcacaaattgttccgtgccaatgcgccggcgcacccaccgccgccgttggatttgcgcgcattggacgcggcggacggaacgccaaataacacgacggactatttggaggtgattggaggggggatgagggatcgaaatcccttctcacattgatgtgttgggcttagatcgtaattgtggtggaagtttcgagaccgagtgaccataagactcgataaatgaattcgagaccccaaaacccaaccaagagtttggcgagtgaatgcctcccccggggacgggacaaatctcggcgctgaaacttttttttttttaatttttaaggtgggccgagcggagggcggttggattcgggacgcaaatttttggagcaggcagcaggaattttggcaaatgcaacaaaaccaacagcatcagcagggcaataccatggaggatggaaatgacaatacggtagtggtggtgatgggacagcagggcgggactacggtagactgggacagcagggaggagcagcaacagcacttggacatggagacggcacgcacatcgcgcaccgaggacattatccagtgagagggggggggggcagaaaacggggccaaaatggagaggggacagacagagagagataattagcagaaaatggggagggttgggaattaattaattagttgacgaatgaatggcaaatgccaaggaacaattagcaccaataattggactcatatggaaactgtgaagtgaacgatcaattaagcagaagtgatcgagcataaatgaatgaactgttcgctaattgagttagtttgaaacctgagaatcagaaagtttca

SEQ ID NO: 3566 - DNA, 4855 bp, Heterodera glycines
  misc_feature (4837)..(4837): n is a, c, g, or t
attgttttttaattttattatttagtttaatcaaaaacatttaaattcataatattatttattcatcaaatgtatattttatttattttaaattaaaatgcaaaaacaaaaaaataataattgttttaattaatcaagaaagcaacaattttataaaacattaaattttctaacattgaaatgaaaattgtgccaaataaagtgtcgaactctttttgtctgctgatgttttcatttttcactaattactgctaattagtgggtgtttggcaccacagaattgtccacaatattttccgccgctttttgtctctccgtcaaagtgccgtcccggcgatttttttgaagtcacagaatggcacatgtggtcgagtttgactgcagcttttgccgttcttgtccgcattgttctcctccgctgctggcgatgcttttcgaccgcggcgatgggacggaaacagcggaagagtaagcgggcggcggaggaccgttgacgggcggcagaccgccgggtgaattgtgctggcgccgcagcagcgactccaactcggccaattttgtctacaaagccgagagtcgggatttgaccggattatgcatccatgagattgggaccgaaggagttttccaaattttaatttggactcgtatttcccggaactcggcatttttgccgcttttttggctttggcatcctttccaaattgtttctcgcctcctcctccacctgcagttggctcatttggctttgatgcccccggacagtgtttttgtgctccgccaattgacttctcagcgcggcaatttcctcgcgcagtctttgcgcatttttgggcaaacttaagacaaaaaatggcactttttggccatttgttttttttttactttctgtgcaaagccgatgagttacaaatggaatcggaattagcctggaaattgaggaaataaacattcgattccaaaagtttaaattcaaaagttgcgagtgattgtcggaagtttcgccataaaacagaaaaaaatgccaccgaaaattgcactaaacatggaaatgaatgagactctgtgctataaaaatgccgggaaatgatttgcatttccgcatcgagagtttttatgttgtcgctaatggcatgccataattgaaattcaaatgactttacgatttttcggtatgggatgacttcggcactttccaactcttcccgaatccaagtggccgtcccttgtgccattgcgctttggtcgggcgccgaacttcgtctgatgtcaattacttttgggaccggcgccacttttctgctttaaaaattaattataaataatttagaatattgcagcaatcgaccttctgtcactgttttccgccacttttttgtcgctttcgccgctttgtgccgttgccggcgggaaaggttccgttgacacgtcgaccacgcagaaaacgcgcgagtgcgtgccgaccagcgcggacagtgcgagccgcggctgctgtgatttgcccgcgacagaagtggtggaatgtgccgacggtgagggcggactcagctgaccggaagggtccggtgccgacgaagtcgccgtgggggacgaaacgctgccgaacgatttgcgacagatatccaacctggacaggggatgacaaaagcaacggcttggagagagttcagttcagacaatcggattaacggaccagcagatcactatcaatttgatagaatcactgatcagtccttccgatcgaccgtctaatggtccaaaccaacaaaactacagcacagaagagaagtgccaacctgagcaccaaatggggctgcatcataaacggttttggcttgtccattaggtcgtctctgtttttcaaccgcactaattggccttcgcgcgtttgcgacatttcgtactgcagtggttcgcggaacaaatgcctcaccgtcgtttttgtgctcttactcttcttcctcttcttcctctccttctgctgttttggttgttcgacgggtgttgcctgaggcaaattcactttttttgttttatcatatttactgaaatagaacccaccccctgaattagaagccccccccccccagaaaagcccccattttgagggaggttgaaaaatagagtcccgagttttattccgtaagtacagtatctaattgtgttttttttaattttaaaattcgcataagctcgattgaatggatgccctccctaccgtattcccgtcgctgttggtcaatgaggtggcggtggaggacagataggagcaatcgctggtgccgccggcgccgtcctccgccgcctttgcgctctgatcggcaccgccatcattttccttgggctgctgcccctcagccgcccatttgtgcattccccacgagtacagcttgttgtccaatgttccggccattgtgaagccgtcgccacagaccaaatgctaattgtaaattataaaactgcaattaattaattaatcggtaattaatcagttaattatttgtctctaaccacgcaagcctttgacaggagcgccttgaccggacacgtgcaccctgcgggcatttcctggcaattgccgtggcccaattcggcggccaaattgcgcccaaacaaatggacgtgcccattctccaaaagcactgtaagaaaaatgattttgtgtggcggttttctgtcccactgaaagatggaaggcctaattagacaatttgcaatggctaataagccaattaattgtcattgatcagtcagcctttgtgccgtaccgccactgtgccaaaggccaagcgaggcgttgaccacgcgcgaggggaacggtttgacagcggtgggcgttaaaacgttgtcaaccacgccgtacattttttgctgaaaattcactcatttttaaatattttcggaagaatttcgtcgaaaatttgacaaatgagaattactccgtttgtgctgctgctgctctttttggcatttgcgaagaagccggagcgttggttgagctgaaaaatatgtccaactttcacaaatttgtctttttaattatgccaagaaattgcattaattaaggcccaattaaacgcccaataataattaatggttggcgcacacacattcaatttgttgtacatgttcgaccccatagccaaaactgtgccggtgtttgtgattaacattgtcgctttgggaccacagctaaaaaaagtgggacaattaaatttaaattaaaaaataataatccgctttatcactcattacacaatgctgttgatcaattgtcgagtgggaatttgaattcggagagggacaaaaactgaaaagggaaaaaaggcgtaaaaaagagatgaaaaaaaaacatttaagagaatagaggaacgggcgaaactgaataatccaaattaataattaagtcccatttcggcacatttccccccccccctcggcgattatggcagtatttttggtacaatttcaacaatatcccccagggccctccctattcggcacaatttgccccccccccggcgaccatttgcggtttctcctgtgccaagtcggccattctctcctacgccccacacgaacacagcgccactttcctgttaaatgtatgcttaatgtgccaaaatcaaagcccatttgtgtccaacaacaactcactgtcaaaacggtcgcgtgctcttcgccacagcaaacgtcgacaatgtcctccctttgaattgcaaaatgagttggcaatttaattactaatttgtaagctattttatgagaattttagtccaaattgggcaatttgaaatgtcatcctttcactgaaatggttttcggcacttttgctttgccccccccccccggcactctgtctgtccattcacttgagcagtgcttcgatgattttcggcttcaacaagtccacatccgcctgcgctgtgcccataaattggcgatggcccactgccatcgcaatgccacggccagcacagaacaaagagaagtgtttgcctgtggggtaattaagggttaattgaccaattaactaattgtgcattgaaatgccgaataattctcgggttgttttcgcacctgctgccacgcgggacacgcctttcccgcgcaacgcttcgatcagagttggccccgtgcgcacgcgacggtcgccgtggcccaattggccatggccattctctccccaactgaacacgtgctcgtccgcagtgagcaccaattggtgggtgacactcagcgcaatcttggcacaattaattatacaacattttggcacaattttaaataaaccattttcctttgaatcattaaaaatttattttaaatttaatttttataagaaatcaagaatttatgctggatgatgctgtggcattgtttgaccttgaactttaaacttttcatcaatttgactttaataatggaccctaattgagtcgactcctttaatcaattgcccttttgaattttaattaatttttatccctttttttcatttttttttttcatttcatttatacgcataagcgtgacgccgaaaaataagaaacaatgaaacaatatcaaataaaacaaacaattggtcacttttggagctggggtggcaaagaaatcaacaaattcagatcagatctttcaagaagtttggcaaactcatttggatttagtaatctcgtctctttaggtaaaagtctatagagacgagaggttcgaataaagaacgagttgtatctaacattggttgagcaataagctgttcttatagtgtattcattttttacaatgtttttggaaaaagaaaaggattcaaaagattgtaaatttattttacctnaaaattatttcatgaaaa

SEQ ID NO: 3567 - DNA, 3122 bp, Heterodera glycines
  misc_feature (2434)..(2434): n is a, c, g, or t
  misc_feature (2457)..(2457): n is a, c, g, or t
  misc_feature (2468)..(2468): n is a, c, g, or t
aaatttgaaaaaatatgtaaaaatgaaattaaaatattttaatggatttaattctcattgaaattaagaaaaataaaataaaaaataaaaaagggaagtgcaccctcacccctcccattaataaatttctcgactttcaaaaaaactgcagaaaactcgtaaatcccggtacggcgtcgccaagcaggactgggacgcgcaaaacgcatatgttccaagactcgagactcaaaccgggcacttttgtcgtgccgagactcgagaggactgaacaggaaactctccattcccgagttaagtggccaatttcaacaaaaaaagtggctaattatgatgatcataaaatctccgaatgatcgattggctttgcctgtgcaaaatgttgttgtcgtgcaagtatgaaactgcgctggtcatctgctcgaaaatgtccaccacttcgccctcgggcaacggctgcgcgtcgtcgcggtgggccaacagttgcgcgagagtgccgccgtcagcgtattccatctcaatcatcagagtgccgtcctcctcgaacgagtcgaagtagtggatgatgtgcgggtggtcgagccgggacagcagcgccacctcattcagcgacatctgacaaggcaaatgagcaaaggactgttgcagatcagacaatgtatcggctgattgaccaatttgaaaagcagacaaatttttttgatcagaatggtgatctaatcgaatcgagtgataagatggctctgaccctactgaccagatcagacagatttgatctatcaaaactggtggctgttactgatcagacaatgctcatctgacaattgattcagtcaggtgatcaccaattgatcaatgtgatttctaattaagcgattaaaaagcgatctagtcaaattaagttgatcagagaccaaattaggtatgttaatggtcaagcgggctttatgtaatcacaagcaaccatttgattgctaaggtccgtcagtgattaaccacattaatcggctcaatgaatgcctaatgaatggaatactgatgagagcgattaaagaacttgatcagagtgttttctccccgatcaccgacagacattgcgttcggttggcgtcagctcgtgcaaatttatttccttgaggataacaaatgaatcgtcgtctttgcgccggtagagaaccgcgatgccaaaagagcctggaaaagtgccaatttcatctttggccattttgcctttttttatttgttttttttaaatttttgttttttctaatttttctcccttccgacctttgccaaccgttcgaattcgctcatatgctgccgaactgtgttttgccaatgcgcgacattcgctgccgccgccttcggcaaaagttttggccacgggcgacgcgtgaggcgacggcgtataggaggaataaaggggcgccgtgttggaaagggcggccgacggcaacgaatttttgtgcatttgtaattttgaaaattcgaattcttgctttgatatttaacaagaaaaatggggtccagacaatccgtcaatggacaattcttcagtgaaggacagacaatccgtcacaattcgtcagcaaatttatttgcttgagcaatgatcaaaattttgcaattattatgtaaaaaaaaattggatggaatttacaatattcctaattaccgtatatgctctaattatagcccatgggggattatttttcaacctcctcagaaaaggggggataattagagactgggggattatgatagagggattatttttcaaaacacctcgtagactgggggataattgagactgcgggattaatagagactgggctataattagagcatatacggtactatcaattctatataaattatattttaattttttttaatgcttcttcattacttttttaaaataaaacaaattaaattaatttttttttaacgatttaaattctttttcacgttttaacaataaaattttgctgacggattgtccgggagcaaagaaaaatagcaaaagaggggccgaacgatggcaaattgggggtgggggcggggaaggaaagcccgagtttctcacgcattgtgccgcgccgagggttcaagcgaaatgtgccaacttttgatgcccttcccatttcggcattcgtcgctcattttgagctgtgcccgccgcatttcatttgactgccgcgactctccgccgctgtttttgtttccatgtgaacaacaacataatacataatattacacatattattattttgctgctcctccaataatggcaatggcacacataatttgtgtgacccgacaaaaaaagaaatgtgacatttaatgggaatgtgaggagggcacagaaatgccattgtttccctacaaaaaattcataaaattgtaagccatgggtcagaagaggcattggctntaagacattggaattctcgaganaattcgctttntacgaaattttaaaccgaaaatgagtctgaaatttgagggacaattcaaggcaaatgtcaaaaagtcagttgatcaatggatttatggtatggcaccaaagttcaaaaaaggatatgaaagtgtgagatcatttgaatttgattttcttggcatttctcggcgtttccgtcacatttttgagcggttttttcggcgactcaatcgcatcggcggactctttgacccacgggacgcccgccaaatccacaaaaatggaccattcctcttctgaaaatgggatttaaaatttaaaattgagcatttcgcgcattaccattgttttgtttgcgcactttgcgcagcaaattgcgcaatttctcgctgatttgcctgtatttggtgatgtgattgtacgggtcggcacccaactcgacaaaaaggagcacatccaacaaaaggccgaccagacgagcgtacagccgagaagtgcgaatgtgttgctgaatttgggggatttgttattaattatagacaaaaaattccggtaaaaaagggggcaagtgcaaaatgtccatgccgcaaattcggacagaaaaatcatatcatattttaaagggaaggatgggtgagtcccactaaaaccctcacaatattccagcagatcagattttaat

SEQ ID NO: 3568 - DNA, 1050 bp, Heterodera glycines
acctccggatttgccgggttaaatttcagcagcaagtcgagcaccagcgcgtcaagtttgttgtgggcatgctcagagaagtgggtggtgttgggatggacatggcacagcagcaaatagacgagagggtggtcgtccaagtcggcaacactgttcaacagcacgttgcgcttgtgggccgacgcggaggaaacggaagcggaggtcaaccgcaacagcgcggaggaggaggaggcggaaggcggtgccaacgcggagcaggaagacacattcgcggcggcggaggaacaactgctgatgttgccgatgccgtggtttgccgccgcccctcgctcttcgtcaccgtcgctgcccaacaacggcgcctcggtgcggtggcgtcggcgcgcggcggtggcggcgtaatcgtactccaacagagtcaacaggaacagtttgtactggtcggaacggacgtcatttctgcgaaaaagcaaaaatgggagtcgtgtagattcaaaaaattaaaagaaaattgtaaaatcgagcggagagatttgcccggaacaacttttttttttttactaaaaaaggacaacccaatttattttattgggattaaactcggaaaaggctgaaatggcgaaaaactttcaattttaaataaaacccaaagtaattggatttttggggtcgatttgcatgaatccataataaatttgaatgccatatgtgcaactcattacctgaaaatgttgcagcatttgtcaataaatttgcgcacattgtcccgcacttggccatcatcattttggtccgcctggtcaccggtgacgacgcaaatccaaagccagcggaggtcggcactgatcggcggtcgaagctcaaggcaatccatcagaaaatcgtacacatccaacacgtgctgttcaatgtcctttggctgattctataaaaaacagaatttaaaaaattcgctcgtttttcttttaaatttttaaaattcggggagggaatgaaagcaattcccccccccccagaattcaattttcacttcccctcaaaaataaa

SEQ ID NO: 3569 - DNA, 6671 bp, Heterodera glycines
acgtaggccagttgatcagtcagcgtaatgtgcgaaattttcccgttgaaaactttgagctcaaatctgccaatttgctcggtgaagtaaaagcggaaccctttgaccagctcgatcagctcctccttttcctctcgcgttttcaccgcatagttttcatcgtacacctcttgctcaaacagctcacggaactccccaatattctgttggatgtgcgcggatgggttaaactcgggcgcctcccagggtagctctgagtgccggacacggtacttgtgtacagcattcacaaagtggtaatcatccgtttcgtgcagatagtgtacgtcgggggttgggtctttgccgtgcaccagcctcatgtacccgcctcgccacggtctgaactctttgagcagctccaactctttttgctttcttatggcctgttgctgtcgtttaagctcttccaactgcttttcctcctcttgctttttcttggtctcgttttccgctctctccgcttccgcctttgccgctctctccgcttccgcttttgccactctctcttcctctgcctttctttcttttgccactctctcatcctctgcctttctttcctttgctactctctcctcctcagcctttttatccttggtctctttctcgcctttcttttcctttgctattctttgctcttccttcttttcccgtgccaatttttcctcccttgccttcttttcacttgcctctttctcttcctttgccttcttttccttggctgctttctctgcagtcttccttctatcttcttcttctgtcttacgacgcctctcctcttcttctcgccgtctacgttcattttctcgctgctttctctgctcctcttcccttcgctttctctcttcttgtgcccatttttcatgccgcaacgtttcttgttgagccgctgattgcttggccaaatatgaaagtgggtttaagggcgcttcgcccgtattgtcttcttcctcctcaacaaacgagacgtcaagaatctcgccctcctcctcatcgtcgtcgtcaatgttcccaaaactttcatgcaccggtgaggacctttttcgagtcaacagccgttccacttcggcaatcatgccatgatgaatgcccctctcaagctgctgtggcgagagaaaacttccctttggcacacggaaacggtattttcggccgtcgtgcaggtgaacaatcacatattgtcggtctgatgtacccagctttgcccaacttaagccaaaaatcggacccaatagccatgatttttgcccacctgtttgggtaaattatgcctgacagtccaaccatccacccggccccatcaaacaccaacttctttggcaagtgcactttgaatttgtttgttttatttccaacaaagcctggcgtattgctcggcaaaattacaaagaaagagtttgtcatttgatcaacaagtataaattcttcaaaatgagatcgtccttatatcgtggtgtgccatctcggttcactttcccccatctttgatccagcggaaactctttgccatcgtcgtcgtcgtcgtcgttgccggttcatccttctttaggtgcttcatgatcagatcggtgcaatcaaagttcagctttgcacagtcttggcaaaacgattgggtgaactcaaggcgttgctgctcgccattctgattgatgagtttgaatcggctgttcccctgccggaaattgtcatcacgacactctttgcacatgaacgtgaacactccgtacttaagaaattttcctattttttcaaattaaatattagccaaaacctttgggcgggccaatttccaaaatatggtcgggtactcaaacacattggtcggttgttttttgggcgattcatctactaaaatttggctaatttaaagaaatttgcataaaaaagccaaaccttcagcttccatggcttttgctttcttcattgcggaagcaatttcctcatggattttgtccaagcgaggcttgcgtcccctttttgagggccccggttgcaggtcaagcagtgtttgagtgttgttgttgtctccaattgtgatgacgtcatcatcatccatttctttaaatttaaaattattataaaaaactcaaaaaatgattacttttgttctcaaacaccaattgatcattgatttttctcggggccattacgattaagaaatagtttatgattataattgttaaaagcataaaatgaacctgcgaaaaaacacgtaattatttattgatagtgagaggggtgttagcgcgcagcgacctccagacgggctgtcccttcttaatcgataggccacgcccatccacaaacacatagacgagagagtagtggttagagaaagatacaaaagggcgccaattcaaacacacagtgaatcccaagccaatttatgattttttacagattatggtactccctctgactgctgccctatccaaactgctaaactgtaaacccgaaaatttagcagaatatttgaacaaccccgaggcggtaaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattctgtttcggtctaacacacatgcgttcagaggttaaagtccaccagtatttctacataaagcaccggatccgcctactgtacccacagctgaagtgcattgttgagtaccacaacaagggccactgcaaatactatcccttgggtatacaattttgtccggaaaaaaatcaataatcattttcagagttgttggccgttgaggaaggcggggagagtgaacccgtcgaaagacctgccgctgaaacggactacctggactacttgaactttcgcagtgggtggcaatcaacactctactgatcaatgaagcgggtgcggcaatcggaaaagttgggcgaattcccggagattgagttcgccgtcaacacaatgggcgtcacggtgtactgcccgcggcacctgcaaacgcctcggtttgtgccatgggaccagcccgggcggtgctcgagctgtagaagcggaactgttgagctggactacatcatccagcccgagggggtgaccatcttttcgaatcggctaaagacagacggcgagaactttgtgccgtttgatgcaattggtaagctgcaggtgtatgtcagagtttgactcttttcttaagtggactttgccgatcgtgcgaaattccgcattagggcccggaacaaggtgttcacgctgccgctgcgacacccggaggtgcacgccaccggcccaagcttggaagaaggcgtaaaagaacaaaaggaaatgactcagatggcataaacacttgtccatttttctattgttgatattctgatggactacccaagaataaatgaaagtgaactcgcttttcccatctcttcggggattattgtcagcggtccgtcctcatcgggcaagacccagctggtccttcgcctgttacggcatgccaacgtgatgtttgacccgccgcccaaggcaataggtatgtgcaaagggggtttctgtgcagtgggctgttgctatttagtatgggcatacggtgagtactcgacgcagattcccgatctggagcggcagggagttgtcccccacccaggtgccccgtctgacgagatgctgaaaaagctgccaaagccttgtctgattgtttacgatgacttgatgggtgacattgaggccaagaaattggccgatctgtacaccaaaaagtcacaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacaggcatgtgccctaccgtacggctacctgttggtgactctccacgcgaacagagacaacattatacgcctaaggacaaacattttcccagatgacgaagagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgcaaaagacatcagacagttggcacgtgtgcgaagcgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacgacgacattgctgagcggacaaacttgggctttgtcaaacgacaggtgaccgctgcagtacagaagcggaagggaaacgtcagcgagcggaacgcaatgtacaaccagcagctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgaacacccaggaccaataagaaagcggctaaacagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaggaaactcgcacagaatccgctcgccagtagcctactcaatcgactgtttgttgggtctgggttcgtcggacaagtcaaacaaacgagaggatttgttccctcaaaatggacaagaaaataaacaaaatatacaccgacccggccaatccgggcgggtatgcgggtgcgagtgccctgtacgcggcggtgaagaagaagcacccaaagttgaagcgtaccgagtttgaagactttttgcagaggaacaccacctacacgctgttcaagccaaagagggagaagttccgacgcctacgcactgtgcctacgggtttcatgaccggtaaattgtaccggggcttattgcgcacaattcagggttcagacgttcaggcggacttggccgatttccaagccctttcgcgcaagaacagcggctaccggtacctgctgttggcggtggatgttctatcgaggcgaatgttcggcgcccccgtaaagagtaagcgcccagtggacatgaaaagggcgtttgaggagctatttgagcaaatgccaagggtgccggacacactgtacaccgatcgcgggttagaatttgtggcaaaaccgttgaaggagttttacgcggagaagggcattcaaaagtttgagaccagttcaaagaagaaggccgccgttgcggagcgtgccatacgcaccctaaagactcggctgtacaaatatttttcctccaacaacacatcggtgtgggtggatgtgctgccaaagtttttgagtgccatcaacaactcggtgtgccgcgcgaccggccttagacccaacgaaatcagcgacgccaatgcgagggaggtgtggaagagggtgtacggcgaaggactcgcacaattggacaagtcatcaaagatcagagctggggaaacggtcagaattcccgagcctaagcacattttcgaaaagggtactgtaatacacacactttctgacctatttattttaatttttaaggttatatccccaattactctgatcacgtttacactgtggatgaggcccgctcaaccaacccccagcactatttgctcaaagactattatggcacaaagttgaagagaaaattttatttaccagaattaacaaaagtacaagtggatgaaaacacaatgtatcgaattgaaaagaaatacaaggaacgagtgagagatggtaaaagagaaatgttggtgaaattcattggatttccggaaaaatattgggtcacaaatgaagaaataaatgaataaaaatattacaaaatgacgaaaatcaatttaaaaaataaaaacagttatggcataatatcggggtcatttaactcctcttctgtgaacatgttcacattgaggtctgggttgaacagacaggtacaagcgccagggcagttccacttacaccactcttcgtcgctgtacccaaagggcaccactttcaagccgtgatccctgaccacccccttattcacggtcgggt

SEQ ID NO: 3570 - DNA, 2378 bp, Heterodera glycines
caaccgctgatctgatccgatcgatcagtcactctgccctacttaaattggccatatccctccccccattttcaacatgtgctcttttcttgccatttcttccaccacttccgctctcccccctcattctaccgatcagatcgatcaccctcccccgaagcgatcatattcattcccttaattaatcatcactccgctgcgtcccttcccttccctcctcttcccatccacccttcctttcccttctccttagttgttcatccaccttttcccctcgagggtgcttatctctctcccctcccctcctcccccttttacctttccaaatgccgccctctctctctctctcccccatttttttcgccccttcggcccattgccctttcgccaaattatcattcgttcccccaaaggcaaatgccccgcaatttgtccaaagtgttgccgactcactcctcaaatagcattgcatcgcttcaccagcaaaaagtgcattttgcgcgcgcatttttttccattgcttcgctttcctttatttttcccgccccactcgctttcagccgatgtctttccctttgaccattcaccgacactgatttaattaatttattcaattacactgatcattcaccaatgtgcctcctcccaatcgcctcacttcgctttgcctttgtcggccttttggtaatggcccaatcgattggtaatttattggctaattgtttacccatttggtgactatctccctgattctgatcatcttccacagttccccaatcatctcttccctcctcgtccttttcttccaccgactccgtcccttccgatctgatcgccactttccccctccaaacgcgccctttccttgccgagcccaacgaagagccatatttggtgcgcgagggagagaagggcccggagttgaactgttcagtgttggagcagtaccgaaacagaagccgatatgaaatggaatggaccaaaattgtgggcgaaacgccaatgtaatgttttaaattagcattagccattggatgtggacgggatttaatttttaaaatttagtttggtttcacggaacgaacggctgttttccccctccggcaaagatggctattcgttgacagacactgcggcacaggtgggaaaagcaaacgcattctgtgattagttcccatttgtgatcagaacggggcctaccatttgcggctgaaaagcattcaatttgcacgagacaacggccgctttttctgcgctttgatcgacacggagacgcgacagcaaatgctaagcgaaccggcccatgtgattgtgttgggtgagtgacaaattggacggcgtaaagctaaggtggaaccgatcggatagcaaatgatactgaacagaagggactgatcagtctccctctgctggtgatccttcgatcgctcccccccccccctttccctttcaattggctaaaaaatatttgtctttccctgaagaaacatcccatttcaaacattgcgcattcatctcaatttttataatttgccttaaaatattcgtctttctctgagcccatcggaccatgccaaattcacttgcaattccattaattcttttccttcctctttcataatcatcatcttccaattttctccgattttccatttcaaccttttattgttggggaaacaagattgagaaaaagagagagaaagagagagagagagagaaagagagagagggggggggagagaaaacaagagatagggagagagaggaggataggagagggaaaggggtagaaagtttcttttttcgacctttaaaagtttcagaacagatgggccaaattgacatttgtgcgtcataaattttaattaatgccaacgattcgcgccaacagattccgttggtctgtcccattgctctctctctctctttgtctgtcattggtccgttacattctctcccccttccaaccgcattctcagcataattacgccgatactaattggtctggaatttgtttctctgcgcgtttgtttggcaaaaatttggaaaattggctatctctttttctgctccacagcaataggaattccaaccgcattctcagaataattacgccgatactaattgttctggaatttgtttctcggcgcgtttgtttggtaaaaatttggaaaattgaatatctcattttctgctcaacagttataggaattccaaccgcattctcagaataattacgccgatactaattgttctgcaatttgattctctgcgcgtttgtttgagaaaactttggaaaattggctatctctttttctgctcaacagtaataggaattccaaccgccattctcagaataattaacccgatactatttg

SEQ ID NO: 3571 - DNA, 2156 bp, Heterodera glycines
  misc_feature (205)..(205): n is a, c, g, or t
ccccccccccggcaaaagtgggtttttttttcccccttcccttttttgcaactttttcccgcttgcttttgaccatttgtcaattcaacagtcaattagggccccccccccccctaatcgtccacaaatgtgtgctttccttccttttctttcccccgggcaaagttacccaaatggactgattcttttgcggataattgcctcncggggacgaaattggacagtgagcaaagggaaaacataacgaaagagcgaaggaatgaatttggaaaaaaacaaggcgtagataaaatcggagaaaaacgtaaattataaatggggaaaaggggaagggaacaatacaatgatggatgatgggatttggggggatttggggggagggcatttttatcagattagtgacgatggcattgccacttttgacttattgtaattggaaaaaacgcaaagacaaaaaaataatatccaataaattatcaaaagatcgcatttctttttgcaaattacggaggaacgaaaaatttacataaacgaaaatgttgaaattcaatacccaaaaagaaacaaaaaatgagagggatttacttggaatttgttttttccgtatataatccaaatcaaaatccccccaatagtgaaaatggcgaatttatcctccggtgaatgcgttaatcccttaatttggcacagatggattagtggcacttcgccaatggtgaaagaacaatctgaaaaagtggtaaattgtaaaatgtgagaggaacgaggaaacattaaacaattataaattaagtattaggggaggaaattgtgcagagacaatcaaagtgagaaagcatttgaacatggaattataagtaatttttcattagaatttttaaatttcattgcatttttagcgatctctaatttccctttccctttctctctctctctcattcccatttttgtccgacaattgtcattatttgccgaacagatcaaattgccacaaaatatgccgccgaaaaggaaaaaattgcgacggactgaattggatgagaagggagggaatggcacagaaagaagtgccattgtttgtcgaagaattattttttcgttgaagggttttcatccgatccaaagctcgaataacaaaaaagccttatatttaaaaaacagcgaatgtttttctgctttagtgccgccccaaacgccgcaaatcactgcccaaccgacggaagcggtgcgcgagggcgaattcgtcactgttcgctgtgagtcgcaggacggaaatcctttgccgcgcttccaatggcttttcgacaaccgcacgcgggtgccggacgcgtggttccacgaacggcacgaaggtggcggtggaagcggaacaaagccacgcgcgataagcacgttacaatggcatttgacacgcagcgacaacggcgcctatttaacatgccaaacttggaacaaagcactgcgagagggcgaagtgatcaatgcggagacgaacagacttaacgtgagaaagggcgagagaagagagcgagagagtgaaagggaaacaaaatagtgtaaccaggaagagagaagacaatgaaacaaacgaaatacaagggcaaagagagaaacagacgaaataagaaaagagtgacagaacacaaaaggatcgaacagaaagtacggcatttgttgaacaggttttgtacgcgccacgggtgaaggttgtcccaacagtgcccgaattgaacatcgaggagggcgagctggccgagctaaagtgcaccgctgatgcgaatccacccgcgacaaatttcgcctggacgcatttgccgtcgggcgaaacgcacgccgaccgcgagtggcgcgtacacgtgcgacgcgcacacgcgggcgaattccgttgcactgccgtcaattcgttagactcggcttctgatcgcatccgtctcaatgttctttacgggccaaccgtacgcattcgaacagtcgccgggggcgcatcgggcggttcggtggtgagcccggcggagggcgatcggctggtggtcgactgcgaggcggacgccaacccaaaggcggacgctatcgcatggagcggacctgggggcttccaacgtaccgggtcgcggttggtgatcgaagcggtcaatcgggttggcctttttttgatt

SEQ ID NO: 3572 - DNA, 1880 bp, Heterodera glycines
cgcttaacgtgggcgagacgatcacgctcagctgctccactgacggcgacgcgggcagtccgccggcgcatttccgctgggcggggccgccaacgaaaggggcgtacgaacggaaagccaccgaatggaacaaagcgcagctgagactgccggacgcgcagttggcacacaacggcatcttccgatgtgtggcacacaacgaactcggccaaggcgaagaagcgaccgttcggattacggtaatggaaaaacgaaaacaaaacggtcggaaaattaaattgaaaaggttgtcgaacccgcacggatttcgcgaatgccaatgccaagcaaaatactgaacaatggggccaacgatgtgaccatcgaatgtgaagcgcgaggctttcctcggccgtccattcgttggctgcgggacggagtgcaattgcccatcgaattgtttgtccattggacagtgacggaacgcatggcggacgcatccccggagtaattaatattcactattatacccaattaattcatgtcccttttagtaaccgcttccctttctcttttcccttaattagtgtcattaactcacttgattagtcgttgcctttccctttttcagttgtccttccgatgagagttgcgtccgttccattctgtccattctccgatttgcgcatccgatcagttgggctgacaagggcaattactcgtgcttggcccacaattcggccacttctccgcccgtcagcagtcaatcgctgctcagtgtcatccatcagccgattgcattgaatgaacgatttgtggacggattggcactgacagcggcagagattggcgcatcggtaggaaaattcgaacataatttgcatatgccaataaattaattcgaattaaggctcaaattgtgtgtcggatttcggcacggcctgaaccaaaagttacgtggagccgagacggaacagaaatcggcacggaatttggagggggcgattacaaacggcacatttcgcgggtcaaaggtcagtgacgcgggaggggggaggggggctgtccttcacatttccctctccgttagatgccgtagacgagtttgaggcggttttggagctgagagaggtctccgaacagcactttggcgtgttcacttgtgaggcgaggaacggagtcggggcgaaggcggcggtggacattcgattgcaggcaccaagtaaagtgccaaaattgacaaacggaagggcctttgatcaatccatgccattatttgttttccccttttcggtcgtcctcaaacgccgcttcaggccaggcttattcagtccggcaccacttggcttatggtcggatggcgccccgccttcgacggcggtgatcggcaacagttcgagttggaatatcggctcgtggacccgtacaaaggaaaggccggcggagacggacaaacggacacttttttcttctcagcgcacaattggacggcaatggctttttacggggtttttgtttattttgatgccatttggcattcatttgataattcatcatccctttttgagattgacggcgatcgcgagttctccgctcgaccggacacttttttggtgcacaatttgacccaacttctgccccaaaacggcgtttggtaccgcgtccgtgcgctcaattcgcgcggggtgtccgattggacggcaattgccaacggcgaaacggcggatgcgcgcgaaagtgcggacattcaagcgccagagcaagcgatgtacttggaggacgagcagaaactggtggttcaggtgaagcgcaccaatgaatttgaagcattgcttttttataacaataattaaaatcgtaaatttaaattttcatgccatttcctcccggccattttcagc

SEQ ID NO: 3573 - DNA, 2129 bp, Heterodera glycines
ccccttctgtctccccattcgcttcccgcctcccccgtttttttctccagtccatccatcttcttctacatccttcctcgttttgtttataataatcacttcttttcttctcccttcctatcacttctgcctattccatttctccgtcctctttcacttcctcttccgccccatcgtccgtttcttcttcttccatctcttctcccttttcttttccccttcatttcctcctacctctgttcttcctcttcctcctccaattccttttcatcctttcttcactcccccccccccttttcagttgaacaacgttcttctgtcctctccctgtggatgatcgtcctcatcttctgttccgtcgcttttctctccttcttccttctgctcacccttttgtgctgtcgtcgacgcgttcaacaaaagatcaacgccaccgtaaggcgatcagcgacagcgaacggaataatcaggccgacaaagaagaagctgaatctgaacgggggagtggtggtggacaggtgggaaaagaccacaacatttggggaagagaagcggaggcatttggggcaatttgccaatggctttttgatttttgtgccttttcctttagaattgacattacctctccgatcgctgttggtgccaacggcaaacattcggcaccgaatggctctcagacggacagcggcgtgttcacactcggttcaacttcagcggccgcagcggcaaatgcagttgcggccaacggactgaacggagggaaaatgggcggcattcttttggggagaaagtgcgtggcgagtttggcacattcaaattcgcttttaaacttcagcatttcgccctccggcgacggcgaatgggtcgacggcaccgtgccctcctcgcccccgcagcagcagcaccagttggagccgtacgacttctccaacgaccctttcctgcaggaattcgcagccgcaaatgccctcgggggaattgtggtggtggagaacgcgctccatcagagcagctcgacggagagcagtccaagcataggccagcagggacagcaggggaagccgccaaatccgtacacaaagtgaacaattggatgggggatggacagatcaatccgaaagaaaggccaaggagtagggacagatcagtcggaaaggaataattgagaaaactcattaggaagtggaaaggacagatcagtccggggatgggaaaaaggagaaacagtcatttcagtgatcagattagctaacacatttacaaggttcttcaaccatttcccgtcgtcactgatcggaaacggggagagaacggcggcggccaatgggcggcgattggcgacggatcggccgacggaggagggggaaaaaggcacaaacgaaaggggcacagggaacagcagcaacgagcagttgatcagcgcggggagcagcgacagctccgccagcgactcgtcctccttcagaaacggcaacgccggcggaggagttcgagtgatgcgcgaaatcatcgtttgatgtgaccgccgattgttcatccatcgtctgcctcttaattgtaccccctcccccgataattgcaattgtccccccccccctacgggtaatttacccctcactttcctttccgtcactccacagatattttgttatttaataattgtccatttttaaacactgagtttcccatcctttgcaaagccataactcctaataatcaacaaaattccttttcacttctacacaaaactcaaatcccttcctcaaattatattattattttgtacaatttgtgatatttatttgtttttgtaaatggcgatttcattttccattttctcattgttcttcccattttaagaaaccgccatctccgcccaattctcttttaattacgcatatttaattattattttttgttgtgatctcttaaaaagtataaattttttgccgataaatatcaaataacatgatgaaaaaggtggaaaacagagtttgatcacgcccccgattgtttccatttcgggcgtgtcgtcccctcgcttccgtttggcttctcttctcgacatatttctgcaaaccgtctttttggttgcatcattttgcgttttccttctcgcctcaatctcc

SEQ ID NO: 3574 - DNA, 2840 bp, Heterodera glycines
gccgacgagcggaggggggaaaaaggcacaaacgaaaggggtcagggaacagcagcaacgagcagttgatcagcgcggggagcagcgacagctccgccagcgactcgtcctccttcagaaacggcaacgccggcggaggagttcgagtgatgcgcgaaatcatcgtttgatgtgaccgccgattgttcatccatcgtctgcctcttaattgtaccccctcccccgataattgcaattgtcccccctacgggtaatttacccctcactttcctttccgtcactccacagatattttgttatttaattattataattgtccattttaaacactgagtttcccatcctttgcaaagccataactcctaataatcaacaaaattccttttcacttctacacaaaactcaaatcccttcctcaaattatattattattttgtacaatttgtgatatttattcgtttttgtaaatggcgatttcattttccattttctcattgttcttcccattttaagaaaccgccatctccgcccaattctcttttaattacgcatatttaattattattttttgttgtgatctcttaaaaagtataaattttttgccgataaatatcaaataacatgatgaaaaaggtggaaaacagagtttgatcacgccccgattgtttccatttcggtcgtgttgtcccctcgcttccgtttggcttctcttctcgacatatttctgcaaaccgtctttttggttgccatcattttgcgttttcttctcgcctcaatctccgacagttcctgcacatttaaaaggtgtgtgtgtaatttttctccccattctctcctccccaccttttggtgcttttcccagcgttccttcgtctgcgctttgtccctctgccgcttttcctccttcactgtcctcagcagttccatcattgcgttcacccgattctcctccggctccatcagcagttcggccgtgtgattccgcaccaattccgagtccctcccctcttcggcgtcctccaaacagagtcggccgactttgggcttcaatttgtacggcaaatccttttgcaatttctttgggataaccaacggggcagacacaaagaatttctcagtcgcttccttcaaaataagcatttgattcaccgagtaaatgaaatgcttcacatttttcatgtgccgatggtagcccgagtcggccttttgctccggcttaatgcccaattcgtgcctcaaacgccctgtcgttttcatgcccagccaattttcacccgacggcagcaatttgtccgtcattgacacacaaaatttaggcaccggcacatcgacccaagagcgaaggaaaatgacatctgaaaacaaaggacaaaaaagagaaatcaccaattaaatatgtgtctttcagttaccgtttggcttaattttgtcctcaaacgtcgctctgaacgccccctcgggctccctcaacgcctttttaatcagtccccgaattccgctgatcgtccgaattgccaccccttggaaaggagtcacttcaagcgcactgttgaacattccctgaagatacaacaaaaataataaattaaaaaatggggctttggcactttgacaaaggcggtctttttgaacacttccaacggctgtccaatcagtttgagcttcttcacaatgtttgtgcttttgtccattcccaacacaacgccggtggcagcaatgcgaaaacccttctaaactttggacaaaattttatttttaaacaattagaaattggcactcatttcaaatggacccaaattctgcgcctcctaaacttgccttttcctcgtcgaccgattggaggcaaagaaagccggtgttttgcgtcacaaaaggtgcccaaaaagcgccgtgacaaaaggcttctttcggcgtgtatttgaagaagcgcagccggtggttatggtcaagaacagagtaaacgaccatcgattggaagcgccgccaaccgcacgaaatgatcagcggatcacgcgacttcagcaaacggtcgtaccagcggtgctttttaatgcgaacctaaacgaataaaagaaatgattcaagaaataaccaaacatagatagagatacctgaacgtatccgtcgttttgttcgaccggcaaaagtcctccgacaatgtaaggaaaggttgggttgaaacagtcaacaaacgccgcaggaacgtcctcaacttcgacacgtatatacagaccgggacggaacccttcgagtttctgccgttgttcttcgtccaaatcgtcgaagacacttttgttcaactgaaaggaaaacattcatttaaaaatgaaagtttcccgctttttcactcactttcgactgtttgtccatttcctccactaatgcgttgtattgttcgttggtttggtcaaactcagcatcaaaaagcttccgaaggcgttccttttttgcccctttcgccactccatcgcctttttcggcgttttgtcccttttccgccttcgtcccgtcctctgcttcttcctcatcctcgtcgtcttccgatgattccccctcttcccttttcgtcatcgcttcccccgcctctctcagttcgttcggttcgaattcgtccccactccaatccgacagttcgtctccattttcctcttctttggccttccatttttcctctttcttattgcgttggctttgtccttcgtcgtttttccgttcaccgtcactttcatcgtcctccccctcgccgtcagaagcccattttccagtaacccacgagtcttttatggattccctgacctgaaacgtaagaggcaaatttagaatttaattacatgttttaa

SEQ ID NO: 3575 - DNA, 660 bp, Heterodera glycines
ccccttcgcccgcaaagtgccccaaaatggggaccccttcgcatcgaggggggaccggtgtaaaagaggtggtggggggggggggtcgccggcgaaggggaaaagaggaaaatttctgaaaattttggctattttcttaaccaaattcattaaaaattctgaaattcccccccccccggcggcgcctatcggcaccgccggcccccaaaaatccaccctatttttccttaaaaaattagccaaaaatctcaatatttggtcattttttttagacaaaatctacttacacacaccgtttcagtttttgcctcccagttccaaaaagatttgcatgtgtggcgaagtggtttttgtaagatagtaaagggacaaagggtggtggttcgagtccgttgtgcaacatgaatatttttatttatttttgtccaaaatattaaaaaatgacgaattttgggaattatttttgaagctttttcccaaccaaattggaaaaacttgatatcattcggaagctctttatgaggagaagctttttctaagcaaatgctaagcatttttataagtttgaaaaaagatataagcgtttgaaattttattttttgaataattttagatcggagagtaaaaaattaaaactcgagcgttaaaaatattcataat

SEQ ID NO: 3576 - DNA, 1374 bp, Heterodera glycines
acgttcataggggttaatttttgtatgtcttgcctcccctctcacagttcgtggtaggaagaatcaccaattttcagtaaagacattattgcttaagaaacgtccccatcctggcttacgaaaagtcctaacacctcccccctccccccccccccccccccacccgttttttgagagagtgatcctttcgccatttagcgaccatccgacactgaagacggactttttgatcgcacacgccacttttgcacactttgtggcgtggagggaccacaagtacggaacgtactttgtccaaagcttagtcgaggtgctgtcaaaaaaggcgtgtcaggaggacattctgagcgtgatgacgcggatcaacgacttggtaagcaagctgtgcatgggaccgcccgaccaccaaatgcagacgcctgtggtggagtatacgctgagaaagcaattttttttcaatcccgttgaataaacaatttattacaaattttgtttgtttgctcaaatttattgaatgaaaatttgtatttttgttgttctattttctttttgttaaatttatgattggcatctcaaatatcaatgttaaataaattttgcagtttttttgcttgtttattaattaggtgtataaattaaaaaatttaatgtgccgacttttgcgatgacaatcggttgatcatttgacatttcacttctatttaatgtttatgtggaaatctttggagctgagctcagtccatttcagtcatcccgagaataaaggggcgccacttattgtttgtttgtccatcgaaaacgggagggatttcccaaattttcatttatgtaaattaaacattttaaattttgtccatcgaaaacgagggggatttccttggcctgatcaccagggcttgtaatcattttgaaaaattgcaaatatcaatcacttacttgaaactctggcctagcctaagcctatatacgaaaattcaatatttatgggccaaaaagcgctgaaaattgccctaagttatcttttatggggattaaaagtctgtggcactaacttcatctgctgatcacataatcatgataatgtgatttgtacaccccaaaatacactttattgcaatttttgccggtcgaccaaccacgcaaatcccatgtggtttgaagcttctaggatggagctttatacccatcttttccatacttcgcgatttatgtccatattttggcactaatttccatgtccattttttatgtccatatttctatatttgtccatattttcacttgtccatttgccgtgtgttccgacccgagaggatggcaaattggcaatgtccgattggtgccgagtgatcagcgaccggcaagaaatggtga

SEQ ID NO: 3577 - DNA, 4327 bp, Heterodera glycines
  misc_feature (58)..(58): n is a, c, g, or t
  misc_feature (4216)..(4216): n is a, c, g, or t
cgcttaaaatgagcatttttatctttttttttatgggaccttgttcccgacttttacncattttttggtcatcatttgaatgcttaaagtctgtgaaaattattccaatcaattttgattgttatgcaataaaaaagaaaaaaaaaattttttttttttttgtatcttcgtttttcctttgcattttttaaatagcaaaatttacctcaattttatatccagtcattagacgcttaaaatctttaactaactaattggtcttcaatttgaaattttaaccgttttttcaatttagtgagtcatcgtcaagtgcttcaaactaccgactttggtccaaatacacaatttatgcagtcaacatcattttcatggttttttaaaaaatttaaatttcacccattcaatcatcgagaaaatttgcggcacttttgttggttatggcaccaaaaaaaaaagcaaatggcaaaaattgggacaataactcacaaattgtgtactatggtttgttttgtggcccttcatttaaatttcaacaaaaagctgcaaatatggttctattgcagtttatgcgtccattctatgaatatcctgagtttcttaggccctaacttttttcttactttgtcaaaacatatattcctggtaccatacgaatgcctagagtctcgggaaaatacaatgaaaaaaaaactcgaaattcagaattttttgaggatattttttttgtctgttgcttttaattgacaccaggagaatgtatcattgataaagttcaaaaaaaattatgtcttaagaaactggggatgaatggtcgttgattggacgcctaaagttaacaatcatgactttttaagtcaacatttgtatgatcagtttataaaatttcgattcagattatgggtccggtattaactgaaattgatacgggattcatgaccaacgatacctaaccctaacccaaaaaaaagtaggatttttcaaaaaaaaacaaaaatgttgaaattttcgaccaaaaaatggtaccgatttttttacggtgatactttatgctcattggtgccataaattgggtcttttactaaatttaaaatacatttttcttattttcggttgtcggcactttggtgttggccactggcgcttggttgcgcacagacagccgtttccgcgactttctcagcgagcgctaccgccaggcggtccacgaggcgttttgggtatgcatttttttttggggggggggggaaataaatcctttttattgatggcttttttaaatatttgggttggcggagggctgattgtgagaaaaaatgggtttgatgaaaatagtaataaaattttaccataaacgaaaaaaatgggtaaaaatttacacctcacaaatttcattaaatgtatgtttaatctttttgttgcaaaatgttgttctatcggcaagatttgttgacagatttacaccagaaattgccattgttttggattttttttttttttttcaaaaatttggcgaaattttgtgtggtgatttgggtgaaggagattttgaggcctttggagaagggggaggtgtgtgtagaaagcggaaggcttggaaaattatttttcaattttaggcgctaattcaacaaaaggcgcgccctttgaaaattattaaaattgtaaaaaaattgagactttacgaagtgaaaaagtgggttttcaggggtttgcgcattacaaatcaccgccctatttttatcattaatctcaaaaaaaaattcttttttaaaaattttttgggaatgttttttgttgcaaaacaactgaattttttaaagatttttcattggagagaagagatgagccatcaatttcaattgcaataattcgctgccatttttcattccttttttaaatttcatttctttccatgatttttttttaattccgtgccatttgatttaattctgtccatttatttatttgccatttccctcaaggcattatcatccgcgagacgtccatccagcacttggacgagcaggaacagtaccatcagcaggagttccagtttcaaacgttcgtcaattcgcgaggttggcaaggcattcgggactcaatgtacttcataaatgtctgtttggcatggcattaattttgcggttcttttcagttggcctcatggaatatgctgtcacggacgagcgtcagcttttaccacgttttgaggtgcttactcaataaataaacaaatttaggtgttttttcgaagttttggcaaatttccacaatattttaaaagtattatacccaattttcttttgttttcggggagagggtattcctatttagccttttgaaatttcaaaaaaaaagttctaatttctttttggctaaaaaggacaacaaattcctgtttttttctctccggcgctaaatttttttagattaacatgagaacaaaattttagtccgaagagcaacaaaaaaaaaaaaaaaaatttttctggctatggttttgaaatagcttgaaaaaatttttctttttttcctcataactcaaagaaaaatttttcaattttttttccattcaggccaagcagttgccctcgtgaatatgctgacacggaccagcgtcatcttctaccactttctgatcgcccattgacgtggtgatcctcggctcggacaccgcctacgcgctgatcggacagaagcatggcggcgtcatcggactcatccaacgggcactcagtcgtgcgtcgtcccacatttggtttgaacgctcgaggcaaaggaccgctcgttggtgcggaatcggtgggtgtttgttgttaaatgtcatgttgttcatattgtttattcaacgggattgaaaaaaaattgctttctcagcgtatactccaccacaggcgtctgcatttggtggtcgggcggtcccatgcacagcttgcttaccaagtcgttgacccgcgtcatcacgctcagaatgtcctcctgacacgccttttttgacagcacctcgactaagctttggacaaagtacgttccgtacttgtggtccctccacaccacaaagtgtgcaaaagtggcgtgtgcgatcaaaaagtccgtcttcagtgtcggatggtcgctaaatggcgaaaggatcactctctcaaaaaacgggtggggggggggggaggtgttaggtcatttcgtaagccacgatgggggcgtttcttaaaaaaaaaatttttacagaaaattggtaattcttcctaccacgaacaatgggatgggtggtaaaacatacaaaaattaacccaaatgaacgtttaccaaaattgccaatatgggcatttccattaattttaaaatccataaaaatttaatattttcccaattttcagcaaaatattaaaaaacaaattataagtcgagaaatttgaaaaaattaatttttgcattttttgttaatatttcattttgtaaatcttacttatttgttggtttttaattgattgttttttttgctaaagaagttcttcaattactatcaaaaataaataaaaatttaaatttgattatttcccggaaaaattatgaatttggtaaattaaaaaataataattttcttatttttaagaaaagccctgacaattagggggtttcctctcaaaggacacatgaacaaaagacccagagactttgggcccactaagacaaattacctacggacaaatccaaaaataaattgcttcaaaattctgatttaaattttcttttacttaccaattgttcaagtaccggtgcaacagcttcggttcgccacgtttggatgtgcttttcttgtcgcttctggttttgcccctcaatctcgatcggccactttgttcggaagtactgggcttgtcgatggtggcattgctgcttgattgtccggcgctgtgcgttcgtccaccgcgcatctccagagctgtaatcataaaatgtatttataaatatgattaaaaaataaactgaaatttaattaaatataattttaaaattaattgttatttctgtaagcggcaaccatgccattgcaaagagtattttgaaattatattattatgaactttattttaaaaaaattattttatttaaatatctttaaaaattatttatgtgtgtgagtactgtatttattatgaaaataataaacgtacagccacgacacgcttgcacgaacacctaaataaattacatgtgntaaaaaattattttgttcgattaataaaattttaaattcatttgaaaatccaaaattaccaatttcggtttgtctttaagtgctgggcatttgtccccatccagcaaggca

SEQ ID NO: 3578 - DNA, 4729 bp, Heterodera glycines
tatgtgatagccaaaattttagaatacaaaaattttcacctcctcgactaatgatgaaaaataatagacaaaatcaatgactttgcaaaatctgagcctgggttcattaataagaaaatttattttttccgtctggacaccaattccgaaggactaccaaatttaggtttttgaaaattaaaaaaaaaatttttgttggaaattactagtaattcctttttataactggtcttttaataatcccaactttttccacaggaagcgcccactctttacgccttctcctacatcatgatactgctcggtgcggcgctgctgctgttggccatgtttggctgctgcggtgtcaccgcaacggcaccggcacaaaagcggacaaagcgtcgtctaggcggcggacaaagtggcgacaacaacggctgggaggaccccgtcgctgtggtctacacttcgtcaccactgctttggctgtacacggtgggcgccggtgtgctgctgatgttcaccatcggctgcggctgttacattttgtacaccaaagatggggtaggaacggacagagacaatgtggggtcggtttttggccacttattctcaccccccagggcacaaccgtgtacaactcaccgatttaaaatgcaattaaattttttttgagaaatcgaatcattaaaatatagctgacccatttaggctttcgaataacactaattatccccaagaaaagggtgagatttaaaaattatgccctatttttttgggggggggggtagctctatatttcagtgtaaaatttttttttcatgtacatttattttataaaattcgtcagattgatgtggagttgtccgatgctctcaactacatggtccaacattactaccaagggcccggcattgtgcaggaaactctggaccgactgcagcaggcgtttcgctgttgtggtaaaaccaatgaaaaaaaaattcaagaatttttctaacgatattttggaaaatttccaattttttcttgaattttcttgtggaaaaatttaaaaaaaaattattttaataattgatatctctcgaaataaactaattttcttcaagattactaattgacattcaattgccccgttgtaggcaatgcgggttgttccgattttcgtgcgtttcgccaagacccgccccggacgtgcgacttgcgctgcgacgggtgccactaccgaatttggcttgcgctgcgcatcggcttctccgttgcgttggccatttttggcattgtgattttggcacaggttttcttttgttagtggttgtaagagccaaaaaaaattttcctaaaaaattaggagggggcctccactttagggtccacttcgtttgggcgccagaccaagtttttggactataacctttttctttgtaaaccaaatctaacattcttggtatcattcgaaagcttaacatgtttagaagctatttctaatttgtaagctattgtttcgcgattagacaattaccaaaaaagttataacatgaaattgcaaaaaagtcgaaattttttggagtttttttcttaataaattttttacaggctagaaaatctttttgtaaggctaatagaacatgtgaggagcttttgaatgataccggataaaaaatgggtaaaatttctgcaaattttcggctagttttctgtcatttttttcattcagaaaaatttttgcccttctattcattctccattagaaaatgactcacaatcaaaattaaaaaattagttttttaggacgaaatttattgccaaatttcctctgtttttcaaaatcttcgccggcagtgcctatcggccgatattgagtattttggccaataatctcacttttttgagatcttttgaaaaaaaaagagtcctcaaagcgctaaacaaaataaattttaaaaaatattcatttttcgtttgttttacttatttgaccacacgcaaaatgcaaatttgttgacagattgccgccatttcggtctcactgattttgctgtgcaccaccgaagaagaggactacgacattgactttgacaatggccatggctatggttggacaacggtggcacaacggcagccgtcacaccatcatcatcagcattactaccacggtgccaatgccattggccatgctggtggcggcggtggtgccgttgtgacggcgatgcgcactttgggccgtgccaccgccaatgcgccgcactatcagcagcagcgacaacacatggatgatggtggtggtggttttggatgccgtccttccacttcatcttctgctggttggtgagaaccatggggacacagcggcgggtgggggaagaaaactcaattaaaaatgatttaattttcaaaaaaaaaatttttttttcggtgctgcccagggctcgtaaaaaatccaaaaacaagaaatttcctgtaaattgttagcctggcgccactacgacacgacacaattcccttcaattttcaaaaatttaacctaaaaacataaaatcgttttgcaaaaattgctaaaaaattgtttttcttttcacccattgggccaataatttttgaaaaattttacgggggggcaaagagcaaaaaaccttcgcgtttccctccgaaattttttctggtcacgggcctgctaaaattccaacaaccctttatttctaacagagattgttggcaacatgtacgacgctgtcggtggtggtggtggcactcatgcgccgtcccgtcaacaatggcaccacagcggcggtggccgtgtgccgcaccaacgcccatgggacggccagcggcaccatttcctgtccaacaatactaataataatgctcctccgtcctccttccattactactaaattttgcaattcaattttatcatttttgatttgcaatgtttttttaactttttttcatcgctccgttcataaaaattcacttaataatttttttgaaattctctttcatttgcattcgattgaacattctcaggattctctcatttctttgatggcttttttatatatttaaattaaaattgtttccaattttttgtcagttattttctcccaaaagctaatcaaatccctccaatttttcgtaattccattacttttcgaaaaatattaaaatgatttttccaaatttatatggcttacttggattggctttttattttcgttcattattttgttgtattaattttatttagctctttaacattgatcgattcatatataagaaaaaaagatgcattttcattaaaataatgtctaaaaatttgtttgtcacatatttttcatttgttggcatcgcgaccaattcaatgcttttttatttgtttgacttttccatataattgttacaataattaatgggttttatttattttttgttccaattaaacaagacccatttggccaacaaataccgacggcactgccagtcaaaatgagcggtgcaactgcaaattcaacttcggcaccagcagcgaacacttcttcgagcagttcaacagtgtccagcagcagcaccattcgggcccagcacaatcagcaaccacaatcgtcgtcatcgtccacctcttcgtggatgaatgggacgacgttcagcgtgtcaatcagtgttcgtttttctttctttttttctggggtggggcaattttggtaaatttttccatttttcaacattgtaaactcacaatctgaataattcgggaagggacaatcccatggggaagagatgggctgcatttcttaaaaacaagcaaaacccactcgaaaaatttgcacttttcctgccccctcccggaacagacggaacacgattaaaccgaaaaaaatccccgaattagaaatccaacactgccgcactttaataaaaatacagtttgtttttgatggatttaacatttttggcatcatccggttgtcctccaaagtttatgaatctacaaactttggaaaattctaaaaattaacggctggctacatttcgattcaaaaaactcggtgaaaatacgtcgtttcgagacgatctatgggaaaaaattatgtgttcatcttttcctatatcctttccttcttactcaaaatcatggttcaaaaacattcaattttttgtgtcgcttttttcaaaaaaaaaatttttaagggaaccggggggggggccggtgatgcttccaaatattaagattttcccatcatttggtccgtttttttaaattgaactttttcaaaaaattctttctatgatagtgccaagaaggtgtttaaaattggttttagtcttaaaaaaatgctttaaaacaattaaaatgccttcatttcccccatttttttttttgcagactccggtcgaggatctgaacatccaatttccgcccatacaattgccgtccggcatcagcacactgttcggcgaacttgctgctgcccaccagcatcagcagcagcagcaacaaaaccaacagcaacaaatggcagcgattagttcatctccgtcaaccactgctgctgcagcatcatctgtggtggcgagtgcaagcagttcgacctccaatgctgccctcctacagcgacagaacgggttcgtgttaagagggaagacgtagtgcggcgggtgggggtgaaaattttaattttgtttttttttctagaaagtttagtgaattttcattcccatccccccgaaaagttaaaattttcaagga

SEQ ID NO: 3579 - DNA, 1639 bp, Heterodera glycines
ttgatttagaatcagattatttctgcctgcgctgaaattatttaacaagatttatagaatgtcaatagtcaataaaaagtgcgctcctgcaggatgaatcttttcttaataaaactctgcttttctgtttcttagctttaaaatctctttttctttttggctgaaatggcttttcattttctttttaaaaactcgcaggcttttttcatggcttttcgttttcttttctttttaaaactcgcgggcttttctttttttttagcaataaaatttatttttattttaatggcttttccttttcttttcaaaactcgcggactttgcttttttttagctatagaatttatttttatttaatggcttttccttttctttttaaaattcgcgggcttttattttattagctttaaaatgtcgtttcattttcatggcttttcgttttcttttattttcaaaactcgcaggcttttctttttttttagctataaattttttttatatttaaatggcttttccttttcttttctgtttaaaattcgcatgcttttcttttctttaaaatttctaatggcttttggttttctttttaaaactcgcaggcttttcttttcttagctaaaatttctatttttttttttcagggcttttcgttttcatttctttttaaaacttgtggtcttttattttcttagctttaaaagttctttttgtttttaatggcttttggttttcttttctttttcaaaactccaggcttttctttttttggctataaatttgtttttcagggcttttcgttttcatttctttttaaaacttgtggtcttttattttcttagctttaaaagttcttttcaatggcttttcgtttttttttgcttggcttttcttttgttttcttggttagattaattaattaatttgttagtaagttaaaataaacaaaataaatgcacaaatacaaaatattggacggaacaaataaataaaacggacaaaacaatcaatataaggtggagaagtggaaatgaaaatgatgggttggtggagacgggccgttgctgatgaatgatagataagaatctaacggatgagggggggggggggttacgcgtcgctatgcaaagtgaaatgagaacagagggggtgggggagggacatttgaatcgttggagaagttcagacggcacatcaggtcgtctatccaacaccccctaagctgaacggcgaaagaatttcgcctctggcgccattttgagcggagttttcccgacgccccgccccctcgcgcaccccgagacttgcgcaccaaaactcgcgcaccccttgtccgattgacttcaaattttatgggccgtcattccaccatcccctaagctgaacggcaaaagaatttcgtctctagcaccattttgagcattacattcccgacgccccgccccctcgcgcaccccgagacttgcgcaccaaaactcgcgcaccacttgtccgattgacttcatattttacaggccatcattccaccaccccctaagctgaacggcaaatgaaatttcgcctcaggcaccattttgagtggagttttcccgaccgccccgcccactcgcgcaccccaatacatgcgcagcaaaactcgcgc

SEQ ID NO: 3580 - DNA, 891 bp, Heterodera glycines
taaatggtttgccgaatgtgtaaatagagcgagtgagctttgccttcacaaaattggcgaatgctgattggtcgaatgacttttttcgtattctcccttctatgatgctcattggcggaatttttgtgcaaagacgactgaattaaccaaataaacgattttttgttaatatattataaaataatacaaatattttatataaaataaagaaattacaaacgaaaaccatttaaaaattgttaaataaaatattctagaaaagcacaaaaatgtccaattcttctccccctgctaaacgagctcgccgttttttcatcgaagagttgcttcgggaaccatacaatgagctttcgcccccacaaaagtcggcaaaagattacgtcaaaaaactcgactcggaaattgaacacgttccaaaatttcaatgggttaaaaacaagtctcgcttcgccattgaagacgtcccttccgacccagagggcttattgattggcatttttcaacactgtatggatgaatcgattagtgacagccggtcaagaggagttgagccgacacacctcggctgcattgtttccagtgcactccttacttcggatatatggattccaattcggcaaatgacttcagacacaataaacaccattctcaaccgctttaacgacgtggctcaaagcaaaaaacaggatggtgtgacgctttggggcgacccatttaccgtaaccatgacaacagtcaaccgaaacggactaccagccaaacgacaactgaaaggaggagcagcgcggaagttaacacatgtccaccacagagttcacgaacagtgtctaattaaggtttttaattaataaatatttttaacttatataaatttagatcgaaaattttgat

SEQ ID NO: 3581 - DNA, 2900 bp, Heterodera glycines
  misc_feature (2887)..(2887): n is a, c, g, or t
cccccccccccccacccattcccgtcagagacgcacacacaaccacccaataggcacggacccgcccgctcatcctctctgcttttcagtggagaaaatcaatcgatattaaaagtaatcgcatatagtagtaatacgacacagttgtctactcacatttcggtggacgctttgacatggtcttggtctttcgtgagctcttcatggaaggactaaacccttcaatgatcaaaaaggggaatcgcttatttgaaatgaaggcaaacattgattggttcactatttgttaaatataaaatttaggtgaagagcagaaaaaatctaaacccaaatgtgatatttcgcgactcatggaatctgattccgggtccactggcatcaatggtcccaatgttcggcttggacgtggacgacaagccttttttccctcatttggtcaaccgccctgaaaattacggatgccatatcttccccacaaaggccgattatttggcggacggaatgaatccggtcaaacgaaaagaattcgacaaatggtttgaggaaaaccgaaacaagtcgtttttcctcgacgaagcattggccaggtattatgaatttttaaaataaaaataaaattttattttaagctattgtaaaaacgatgtggatattttgatgtccggtttaattgcattccgagcggaattcatggagatgacgaaacggtcagctggaacagacggaaaagtggaccgagctgctcacaaaacaccccatgacggcattgattccgtacgccactgtattacaattgcctcagcttgtatgcgccatttccgcaccaatcacctaaaaccagcccacttggctcttgtgcctgagaagggatatgacagctgtggggacaaccaaagcgatttggctctaaactttatgcagtggtattctgaagagcatggagtacggatacaaaatgctttttcggctgaaggcgaaaaaaggtaaaattttgaaaatgtaaaaataataaaattagagtgatagggtgggtaacttccgtctggatggatggattgagtcggagaaaaaaggactggaaattcatggatgtgtatggcatgcctgcccaaaatgttatccggacgacaaggatgtgatgccttgtggcaagacagctggacgaatccgtgagcggaacaaacagcgcatggattttatattggaacgcgtgctaaatgtggaaattttttggcaatgcgagattgaacaaatgctggcccgggacagaaaaatgaaggacaaattcagcgaatttacgggtgatgggggtccaatcaatatccgtgcttgcttcatggggggcagaacgggagcattgaagcttcaccacgagatagcagcggacgagacgattagctactacgatgtcacaagtctctacccatttataaagtacatacgatgaatttgtcaatatttaaatttaaaatttttttgtagttatgtgacccattatcccgttggtcatccaactctgcatgttccatgtgaggatgttgactggcgccgatccgaagacaatccatatcacctggccattctcaaagtgttcgttattccaccgcgccgaattgacgttccagtattgcccgtcaaagtggatgatcggctttgctttccgctttgtatgaaatgttgcaaaaaatttccaaatgggggtgtaagggagacgtacaactgtacacacattgatcgtcaaagaggatggattagtacatgcacgtctttagaggttaaaagaaaaactgttttttgttggtatatttggtaaatttagctaaatgtcgcattggatgaggggtacagagtaaccgagttattgcgtgttctcgaatacagcaagagtgacaaccagctatttcggccttatatgagcgaattcatagccgaaaaaatgcatgcttcgggattcgatgatcagattcggggaaattttgaagcggaggagaaattcatcgcggaatgccgggaagaatttggaattaaaattgaccgagcgaaaatggtcccaaacaagggaaaaagagcgcttgccaagttggcggtgaataatttatgtaagagtttaatgaattaaataattgaatacttacatgttaaggggggcgtttttctcttcgtaattttgggcttacccaaactctgattacggacgacccgtcggagcttggcaattatttggacaacaaaaaaattgaagtcacaggacttgacatgcttacaccagagaggatcttgatcagctaccatcaaaagaatgattgggtcaaagaacacccatgctcaaacgtcgttgtctcactttttactacttcggcagcccgattgcacttgctaaaagcaatgcaaaaagttgttcgaactcctgggtgcattcttttatatacaggtaaaaattattttttaacgcgacgatttttgaacttttagacaccgattcgctgatttatgttcatccaaagggggcaaatcctttgaaaacaggccctcatttgggtcagtttacggacgaatttccgaaggtgacaaaaattattttaaacatcataatttccaaattttttagcatgatattttggaatttgtgagcggcggtgcgaagcagtacggactgaaactccgcaaaaagggatcagaagaagaagaatttgagtatgttctcaagctgcgtgggatcaccctcaactatgatgtaacagaaaaccaaggattacgctccgaaacttttaaaaaacgcgtcttggaatttgcccgaaccggaaaaacccagccaatcaaagtcatttaccccaatttccttcgccctaccgttatccaaggaaatgtcacctcagctcctctccanaaaaatatataag

SEQ ID NO: 3582 - DNA, 5381 bp, Heterodera glycines
gatgttgactggcgccgatccgaagacaatccatatcaccttggccattctcaaagtgttcgttattccaccgcgccgaattgacgttccagtattgccagtcaaagtggatgatcggctttgctttccgctttgtatgaaatgttgcaaaaaatttccaaatgggggtgtaagggagacgtacaactgtacacacattgatcgtcaaagaggatggattagtacatgcacgtctttagaggttaaaagcaaaactgttttttgttggtatatttgttaaatttagctaaatgtcgcattggatgaggggtacagagtaaccgagttattgcgtgttctcgaatacagcaagagtgacaaccagctatttcggccttatatgagcgaattcatagccgaaaaaatgcatgcttcgggattcgatgatcagattcggggaaattttgaagcggaggagaaattcatcgcggaatgccgggaagaatttggaattaaaattgaccgagcgaaaatggtcccaaacaagggaaaaagagcgcttgccaagttggcggtgaataatttatgtaagagtttaatgaattaaataattgaatacttacatgttaaggggggcgtttttctcttcgtaattttgggcttacccaaactctgattacggacgacccgtcggagcttggcaattatttggacaacaaaaaaattgaagtcacaggacttgacatgcttacaccagagaggatcttgatcagctaccatcaaaagaatgattgggtcaaagaacacccatgctcaaacgtcgttgtctcactttttaatacttcggcagcccgattgcacttgctaaaagcaatgcaaaaagttgttcgaactcctgggtgcattcttttatatacaggtaaaaattattttttaacgcgacgatttttgaacttttagacaccgattcgctgatttatgttcatccaaaggtagcaaatcctttgaaaacaggccctcacttgggtcagtttacggacgaatttccgaaggtgacaaaaattattttaaacatcataatttccaaattttttagcatgatattttggaatttgtgagcggcggtgcgaagcagtacggactgaaactccgcaaaaagggatcagaagaagaagaatttgagtatgttctcaagctgcgtgggatcaccctcaactatgctgtaacagaaaaccacggattacgcttcgaaacttttaaaaaacgcgtcttggaatttgctcgaaccggaaaaacccagccaatcaaagtcatttaccccaatttccttcgccctaccgttatcaaaggaaatgtcacctcagctcctctccaaaaaatatataagccttatgttggcaaaggcattgtttgttctcgtgactttcgcgtacttgattttggctattcatctcgataaacattgttatttttatctgatcaataaattttgaacattaatgatcggtttaaaattacaaaatattaaaataaattacaacaaaaatacaattgagaaatgaagggtaggaaagagtactttctggctggaaaattgaaaattaaggaagataagagacaattttgcaaatatcaatctaccaaaaagtgtaagtatcattttggctacattcatgacgtccttcgttcgaaatttgagttgattcttcgttcatgccattgaccttttcactgcggatttcagtgaacattctcccgagccaatccagctcgtttggcacatcttccatttgacatagctcaagtggatagaaacggtcctcttggccttcttgaaagcgctcgacagcacagtgaagaaacggatgacggagtttaattcgatggcgaacataaaagtgtgcagcaacgcaaacattgaaaggtctgcctaaccggccataggccatcattgttgaagctccttggggtgtgatgccgccaaaagaaaaagttttggtgtacccatttcggtctttgtatgttgtctgaattgggagtccattcaacgcctgctctacaattttacaatcagaagggtgattaagccgatcacgcagttcactgacacgacaattcaaaattttggcgattttttcagtaaaaagcaccatttagacaatttggaagctacaattttggaaaaattagcgaatggaagactgcaatttatagggtaaaactgaaatattaatgagatgaagacaacaaaatgaaaaaattaagcaagtataatgctatttataatgatttcgaatgagccaaatttattttatgggttaaataaacattgaaaggtataaaatgcaaaatttttagttctttgtattattattcttcaattttttcctaaaaatgtccacatcctctaataaaaattatttaccaaaaaaccaatgcccaaattgtgatggtaattgcaattttttcaatagtgtacaaaaattttttttcaaattttagatgatgaagttgacactgacccttcacccgaagaagttgagaaatggacgccggaacaagtgattgagtgggaccagcgttgctacgggaaaatgccagctgaagaagagctttggcaagaattcctcgacaaaggagaggcaaatgtcagtaaataaaatttttgatccattttttaaattatttctttaggttctgcgtgagttctttggcggaaaaggggcgcttgaagttgagaagagccttcgagaatacgcgaagaaaaaggaacgccgagacgcaattctgattgagaaaagaaacgaatacaaaaaaatgatgggaaaaaaggatgaaaattgaatgttcgaatttctccatccgctatatcaatggcttttattttattcaattattttgatttttaatactcgaaataaataggttaaacaaacaaaaattggtataaaattcgaaaaaactgggatcttttttcatttaaataaaaataactcttaaaataatccattcacctgaaataatggctgaaaatcataatgagcaaaagatgaatgagcaacaaaatgaaataattccagctaaaaaccccagaagcatccaatcctggaaacttttccgcccaaaatatatgctaacttttcgtttttgcgacggtaaacagctagtctaattacagaatatcataattgttaaaattcagcatgtctttcgtgcttatggaacaatacaaacaaatattcaaatagaccaagtgacggaagccaaaataatgatcttttgatttttaaataataatgataatttcgatgattcaatttttgtaatgataatttcaataattgtaatgataattcgatatttaattgtttgcagttaattcataataaatgttttttaataaaatcatttttttaattttggtcatctcacaacttatcgcccctaacctccattacctcccaaacaacataaaaaaggcaaaaatttgttatgtttgcatagcaaggaaaatgccgagcgcggaagcaatttgatctttagctcattcctctcttgatttaacgccggctccgcactgcaatggatgtgcttatttatttattgccttgttgggataattggcggtaacctaaaaagaaatttaccggccaacagttcaagcactttaatcgtcccaatattcccctaaatgcgcatcgcagaaatatgagatgtcgagaaaagtaggctgtgattttttattgaaataataaacaattcaagtgcaagtggagaataataataatggggcgggtccaagtgatggcggtgttcggaccagaccaaatgaaaaccgtaaactaggaaatttttgtttaataaatttcgatttttttttgaagaacagctgactccgctcagttcacgttcgggaaataatggggctttgcaaaatcgtactaatggtgtgctaattttgaaaaaaataaaaaaacaaattttttttagtgagaaatgtggctgggccaagtacggcgagtgatggtgacgatgaacgtgaaaacggtgagatgaacccttaataattttacccaaataaatgcattttgacaggccccgttctaagcgctgtcatcgaaggccacatgaaccgttcgcggatgcgtctcattcgcgacgagatggttcatcgtgctgttcagcagcaacttgaacaccagcgccatctgttgcttcagcaagcgcagcagcagcagcaacgagaagagcgagaaagacagcaacactttgatcagcaaatggaggaagcagagcttcttcacgaacaactgcaggcagcagagcaggaaaacgacgagaacatcgaaccacagccccctcagcagcagccgcaaccgctgattcgtcatcagcagctgcagttcgaacgtaatgttcgactgcagctgcgcgagtcgcaacgatttgaaaggggagttgcctcgtcaatgctcgttccgccagcccagctctattgggagaccgaatgcatcatctgcaccagcaaccgcgcacacctctacagccgtaattgcggacacatctaccctgtgctcgacatgtgcggtgaacgcggtgatccacaaggtcgcgacttgtatgctctgtcgtgcgcgaattgaggggatttatccatttgtccgctgatggatgtatttgataattcttggacccctttgtcattgtccatcctatcattaccctattatcacaatttttgtaaacgatccattgattgccacttggccttagcaattctcaatcattatttaaactcagccaaaaaaaatcaataaaccttattaattgaaaaataaataaacaccaattcgttatgcatttataagagggggacgggaatgaatcaatgaatgattttttgcatttagtgtccataaacacggggttgggcactagcaccgtgtccaacttttcgccctaaagcgtcagctggaggccacaagccgcaaccaagcactagcgcaccagccccaagcacagggctgagcactagcgccgtgtccaaccgttcgccgcaaagcgtcaggccggaggccacaagccgcgaccaggcactagcacgccaaccccaaacacggggttgggcactagcaccgtgtccaaccgttcgccgcaaagcgtcaggccggaggccacaagccgcgaccaggcactagcacaccaaccccaagcacggggttgggcactagcaccgtgtccaaccgttcgccgcaaagcgtcaggccggaggccacaagccgcgaccaggcactagcacaccaaccccaaacacggggttgggcactagcaccgtgtccaaccgttcgccgcaaagcgtcaggccggaggccacaagccgcgaccaggcactagcgcaccag

SEQ ID NO: 3583 - DNA, 8952 bp, Heterodera glycines
attgaccgaattatcctacaattacaatcccaaggcgaagaaataaaccacccccaaatcaagcaatcgatcgagaccaaactcccattcaatctccgattaaaattgagagaaaaatccaaactttattcaacaaaagaattaatgaactttctcaattcccacacccaagcgcgtgaagacatagaacgaatggaagattcaaacagacaaatgagaaatttcccccctcaccgaccacctcaaaacagacaacaaaggcaatcctacacaaactattcacaaccccagctaaaggcaacccaccgaaaccatcaaaacatgcctttccctccctatcccatcacttctgcattaacaaccaaatcaaaacctgtccgtttggcagaatttaaagcaaatccgtctcaacccaaaccacaaaccaaaataatattttgtcgattctgtgaaagagacaatcacttgagcaaagaatgcaaaatttatgcaaccactgaaaaacgaagtgatcgagctcgcgaattaaaactttgcctaaactgtctgaaaaaaggacatcatttgagagaatgtaaatcaccattttcatgtttcaattgcaaaagcaaacacaataccctcctatgcacccgaaagcaaaaccaatataatcaaagagaaaattttacaaaagtaaacgtcacgcaaaaccccgaggaattcgaagaaacccaaacatttatgtcaatggattccgatcaaaatcagaaaattatacaaaatgatgaagaagaattgcttatgaccacggaagcaccagtcttaaaccccgaccaaaacaaaacacaaaacgaagtaattttcttcgacaatgggtcgcaaaaaagctatataacagacgaatgtgctgattctcttcaattacccacaatcgaagaaaaattattggccatatccacctttaaccaaaataaacccaaaatcatttcatcaagactagtcaaaattggcatcaaaacactaaacggtgaaatcgaatacgtaacattacagactgtggaaaaaattactgatgttacaaaaatggtcaatagagagactgttgatatattcaaaattaaaataccgataaaccatgcctatccacaaattctaattggtatagaccattattggcactttatgctgccgaactcacaaattcaaatactcccctccggattttactcaatcgatacaaaattaggaaaaatattatccggaaaaggtactattgaagacacaaatattaatcttgtgaaagaaaagcgaaaaaaggatgagacaaacgaaatccttcaaaaattctgggaattagaaaatattggaattaccgactctccacatttgacggacgaagatacagctctcatacactttgacaaaaatgtcatttttgaagaaaatagatactacatccgatggccatacaaaagagaaacaccgaatttacccacaaattttggattatgtctgggaagattaagaaatgtagtcaaacaattgatcaaaaacaaacagttggaaaattataataaaatactgcaagagcaaatggacactaacgttaatgaaattgccgacttcaaatccaaaaatttaattcactatctcccacatcaccccgttataaaagagagttcaaacaccacaaaaattcgaccagtttttgatgcttcagcaaaattaagaggaagcaattcactcaacgacgaaattcaccaaggaccaaaattattacctgatttatgtggaatgattctccgattcagactcaaaaatttcgtcttaataggcgatttagaaaaagcttttctacgagttggattaaatgaaatagacagagatacaacacgctttttatgggtaaatcaatcatatttggacgaaataaaccaaaaaatatcgagaaatcgaaatgagagacgtagaattaagacgtttcacccgaatacccttcggagtcaatgcttctccgtttttattaactgctgttgtgaatcttcatttatcaaaaacagatgaaatgtttgaaaagtttaaaatattacaaatagatgaggaattatgtcttagtggaaaagagaaacaattcaaagagctatgcacagaacttaaagaaaatgcatacgtcgacaattttgtaatgatgtgtgacgacgaaaaggaaataaaattcaaacattactggagcaaagaaatattcaaattagcatccatgaatttgagagaattcgtgtctaatcatgaacaaagcaacaaagagattcaaaaaatggaaggatcagagataccaaaaatgacaaaaatgttgggtataaaatggaatgtcgacacagacgaactcgaactacaaataaaaataccactaatgagtagagacacgacaaaaagacaaattttgaccatgatcgcaaaaaatttcgacccaatgggttggatatcaccagtaatactcaaatacaaactatttttccaaaaactatggagatcaaacaaagactgggacgataaattaaatgatgaagaaataagagagtggaacaatatttcaaatatagacgaagtttccataccacgctcaccatttacaagtcaaaatttaaaatgtgcttctttacaccttttttctgacgcctctgaattagcctacgccactgccgcatatttacacgcaaataataaaactgacttattattcgcgaaaacgaggcttaccccactcaaaggcctaacaatcccaaagcttgaactattgggactattaatagcagcaagagccgtcaagtttatcatcaaagaatcaaaattgaaatttgaaacgatatgtatctggtgcgattcaaaatgtgtactcagctggttaaaatgcaaaaagaatttgccaatatttgtaaaaaacagagtggaggaaataaaacgaattgtgtcagaatttcatatcactttctattacgtaaaatcagcagacaagccagctgatttggcatcaagaggtacaacaatgaatgaaatgaaatacaacgaattatggtggaagggaccaaaatggcttaaattaggaaaagaaaactggccagcccacagtttctatactcctgagcaaaatgattcactttatgatgttaacataatggaaatcgaaaacactcagacaaatttagtcaaaatggactaccaaggatttattgaatggaaaaaatacaattcatgggataaagtgacaagaatttgtcaaatcttattaaaatttgtattttttacattaaaagactctcccgaattcaaaactaaattcaaaatacagaaatttcaaaacgaattgagcttaaaattcatggcacaaaaaatgctaatacgcataattcagaaagaaatggaaccaaataatgaggaagagagacaattgggaatttacagagacaatgatgaaattttgaaatgcggaggaagattaaaaaatgctcagataaaagcgacaaacccaatattcttaccaagaacacattttggtactcatttaattattatggaccatcaccaaagaaatttacacgctggaacaatgacaacactagcagaaattcgtaaaacttattggatccccaaaggaagaagaattgttgaccaaatcagaaaacaatgtttctattgcaaaagatataacgcaaaaccatatcagcaaccaaaaatgccgcaattgccaaaatcaagagttcaaataacagagccttttcaaaacgttggccttgattacatgggtccacttcaaattaaaagttttactgaaaaatgttggataatacttttcacatgtttcaccacacgtgggatacacctcgaattagtgacatcattatcaatacaacactttctcaatgcattccgcagatttatttcaagaaaaggaacaccaaaaattatttggagtgacaatgcatcacaattaaaacttgcatcaaaagtattacctgaagtcctaaaattaaaggaaatacttaaagacgactcaattaaaaactatttcgaaaaggaaaacataaaatggattttttcaatcgaattagccccttggcaaaacggagcaatagaacggttaaatcaaaatgtaaaatcagcaatgaaaaaggcaatcggaaggaaattaatagaatttgactcatttcaaactcttatttgtgaaatcgaagccttagtaaattcacgaccaattacattcatttatgacgaaataaattcgtaccaaattcttagaccaatcgattttatactcccgcacaaaaatctatgcattcccccaattttggaagaaaatgaaactaatgacccaacatatttaccaaaaccaacttattatgaccaaacaatagagttatggaaaaagacaacaaaaattttggatgactattggaaaatttggacagaagaatatttaccaagcctgagagaaagatataaaacagaaaataaaaatccaaagaattgtgtaaaatcttttccagaaatcaatgaagttgtcataatccatgatgagaccccaagagcaatgtggaaaacaggaattattaaaaatgtcataacaggaaaagatggtatcataagaggagctaatgtcgagttaccaaacaaaaatgtcattaaccgtccattaaaattactatatccgttagagattaacaaaaatgactgtgaagagaatgagactatcacaaacttaataaaaaccactgaacacaaacaaattggtgcaaatcgaaagagaaaacaaagtgtcctatcatccccaaaattaagcaaagtatttttaaacacactcacgtttcttctattatttatgcaactcttaccatgcttatcccatttatatgaatgtccaaaaaccaatgaaatatggagaacgaagtatacaacattttgtgttgaaaatggatttactatcagacaaaataaattaacaatggaattttgttatcgtaaaatattttgtcacaaacaacacgtcataaaaaatcacccaccctattgtggaccacaatgcaaatgtcctgattggactaattcttgtagttttgcctcatatcacagaataaaaagagaaataactgatcaggaaaatattcaaaaaattatttcattcttcaaaccaaacatttgttcattcaataaaacggaaaaatgctccctaatggataaaaatatatttagttcaataatgctttatgataatagcattcattcagtcaaaagttttaatttacttcatacacaagccaattctcgaattgattatcgttgccttggggagggcaatctgacgattggtacacaaaaattctgtcaagaacacgaatgcactgacacacatggaacaaaattttgcttttacgagccacacgaaaaaacttatcttgtgaaatcagaccgagaaattatcccaataaaagcatggggaagcatcgaaagaattttttatttggctaatgacacattgatggatgaactcaaacgtaaaaaaagagaattcgatccgttcgaaaacgaacaaatatccgctgaatgtacaaaaggtggaataaaaataaacccaactcatgctaccacggaattagaaattttggttgataaatactttatcctaaagcgaagtccacagagcgaagaatttatttctctacctacaaaaattactatgaacgaatataaaccagtcattaaatttatgaaaggcacaagcgtatctgagtacaaaaacttaacatgtcctccatcaccaatctgtgaattaattatctgtcgattctgtatggaatacattcgaaacccacaatgcataggtcaaatgcattgggcactaattctgatcatgataatgctcaccctttacgttatcacccttagtcttaaaattataaaaatactataccgcttcaccatatttatttttctatcagtctacaattgctgtagaaaaagaaaattaaagaaaataaaaataattaaacggaaacaatttatttatttaatcatgattagccttttactcaattcgccgactattttttcatgtgatgaagtcactaacatggtagcaggaacaaacgactgcgcaattgatcaaaacggaaagattgaatgtatttacgatcaaacaacccaaatttcaatcacaccggaacataaaacgtgtctgaaactcgacaatgaaaagacgcacactacgatggaaacaattgaattatctgttgaaagtctaacaataatttgtgcagagagatctgaatattttatgcgagattatcaattactgtcgagctcacaaaagcgatgttcaggtgcaggaaagtgcactggccaaatatgtcaaactttaacaatgaagggaaaaaatcctgaaatcggtgaccatgccaataatcaaccaggatattcctattgtgtgccttcctgtggtggttggcactgcaaatgctttcttgccaccgatggatgtttattttatagaacatataccgaacccatcgatagaaacatatatgaagtggtcaaatgtccgacttggacgattttagctacaatcaaaatttcgcttgatccaaaaaccatacatactgtggaattaaaacctggtgtcttaacacatgttaaagactcaaatttatctctgacactcacctcaacttcaattccaccaacgccactatttggatccaaatttataattaatcgttcaaacgcaaaagctgtaatagttgataatgagaatttacttaagaatagcctacgatgcgaaactaaagaaaaggcaacaaaattcagttgcacctttccaccagaagcttgtcaatgtcacggaggtgactccgttgttcactgcgaatgtgagaaaaacccactcactgaaatgttcacgagaaaagaaaatattttgcctctcgagacacatggaagccaagtattcttcgacactttattaagggcaaaaataaaattaacaacttcactacaagtgcaagtcacgctaaaaggtcacaaagtcaaagcaatttacgacaaaaataattgtactgtaaaaacaaaatcgttagaaggatgttactcatgcaccaatggagcagaatttaaatttacatgtacaactaactttggtaccgcattggcaaatgtaaaatgccatagtcagaattttcaaataccctgtgacacaaaagggaaccaacagcaaattcagctttcctttaatcaaccgagtgtaaaagaaaaatgtgaagttatatgtccagatggaaaaagtgaaataacaatggaagccactctgaattatgtgagccaacaagacaaaataattaacccatctaataacaaaaaggaaacacccgtacttggaacttccctcgaacaaatttccgatatatttaatttcatatatacattaatcaaaacaaatctttttaattttttaactatactttttactttgattgtgatgataacatttataatttgtatatgtccaatgatttacccacttctttttaaacactttcctttccgtcgcgggaatgtcgcgactacgcgaaataggatttttaatttaaaaaataaaaacattaaaaacaaaaaacatttaaattaattttaaattaaacagctaaacattaattaattaaatgtgaacgaaatgaatgaattgaaagaaagaaaaatcattagtcatttttagtcacaatttttccattagaaaaattgtcaaatgttaaactttaattatgaataatttgaacgttaaaagaaataacagattttaaacaaatgttaaaatgggacaaattgtgaatgatattaaagaaatagtaaaatgttagaaaattagaaaaggctaaagtggcacaaactggaaaatgagaaaggttagtaaaattggcaaatgctgccaagttggcaaacaagcattcaagcaggaattgccggtataaaaggagggccctaacctcccactaatcagtaaccaaagggtgtctgagacgcattgcctcgtctcctccctccctccccttccctccctccttttctcagctcgccgtgccgacaacagccgacaactgcgctgcttgcccttgccatgccgatccgtgcgccgccgttcagtgccatgcctgtccgtgccgccgacttgtgcccgatccgtgcgccgcccgttgtgccatgcccgacccgtgcgccgcccgttcgttgcattccgtgccgccgccccgcaccaccaattccgtgccgtgtcgccgacgtgtcggtgccggatgcccatccttccccgattcctgccgccccaattgtgccgttccccaatttgtgccgtccccacattttgacccatttcgtgccgtcccccattctgtgccgtccccacattttgacccatttctgtgctgttcccccattttgtgccgtcccaacattttgaccatttccgtgccgtcccaatttgtgccgtccccccatttgtgccgtccccatttttgtgcccattttttgtgccgtccccccatttccccttcggtttaattacccaagtttgaggactctaataaagtgcattttcatcgctttcccgcctcacttgacccccagcaatttcgtcacctccaattgaccgccaagcccccagtcgtccctactctcgccaaatccgggcccttgccagccaacaaacccccaacagataccggccgctcaattcccgaccaacaccccgattcgccctcttcatcccgtcccccccatttgtccatcaccgatcgcggaaaggacaaagtggtgcacgacgacccgggacgccctgcgcacaacaacgatccggcctccgacaacaaatcgtcaaacttctgaaacagcgaaaacttttcgtgccgcagcccatcttcaaaagtgagaaat

SEQ ID NO: 3584 - DNA, 1298 bp, Heterodera glycines
aagtaaaaagatttttttcaaaaattttcccattaaataatttttttcccattttcatgtgccgcacgttggtgttttggtggcagcgaccgatggcggcggcgagacaacggcaaatggacaagtaagaaaaaaatgttttttttttcaaaattttcccattaaataatttttttttcccattttcatgtgccggacgttgatgttttggcggcagcgaccgatggaaggagcaatgaaattggaggcggcgaaacagcggcaaatggacaagtaagaaaaaaaatgttttttgtttcaaaatttttctcattaaataattcttttttttccccattttcatgtgccggacgttgatgttttggcggcggcggcgaccgatggaggcggcgacacagcgcccaatgcggaaaatgggcaagtaagaaaatttaaaaaattttttcttttcattaaatttaaatttttcatgtgttggtggcagagacagagagcgatgaaattgtggcgctcagtgcaccggcagtgacgacgaaatcgaccggtggaggcaaaacggtctgttatgaggaggggagggaaatttatgaaaattttcaaagccggtggcaaagcagcgcgtcaccggaccagtgcaaaaaatgtggggggggggggtttgatttgtatattttttttttacaaattttccccaattctaaaaggcggcggcggcgacgaacaccgaagacaaacgacgtgcgccgatcagtgacgaacaaagtcgtaacgaggtctgttgaatttttgaatttttttcaaaattcattttttcatttgttccaggaggcaccgacaactgaggtggtgctggatttatccgactgcggtgaaaaaaatggagagccgagacgaaagcgggtgagtgtttgttatgcttaagatttttttgtttttgttttgggctcacccattggatgggccctggattttagggctcacgcatttgctgtgggcccggtgtgctgggctcacgcatttggtgtgggccctggatttaggggctcaccctttgggtgggccctggatttaagggctcacgcatttggtgtgggccctggatttaggggctcaccctttgggtgggccctggttttgggggctcacccatagggtgggccctggatttaggggctcaccctttgggtgggccctggatttaggggctcaccctttgggtgggccctggttttgggggctcacccatagggtgggccctggatttagggggctcacctatagggagggccccggtttta

SEQ ID NO: 3585 - DNA, 4002 bp, Heterodera glycines
tgcttaaatttttttgtttttgttttgggctcacccattggatgggccctggattttagggctcacgcatttgctgtgggcccggtgtgctgggctcacgcatttgctgtgggcccggtgtgctgggctcacgcatttggtgtgggccctggatttaggggctcacccatagggtgggccctggttttgggggctcacccatagggtgggccctggatttagggggctcacctatagggtgggccccggttttaggggctcaccctttgggtgggccccggttttaggggctcaccctttgggtgggccctggatttaggggctcaccctttgggtgggccctggttttgggggctcacccatagggtgggccctggatttagggggctcacctatagggtgggccccggttttaggggctcaccctttgggtgggccctggattttagggctcacaggtttaggttttaggggataaatttggcttaaacttggttaatttccattttttttttcattatcgttgtggagcggcgaaacgtcgtgccggatatcgtcactggagagcaaatggaggaggaggaggaagtagcgcgcagcagccattcacattcccgggtccaatgacagcgcagccattcaactacaacaacaattttccgcaaatggcacctttcccgtgtatgatgatgatgatgatgcccgtgatgccgatgggcatgccattttgcccgtaccctccaccgccacccaaaaattgattctcatttgtttatttcttttggcacatttactcgatcaaattaaatttcgcttatttttttcatcaataaataaatgacaataattgcgcgcaaatattagtacactggaatggaaactttttgtgggtgatactgtagggtgagcagcagccattcgcattcccacgtccaatgccaccaccgttcaactacaattttccgcagatgatgatgccgatggtcccgttcatgactttttgcccgtaccctctaccaccacccaaaaactgattctcatttgtttatttgtttttgcacatttattcgatcaaatttaattttgattatttttttcatcaataaataaatgacaataattgcgcgcaaatatatattagtacaatggaatggaaattttattgtgggaggggggatactgtagagtgagcagcaccacacgtacacagcaaatgaaaattgcttttagtgcagcatgtaaaatgtggtgctcactctacagtagggacatttttcagggttgggtgaaatttttaaatgcataagtaaacattgtcgacatagtcctacgtgtccacaggccccaaagaattgcgccacccctacaatacacaaacacatcccccctatattcgggtacaacaaagtgtcggggaaatggacaggtgccaacgggtccccccaacgaaacacggccttcgtttcgctgccggcttgaagtgcggcttccattgggttgcgcgctgccgttgcattgagctgctgttctctgctcattggcccaaattcaagcatcatgcgcccatgacacagccccatccttgctcgttcttggttccgctttcgcaatttggcacatggcatgcaccggtccccgtgacactcatggcatccttgaaaccccattttttaaaaaatgatttaaattattgttggccacttgcggtgccgaacagtgacgggttttgtcccttgcgttggtttggtgccatttttgttggaaattcaatgggatcgatggggaataaaggaaatgccatcccctcccccctcccccccccctgcgctcggttcgcatgcctattgaccattaattaacactgtgacagattcaaatgcggccactgccgaaaaaattcattattattgcataatcccaaatatgaacaattcaaatgaattagggacaaaaatgcaaatcaaaaggaaattcaaaagtcatttttgggtctttttttcatcggagccagcaggtccgttgcgcggcaattggccaatgcgcactcctcacacagatcaaagctgaagcaaacacgatcgccctccacacgtttcaccttctgctgattgttgaacagtcgattccaatcatctcaaaattaattaattaaaaatgtaataattttttattgtttattacccggacacaaataggtcgtcagcaaaaatttgccctttgccaacttccacaactctcggtcctccactttgcgtttcttggttaccgactcatccttcggctcgacatttttgagggtctcttcctgtggtttgggctcgggatgttgctcagcagtagcatcagtaagagtagcagcgcgtctcttcattttggaaaaattggtagaatgattttgagttttgaccgggtgaaatattttggttgggagtgggcgtgtcagggtaaaaaaatttggtgtgggcgtggcaccacttttccggatataaaagtgaaatccatgcacatctgactttcattttctcctgcaatggttctcgtaagcgtattttgcgctcagctgctcgattgccctgtcaaattgttgcgagaccggctcaaccaccccgaggaccgcgcactcgtgctgaaacacctaattgggcgcaaagtgcgcaccacctacaacgaccgtaacgggctcaccaaaacattcttcattgctgggatttcggcacggggcgcagcatttcttcccgcttatggccacttgcgcaacccgttcaacatcaatgtggctgctcatttttacgcccgccaccgcataaagctgcactttccttatgtgccgtgcattgttgaacgcttttcggggggaggggaggacaggcactacccaatggagctgcttgagctgattgatgacaacatggacattgacaacaattggttgggcaatcttttcaccgaaattgacgacaatgacaaatcaagcacatcatcgcaccacacatcactgcacctaatactggaggacgatgacatgtacattgggcgtaatgagtgcagtcaagatgctgcaccatcatcctgctggtgaaactgtgtggttattatttatatctaaaaaattcaataatacatatttttattaagtaattttaaattattgattcagcaaaaaatttcccaccgagaaacacaaatgatttggaatgtaacattgagggttctagcatcaccatgaaggagttatctgatcaattcgctatatttttggatcttttatatgatgactttttaatcagttaccttttaagtgtactgtatgctttgcacactgtaaatcactaacatttgaataatggtaatatttttccccgaaagattgatgctttaatttgcaatggcattgtttttgttttatcacaataaatgattgggatttctatgcatttgcttttgagtcaacggttatccgcccaaacggcaaaatttatcaaatttttgtggatttaataatgcgtgaattgtgaatgaaataattgttaattattttcttctaaaaaaataaacacaaaaatttttcggaagtcggaattccgaccccaaaaatgtcggaactcggaaattttcaaaaattataaaatataatataattttttaaatatttaataggcgaaattttaaaattcttaaccatgtaaaagctgatagcaaactgtttttagtatatttctatttttatttaatttttttaatgattttcaaaatatttgtttttttgggacagttacacctttttttgcgtcgcgctttaaagaaaatagaagttttttgaaaaaatatttgaatttttggaaaattcaggctcaacttccacccgaccgatttacataagtagttaccctacacctatcgtcgtcaggcgtgaaaacgattaatgaccgtttagccattgatgtgttgccgccgcgcgggggtttaccgcataagccaatgcctatggggggatgtgaagag

SEQ ID NO: 3586 - DNA, 3570 bp, Heterodera glycines
  misc_feature (1245)..(1245): n is a, c, g, or t
aaaaagggcaaattgcaattttattttcatttccttttttcggcagctcattttcttagggcttttggttccttttgggcaaattcaaaagctgagattagaaggtcgtcattttctttgatttttaaaatttaaataatttaggaatttttgttttaaaatttggggtttaaacattaccattttaaatgcaattggcgcggttcaaatgggtaaggggcgaaaaaggcgaaaactgcgcttgtcaaatgacaaaaaggcattaatttaaatgtcttcaataaagctcataacaaatatatatatatttttaatgaatttacattgtatgaagtattggaaaaagaatacattaataattaattttttttcagcatttggggggggtgacaaaacttaaatggccaatggaggggggttaaatttttaaatgggggagggggtaaaacgtttaaagtttggccaatggaaatttttgtgaaatgggggacgaaagtttttgctaatggggggggggttaaacttttaggcggtgatgaaaaactttttggcaaaaaaaaacttttggtcagcgatgcggtgattaatgatcatttggtggcggcggcgcggggcgcaggcagtggtgtggggcagagaaaagaaaagagtgagagatggaggagagggggaagagggtgggaagggcgcaagggatgaagagagatagaggaaggagagattgtgacgtaagagagaaagagacagattgtggggcaagggaggaagagagatattgcggggggcaagggagaaagagcgggtagagagagagcaaattgtgaagtggcagacagacagagaaaattgggggtgccgataagggggaaagtgatgatgcggggcaagggaggaataggagaaagaaagaagagagattgtgggcaaggggaggaagagcggatagagaggcagtacagcaaattttcaagtcaaacagacagagaaaatttgggtgccgataagcgaatgtgggggggggccttaagaaaagaaaaagggaggaatgttgcatatattaatcaaaacatttttgagcgttgggaaaggggggggggcaagcaaattatacgaaaaatggggggggggatcccaaaaaattgtcaaaaataatgttgttgatccaacaacattatgatcttgttgttgatgggtaatacagcaaattatgcataaaaaagttaaaaatagagtaaaattggtagngggggggattgggatcactttcatttattttgccatgcagtggttcccctttatttgcactgagtgcgaacccgggcttacgtgttatcatccagataactatcgtaagcccattctatgtatacacagcagtattgaaaacctcaccgactttttgaggcagggcaaaactgaaacaacatgcccaaccgaaacaacatcaacggccagcagcaccatcatctgtcctccgcctccaccaacgacaactcacagcattttactgctgttcatcactgttttgattttgttcgtgtttttcgcgcaggtccccccccccctcccgtctaatcattaattcttttttttaatcctttccaaagttacaggctttcaaaatggcaattgttgcacggcgtctgctcaaaaaccgagccattcaaaaacagttggagcgccgccaaaaaagtcagttgaattttgggcaaaaataaataaataaatttttttttttgaagacatgaaaacgcttcgtcgtcagcaggcggcagcagctggtcagtcgtccattgttgtgcgctcggtgagcaccggtttgccaaggaaccaaccgattcatcaggtaaaaagttttttgcacattaccgaaaaacgccaaaatttcagcgccagcaagtctgcaccgtgccctcccatgaggtcatctacgacgtcccatgcaccggagaggaccagcaagaaggatcggaggacagcttttgagaaacactgaggatccgacaatctgagctttaaattcacacacacacacacacacacacacatatatcattttgcattttcatataatcatttttaattgcattttcatataatcatttttaaattgcattttcatacatcattttcaaattgaaatttccatatacgcattgaaataaaaatttgaactcaatataatgacaaataattagctaagattatggtatgattaattaattttgtccaatggtagaccagaaagggtccatatttaatcattaaaagtgaattttgaattttgggctttgtgtaaatgattcataaataagcagtttgcacacgatgggatgttttgcatagtaaaatgggtcacctttagggatcatacacccaaaatttgaattctgagctgcacatttgaataattaatcgcgcaaataacgaaaatgttgatgggcatcggggagaatttgggtcatcaatcggcacgcgagaacatattgtcggcatataaaggcggaaatcccctgtgttatcctcatttttaaatgaacattcgtccacaatattgtccataattttaatttattttttgcacaattaaatttaataaaaataaatatcttattttcaatttttttttaatttattaaactaatttgaatcattaattaaaagagaaaattttacttcataatttgcaggtcgtttccctgaatctcaatttatcccaacattatcaaaaatgtccaactcttcttcaaaaaatggtaaaatagctcaatctctcccttcacaattaacaatctgtcaccttcagtaccggacgaaatcgactgcgaaatgcccgatgaacgtgttctacacctcgagtgttttgaaagcggcgattatgatgttagtaactgtgatgaattctatatttaaatattttttcctcaattttaatccatttcagattatggaactgtacgggccggaccgtgctaaagagatgctggtcgacctgcgcgactatgccgaggcgcacggaatgccatgtcaacatgtgaagatgctgctctacaaactggacaaggggctgatcaaatggaaggggacaaagccctgagaatgaatgaatgatgtgtgatgatcattgtgttggggagcgggaaaaattggtgatggtgtttattttaaaaatggaaataaacaggtttgggaaaattttggcaaatatttgggtccctgatcagtcacacgggggctcatttatgagcgcccactcccacccattcctcaaaccatgttgtccaatgcttggtcatccctccgtcttttggtcagtcacacggggctcatttatgagcgcccatcccgccataattatctatataagatgtggcgtggcacctgggccgacttttttgcgtataaatacgggctcatcgggtggcacactcttcatttggtatccccatttcactcattcgcatggcaatcaacatctccgacaaaaaatagttgtgcagcaaatcctcggccaactgacctcaccgtgacctcagtggcataacatcagcggtccccgcctctcgacac

SEQ ID NO: 3587 - DNA, 6806 bp, Heterodera glycines
cccccctccaaaacacatcgggcttttgcacgctaatttgtttttggcatactttgttaatgtcggttttattccatgatgagaagattgtttcgcccagagcatatatcaataccaatggcccgaagaactggaatttatttctttttcgatgtttatactccccctatttattttccactctaccaataataacatttaaataaaattataattttttatttcttatttgattaatttcgatcaatattttttgataattaaacaaattgtatttttcaaaaaagacctttctcgcagtagcaactcatcggcttttttttactcccttcataaaatgtctcgcttttgccccctcgcccaaatcaaggaatcgggtcggcttaacacaccaaagggaaaatttagtgagttccaaacctatcaaattaaaaaagaattttgatattcgttttaggtcttttttatgctttggaaattgctcgaagctaccagctcatagggaaaagtataacggaaaacaaattccgttatctgatgaagacggagaagaaacaaagggaaatggccatggaattgatggaaaatgcagggataagaaactttggtacccaacaccttgaggctgtacaaaaatactgggacagggaattcccggatatgtttcgcattgtggcttttgaaatggtaacaaaattcgcttgaaaaatataaagttacatatttttagaagaccgggcttaggccaattttcaagggagagggtgttcgtaaaaatgaagtgggtgtgataagagaaggagaccattgggatgggatcaaatcggcttcttggttttttggtgttcgatacttctgtgtcagctgtgaagtgacgtacgatcgacctgaaagacacagaatggagtgtaaggaacgctgcaagaaatgttgccggatgggattcgggttcccatgtgcggatgacagcccggaaattaactgtgacgagtgccatcgagacttctataacatccaatgctttgaagaacacaagaaattggcttgcaaagagtataaaaaatgtgaaaactgtggggagacacacaacactcggaacaaacacacgtgtggggaaaaattttgcaaactctgcaaagtttgccacccagggcggcaatgtttcatcaaaaaaattcaagtgcgaccgcagaaaacctacagaattgtggcatacgatctggagacgacagtagatgggggagaacaccggcctaatcttgttagtgctgcacgtacttgtaacatttgtgcgggagaagagcgtgaatgtgagatttgcgaaggccccagtaaaatcacatggtcagtagcggatggttttgagccaatgagcgagtttatcgtttggataatgggttttcaacgatttgaaacgattgctttcgcgcattatgctgggaggttcgattcacactttgtcttgtccgagctaacgaagaaggaaattgcgacggagttgatgatggctgatttgaaaatttatcaaataaaggcgggaagagtgtactttcgggatttttggatgcttagtcagaataaattggcggaccttccaaaaaccttggggttaaaaactgcagctaaattgtattttccacacaaatacaataagaatgagaattttgggaagagattacccaacctgccttctttgggagactactgcccggacaatatgaaggaggaagaagccgtaaaattggaagcatggcacaatgagaattttcaaacggaatttgaactaggtagggaaaatagcatttttttctttgaaaataaaatttaaggggaacaactcaagacgtattgcgaaaacgatgttgaaattttgatggaatcaattttgaagtttcggcagttatttttggggataacaggagatttggatgtgatgaaggacagcgtgacaatcgctggtgttgtgatgaagatattcagggcaaaatttttgaaggacaggcatattccgatcatgcctgagggggggtacgagaaagctgagaatcagagcaaaatcgcagtgaaatatttcgaatggttggcccaaaaaaagggagtaaaagtgcggcatgcgtgtaacggaggagaagtggaatttggggggctgaaggtggactgtgtgattggggcagagaaaaaaataattgagtttcaggtaaaagaaaaaatattttctttttaagcaatacttaaggggtgtgcatttcacgggtgtccaagatgttttttgccttggacgatagcgccaaatggaaggacgatggaagagaatcaaagtagaaccgaaatacgcatggaaattttgagggaaaagtgcaaaaatttttcaatcggagaagtttgggtagaataaaacatttagaaatatttattaattgttagttttaggagtgtgatgtcagagaggaattgaagaaaaataaggagatgaaaaagttctttgaaagtgtgccagacaagggaccaatcaatccgagggatgcttatgccggggggagaacgatgcccttttgtttgtacgcaaaggctacggaagaagttgagatatcaatgtttgacatcattagtttgtatccctttgtcaattatggtaaaaatctacttacttttttataattttttccgcgcttaaggcactccataccccgttggggtcccaaaaattgtagtgagcagggattttaatgtgaattggacaacacccgacgacgtaccctatgatggacttttgaaagtgaaggtcgtccccccgaaaaatctgttatatcccctcctccccgtgcacatcgatgaaatgctcctcttccctaattgttggtcttgtgcgagaagggccaagaatgaatttgtgatgacaaaagatgtgaaaaaatgtaaccatcgtcccccgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtataaggcaaaatatgacatcaatttggcgtacgataaaattggactcaatcccggactaagaatgattgcaaaattggtgagaaattataaaaaatctctaaaaattgttcgaatttaagggattaaacagtttatggggcaaattttcgatgcgcaataccctttcaaatacggaaattgtgggcagcatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaaataaacacaaaaaatttagattctctagcttttgctcatcggaaggggcgctgtccgttggtggaggggaaatttttggggtaaaacataatttttgaaacgcatttaaattgtggttttaagggagatgactcgagagtatgcggacagcgaaattttggagtttgtgtccgcgggtccgaagcagtacgccttgaaacttagaagaaagaaggatggtgtgatttggcacaaaaccaaaatcagagggatgacactggatagacgaaacgaatttaaatatgaattgttcaaagaaatggtgctggattacaagaaaggggtcaaaaaagtttttcactacccggagaagatcgggccgacaaacgacttccgggttctctcaaaagacgtacaaaaagaatatacaccggtgcagaaaaaaggaattattgacgatcactttaatgttttgccctttggatattattaataatttttgttttgataattttgtctcatgtttataacatttaatattttaaattaatcaaatttgtttcatttttttagaatgtcaaagaaaaatttccaagaaacttcaaaagaaatccgccgctcgaaaaatacaaaaaattatttcaaaaacagtcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagctgagccgagctggaaaattgagaaaatttcagtggacctttattgcagtgccctgtcagacccagtgatcatccctgcccgccccttccaacaatcgaatccagacattgttttcaacgagttcatgcacaggcagcaatcatttggggaagtgaatttgttagaccagagaatttcaataattattgccacttattctttccctgttaaataaaatttttttcatttttccatttcattattttttgtttattacaataattatttattcgagtttttttctttattaatttttcagttaaaatgtactcgtttcaaaaatattttgaggaggctctcgaaaaagaagattttttctggcagaaaaacagagcagaagtggaggcattgttaattgaggcttcaaattataaaattataatacacagggactacgaaagccgctattctgattatattgccacctatcaccgcaccccactcttctgtttctgcatgattgagagaaatttaagatttttttacgacacaggaaccgggacgcctataggaagggttacaactgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctgggcagagaactacttttgaaccctgttgaagttttaattgatatgttctaccaacgtatagataggttggaacatagaaaaaacaatttaaaaatatattttagagatttggtcggatcgtggtcattgttctatagactcccaccctcactttttgacacttcccgccgggtggttgcggagaataaactggaagaatttttaaaattaccatcattttttcgcatgcttttttataataaatattaaatgttcatgttgtttttaaagtgaaggttttgacccaaatatttaatcaattttaatttattatttttggtagaattccagaaaatgcaaacaatcgctgaaattaaaaatttcgagattgttgatggtggaagaatttttgttgtgagagcgagaattgagaatgtgatggaggcggagtacagggtttgtaataaaaatgaaaaaaatatatcagtttgtttaggcatgcactttatgccgtaaaggggcttgttcttgcggggctgagaaaaagatgacatcttatttgaaggtgtctgtggcagatgatacagggcttttggaaaatgtgggatttttcggtgtgcgtgggaaacagaatgggatggtaacgcaacgcttttttaaaaatccatatacatttaaatttaggatgaggtcaaaagtttggcgggcgccgtgtgcaccatgaaaatcggcgcgagggtgaaagaattcggagggaagagggggatctattactctttgattgatattgtcagcctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggcgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatgtgtcaagaattagcagaagaggccaaacaatcaatcgaaatagccaaaaattatcggcaagaaattgggcatatttatcggaccgcttactcgcagcccgatttaggcattggagacttggccaataaattaaaagaaacaatgcgcgaaaaccaaatacggtttgaaaggcaaagacctcaggaagaatttagggatgaatttattgcttataaaatttaagaaaaaaaataaaaattcgagaaaatgaaactgcatgagactcaaaggttgtgggacataaaccaaaaacaggtgaaaagggaaacaggtgaaaataggtgaaaaggaaacaggtgaaaacaggtgaaaataggtgaaatttcacctaaatacatataggggcgtgcattaatggggcatattagagaatgtctcaactagtatcaataaaaagtgccaaaggaaaattttgtgatggttatcgctattacaaacataaaa

SEQ ID NO: 3588 - DNA, 2143 bp, Heterodera glycines
  misc_feature (2118)..(2118): n is a, c, g, or t
gccctgccttgttcacagcgactatccgatactcgtagccgtgaccaggctgtacgcgttcgtcagtgtacgcgcagtcgtacaccggatgtgtgttcacctagaaaacgcccaaattttgaaaaaaaatgaaaaatgaaattaatatgaataatattaaattattaattttaatttttttataaaaagaaaataatttcctttctagtaaaaaagcctaattgtttttttaattaattaaaaaatcaatcaaaccgaaaaaaaaaattaaaaatcgtctgttttttagtcatacctttttttcggtgttatgtcgtactaaaaaccctaaacattctcccagcaaatttcaaaaatcgaattaattaaaaaaaattatgacaaaatattttgaaaaaccaggttttcttgaataataaatgaaattttaaaggctaattaacaaaaacactttggaataaatgcggagaacaattcctcttttgggctgatgaaaccatcaaaaaatttttgttgaattgtttttcaatatcggtttaatctttttttttttaaattcgcaatctttccgatcaccttgatccaacggcccgtttttgcgtccttccgttgcacatcataatgggtgattggcgatccgccagtgtccgtcggcggtgtccatttgatgctgatgtgattgttgtcgtggtccgtgatctcgggacgtcccggcttgccaggccggccgtacgggtccttggccagcacggccgaatcggtgttcaacgggtcggaacggccaaacgcattttcggcacagacgcggaactcatactcgtggccctcctgcagcttcggcacggtgctgcttgtgccgaccacaaagttgttgaccggcacccaaacttggctgcccacatcacggcgttcaaccacatagttggtgacctcggagccaccgtcgtcctccggcggttgccatgacaatgtgcacgagtcgcgcgtcacgttgtccaccacaagtggtcctttcggcggcgccggacggtcttgcaccagcacttcaaagtggccttccgtctcgcccacttcgttcttcagccgtagctcatagatgccggtctcagagcgctttgcggccgggaagaagattgacgtgttgcccggacggcgtacgtccatgatcagctcgggcggcagcgtgccggcaccgcctgccttcacccagcccacagacgggtcaggcgtgccaacaaattcgatgtccagcgtcagtgtgttgccggcgcgtactttccacttgcgttgcgcggtgatgatctgcggcttcaggaagcgcgccttgcaaatttgggacgctgacggggccgacggtgcggacgggcccgcttcgttgacggccagcacacggaactcgtactcttggcccttgcgcagcccggtgcaggagaaggatgtggcgggcgtgtgcccaacttcaatccagctggacgagcccttctcgcgccgctccacaatgtactccttgatgggcgcgccgccgtcatttgtcggcggcttccatgctacgtcaatccgattctcatcaaagtcgatgatcgcgggcgcgtccggtgcatccggcacatcaaacggattcttggccactatttccttgtccccctccaacggcttgctctcgccgtacacgttgaccgctttgacacggaacatgtacgccttgccgggcaccagccggttgaccttggcctcgcagtcagggaattggccaacttcttgccaagtgccgcgcgaggtgtccattttctccactacatagcccacaattggcgcaccgccatcatcttctggcggtttccagctcaacgtgcagccctgtttgtgcacgttgcgagcctgaaaaaatgatggattggacatagccaaaagcattaaaacacaaaaatgaaaatatgcaaaaattcatatatttaaaaattaaattttttcaattattttcccaatgtaaaaatttcaaattttggaagtcttggaaaaacgtaacaaaaatttattgttaaggcatttaggcattcgtgatcactaattttatgaacgattttgaaatccaaaaaataccgtattccctataatacnaaccccgccatgaattagagctccc

SEQ ID NO: 3589 - DNA, 2205 bp, Heterodera glycines
  misc_feature (25)..(25): n is a, c, g, or t
ggctcgccctcaaaactccgcgtgnatgtgatcggttgcccagcccggacacggatgtccatcagcgagttcaggttcagcttgggcgccagtgctcgtggcttcgccgttttgggctctgtcgggtcggacggttcgccctcgcccgccttgtttatcgctttgacacggaactgaaattgaaatttaattacaaattcaaaatttccattttgaatccacgtttggcaattttaggcaaatttattttttaaatcaaaaattgtcgatgctataattaaaaaacaatcaaaataaagaatttgagtataacattactctaaatattcaaattaataattcttgatatcattcgatagccgtgaaaagtgagtttgttcactttagcctataaatttaaattaattgaacaaatttaaaaaagcatggacaaaaaaacgcaaatccatgttatttttttttgcttttctacctgatattcttcacccggcaccagcccagacgccgttcccttgcactgattgcccgtcacgtgggcacaaggcgtccataagccagtttttgtcttcttctcaatcacatagccgtcaatgggtgcaccaccattgctgatcggaggcttccattccaactgaaaattttgcttttttaaataaaaattccgaaaaatatattttaaaaaatttgttaaatttttaatttaaaattttttttaaatgaaaatttccaaaaaaaaaattattttcatttaaaaaaaaaaaattaaaaattcaattgtttaacttttgaacaattttttttatttttaatcttcaaaattcaaaattaataactctcacaaaaaattctatttttttgaaaaaccttgggaattttaaaaaatttctcaaaacatttccaataaatcatataaatggtttttattgaaattttcgaagacgttttcaacaaaaatacagtagttgccggaataccgtatgccaaaaactcacatccatgtggtccttgtcccagtcgaccaccttcacatcctgcggcttgcccggcgcttcccacgggttctttgccaccacaccgcggtccatggccaacggcttggactcgccctgtcggttgactgccttcacacggaacttgtactccttgccctccacgagacggttgacgcgcagctgcgtgtccggcgtctcgccgcacggcacccaacggccaccgtcgccctcctggcgttccacggcataatgcgtgatgggcgagccgccgtcatcgtctggcatgtaccatttgacggtggcactgtccttggtcacgtcacgtgcctccaacggtccgtttggcggagagggcacgtccagcacgaccaccaacacttcagcttcgtcttgtccatgctcgttggtggcgatcagtttgtatgttccgctgtccatccgttcggcgcccaatgtgcgcaacttggtgttgttctcgtgcgagttgtcaattttggtactgaaaatttcgatgaaaataaatttgggtgcaagcataatcattagggttgtaaattatatggactaaaaaacgcgaaatatggacataaatatggactaaaaaagcatgaaatatggactaaaaagctcaaaaatgaccaaatatggaccaaaatatggactaaaaactgccaaaatatatgttttaaatatatatattcaatatttgcttaagtaaacttagaaatacaacaaacaaccaaaaaatggatttaaaacttaaaaattcaaaatttttattgtcgaccattgtataaaaaacacctccaagtttgccaatttcaaaaaaattatcatttaaaaaaagaaaaattcgcaaaaaaatagtgaacatattgattaaaaatgccaaaatgacaacgaaaactcaaatttttcgtattttttggggtgtaatttgtaaaaatttccaaaaagtcaatctttaggggtgtatttttcgctttttaagatttttcttgtgaaaatttgccaaaaatggcctaaatatggactaaaaaggcaaaatatggatttattcccgaaaaccccaaaatatggatttatatggactaaaaaccttcaccaaatcaaaaaattttaatgcagaaatgctatatttgagcctctttcttcatagcatatgcgcagaaaaaatatgtttaatccatacaatttataaccctaataatca

SEQ ID NO: 3590 - DNA, 1849 bp, Heterodera glycines
ttttaaaaaaagttcaaaaattgtttttataaaaaaccataaatttttttcgtgaaaaattctgttataaaaatttacaaaaaaaaaaatttgcggggtggaacgaactgctccgaatagtaccaaccgatcagatgtgccgagctgagtgccgttgatcagccattggcactttggatcaggttcaccgtccacgggcacattgaactcaatggtgccgccctttttgatccgaatctccggcattgctgatcggtcaatttttggcgccagccgtcgcgctttggccaacaatgtacggcttggatttgacggtgctgactcgcccgctttgttgacacccttgacacggaattggtactgtttgccttcaacgagcccatcaacgcgtgcgtccgttttgctggccggcacttccgtggcgtattcccattcgccgttgccaagccgcttctccaccacgtacttctctagcggagcaccgccgtcctgaaaactcagagcagtttttgctaataatgccaggctgtttcattacaaaaatagcacagaattgaccaaaatgggctcaaaaaaaaactaaatcgccgtgccgctttgaaatggtcagaaaattttgaaaatagcatagaaaatcattaaaaaatctctccatttataagaaatgccttaaatggtcagaaattttgaaaatagcatagaaaaatcattaaaatctctctctttataaaatctaaaaagacaaattacttcaaaactccgagaatttcctagcaaatttatagtataaaaagcttaaaaataaaacatccgaaaatttcctcataaaattatgctaacaaactaattaaaaaagctggcgccataaataataacccacatccgttggcggtgtccacttcaggtcggcccagtttttgtcccagtcaacaatgtccggtgttcctggtcggtcggccttttcgaatgggtccttggccaccatagattttggagcctccaatgggtccgactcgccgtaacgattaacctggagcaaaaaaattaaaaatttataaaaaaaaatgaaatttttaccgctttgacacggaatttgtactcgtggcccggctgcaggtcgtccagcgcaatgcgcggctctgtgctttcgccagccggcacccatcgtccggtggccaagtcctgcttctccaccacgtaatgggacaccggtgcaccaccgtcgtcctctggcggtttccaatcctattttttgaaattagcaattaaatgacaaaatgaaggaaggcattgatgttgaccaatgtgcatccgttcttgttcacatcggagatgttcagcggtccgcgcggttcaccaggcctaaaaatgtaaaaaaaaagttgagacggaaattttaaaaaaatcgggatttgagaactgcctcaggaccagatttcgggattaaaacccgggttttcgagatcctgacccttgtgaatcatttttaatatactcgaattccggaccgggatcccgaaaaatatggaccggattatgtccccgtccagtctcgaatatagagtgtggtaagaaagtaaaaagtatacggtaattttttaaacaaaatatactgtaatggaaacaaaaacggtataacagtattgacacatataatgataaattttctgtggatttaataattctatttacaattagacacatttttttcttgctggttgtactatacagtacgacacttgcctatccaacacggtgaccagcacttgtgccgtgtcagtgccgctgtcgttgcgtgccgtgatgaagtgcgtgccggtgtcggtgcgcaatgcccgtttcacaacaa

SEQ ID NO: 3591 - DNA, 3887 bp, Heterodera glycines
  misc_feature (82)..(82): n is a, c, g, or t
cgctttgtccgcttcaagaggttccgactcgccttccgcgttcacctgtaaaaagcgggtttcaaagaaattaaaatgtatntaaatttgaaaaattaatttatccaagaaatttcgaccccattaaaatgaaatttaataaattaatttttaccgcaaaaaatgagataatttaaaaaataataattcttccaaaaaaaatctatcacattgaaatggaatttaagaaattaattttttcaataatctaccgccgacacgcggaatttgtactcgtggcccggctgtaggccatcgacagtgaattgggtggcgtcgggccccgtggtgcgccccgctttcacccaacggccgctggccgtgtccaacttctccaccaaatagccgtcgatgggcgcaccgccgtcatccaatggtggcttccagtccaatgtctgtcaaaattgtaaaataaaaataaaataaaaatgaataaatatttttaatttattttaaaaatgtaaaaataaaatgaaaaaaatagatttaatttaagtgttgtaaaaacaaaaaactgaaacatttaaatttaatttaaaaaatgtaaaaatataatataataaatatttttaatttaaaatatttaaaaataaaaaaatttaggttttattttaaaagtgaataaaaacaaaaatgaaaagatttaaatttaatttaaaaagtgcaaaaatatgaaataaatattaatttaaattattatttacacagcgatctgcatgaacgtcggacacattgagtggaccttccggtgcgccaggtttgtctacaaaattatttgtttgtttgtgcccaaattatttaattaaatttaaggacaattaattaatttaatatgaaaattatttttatatttttaattcaaataaaattaatttcagcatttttatgtggcaaaaacttaccaattatgtcgacttgaacacgcttttctgcttcaccattttcgtttgtggcacgaatcacttaatttaattttatataaaatttaatccttaattttgtgtaaattttctgattatgaaaataattaatcaaattctctatcaatttatttttaattgaattaatataaaattttacaatgaattgcaattagttaattaatgtttaatataccattaattaagtaattaataatcaatttatctaaatcgaaaacaacattaaattttatggcattaaaaaatgaaattcagataacattaattgtattaacataaaatttcattcatttattatccctaattaatcgcattattaaacattttaagccaccaaaactgaccatattcgccgctgtgcgaccgctccgtgcttttgatctgcagcttgcaacggccctgctcctcgtcatgctcaagccgtactttgccgcccgctctgatctcctgcccgtccgggtacagccacacaacgcgcggcgtcggctcgccttccaccggcacatcaaagttgatcatttggcccgcgtgcaaccgcaacggttgcaagtcgccaatttggggtggcacattgcgaggcttggccacaacggatttgctcggatcgctgggctcggatgggccgcccttgttcacggcggtcacacggaattcgtactcctcacctgtgtgacaaacaaaatgccaatttttcaaaattgtaaattttcaagcataattcagtttcctattaaaactgtgaaaaaaaatttatttggcgcggcacccaaaatctaattttcaaaattcagtgttaaattacctgtaaagttaggtgttttttttagaatagttacgggtgaattcaaaatttggaaaaacgtggcaaaataaattaatggagaattcaaatatttttaagggtaaattaagggtttcataatacattagtcctatgttgtttttctgtgaaatttttttgaacttctgctgtcatttttgaagagttatggggactaaagatttgtaaaaataatccgaaaaacgaattaattaatttaaaaccgaaaaattcgaaatgattttcgctgcgctaatttttgtcttaataggtagggaggggttgccaaaaaataattaaagcaacaaaaaagtggaaaactcaaaaaaatattaaaaaattgcaaatacgatgcccattcttttttcaaagacggaatccattttttataacccttggaaaacgtacccttcgtcaatccgtcaacagtgcccgcggttgtgttcccgtccgtggtcaatgccggctcccatcgtccgtatttgctccgtttttcgatgacaaattgttcaacgggtgcaccgccgtcatttgccggcgggtcccatttcaggtcaacatggtccgcgtcccagtccaccaactcgggcgcgttcggcttgtccggtcgttcgtatgggttcttggccaatgtcgatttgtccgtttccaatgggtcggatttgccttcggcattcactgcctgtgaaaccaaaaatttttttgtaggggaatcatcaaaattgggggatgattttgaaaatagaatagctgatgaaattacagtaaccgatggaacgacccccaattttgggcaataccgtaatgaacattaatccgacaatttaacaataaatgccaagtaacgtagaaataaagtcagaataatgaccatcgaaaaaatgtttcttccagactgggaataccgtaacccaaagaaagcacagtatttcaagcgaccgaaactaccgtaatgccaagcattggcgttttgccaaaagacaaattcaaaaaaattatgctcacgcacctttacgcggaatttgtagttggcccccttggccagtccgtccaccaccatgtgcgggtcggaacatgtgccgaccggcacccaaatgccgtcccgttcgtcctgacgctccacctcgtagtactgaatcggctcaccaccgtcgtcctccggcggcttccagtccaaagtcatctgattttcgaaaacgtccgacacttccagcggacctttgggcgctgtcggacgacttttcactgcgatctgtgaaaaacggtaaattataatttttgaaaatgatttaaattaaggagaaatggcaaaattgaagtattaattttgaccaaatttcaatgaattaaaaaaaatttcattgcactttttaattttttggtgttacaaaaattttgcatgtatgcgaaaatgaatatttagaaaaggaaactaaaaattttttttatcatgaaaccgaaaaaatttaaatccaaaaagaaaacgaaactcaaaagtgccgaaaaaaggggacgacacgtaatttcgcataaccctgatgccgatcacagtttatgataattttttattttcatggcgattcataacttttaaagccaaggtaacccggtttttggttcccaaaattgtttagccgagaaattccaattaccaataccaactcgagaaacattaaaacagtgcaacaaaaaataaactgaccgttacagtaaccgagtccgagccgttcggatttgttgcggttacggtgtatttgccggattgtgcccgtgtcggtttgaccatggcaaatttgctcaagtagtcctggtcctgcacattggcacagcttggcaatgcttggccgtcctcatatgtccatgtcacggtcggcggtggttcaccatcgatgtgcacattgaacttgacgtcctcgcccggtcgaacgacaaggtcggacagatcttcacgatggatacgaggcggcacttaattattaaaattaattaatataatttaaatatattttagaaattttaatttatttttttaattaaaatatatggagagaatttattacaattgcgtggctttgcaacccactggg

SEQ ID NO: 3592 - DNA, 1045 bp, Heterodera glycines
agtgacagtaatgcccggctctgtacagcgtccacacggtacccatcgaccgctcgccatgtccagcttctccacttcgtaatggtccacgggcatgccaccgtcatcagcaggcgctttccagtccagcgtcatgcggtcctcaagattggaatacggtaataccgtatattcaatggacaataaatttctcggaaaataaattatcatgcaaaagaagactaaaatgccaaagtaggagtgtaaaagtaacgaattagaatttcccggtttttttaatttttcggaaaataggcgttaaaggagcaatttcccgttgaattaattcgcgttatttaaatttttagttttttatataaaatttgatcacccataattcttctaaaagtgatcataattccatattaaattttaaaatttgctgtaataataataattattgggtcaattttaaattaattatttaacgttattattatcacagactatatttcattttcataatcctcctcctccctacctccaacacatctttgacctccaacggcccctccggcgcactcggacggcccagcacattgaccagtacgccgtgtgtgtcggtgccgctttcattggtcgcggtcagcgtgtaagtgccggcatgcgcacgtgtcgcgttgcgaattgaaaaattggttttgtagtcctcatttgcgatgcgcaatttgtcgttttcagcaattggcgcatcattaaaggtccacactttttcgggcggcggctcgccggtcaccggcactttgaagtccaccgattggccaaccttaagcgtcagttcagaaatgagaattgtttttttttattaaaatgaatcatttttaattacccaacgatattttttcgagaaaccatggacacttttgagtctcgagtaatttggagtcccccaaacaaaaattaagggttttttaataaaattattcgattatttacgaaaaaatgtaagcaaattgaatttcaaaggtattttaaaaccgcgctactttttggttttttattaaaa

SEQ ID NO: 3593 - DNA, 1001 bp, Heterodera glycines
ttttcttcttcctgcgtaacatttttcttcattttcttctgatcactctctgtctccgactttctctcttccgtctctccgtttttgctactatttcgtctcgcttcctcactctgtttgcttctgtcactctccgacttgcttctctccctcgccccattatctctctgccatccctctccgtcttttcctccctcttctccaacactcactatttctctttctctgcttccgtttctctttcttttgataagatttcccaatgcttttctgtagaaattcgcttgtctcctgaattgttgaaataaacaaattcgccttatttttgtccatttgccttgatgaaattgcggtctgccggaattggcggaccaaagcgtcgcttcctccgagttgggcaatgatccgttcgctttctgattttgccaaatgttcccctctttcccccccccctttttttaccctttcttcgctgttcaaattgtccaattacgctgcgcaaatgcatattctcttcaaccaatttgttgatgattgccgtgtattgttccttctctctcataaactgaatttgaatgatttctgttttattttttattttctttgcctccgattccggcacagattgtgccaaatgggaacgaagtcgttggcactcgctttcgagtcggttcatcattttgcgcgtttccgtcgcttgggttacgtctttgtcggacatcaattttctgaagggattatttatgatacatatataattattaattaaaaatatatttattttttaaaagaataaatgacttttactctctctcctctctctctctcgctctctctctcgctctctctcccctcccctccaggtttttattattctctcactcactcattctcggcactcttttcctgcagcatccgctcgtaaagcatcactttgcggcgtaatgatgctatttccagccgtgcccttgcgcttttcccttcggcggtgccgtctttcg

SEQ ID NO: 3594 - DNA, 3642 bp, Heterodera glycines
agaaaaacaaaacggagatcgttctttctgcaggagggtttcgagtgaaatggactgcgactcatcgatggcattttgccagtggcatttcgatgaccacccaatggcccgggggaagtctctcttcgcggataggtggcacattgtgccgagcttttgtgtgccatttcgttttgttttatttgcttttttttagtatttatcctcaatgtttcaaaaatttaagctgatgcaaattcgtcgttcccgagtttgtttttgtcatttgttctaatgccaaccgaaggagaaggaaaaagtcagaaaaaagcggccaaaaatttgtcaaacgaagtgagtttttcagagaaattgaagcggaggatgaataaataattttttgtttaagtaaaaagtgaattttgtccaatttggcaatatttaatataacattactgtaagagggaatttatatatttttttttcgaaacgaaacctttcataaaaataattttttatttgattttcggtctcaatttgtactttttatttgattctctctcccttttttgttttataagttttatatcaaattttcatttgaagctcataaattttcgtttttagcgtcaaaaagttaaacttttcctcaacccgcgacaaaaaatgccaccgacgacaagagaacacattaaggtatttttttccaaactagtatttccaatctttttctgccaggaatcccaatatggctttgtttacggcgtttcgggaccgggttggttttatttcgcctcattttttgataattttttacttttaagtggtaactgctgagaaaatgtccggtgctgcaatgtacgaactcgtcagagtcggccattctgaattggtgggcgaaatcatccgattggaaggcgactacgccacgattcaagtctacgaggagacttgtaagctcgtcaagttcgataagttcactcgtcctccgttaagcgtccgtcacaatcggtgaccccgtgctgcggacggggcagcctttgtctgttgagcttggcccgggcattatgggctccatttttgacggaatacaacggccattgcacgacatttcagaaatgaccaaatccatttacattccgaagggtaaaatttgtgattttattcccttcgaattttaatttgacattttaggggtcaatgtgaaggcattaaaccgtgcaaaacgatgggaatttatgccgaggaaagatttgcgagttggggaccacgtgacgggcggagatatcatcggaatggtgcacgaaagtgcgttggtcaagcacaaaattatggtggagccgaaggcgtgcggaacggtcaaattcatcgccccgcaaggccaatacaccgtcgaagttggcatttggacgaaatgccaaacttattgactctttccccccccccccccccctccacaaaggacaccattttggaagtcgaattcgctggacacacccaaaagcttacgatgatgcacatttggccagtcagaaacccccgcccgtccgccgaaaaattagcggccaatttccctctcctctgtgggcagcgcgtgttggacgcgctcttcccgtgtgtccagggcggcacaacggcaattcctggtaaacagttatttttgctctcattggcacttcggcgtttttctattttatattttttaaattttcaatctattttgttggtctaataaaactttgtgaaacgtgctaatagagaccgaaattttgaaatgaccagtacttggaaaagggaccgggacgggatccccccgatcccaatttttggagcggagcccgacgagacttttcaaaaacgatgaaaaaatgtaataactatttttttaacttttctccgacgatgattagggagagtaattccatatttgcagtgtaattggtcgcttttcaaatttttgctccgttagctctgtttttacccaatttccttataatttttcttccccagtcttttaatctgttgtcatttgtccgtcctttttcaggtgcctttggctgtggtaaaactgtcatttcgcagtcgttgtccaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggtgggcactttgccaagactgtatttttatttttcgttaaatctcccctcccccttccgcaggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcgtaagtgcatgtcgaccgatggcactttcccttcccttccctttgctcagagtgtcgccgcccggcggagacttcgccgaccccgtcacatcggcaaccctcggcattgtccaagtgttttggggactcgacaaaaaattggcccaacgaaagcacttcccttcaatcaattggctcatttcttacaggtgggccaaattgggaaaaagtgaagaaaaaggaaagggtggactttgtttattacaaaaaaaagtcaaaaacaatggttgtgcgatatcatcggccaacactttacggacattagctaatctttcgtcaataattgcgtcctttttcgtccgttctgtccctccctttgtctttttctgtctcaaaaattgctgaactgttccaccggttgttcctcgctgtgcgcgagttgcgcgtgtcgcgttgcctccggcaatgcgtaattttcccccggcgcgtgctgctgtctgcacctctgtctttctctgttttgtgctgctgcccttccctttatgcagccgaccattgacgacagacaaacgcactaaacagcaccttctttctctgctttgtctttgtattttagggtccattgcttttattggacctttgaccctccgcttttattctcagttaattctcattacggctgtttgattcgactcactgatttgtcccctccgctcatataatcgatgtattggtaccaaatcaccatgaaaccaatcgccagaacattgaacagaaaacagaggacaaagcctccctcaattgcgcttattgtcaccaaaactttccagtggaattcggtctgaaaattgcatttcatcgccgtcataaattcacaaaatgatttcacctgatagaaaattaaaagagcgccggcactcgaattgacgacgagtaaaatggtgacgacggccaacagaaaagtgttcacatagaccaaatcgagcacttcgagtttcagtgagatgagcaaactaatcagagagacaaaagccaagcaagagacaccgccgtacaaagacacagcgaacggagcattgacagcatgtcgaactctg

SEQ ID NO: 3595 - DNA, 4344 bp, Heterodera glycines
tcgttcgcttattttgactctcttggcacctgatttctcctttgttgccgctgctaaaatatcttccgcaactttttgtgtgtcgtgccccaattccgctgcgctttctgtcccattccattgcgtttgtctctgcccattttttgttttgttgtcatcgttcgtcctccaattttcttcgtccgttccgttgccaatttgtgccgttaatagccgtattagttgttgattggtttttgggtgtgtcgttgtattattttcgttggtcgaatcgaatgaaagaacggcgttttggccactgtttttggtgaaaaattgatatccgccgacgtgtacaaaaagaagtccgatgagaaggcagctcagcacggcggtgcccgtttgaattgcgaagctgaccatcccacttagtcgtgccggcactccgcaaatgccatccactccgcggtgggagtagtaatagtcgtgctgctgctccctgccgttcgtcgtctccattctgttcgggaagttgctaaccatctgcgattgacgctgttggaagtgtgcttcccactcactgccgtagtgatcgctcactgttgttgaaccgttcgtttgtatgtcaaacggagctgcgttggcggtggcaaatccaattgaatttgtccgtccaatttggcgatttgtttccgccacttcgttttcggcgtttttcccttctgctactgatgctgcttcttctgctgttgtgtataaggggggtggagacgtgggaatgtttgggttcggattttcgaatacttcccacttcctcttcagctctccgattatcccatcaatttcctcttgtccgagtgttgaagtagatgaatatttggtatgccgactctttggtgccggggacggagaaagtgcagccgaattgtcggaattgttctcttccttctcaacttcggctgattcttcttcctttttgttgttttcacttttttctccaaaaatttcttgtttgcttgacgtaattttgacacgtttcgattaacgactttttaaaaagcactttgcatttttggtctaatatattttaaagacgtttaaacgttaaagggaatgtgaatggcatgtgtaaatggtaagcaattcattcacccttaacaatgctttgttccgcgcaattaatcggccatttgcattttccgcccatttcgcactcccttacaatgtcagttgatgaagtgtccgggcggacgggtaactgccattaataaatgctttaaagcggcgggaattagccattgactgcttgtgggaatgggtgctttcctttcccctcccttcctctctttctctctccgttttgcttctctgcaaactttgccggtttccatggacaaccgagccgagtaacaacgggacaaaaatgagcagccaccgattgttgctattgtggtgcctgttgttcctctttgcgtccatgactaattcctcctcaatttccttttttgtcctcccgcagctttccacgttaatcatgtttaatttttcaaatcatattttatattatttttaccgccataattcaatgacaacatttttattttctttcatgtgaaataattgagttttctaaaatggttgtgaataacttaatttggcttttgcattgaaagtacaattggtatttagcaaatatatgcgtgcgttggacgattattacgagaagaattttgccgaatttgttccactgagaacgaaatgcaaagaaattttgcaggtgattggcattataaaataattgagaattctcctgtttgaggaagaggaagatttgtcagaaattgtccaattggtcggcaaagcatcgcttgccgaggccgacaaaatcactttggaggtggccaaactgatcaaggacgatttccttcagcaaaatggctattccagctatgatcgcttctgtcccttctacaaaactgttgggatgctcaaaaatatgtatggctaaagaaaagcaaatgatcaaattgtgttgttcgaataaacatcctaaggattggcttttacgactttgcccggcactcggtggaaacgactgcacaatcggacaacaaaatcacgtggaatcagatcagagatcacctcggggacatcattcacgaactttcttcgatgaaatttgaggtggacatggaaagggatgacaacaaccaaatcccaatttgctaaccaattaggacccatccgaaaaaacggaagatcagatcaaaaaggattacgaagaactgtatgaacggatgcagaacaaattccgagcgttagaggatgaatgaacaaactgtgatcaatgataacaatttctcaaaattttccctcatttctcttagtgtagtgatggaaaaaacgtctcagtgagttgtagttgtggtaggagccgcacagtttccatcggcacgagtgggcactgcgtcgttttgctgaaagcgttagaatgtattcaagttatggtcatttgattaccgtaaaccgatgggaatgaccgtcgcatagggccaccattttggtgggacgacggcggaattttaagcaacggtatgaacgatggactcaggaagggcggagagggaaataaatttggcacgacgggactgaactggtcgagcggctgaaaagtgccaatggttaaagctagagttgtacgggaccgggactggtactaaaaaacgtttcaactgactacctaagtcccagttttggccgggactattcccggttttttcccagccaaaaagtcccgtttttcaacccgaaaagtcacggtttttctcaaaattcccggtccagtacagctctagttaaagcatatagggaaaagcagaaaccattacagaacttaaggaacaacgaagggaccgcacagattcataatgagcatctgactcattttatttcttcgagttattaattaaggaagaatagatgaccagtataacttattacacacaaatgaatttgccatttaaattcggcatttgctaattggcaaataattaaactcacagcagccgaaacggaagacgacgacagaaccaaacagagcaaaagcatggccaaaaacaccgggaaaaccatcggagaaggagcgaatttgaaactcaccggtgaaaggacgagttgagcgggaagaggacgaatgaatggagtttgattggattggccaaattaaagggcaacgaatgggtaaagggtgccgcgtggggagtgccgaagtgggggagggcatgcaaaaggccccggtggataaatatttgctctctctcacttcggcgttcattcattaaattttaggaaagttaatcacttttggtcaatttagtaattcagggaaatcaaaggctcagcaatctttgcatttaattttaaattaaatttcaaacagaaaaaaggacagaacaatgaatgacgaaagtgtcggtgaacaaattaagttggaaagaccaaccgactctacgaggaaactttgtgctcctccctaattgaatgagcacttcctcattaaatttgttggcctttcattcttcgacaatctccgcgcggatttctccgccttttgcctttgggcccggccgcgggtgcgtcgacggcgattggaacaaatggtaaatgctttccaactgatcggccacccaatacggcctcagttggtttggcgctgcccttcgaccattttgtgctatcaatgcgtcgctgggaattgccaattttggacaggtgccaatgccttggacagcaattggacgctcttccgccgattcctccgctttttgtcgttgtcttcccattttgggaaacgaatgatctgagggaaatgaaaataaaaaaataaataacaaaaagaaaatgacgaatttaaaaaaatggaaaaggaaatgttgtcagcacattgaatctccttttactttgtatcaattgaccaaatgttagaaaaataaacttttgttggtttttttcgttgtccaattgcgtgttccaacaaatgctcccctttcccctacccttccccccctcccttttccccttttcccttccttccgtttggttttgtcattttaattggtgggcaaggaagggcttcctcctccgccgcattcattgcctttcctcccatttcatccaattcacaattgcccgtccaaatgccccgagggtcgcttcttcagtgcctttcccctcgggccaattgccaaattcccaaatttggcctttcaaatttgtctgttttcgtttgctctttcattactttttaatattgtaaggattgagccggcggcggacagttaaaatgcttcaaatcgaggcgtaaag

SEQ ID NO: 3596 - DNA, 3946 bp, Heterodera glycines
ccatttctaagcgcattgttcagttttatacaaagtcataaataattccaggtattttacggtgtgttaaaattagtaaataagtagccaacgaggaaaggaggccggtctacaatgtgaaaagtcaaaaatcgacatgagagttgtgggggtgtagaatgattcacaattcaaaaaataacagggtgcaagctgttgatgatcttcttgccagaggagtaacgactcagtgcttcaatgttggtttggacacagtgcgcaatgtgacgcagccaattcgggtcgccgggacgacggctttggtacacctttttggaaaggaaaaaccaattggacttttgtcttacaatcagtgaccgtttatgaggttataatcttttcttaattgactaatcttatattcttaaatcaaacgaaaacgaatttaaatcttataaactccagcttcaaatgacactaagaatagtggcattgaggaagtaagaaaaaagatggtccaggggggaggggaacgtaatgcacccaaataaaatttaagtaagaacacgtaaaacatacgtcacgggcgatggggatcatcctctgaacgacgtaattgccgtactgaaagggacacgtaatgagatgcccatgcagaaggtcatggaataagtcaggttcacctgattgaacagcatttcatacagagcagtccgctgctttccatcactgaaaataaattggtaaaaatggaaattcggaaaaaaacaattacgttgaaggtttgtacccctccaacacctcccggaataacatggccaaacagttgcagcggtcctccgcgtgcttaaaagcctgctcgaccacgtgcgaagagtatttaagcagcgagagatggtaaacgttgcgactgaaatttgtgtttttgagcgatgaaagattaggctttattttacatgatgtgagttttgatgatgtaacagcgttggcggcggagatagggcgatttgataataaattggacgaggtaattggcgaattcgttttgggccaacgaatacgcatttttgagaatgggttcaatgagaacatgcaatatttggatggaaatttcccttaagctttacgaatgataacgggccaaaaaaagaacaattcacttttccaagctgttgttggcattcgcagtgccatggacgagttggacgacattttcaaggacgaattggatcacacgacagccgtacttattctgcaaaaagacacgcaatcagttaactaaacagtcaacgaaggaatattctggtgaatgattctatcgacgtgacggcatttagcttcactcccaattctttgaattgtctatacatctcatccactaccctcccctcaatcgaacttcgaaaacggcgctcagtcgggtgggacagttggccaaggcgaggataaaaggtccgtacacgtcgggcgcaaaatggtcaactacgcattgcacaaaatggttcccgttttggtcggtgaccaaagtgttctcgtgtcctttgaactgttggcagaacaattggcggacttgggacccggacaaattaacgacgagctaaacaaaatgggcataagtatgaatcaaggacgtgtctcaataggtaataatgtctttttttcggtggaccccaaaactcagccgccgaaactcagccgagacataattcaaattttcaagaaattttcagcgattttttttttaaattttttgaattcttagtaaattttgaaaaaaccaactgaaaatttctttttaaaaaaatttattcacggctgaattatgtctcggctgagttttggtcggctgagtttcggcggctgagttttgtcctgctccgtctttttttaccttctggacaatgcgacaagcaaaacgattgagcaccattttaaaggcgagcggacggaccaaattgagcaacatttgattggtttcttttgaaccgttctcaactaacttctgaaactattgttaacgaatctgtttcagtcccaaatgtgatgcacctgaatgacgaaacatccgttgcaatcgatgcacaattgcagaaagcgttcttttccaccgttgacaattgcacacaaaacctggaaaattcacaacatcaacaaaagacgttctctgccaaatgaatccaaaagtcagttttgatggatttgatcgtacttgctgtcggaattgttggtcctggtccatccgttgctgcaattcgcggttgcccaccccggcggggtcttttgccaacttcactaaaacgtcgaaatccgaaggagatctgaagtcatgacagtggagtccgttggtgatgcctttgggtggagaaatagaagaacggaagttttcgatatgacgtgaatattccttgttgtccaacattgagccgaacagtggtgagtgcattgttagcgaatcaaaacaaaagtgagcgatgagtagggttagtttttttaggagctaaaaactgccaaaaggtaggatttagggcacttttccagtttatacaccccgaagcttccagtttatacgctcccaaattttttttttttaattattcgccttccaaagtttatgccaccgcatttctgagccacagacacaagttcgctttgcatgaaggagatgcagagaagttaaccattcttgaaattgagcgtcagaaagttgtattttttgatataattttgcaggagtaaaatttttggcgctatttaaaaagagggcctttttgaattttttttttttgcacttttttttgctcgaattttttttttaaatttattttaataataatgaatagggagtccaaaaatatgtacataaaatcgcaaaatatgcgcataaaatatgcaccaaaaatcgcgaaatatgcacataaaaagaaaaatatgcacataaatttttccaaattgagggcaaattttcaaatttcttcaagtttgttaaatgtaagcataaaaatcccgaaaatagctaaaaatagtatgaatgattattttggaaccaaaaaagtaatatttatttattttgaagaaaattgcgcaaaaaatggagaattttctatttttctgactatttttggcataaagttccaattttttaaaaagttacttttttaccagaaaatatacccaaaaatgtgattttttttgaaaaattttcggtcattagagcccaaatggccgctttaatagagggggccgtttaatagaggatttattgaaaaaatgcccaaatatgcacataaaatatgcatgaaatgccgaaatatgcacaaatatgcacataaatcgcgaaatatgcacaaatatgcatatggaaagttatcctagaagcttcaaaacaagctaaaaacatgtttttcgtgcgtttcaggcctcccacagtccaggaaaaaaatatgcatgtgaatataattggactccctaatgataatctaagtgatttttttgaatgaaataaagaaaaatttgaatatatcaacaagaatgaggcatgaaaattgcgaatgagttcggagaaagtcagaaaaattggtcatatcgaaggtcgcgcggttccgcgagacccactcgggacgaaaaatggcgtatttttacataacgatttgtttaaaaattgaattttataaataatattataaatttatctggagaaaaatgaatcataatttaacttcaaacttaggtaatcaagttttaactggagtaatagagaaatctttggtctatctaattaaagaaaattaaatttggtagttttttaattatatgtttcttattttaatgatcatgtaaaaattgaggaatattctatcgctcaataccaatggattattatttgattaagttttgagcaaaattctgcaaataaattaaaataatattaaagtttaattttaaaatcatttacactttttgtgttcga

SEQ ID NO: 3597 - DNA, 3572 bp, Heterodera glycines
  misc_feature (2071)..(2071): n is a, c, g, or t
caatttggcgcagtcacaaacaaaggacctgctctacatcttcgggtgagaaaaagtcatcaaattttttttcaggactaaaagccgagacggtaaaacaaattaaccgaaaagccgggattggctgtgatttgttttgaagccgagtcggcacattctaaaagcagtcaaagaaactcctagacatcaaaagccgggttgactctccgaattcgtcaaaagccgggtcggctcagcaaaaattcgacaaaagccgggttggctcgtcaattccgtaaaaaagcagacaaaagactgcttattcttctaaagccgggtcggctcgacaaatttcaacaaaagccgggtcggctcgacaaattcttcaaaagccggattgctaaacaattgacgatggacccaacgcagcttaaactaattttggaggttgtcttgaaggcatcagcggaacaaagcaacagttctgctgcattggcaacagcaatcgatgctcgcctttcaacatttgattatgaccctgagttagggcatacattcgacgtttatgacgcagggacattttgacgggcagcgccgctcctcaacattaatatttttctttattttttatccaattaaaaaaagagctgtttttgaaaagtttttgccaatctacaatacctaatttggatgatcatggtgtcatttaaaaaaattcacttacttttgttaactgagtcatttttttaacattttcaaaaacatggaccggctcagtctattcactatcttcataaatacatatacaattcagcttagatggttgtaataggtcaaattgatgctttgaacgacgtatttgcctttgttaccgatgttaatggcaaggaatttcgtgtcccgcgggaattgtaagttattgcgtaaataatacaacaaaattccaccaaaaaaggattcgtgagccaatgttcggaaattactatcagtttgatggcacttttctggaaagtgatgttcttgagccaacttctgtcacggctttggctaatgacagcaaagcgttgttggacgcccgggccaaactttgggatgaaaaattcggaaatgacaaatgcacattgcagaaaatcaaggaaatgggcatcgattcgttagtgaaaaagtagggaaaacagattgaacatgacaagaaaagtaatttagaatttttgattcgtctgtgagcgaagaagcgatggaagagaatgaaacggagcaaaaggcaaatggaaatgttaaggtgggtcgagttcgccatgacgtctgacattgtaattcgctttggtttttcagttgcacgtcgaagtaaagcgaagcggcagaaaaaacaaaaacggggcggagatttattgctcggacaattttccattggttatcgacagcagtggcctcttgaacagattcttggaggatgagccaatcataagacacgcgccggaccgaaaattcggtgtttggtgcgcgccgcgaaaatattcgatcgacggaattcaatggaaaattgtgcggattgatccggagagcaaaccaaagaaatcggtcccgaacggagttagcaaaatgaatgggcgcagcaaagaatgtgtcagcaatggagggcagactgacgaatgcatttcgagttctccatcgaccgttccttcgcttccatcgacgactgttcgaaactccccgaaattggaggaggaggaggagaaagtggatgagaatgaactctttgagggactcatctgctcgcaaaatgaaacccatttcctcgtcttttcccctgggcgtcgttggttgggccgtttggacaaggcaaagtgtggcaaggacagtgcgtctattctcgggatgtggatccaattcaaaatgtaataaaatattttcattccataagaaaagtctctcttttcagcaagaataaagccggtatgaaattcgtggacacgcgcttcatttttattcgccaaaaaatcatcgcaactccaaccggtgattatgtgttggttgtacattttaatttgtgaattagttctatgtcatcaccccatttaatttgttattntaatgcccagattcgctgtcgtctcaatattcctccattccttgaagtgagcgaaactccgtggtgtgaggaattgcgtacaaatgtcattgataaggctgagatactcaaacaagagcactatggaaaaactgtcctggtatggacaagggggggggggggtcggaaatacgcgtttatgaaataccctaaaaaatacaggcggtgattggctgtccgacgcaagtggtggacgaggactcctacgttctgaagtggcaattgctgagtgtggtggattagaatgataagtatactcagccaaaactaccgatctcactttattgtattgccttaattatgtacggttgacgattttattccagaatgtttttaatttattacattgttcaagttgattacatgacaataaaagtttgatatgtttaggcaagagaaaagtggggaacaataaaaaatatatttccgcatgataattggttaatacaaggttaataccatctctaatgttagtctatcattttgtaaggagacaatatcagccgagggtcaaacagtcgtttaataccagaactaaacattcgccgtttttggtcgattagtttgtgatggtattctcgcttcaacagtcctatcccatgctctgctgaaatgctcccgcctgttgaggccactgtttcataaatgaaggggtaaagcctataaaaaagaacttgtgctttacaccgacaattaatccacctttggtaaacgtcctcgtcaaatgttggcacggtgacgttgagatgggcattaccatcgcctgttttgagttccaagtaaatggcacccatctttcactcacccaaatggccaaatgtgcaaattcgtcggacgttcgtctcacgcaagcgctccctaatttgctctgtcacctcgtaaaagtgttctaatggcaacgaaatgtcgtgcttgaacacgtaaccgtcctggcgaagacccaatgagcaattctcgcgaattttccacatgtgttcagcctcggacatattcttcgctagcactccgtcagcagccaatgcgtcgccaatgcatcggtcgaggaatcggtccatcttcgctaagtcatgttccgagtcggtgccttgaataaagaagtggtcagaacacgtaaataaatgacggaacattcagttatgcaataattacccacccgaagtttcaatgagcaaattaaacgaatatgcaccaaaaatcgcgaaatatgcacataaaaagaaaaatatgcacataaatttttccaaattgagggcaaattttcaaatttcttcaagtttgttaaatttaagcataaaaatcccgaaaatagctaaaaatagtatgaatgattattttggaaccaaaaaagtaatatttattttgaagaaaattgcgcaaaaaatggagaattttctatttttctgactatttttggcataaagttccaattttttaaaaagttacttttttaccagaaaatagg

SEQ ID NO: 3598 - DNA, 1673 bp, Heterodera glycines
atttgtagcaaataaataaaaatagtaccggaattagggtcaaacgaaaaggtgtccgctatttttttggttgacaaaacaatttcatcgtgaacctgtaacgtttttgcacgcttttgtcatgtcaaggaaattaccggaactgaccctccgaccaatccggtattgcccgcctgaggcaccacggccaaccgacgatggaagcaatgtttaagcacagcggacacttgctgaacggactgaggaaggagaacacactgagaacgacctgcaaaaaatgggatttatgaaccaaaaaacggaaatgaaattactaaaaaaagtattcagtgagaaatagaaaaatcaaacaaatgcagagttcccaagtttctattttcaaaataagacaaaatggctgaaaaactaagattcggaccccaaaaataagatttttccaaaactaatagtagcgcgaagaaaacgcaataaaaacatgaaaaatcgacttaataaatattttattagcgtaaaaaccagagctgtgaactgaaaattttcaaaattagcattggccgacaaaaatcatcgtttggggtcaaaaaccagttttttgaacagttttattcaaaatgattaaaaatcaacaaaaatataatactagagctcaaattttgcattttttttaactttcaaacccaaaaataagcacaaatcttggaaataagcacacttgggaactccgaacaaatgaaatcccacctgtgtaccaacgcataaagtcagtgttgtatcttaaaattgaaagtgaacaggaacgaagagaaaagcattcactcgtcaatctcttctgtcttaacacaacggtcgccgacaattccacgaaaattccgcagatcatcttcagtaagttcggcaaattctcctctccgttcgatgactgttgaaaacaaatgtcgaccattgaatgtatgaagcaacccccggatgatagcgcattttaataatgccattgctacgaaattaatttgtgaaaaaaagttcaaatatttcaagcaaaaataatttgttgaaaaaaaaaacaaatgagaaatgaaagaaaagggaatttccattagatttataaaactattacgacaataaacagcaataccatctatttttcatacgtcaacaattgtctttatttttcgctgatggctctgagcgcggcttcggccacttcaatggaaattcccgcctcggccttctgcacatcagttgcattgaggtcagaagctttcttttggctgacatcaatcaaatttttgatggcctaaatttgtggggcaattagccaggaaaatgagtcaaatttgtgcctgttcgttgagttcgctaagagaacaaagttcctcagcgagcacttgacacgagccgtcaatattcattgaaagggtaccagaagaagcgaaaaacttggagacgtttcctaaaacattgaaaatcaatcacaagatacaaattcgaataatgttgaacgattccacaatatttggaacaaccatcaagttcgtggactttgacaactccgggctttaagactgcaattgtaggcacatgggtaggaagaattccaacactgctggacatccctgtaacatcaatttgtttcactgccacatttgcataaaatgcctaaaattataaattaa

SEQ ID NO: 3599 - DNA, 7348 bp, Heterodera glycines
tggattttctcactcggacatcacaaggtcggttacgttgggcttctggaaatccttcgttattgatgttccgaaggggaaaaaaattctgggctttctgtatttcttttgttgttttgtttgttaaaccctctcactttctcagattgacattgtcgcgcgatgccaaggcggtaacaatgcgggccataccgttctggcaaatggccgcgagtatcatttccaccttttgccttccggattggcctcagaaaaggtgacccaaaaaacaaaacaaaaactaatgttgctgttgcaggtgttgaacattgtcgggaacggagtcgtcgtcaatttggacgcccttttcgaggaattggagagcaacaaaattgaggattcggcagaccgactgttcgtcagtgacagtgcccatttggtgttgcctgtgcacatcgcaacggatatcatgcgggaaaatgcgttgggacaaaactcgtaacaaacggaacattaaacatcgatcaaattatttacatttttgcagaaaactcggcaccaccaaacgtggcattggtcccgcctattcgagcaaatgcttccgcaatggcatacgactgggcgaactgctccaccaaccagagaaatttgaacaaaagttagtcgattaataaaattagttgaccttttgtcgtgtttagctatcgttcgctggtcgcccacttcaaaactcttttccctgacattgaattggacacggaaagtgacgtcaaacagttgaaggtagtttcttttttaaatttcattttgcatttgtcctttttttgttaggcccatgccgcacgtcttctccaaatgggcattgtctgcaacacaaccgttttcctgcacaaaaagcgtttggagggcaaatcgattttggtggaaggagccaacggcactctgttggacatcgactttggtcctatccaataatgttccaatttcttttaccttttcttctcaggtacctatccgttcgtcacttcgtccaattccaccgtcggcggttgcatcaccggccttggcattccgccgacagccgtccgtcgcgtcatcggcgtggtcaaagcctaccaaacgcgtgtcggctccggtccattcccgactgaactgcttgacgccgatgtatgtacttgccccaaaaattatgttaatttgatcgcattgtttgtctttccatagggacagcccagcgaagagggcaaacgtttgcaagaagttggtgctgagattggcgtgaccactcgcagaaaacggcgctgtggttggcttgacttggtgctgttgcgttattctgcaatgatcaacggattcacttcgtacgtttcacccatttattattttatatgttcatatttatagtttttttcataattttagtttggctgtaacaaaggtggacatcctggaccaatttcatgaaattaaaattgccattggttacgaattgaatggacggcaaattgagtaccctccaggtgagctgaacaaaattaacgactgtttttatgccattccaagtgtttatcttttttcagcgaccgtcgatgattgggcaaatttgtgcgtccattacaaaacctttgagggttggcagtcgccaacgaccagtgcccgtcagtgggaacagttgccggacaaatgccgtgcctatttggagttcatacaaaatcaactgggcgtacccgtcgaatacatcggagttgggaagggacgggagcagctgattgtgtgcacgaataacggagggtgatagagaaagagagaagtcataattattgtttgtaaatttattttcgaagcatccaatctgccattctaataaaagtgtggctcattcagttatataaatgatatatcatttgacgtctctcggtctgtaaatgccgaattcgaaagaattttttagacaaaagatgggtaaactccaaatgagaggaaccgttttagattttgttgaacattatgcgttttacccactcgacggttcagtctcgaaggcatttagcctacccatttttgttccttgaaaaggatccctcgtttggttttcgaaccccactttgatttttgtcgacccttctctaaatagtgcttttttgcaggcccgtaaccagaaaaaaatttcggggagggcacccgaagagctttttttttgctcttcgggacaaaatgaataaggaggaaaagcggggaaagggggggggacggcacataccaaggggcagcaaaagaaggggaacggcacgtggcaagggggaaatggggcaggggcaggacatggcaaagaaagggggggataaagaaggggaaaggggtgggggaacggcacatatcaagcaaggggcaaaagagggggaaatttacgaataaaaatataaaaaaggacggatgcataagttgtccaataaatatgtattatcgttcaatgaaacaattaattgtttgatggtattcactcattcatttcttttctttttggccatctccgccggtggaataccaaacggactttttgtcgactgatttttctgccgcgttttgacgaggaaacagagacttcagaaaagtggcaatgtccggaaggacatttttgtgctgaaagagcattcattttcaatgccatccgcaaaattcggcacggcccatcccccggggcatcgtttgtacagtctctgtctaagattctccccccgggggttgcccgtccctttttctgcgattccttcgtctcttttcctttgtgccaccttttcctgctcctcctccccctccccgtcgtccgtcttcggtttccgttctgtgcctgcgccgtacccttcgccattttcgtccgactccgtcgccccgccgcattccatgccaccgccgcagcatccgccgccgcagtcgcccctttcgcgcggcattatgaaagagcgaaattgggcggaggagacaatttgatgctgaacaaacggaggacaaatatgtaattgtgaatgaaaagcatgtttaacttggggaaactcgcgacagccaaacgcgcagagattggcacggacgaaggaaaaagtggcacaaaaagtgagcaaaaagtgggggaaagagttccgaagagatgccatggaaaaggggcggaaactgtgcaatttgtcacttaaatttgtgggccgaatgctcgacaattcggcgtcaatttccgcataaattgatcgtttttcccgctttttgatgtgtcagtccgtactttgagcagcagatcaacggaagaaaagaaaggacggacagaagaaaagactgcgccggggggcgacggatggccaaagcgaagggaagggaaagggccaatccgttggccaaatcaaacaattagcagcacaatgacactgcgagcaaaggtccgttattgtccgattccatgccaatttcaatgcttttcgttttgtctcggtttgttactctgtgccctttcgttgccaaaatttctgttttgctgattgctagggtaccggttaaaattctgattcactggaaaatttcgtcctccaaaattgtttccgtaagaatgactcggtggcccggttcttccaaaatattttggctgaggctggtaagaattttggaaatttctttgaccaaaataacgactttgttcgttttggtatgagatttggttcgcgtttggcaagtggaatggattttgtgaatttcggatttgaaccgaacgttcctcagttttctcttcaaccaaactaagacgattagcgaccattaaaagttcgtcgtatgtttgggacggttttgactgacactccaaaaattttgccatgttcgtgtcattgatattaagaacgaaaaattttttggaaatttcgtctctttgtgcctcacttaaaccaatatgggcacaatttaccagcctttgaattctttcaccaaatttcataacactttcgccctcctttcgtttccccgtctgtgtaagttcctgaaaagcacttgcttccttgtaatccgtctccctcaatgtcgacattatttccgtttttatcgtctcgaatggcgcggtatttccaaatttactcagtgccatgttaagtgccctcagagcttttcccttcaatttcgttttcaacatttccagctttttttcatgtcgccactctccaacacacatttcaacagtcaggaagaaatcattgattttgtcacttccttccgttccgttcaagattgggatttctctcattgtgtttgcatattggttggagagtgtgactttgtgtaattccataataatgtccgggatgggaatggtttgggctgggaacgcttggttttggtaaacagggggatttatctgtgcataaaccatttcgggattttgttggaaatttcttggattcggaaactggccatgattgtgtcggttttcattttcggagaattgcaggttcaatggaggcacaaaattcgaatttgcctcttgtcgggacaaatgttggtacatccgagcatctcgagccgagtattgctcgttttggtgattggcgaattgtgaatgcattcggtgatttgagtcccgaaccggaaactcgtttcgatttggccgttcattgtttcggttaagctgtgaattcacaaacacgcgagggttataaaaattttgtgcgggattttggcggttatgattatatcggttctgaacaagatctcgattttgcatttcccggggaaaattcacaaaatagttgcccccttcttgaaaagaaatgtgcggtgaaattggagttgacgccgcacgggggtttccaatgttttgctcgttcccgccgaaaaaatttatgacagggttcagagggactgcgagctgctgctgtccatggttagagttttgagggtttgattgattttgagcgggggccgggaaaggctgattttcgagggggtgattggaaaaatttccctgcgcattgtttggttgcacaatcgcatgagtgttttcgtttagttgctgtccagaatttcttaaattccccaaattttgagaccattgtgatgaacctgactcctgctccatataattcactggtacacggcggcgaaagttgtaatgtcgttgattattatgaccactgtccattcattttactgcaaaatggaacaaaaacctgaaaaatttgagtcaagactttccaaaattaacacccagtcaaatgcttttgtccgcgtcagcgccttaaaaacgctgtccaaaaggatgggtttacgtcgtaacccaggagcgccaagtcttacctctccgggattgcggaaataggaaatggggtaggactgactgtattttggacggttggggaaggaaatggggtggtcaggtaattaaaactcagaaacacaattacggggacaagattgaatgcttagtcaagatttaacggagttgaagagaagcggagagaagacgaagagaattgttgccttacaaattggccgcacctcgtagtcaaaaagtcgtctgatgacaaacactttgttgatcagaacaaattaaggcgatttgaagaacaatttatttttaaaacacggagaaaaaacaaaaacggagaatatccaaaagcaactcccaacgaacaaaaaacctcaaaacgaatatgaaatttaaacacaaaataaacgcgaaaagtcatcgttttaaaataattaaattgtcattcccagtacgaaaaaaatttactaaccctcccattaaaaatccgaatattttctcaaaattctcaccttcctcgtcaatttttgaccaatttgtcgcctcatcagtgttggacaattgaggaagaaaaagtgtgatttatgcagagaaaagatattggaaaatagtgaattttatgtgcggtcaaaggaaatgaatggacagagcgaagacaaaagtgcggcacgggggaaaatcgaataaaaaattgccgaattgcaaaattttaaaacattaatttctaaaaagaaagcgcgctatatgcaaagttaccgttttcgtttttgaatttatcaaaaagtaaaaacaaaaggggggaccatttggttcgcaaaatttcttaatatatagtcatgaaaatttatcccctgggttttttgggtccatggatcaatcgaatttgaccggataattctggcgccttttcacgtcttccagggcattggaaatgccttgatcaaagagctcgaagggtcaacggaaagcgcggaaattgcgaacgaatttttcagaagcatccgggtcaggagggaagcgttcagaaaaaaggacatgacggggaactccatcagaaaagttctgattcatgcggaccaattggagagacgttactccgctgaatggccacaaatcatttgccaaaccctgggacaattggcaaagatacaaacttttacaaaagtccttttttatttggtttttttaaatttaatttttaatttaattttatcgagcaaaccaaaggcacatagtgctcttatatggtgccaaaaacaaacaaataaaaatcaaataaaaaatacaaaatgaataccgtaataaaaatgaataaaaataaatcaaatgttaaaaattcacaggtgattaaaatatagtgtatatgtgacacagaaaatttcctactcagaactcattgcttttagtaaacccctgaattcctttgccttattaatttgcaccgctaccactggaaggttattccagtttcttactatcctatgaaaaaaattattttgtgttttggccgtgtggcgctttactcgtaaaagtaaaggcctcctgggcctttctgagaaaaagaaattttgctcagcctctaggctggcgaacccttttataattttaaaagctgttgtcaaatcattaatttttcttctttcttctaatttatgtaaacccgcgattttaagtctttccacatattttttgtacacaaatccacattttcgaaaaacttttcttgtgaaaaatttttgtacccgctcaattttgtctatatctttttttaaattagggttccaaacttcggtagcgtattgtaattgaggtcgtacaaaagttttataagctgctgttagagtctttatttccctgcttttcaacactctcaaaatctgaaagcttctaagatatgcgtttcgtacaattttgcttatgtgttctgaaaaattaagtttcgagtcaattataatgcccaagtcacgaacattatccgactcagaaatcttttttgagttaataaaatattcttttttcatattatttttccctaaaatatgaaacaaaacatttttcagttgaaatttctaaccc

SEQ ID NO: 3600 - DNA, 2095 bp, Heterodera glycines
aaaaaaaaattgcgaaaagccaaaaataatgcccagtccaaaaatggaatgaatgtatttgaagagttgcaccaattttcttaacagatttcgttaacggcaccgccagacgttaccaaaattttttgaaaaactcagcgatttatttgattaactacagatttaaaaaaaaattattttattacgacctattcagcattcatcttctaaaatattataatactcacaatcaatgttaaattaaaaatgcatttggttgaatttgagcgaagaaacctgttaaaaggctatttttcaactgcgattaaaatttaaaagttgcgttttattaccccaaaaaattatagtgccggcgaactgtgcagcagtggcaaaacagcatatgctgcaaaatgagctctctacttatgtatattcagctaaaaaatgcaatttcaccttgtaataaatcgcagctaaaaactttttcatcctttcttattttattccatagaatttaaatatttttttaatttatcgggacaataatttaaattgagccgtgtttcataaaacatttctcgtttcaataatgctcaaacaacaatttaatgtaattatcatgcataaatgttcttcttcgttcttatttagttgagtatggtttttccatgacggattctgacgcaaaatttggagctttgatgtgggacacgccacaatcctaggacagaaagggtggataaaaaatataaaaaatgaaaaaaatattgaaaagggtggttgaattaatttaaatggaaatgaatcgctcaccgacggacaatagctggctggctctcctaaatttgacattaattacataaattttaaatgcaattatcggtgttgtacctggctctccgggtggtccgaacccgcccggctctccgctaatgcctgcctggcctggctgtccggtgggcccttgtagtccgattttcccaggtattcccacgtccctaatttttttcggtttaattacacaaataaagaaatgtgcgtggctttcttatttgtaaatgcattcagaacctgcttgctttccccggggcgccatgtggaccttaaaaaggtcaatttaaaaatgggtaaaattgaagcatacgcacgactccggctttattgatgaatcatattatgttgtgtatcaagagttgttcggaggctataatgtggaattccggccaaaaatcccggaattgctgtacagcaatttaatcctaccccctgatttgtaatatttcaaccgctttttctcgacagaaaaacccggatttatagcccatattgaccaattaggctttaactgttcaaatgcatagtttggcaatgtatatattcttcatttttttcccaaaaaatattgctccctacccttggggcctgatgctccgacaggccccggaggtcctttgatgccgatgccttaaaattgcaatgttcgttcatttttttgctgccggacggactgtcacttgcctgccaccacttggtcaccctgcagcccgggcctgcccggcaccccttttattcccatggcaccaacgtaaccacgtgctccatttgggcccataattccttctttgcctgaaaacataaaattttttctcccgctgtgtccgtatggaatctaacagtaaattttgcatttaccctctgagccgtattcgcctgatgggcccgcctctccgatacgtccgcgctccccctgagagcctctggaattgcatacaaaataacattccatttggatattttatagaaatcggcgggaatgggattcccgccggaaaacccgggaatcccgaagccctgtgaacctgttaaccgcctttttgccggaacggaatttttacgggaaagggaaaaaggcttcgggaaattccgtcctgcttttttcgtttctcgttgcaaataaatttttatcgtactatattattttatatattctgctggtgagatgttaccgttggcccggcgggcccgccggacagataacgcatggcatgtcggcctccggttggagttgtacgtccaacccgtcttctccgggctgaccttgtcttccccatct

SEQ ID NO: 3601 - DNA, 7538 bp, Heterodera glycines
gagttgtacgtccaacccccgtctttctcccggctgaccttgtcttcccatctttgcaaagaaatggtcaaacattttaaaattgagatgattttcaagggcgagattagctgagtgattttgataagaaattcatgctctccagaagtttacgttttgtcaaatcattttgcaaaaatattttttaaaattttattttaaaattttggtattttttcttcccaaaaacctttgtttacatgcatgatttaacttcccgcttaaaaattcactattatgatcgggaactttggctataaaaacatgtaaaaaggcattattctacctctccgggcgaaccgtcaggccccggaggacctgaaaaccaaggaaattgaaataattaatatttaatttgttgaaataattaatatttattctgctgtaagcatttgccgttcggtcctggcgtgccacttgcgcatgccaatgaatgacagccttggcagaagtgtttgttccacgatgcacgtgccggtcgacttgcaacaattgttgtatgcatcgttgggttatcattaattggctccatttggatcatttggtgccacgccctgtccgagttttgcttgaatcgaacggacatttcctaaacaagcagatgaggggataatggtgatgaatcactaatgatcaaaccatgtgtttcgcatcaataatctattgatcaatcaatgaacgaaatttttcgaaataaattctttgatcaatgatttgacccatttacaattgatccaatacagatatagtgaaaataaaaataaatagcaaaaatttttttgccattaaatagaaaatgatttttcggtcctgtgatttttggtctagacttaatacaggtaaaactttttctttttttaacagtaactttgagcccatttacagtctccaaatgctaacatagacaattggcattttgtcatttatcacctcaagttctgcacgcaaaatgtttgccttatgcacaattatcggcacgaggaacagcagaacgagcagggcacaagtgctgcagagaatgcccatcgaggcgaacaaatgggaggacttgggccaaggaggagaagcagaagatgaagatgatgatgaacaatattgcatctctgaatatgttgttcttcccattccttttcttttaaaaacaacaaagaattacacgagattaatcccgagccaaagcctggatcattagtaaaacgagatttaaaataagacgggatttaatactggcagatttcttaaatctgccatttagaacgtttgttcaacaaaaaatgttttaacttttttttttctaagcacattttatatttggtattgcctagtgatgaaattttgtgagcttttgagaacaaaactgtttttagagaacaacattcatagctaccaaatttgtattgaaaaaaattatgacaatttgtcaaaaaatgatcgcgtggcggaatttaagaaatatgccagcttattatcatccattcggcccattttccaattccttcataagctttacgatttgacggagggcactcactaatacaaaatgcatgaatgatgaagaaaaaagcgaaattgaagggaaaatgcttccattaacttcctcttttataaattcccattttttcgatacggcggcgcccaaccaaaatttatcactttcatccgttttcaaaaggcgagagaacaaagcgattagctgctgctgactgctgtgcttcctattcgacgcgcccccggcgtgcttttcctcatgatttgtcgccgcttttccccccaggggacattgagcgggtgagctgttagtgacccatttattagccattcattcaccggaatttaatgattaatgaattgggggagcaaagggcgaattttgtctgtgatctgattgagtgaaatggtttgtcaccaatttgtgggactgttgattggtcgaaatacgaaaagttcaagtgtggaatttacaaatttttaattgtcggtaatttatttttgaaagtattttgttttttctaaaaattcatcttaaatataacaataattaaacaattaaaggtcaattgccttccttttgagtttttccgagttcaaagttgatgataacatttttttctccaaggtcttcatcgcggtcattctattatgatatttttatatataatatacaatatacacacaaaaatacatttgtaaaaaaataaatttctttttttttatttggcgggatttcgactcattttggctgtggcgggatttcgacgcggcgggatttcgacgcggcgggattttgacgcggcgggattttgacgcggcgggattttgacgggcagcgaattttttttaatgctttttaaaatttatttttagcaatggttaaagtttcaagatattccattattgattccaacaatctgccgctcctcggctttccaacattggacgatataaatttgagatggcttttttcccaaaattctgaagagattctacaatttttggcacacaacggacttatccaaaacaaaggctaaaggattgtctgtttttaaggcttttattgatttattaaattgtaattataatttttgtgattattaatgctaattgtaagaaaaaataataataaaattgcatgaaaaaaaactgaaaaaatttcaaaactggtcacttttaatatagcgccgacaacgcattaaatctaaacggagggacagattatgaaaacacagacaaaaaggggttcttttgtaaaaatagacaaaatatataatttatgagttgaaaaaagagggagaaaaggaagattcgaacaatactttctacccattcttttgtttcttttccgggttgtttttatacatgcactattttcctgtttttttttctttgcactgccatacaaaagtgtcggcgtattttctttttctgcattataaaaagaaacaaaatgttcagtataaaactgttcaaacgctcttttctagccattattggcttagaaattcgtaatttaatgaaggttctgaaaatgacagcaaaaatgaggacccataaatccgtaactctttcaccactgatttgtgaagtgcgcacgttacatacgctgtttttgctattttactgcaatttgatcaaaaatagaatgaatgtcaattcataatttcgacaatggcaatgcagtctttttttgaacagccattttgtcgttaaaaagtcaaatttgttaaatggcgaatctgattttaaacacacaaatggcacggggttaattagtgtttattatacacacaattatgtacagtacaagttacaagtaatatatacgctatatacgcatcaatttggattaatccagtataatacacaaatatgggtatgtccaatatgaatttccatggcaattcatctcccatcatccgtctgcttcttcttctgctgctgttgtgctcatcaatcactaggctcccaagtcgcgcttcaggtccttcagaagtttgaggctgctgctgtggtattcgatctgtgccgccacgaactgcaccaattgttcagcctgacgatcctggaaaataattgaaattttgtcaaacaattttttttctgggtgtaaaattctcaccacggccgtttgaagagcctccaacgcagtgctgatggtctccagttgggtgtcaaattcgtcttgggctttgcgcaactctgcctcaacctgaaaaacagtggaattagtcaatggttgaaaaatggagtcggcgacgaaaataacacgacgtacagagggttttttgtcgtccgaggcgcgcttccaacggctttttgtcgcgtccaaatccaaccgtttcttgttcaacacgctgcgttccttctgtaaaggaaaagggagggatttggattaaaaattgtcgaaaattgagtgaaaaattgcaaatccacgcctggacggtgcgcagttcgttctccaggaggtgtcggaggcttgccaatgtttgcgtggtgaccgattggatgagttggcgttcccctgctgccattttggactccgtctgtgacaccttcagcagaatggctgaaaagaacagaaaatgcaattagtggggttaattaaattgagcatttccgattcaaattctctcacctccgaaggtcgactcggcgcccaccgctttcgatgctgcttccttaaattttggtgggcattaaaatgtgttgtgaatgccaaaaaccacaccttcatcgcctccccaagaccgtccagcgtgttctgtcggccggatttgtcctttcgcgggtccagcgctcggactgctgaaaattgggggaaaaaattagtgttttcctcaaaaaagcgcaaattccaagtgtccaccagggttcggctgcaggtacacctcgatggcatgcaccagcttcttcatgtgctcctccgtcttgtcggtcttggtcagcaattgttcaagctcggcgcctgaattttggggaattttttttttttgatttttggaaatccaaaaatgccctccttaccgatttcggtcttctccgcgctcagaatgatctccgccgacttctgaaatgtgcagggatggcattttttaaaaatagactccccagaatctgttcatttttacctgccgtgcacggctcgcaagtcttttgagggcgtccattttgaagtgcgcgcgggtggcaaccgatgaaggattgatgaacaataaatgcagacgtttgacgagacttggagacgaacaaataattgttgtgaatagggaattgttgaagtgaagaaaacgagtaaaaatttccatttttatacaaaaaatttccctgaaattttttaattgacagttttttttgcacaaaaagcgattcgtgccgattaccattttttgtctttacgcctttataaatagagacggaatgaactctcattttcattctatctgtaatcattcaacaattgtatttctctgcaattattattataatgtgtttcggccggaagaagaaagggaagcgacagagttcgcctgagtacaccaaagtggtgagttgtttttttggttttctattccagtttacatgaccataaaataatttgacaattttaatgcattaaaactttttctaaaagcatccaaattaaatattcttggcatcatttgatagccccaagagtccttcctctattagtctacgaaggtttaaaaaaattcacccaaaattcaaaaacttatgccaaaaaatgttcaggaaagcaattttttaaattttctgatcataacttttttgaaacataacgaaattctttgaaattttgcaggctaatatagaactctttaactatcgaatgatacaaagaatatttattttgatgcttctagaaaaagttatgatccattaaagttgtcaaattattttatggtcgtgtaaactgcaatagcgtcgttttttgtcatttaatcattttgtttattttctttaactcctcttcccacctttaagatgcccatttctccaacaacgcccccttattcgccgcccaagaagcctgatgatgctacattatcgcccctcgagcagaagccagttgataaatcgccgcttacgaagaaatcgaaggcaaaatctccgttcaagaagaagcttggcacgaaaccttcaaagaagaaggctggcgccaaaacaccgttcaagaagaagaagcttggcacgaaaccttcgctgaagaagaaggctggcgctaaaacaccactcaaaaaggagccggaggataaatcgccgcttaagaaggagccggaggacaaatcgccgcttaagaagaaactggaagataaatggccgcccaagaagcccgacttttcttcaccgtccaagaagcccgttcctctgccacgtgctgcaccgggtgccaaagtgagttttccgcaatggcaattttctgtggcatcttgtctaattacaaacacaattaagactgctgccgctgcttctcgtcaaccgatcaaaaaaggcgccgctgcatcacctctcaaaaagcatgctcttccattgcgtcccctttcgccggcgggcaaacgaccggctcctcatcctcctcaacgtccactaacagcagcgaaagtgaaaactgatccatctcatttttgctgtactttttttaatcgcaacaatgttttagcctgttgcccttcctctgcgtcctccgtcgccagcagctcatgggcaagcagttcatcaacctgtccagcatggtctccatcaacctgttcatccttatgcaccgcctcatcagcagcagccaattcatcctcgttattcaccgccacaaccgctgccattccaaatgccggctatgccaacaattgcgactggtggtggaccgctgatccaagtcaacgtgcaacgaaaagagaagccgacgccgcaacctgttgcaccgttacgtgctggtgtgaagcccattccgctacgaaagccagtgaaagctgatgatgaggaggagcagaacgcggaggatgacatgtacagcccaaaacagcaacaaccattggaccatgggacaccgaagaacgcacttgacgaagatgacatgtacaacgtgccggacgcactgaaaagcgaccatggcagaggtgacgtgcaacagaatcatggtacgacgacaccgaacaatgctcttgacgaagatgacatgtacaacgtgccggacgcactgaaaagcgaccatggcggaggcgacgcgaaacagatgggtgcaccgaagaatgatgtcgacgaggatgacctgtacaacgtgccgaacacaacgaaggacagtacagacgacgatgacttgtacagagtgccgaaatcatattaatgttgtaacgtgtgtctatgtatgtatataaaagtgccaccccctgcgtattgtgcctattgtatatatattttatgttaatgtgcttgtttggttgtgattgtaccattacgtttgcacataaaaaatttgatttgtgtttcatataccaaattaaatcacaaaaggaacaaattgaataggtagtattttaaatcgttttcctaccaaattttgtaaaatccaaaaaatttacgtggccattttttcacaaatctgtttacaaaactgatgcttgtcattggccgtaaatatcttacatcagatcactccaagtgatcggcagggcattttttccagctagaactttcgagtttttgccggcaatcatggagtttactggtcccgtttttttttctttaaaaatcatggaaaaattttttttagggctattttactgtgctgagcacgaatccgaccttatttttgaccgattctgaaccccgaacccggattcgaacatttttcaaaaaaatatttttaaagtttttttctttcatctatgtttgtcttgagcataaacagcatgcgcataatgggaaatttggtcataccatgataacacttgttttaatttagggccgtaggctcactaacaatttaa

SEQ ID NO: 3602 - DNA, 1179 bp, Heterodera glycines
ctgctgacgattatttttccagtcttcgagcagataattccaactgttttgtaaatctgaactgccattgctggaattcccaactgttggttcatgcgaattcattgaccaacgtgaggtgaaaacatcaaaaactgatgagacattggatgactcatccttcttgaaaattgttagtcgttttgataaaggattggttaagcattaaataccgttttctccatatttgaaagcatttgtttggtcatagaagcagatgattgaggtcgtgcgtaacctggcgccttccgttgatgttcttctcttgataaaatggccaattcttccgcgttgagtgacttcacttgtgtcccagtagccacatgaaccgctggagcatattcagactttcgaaggtcaatgccggggcagttggcattgtttgttggtgccgcaatcggtgaaacaatgccatgcagagaatgtccatccaatacggctatgaaggagatgtaccattcactagaacactaattattcgaaccttttttctcccgaatcgcctcagcccttttctgccacacattcgcaggaggggaattgccaatgtttgaattgttcgcagactgcgtttgcaccacaactaatggcgagaccggcacagatgcggcaccggtaatgcgagaattagttagatgagatggttgttttttcgatgattcttcatttgaaaccatcggtgaagacggaacagacaaaggaggggtgccaacacgttgatgttgaaaatgcagtggatggcacgaggtttcggatgaagatgaaagagatggggattttcgctgggtaaccaccacgcggtcaacgatctcattgatcaacaggttgtggtctttgagaagcaaatcaatcatacgtatggcattcctgcaattttaattgttcaaatgtgcgttcaaaagatggtcgatcccaaagggggagtgagtgacgttcccacccaccaagaatgtggttttcgaactttcgtccgtctttgtccccacgggataaaaccccaaaaaatggcttaaaacatttcccatcggctaactggaaaatcccaatccaggaaccgcactcactcttaccgaactgagtctgcagagtctttaagcgttattttgcgagtggtctgctccttgcgcgtacttagctttt

SEQ ID NO: 3603 - DNA, 2171 bp, Heterodera glycines
  misc_feature (61)..(62): n is a, c, g, or t
agtttgcttttgtgtgcatttcattttcgtgatgggttttggcaaaatctgctcttgttgnntcgagggttccaataccgggattgctttgccttcaggtgcaacgtttgactttttttcggcatttaactcttccttttcttcatcaacggtctcaggttccgtcgtctccgactgttgttcattttctttctttgcctgtttttttgcccttttcttttctttttgacgttctttgctccgtttttttgattcctcaattgcctcctaaatgaaggtcaatgaaggctgaccaaatacgtttattttaatttgattttttacattgttggaaaagtacaagtttagaaatgtgtaataaaagtcaaacttcatgagccaacagtgccagaagtgattgtgcggctttgttcgcctgttctgcctgcttttctttggcttccgaaatgaattgaacagattgaccacacttttcgataagttcctgtaaaaaaacgagccaaattagaataatattaaaatgagacttggtccgttaaggtgcaaatgaaacgctggcaatctgagtcgctggggaattgagttacatgttgaacgaggaaatgaacaagctgtaaaatgaatgctgactaatttaaacatataaaaaatgccttcgaatgtcctttgcgaaaggcagccatcaaaggggtgagttttcgattgtcttgcgcttcgatgtccgctttgtaatcaactaatacatgaacagtgtccaaatgaccattattggacgcctaaaaaatgaaatacaataactgattcgtattgttgtaagtctcctctttaaattaaattgacaattttcttacaagccaaattgcggtgcacccttttttattgcgtgcattgatttgtgcattatatctcaacaaaagtccaacaaaagcagcctgtcctttgtcagcggcaatggtcaacgccgtgtcacgacttgtaggcaccggcgttgtgtttacgtcggcatttgcctggattaatacagtgccaacgtccacgtatccgccattggccgcttccattaaaggagttagcccggtctaaaaacaaaaactgaaagggaagttgaaagaaagttagagggacctttgctcggtgttccacattggccccatactgtatcaacagacgggtgacctccgtccgcccctggaaacacgccaatgtcagggctgtatttttattggtttcaatttgcgcattgatatccgatccattctcaagcagaagacgtgttgcctcttcatgtccattcatagcagccagcatcaacggagaaatgcccaacttggaattggtacgagaattaatttctgcgccattgcacaacaaaagctgaatgatgtccacgtaaccaccggaagcggccagtgaaaggggcgtatagtcactcaaattgcgatgttctttgtttgcgccacttttaagcaataattctgctacctaaaatttttaaattgttaatacaacatatgcgtccaagggtttggccaaggaagggggggggtgtaaagtaaatgttagtcgcttcaaattttattaaaattttaattttcaatcgacccatcggcactattggtcttccccattgccaattatcttaaaaaagcacaggaaaatttaaaaaaatctatttactatacactagttttacaggttcccatgtcagtgtcagtgaaaaaatagactcgttgtattcaattttatcctttaatatactctagaccaatcgtacgtcgtaattggcaatagttaggattccagtcctttattgataacataatacgtaaatctttccgtcccccagagcaggcgagagaaagcgctgtgtctttggtacggtcggcttgtgcgtctaattgtgctccagcctcaattagaagtttacagacttccgcgtggcctccggtagcagcgagaatcagcggggtgaagccttttttgtcgcggtgctcaatatgtgctccacgctttatcagcaagtcaactaatccggcatgaccaccaacgcaagcgagcgtgagagcagtgtcttaaaaaacaagcactttcaacaaatgatttaaagttttaataatacctttggcacgcgcggaaacccaacccaatttacacgttcatttgcataaaaa

SEQ ID NO: 3604 - DNA, 5263 bp, Heterodera glycines
tttggagctttttggctttggcatgccaaattcaacgtctttggccacacttggagaggcgattttgttaacctcaaaaaaacctttgattttaattataaatttgaatcatttatacatctgctccgtttttaatcagcagctcaacaactttagtacaattttgacgggcagcttccatcaatggcgtacgattgtccttcgagaagcagtccttaaaattgttaaatcaaaaaatgaaattccataacaaaaaattaggaaatataatttttaaaaaattacaatttgagcgccattttcaataagcaacttgcaaatcgaatcactatcaatgccagcagtgcacaaaagggattcgttgaggtctttctggacaacctgaaataattgatgaaataagaaattacacattaaaagagacttggagggggtaagctttgcgcaattgttggacgatgtactgagcaactttctcgtgcccctcttggcacgcttcataaagcggagtacgctctccgacggtcaaatctccacctcgcgaaacaagcagttcaacaacatctcttaacagtcaataataattaaaaagttcagttagttgtgagactaacttaaatcctccagaagcagcaagtgttagcggtgtctccaatccgtcttcatttttcgcgttcacatttgcaccttggtccaacagcatttccaccacatcgaaatggccttcgcgactcgcctccatcagtggggtgtatccctcatcgttcggttcttccaattcggcacctgcactcagcaataatttcaccttaatgtaaaattcgattggattgtatgttttacaatttgttaccatttcggtgtgtcctccgccagccgccagagtgagtggattttcaaaagattcgttggccaaattgacttttgcacccgcactcaaaagtaatttggccacttccacatgaccgtccattgatgcttctatcaacgcagtgtaaacttcctcctcttcaagcgcatctttggtgtccggcatcagtgagagaaggtatttggccgcatcgaaatgtcctttgaaggcggcgagagtaagtgccgattcctgggagaagaaaacgtaatttcgaatagtaagcacgagatgtagtacaccttgtactcaacactttcaaccacatttgtgacctttgcgccatgcttgactagcagcttcattatctccacattgccaatgcttgccgcttccatcagagcacagtgacccgattcattgcgaatatccaagtcacaacgcccagtcgctagcaactctttcacgcactgaacgaagcaaaggctactaagtaaagaactttgttgcaagtaataacttcgatatatccggatgcacaagcgtagattaaggcagtattatgtgtggaactcaacgcattaatgtcagtaccagcttggaggagcattcgaactacgtcagagtgcccgccacaacatgcctagcaaaatggaaatacaatggaacattccatggaagtgtgaataagtaagtacctccatcagcggagtgctgtcagcctgctggacaaattcaggagaattgcgcatgtacccgggttttaattggtcgcaaactaccctaatgaaaatattaaaaattgttgagaacatataagcggcactgagatcggggcacatatatagagtgtgggtcgacaaaaaatcagaataggggtcgaaaaactaaagttttttgttaaaaaaccaagagggaaccttttgatgtgcaaaaaggaaaatgtttttgagaaaacaaaaataaaaccaaaaaggggaaccttttaacttacaaaaaattttttttaagataacgaaaattctataggtatatttttaagtagagtccggtaaaaaaaaatttccgggagcgggagaggggatcgggagttcaaaattttccgggacgggagtcccgaacgggattcccgtaaaaatcccgctcccgttaaaatcccgtccatttttaacgggagtcccgggcgggagcgggagtaattcgaaaatttaattaaaaactcacaaaaatatttttaatgcacaaatttaaaggacaatcaatttattaaattaaaaatatttagaaaaatttataaaggagaaatttgaaataaaaaaatcttatttttgagtcaaaaatcagaaaaattttttcaaattgcttaaataaattattttttataattaattcgaacaaaacatttattaactttatatttttgactccctttattaattttacaaaattttttgcggtgtatttcttgaaaaaactttttggtgaccaaggaggaggagggaggccggcggtgccggtaggcgccgccgggaaaaaaattgaaaattttaatacaatacattgttagattctgttcaaaaatgaccaatttttgcaaattgagcaagttttttaataaaattaaggattttaaggatccggcggtgccgataggcgccgccgggaaattttttgaaattttggctatatatttaacagattttcaatgaaaaatcattatttttaccaaaaaaatcaattcttaccagtgcatttttactcccgtttttgggtaaaaatttccgggagcgggatcgggagttcaaaatcttccgggacgggagtcccgaacgggaatcccgtaaaaatcccgttcaccgaaaaaagcgggagtcgggagcgggactcccgtaaaatcccgccggactctttttttaaggttgctgttcattttggaaatattggatttaattatttttgcgcaatgttatgaagaaagaggctcaaaaatagcatttttatgtaaaatcttttgatttattgaaggtttttggtccatatacacagcgtccgggaaatgagctcctgtgccagaaaagatttgcatgtgtggctcagtggtttttgtaagatagtaaagggacaaagggtggtggttcgagtccgttgtgcaacatgaatattttcatttatttttgtcaaaatattaaaaaatcacgatatttgggaattatttttgaaggtttttgccaaccaaattggataagcttggtatctttcgaaagctcttgataatgagaagctttttctaagcaaatgctaagcgatttggtgtaccagagaaaagttatgaggctttaaaattttgtttttcttataacttttgaaatagagcattaacaaaaataaattcagcattaatcgatgcagaatttttttctctaacgatatgcaaaatttcctgtggatctaacatatagaaaagaagctaaacatagcgaagtaaatgttgtttttcctaataataaaaatattagatagtacgccaaaaggagacaaaaaattagagaaaaaaagataatgtttttctctggcactctctatttatggtacacatctcgttttttcggacggtgtgtggacaaataattcataatgccaaaattactcattggcctccctccccatttaattttcattcacttaacaattacctaattcttaattatctactaaagtagcagtggaagttaacaatcatttttaagatttttgttgaaaaaaaaatgcaattttattataaaaattttattacatttttttttattaaattgtaaaaaagttacttacaatttctggtcattttttggacaattctaaagtaaatcttcaaaaaattttcccggcggcgcctagcagctgcgctcgacctgcttgtatccaaagttttttgatatgtgaaagcaaaaaaaaaaaggtcgtcgcccggggttagggtaccccctcaccccgccgttaagccgaaatcgaagtttataaaattggtccaaggtgatgaaaaataaaaaaatatgaagattgtggtgcaattaaaaatttttgattgttactccatttcgatgactttcagcaattctccggtggcaattcatcgcatttccctcaagtcaatatttggcaacgaaattacgcattaataaacaaacggacggggcaatactcaatacgatgacgcccaacatcaattaatccccgtgggagacccttttccaacaaacgaaaagaagcaacgaattgttttacttaacatcccaatatcctcaaataatatttgttttgtccactccacaaaatgcatgcagaaactgtaacgacagcatttggcatttctaacggaggcaagttggtgaatgcttgtgattcgaatggtcaagctgctcttatcgaatcacgtggaatccttttcaattttccagtaaataattgtatatacctttaaaaggcaaaagccatagtgaacatattaaatcagcatcatttccagggttgccagattaaaattttaaaaagcctcattttgggtcaaaaagcctcatttttacaaaatgtattctaaacacgtttaaaatgttcaaatgttatatttttgattgtccatgatcaatttgagcatttttcgcaaggggagacggcggtgccgataccgccgggggaaaaattaagaattttgatcatattttttagcatattttcattaaaaaaattctttaaattgccaaacattatgccaatttatcaaaataaaatttctcaaaaagccacaaaaatcctcaattcctcattttccaaaaaaatcctcattgacctatcaaaaagccacaaaatgaggataaatcctcagatctggcaaccctgatcatttctaaagtgacgagagtggagttgagaggctcttaagaaaagtggactgactgtgcctcggtagccctttgtcacaggtcattgtagttggagacgtgggtccaacccctcccccaggcacacagtatttgccatttcctactttacgtatgttttgttgccgttttgtcaaggaattgacggtgattccgccaccaccctcaacaacaacacaacgacaacttccaattgttccgcgttgtctctcctctctcacttatgcaacacagattcgccaacaaccgctgctagattctcaatcaagaaaaagttgtccgagacgcttctgtttacgtcacggtcaccacgccacactctctcctcaagtgcgatcgatttggccgttccatcattactcagcaaatttacaaccaaaaggaacaacgaaaaatgctcaagtcaggaatctttgcggtgagttttcagattcctcaatagcgcgcgatttgaataaaaaatgcattgcaagtaaaa

SEQ ID NO: 3605 - DNA, 2697 bp, Heterodera glycines
  misc_feature (2674)..(2674): n is a, c, g, or t
tgagaaattttgaaaattttgattttcggcttttgtttctattcgggtccggggttcgaaattaatcgaaatggatgtcatatttgtgatcaatgacccacgcaaaaaccccattaaaacatgttttcacgactttttagaaaaaaatatttcagggggggggtcactagctttactaaaagggtgatcgggcatcatctatttgtatatacatacatacatacataggtattacccaattcgttataaattttttgacttttttatgcaggataatgaaatgaataaggatcattcgataagacaacgccgtgggctaaaacaagcggattcatcagaatccaaattaccaccaaagcaaagttcaaaagctttgacaaagattattttggctgttatattctgcattgttggtgtgttcgcctttatctcttttcgctggaacaatactttcattcgtcgaaatgattctttacaaaaatcgaatcttccacttgcgtcaaatgatgatctttacaatcaggtagcaagacaaagtgacaacaaagtctgcccactaatttttaaatttcgactggaattttagctgattatttttgtttatgtatatttatttatagaccaactggagcacacacagaccgcaactttattttgggttaaagacgaaacatcctgaatccccattatttggttttatttggtatcagcagtcgaatgatacgtttattaaacaattttcaccaaggcattggtgcgaacatggtgaatatttttaataactatttaattcatctgacttttaggggataatgttaaattttcttggctcgcgcacgatggtcggacttttggccgccaagtgattgaagacaatgacttggcaatgcaagtggattggatggcaaatggcagaaagtcatggaaagtgcatctttcagcgaatagcacaaataattatgcactgctcttctatttggctttacaagacaaagcttcacattttgttttacaagaccagcagtaccgcaaatcgtcaaacaactttggctatggctttctcgacggatattctcatattcttggtcaattcgctatgaatatgaatatccaaggcgttttttcctccgaagctgtttcaaaaattgcttacaaaatgacaccgattttggatgtacgacacgtcgatgaattgattaaagtttcaattggacagactgaagggaagctcggactgcagttaacgcaaaacccagagatacctgacgaggaagcaaatttcgcagcgattcaatttgatttttcaagttggtggttttaaatattttgtaattagaataatttagagaatatccatattgaattagaaatgcttgctgaaggcgatgctaaaattgcgaatttcgatcatatttttactcgaaaattggaaacgtttagcaacaaatttgatgaaatattcccgattgatcaccaggtcgggtttcttttttcttttttacttctttttgacattattttaggaaggctctgattcatttaatcgcttgggaaaaattgcattgtccaatttactcggaggaattggagtttggcacggatattccttggtcaaaatcgacgaatccgaccatatcaactcatatggtcccctttctctcatttccgcagtgccttcaagaccatttttccctcgtggttttttatgggatgaaggtaaaacgcactcgtaacattcccaaaccaatttgttgttcttaggttttcataatttaatcattcgacattttgacccgcaacttacgcttcaggtttacttctatcgttttgcccttcccataaaaatgcgtctttttcagattttggcttcttggcttgattcgatgaattttgatggatggatgccaagggaaatggttctcgtccattattatctttcttgaaaaccaatgccattaactttgagattttgggttctgaggcacaagccaaagtgccttcggagtttcttgtccaaagtccgtcagtcgccaatccgccggtgtttttcttagtgctcgagaagtttctccgtgacagtgcggtgctttctttctcccgccgcctttcactttccttcactctttccgcaggtgttcaaccgctattccactcggattgctctgctttatccacgtatcaaacaattttacctttggctgcgagaaacacagaaagggcctaaacttggcacaatgcaatggcagggacggaatagaacaacgcaaatggaattgaacccgaaagttttacccagcggattggacgactttccccgtgcgacacatccatcggccgaggttagtcatgccaattattgcagaagtgagtggtttcaaagaactgttaggacgtcttcatctcctcattgttctttctgttattggcataggaatatcacttggatttgcgttgctggatggcattaagcagcaaggttcttcgtcagcttgctgaaacatttggcgactcggcttgggtgcccgtaatcgaagaggatgttcggttgtacaacaacataaattttttggacgagttacactggtcaaagtcggctcaacaatactccgactttggacttcatagtgaaaatgtgcagctttcccaggtattgtacgtcttgatttttaccaanttaaaaataacaaaagcaggaag

SEQ ID NO: 3606 - DNA, 7334 bp, Heterodera glycines
  misc_feature (22)..(22): n is a, c, g, or t
tgagaaataatttttaaaaaantgttgccataatgtcacatacattttaaaatttcaattattctgccccaaatggtatgcaattgctcttagatgacgaaggtggtcttgtgctgctcgctgctcaaattcagcaaaaatctgacgcaaattgttgtcctgatcaacatagagggatttcgcctaatacctttccctctaatgccatttgctggcgcactggccaattcgcactcttatttgtgcatattttccatcgcatgtaacaaagaattaaaatatatattttaaataattatgaaataataatttaaatgcagaatttattttcaacataattctttaataatcatttccgaaataaaaaatattatttaatgaaaataatttacataatgacattttgccaacattttttaaaaattatttctcagtgacgaaatgatcggccaccgccaaaagacatagaggaggcgtaccaagcatacatatacaaggggtgtctcaggccaagggtcatatgacgaacgattgagacgggggaggggcgggtgtctcgggaccaaaatttcatagtccaaatttttctccatccagctcgactttttttcgcaccgcttttctttcttttttttgtggcgcctttttcaaaaaagttttggggaacggttggggcgaagggaggggggggggggaatttttaaagaattagtgtgtatgacacaaggggtttttgtgttcatttccatttacctgatttgttttgcttattgagcacagtaagacagtcgtcgtcagtgatttcgagctcattgtggcaaaatttgacatcccaacaattttgttggcgatttaactccgttaattgagtgacagaaacttaaaattagagcaagtttcagatgaaaagaaagctcgaatattatttttttgtagaattgagcgggaccgggaattttgacaaaaaccgggacctgaaaaacccgggaattttcccgacccgacccgctcaactctattattttgcattcgagaccatcagcagaaatgaccttctgctggagaacagagaccgagaagttaaaaatgaaatttaaaaaatgactaaaaaatgaatgatctaaaattagagattagtgggagagggaatcccgcgggacttcttagtgtaaatctttgccattaaataccgatgttgtctcccaagttccgcccttttctctcattctcctccttttgttgtttctgtcgcttctccaattcaatgatccgctccaagagttctttggattgattggcattagcttaattatgctttttaaactacaaaaattgttacaatttattttctttttcaccgtctttttccatttgctccttttccttctccattctgtaaattttgactttcaactcaatgttttcttcaatcagtctttgctgttttaattctgcttgaagtgccttctgtgaaaaattaaaatttacgaaatttatttttcaaagttttgtaattttattttattttttaaatatttatggtatttgatttttagctttttctggaatccctgcctcttcaagttccattttgatgaacgcgcacatttgtttggccaccctcaattccatttccagtttctctgacttcttccagaataaattaatttcgattatttccattttaaatatttttgtttttatttattttttaccaaaatcccatcatcatcatcatcgtcctgctgtttgctttggcctccttcctcaacttctcatctccaacgtgttcagcactttcctctttttgtccacagtcatccaaactgaacgcttcgccaatcactacgaaaatatttctcattaacttatacatttttgctcaattaattaattaatttttatttataaacaattttcatgaaattctcttcatttgcttgaacataattttcaaaattcaactaaatttcataaaaaatacatttttctaaaccctgctgctgatcagctgctgctggtgtaaagacgtcatttgtcgaaccattcgaaattgacatttgaattttattaatgatttttttataaaaataatatttcaatttgattgaaaatttgaagcaaattatttgataatgcaatttgtgtgcattataggtcattaaacgaaactaattatatcagaaatgaggaggaggctaaatgatgacctgcccccaataaaaggaaaagaacagacggaccaaaaaaaacgctgagatttatatattttagcttctgctcctttaaactttgtgctttcgaatgataccaaaaagataggatttgtattgtataaaaagcaggtattgtcaattgattggactcataaaatacctttggattcataaactcgataaaagtgccgaaaaacctttcatttaaaaatttctcacatttttttccttaaacgtcggttcattttgcggcaattaacagcacaattattgtcgtaagttgtgattgcgatgcgaaaaatgatgttaactaaactaaaaaaactttatttatgttgtgaaaaaataagcaaaaaggatcaaatatttattatctttccatttgatcgctacaaaatataatttttaataatgctcgcgagtttcggtctcaatctcgactcgataaaagtctcctatcagcgtgccggacctcaaaaatctttttttaacactcttaaagacaattatgatttcaaaaaattagagtgatgcgggacccgggacctggttgcggacaactgagtaccaaggtcccggttttgaccggggccgggactagtcccggttttttcccggtttttcaaaacagactttcaccaaaaaagggcaaacttgcgatttttaaccatttcatgaatttcgttgacaagtattcataaaaaatatctataattttgaaaaatttacaaaaccaagttcgtaaaaaatttaagaaatagaaaaacgaaattcatttcttgaaaaaatttactaattggaaaaaaatgaaatagaatttcgtaaaagttcaactaatgcaattcaataacgtaaggattttgagttttttgcaaaaaaattttgcttttttccaattttttcgatttttgccaaaaatttttattggcgaattgactgcacaaaatttaaaaatataatccatttcactttaaaaaagccaaaaaaaaatccctaatccgtatcaagaattgtacggatcaggatcgggattacggactaggcacccatacggattacggattaaaaatccgtagtccgtaaaaaatccgtattggccgaaaaaaatacggattacggactacggatccgtaaaaatccgtatacggatcccgtccgtatccgatctctaattaaaaccattttgaagaaaaaaacatgatacaactaaaatttatcatttttagcgaaaaatcaacccaaaaagcgaaattttgccttttttgcttatttttgacaagctaaaaacatatttttcgtgcatttcatgcctccctggagaatgtccatccacacatcgctacaaatccagctgaaattcgtaaaaaacagcatgggtaaatgaaaatgaaattcctcaccgtctgtgcatccaaaaagtctctttgacccctttatatattcagtagttcttaattgttgtgcataagaaagcattttggtaacctttcaaaaagacgaagaagaagcggatcaaagcaacaaaaatgtcgtctgctgattaagtgtacggaaatgaataattaaattgattaattgtatttgagaaatgaattttcgattgaaacgattatctagagaatttggaaatccattaagtagttaagggttcactcatccccccgcttagaaaaaaataattaaaaattcactagggtaataagaaaggttgcgatttttagtgacgaaaaatctcgagagtttttctaaattttctcgcatgagagtcaatttcaagtacgtacttgccattcaagtacatacgaatccgagctaacaaataagcaagcaacattcaaatcaaaggcaagctttcgtgcatttgaacgtgcatcgatcggtgagaattaccaaatccggaaaaacccgatcagagagtccgcctcagtttcctagcaattaacaatttttcaatcatcgatattagcagggaacggatttttaggttttcacctacttttttggggggataacatatgctgagataagcgcaaaaacacattttcttcgatcacttttcgatttagagcgacttttaaacaattattatgacttgtgaaatttttaaaaaacttttaaatatttctgcttttcaacagaaacattattatgaaaaagcaataaaaaaacaaaacaaaaaattggcgttactttttttcaaaaaatgcacccctcagaatcgatttttcaaaaagcaaagatcctggaccatgatttggcggacgatcaaacattttgacgcttgaatactacatatcttcaaatgtgtttaatttacattgtgcaaccgaagaggataaagatgaggaaattatgggaaattcacacattaaattcggatcagagagtccaactcaatttcatagcactttttgcatgtttttgatttttttctaccacaattttttggggtcggggtcactttggcgcgggacattttggcgccgcaaaataggtctaagtgttctctaatagcctgcaagatgctagaaaaatatattcgttttaacaaaagatatggcgtgctgcgccaaaatggccagaaaaagtcagttttttaggtttttggccaaacttttttgtatctcaactagattttttgaaattttgcaggctattagcgactatcaagcgcttaaaatcacatcaagattttttaatttgaatgataaataaaaatgttatagcgtttggcgccaaagtgggtactctttaagtttgggtccacatttttggtcaaattttttcaaaatttttttttaataagcacgtaaaaaaatgtgatgaatttatgtctgtttcaaaattgtttttgtgttctttttgctctctcatttttcccaactctctctttttaagttacataacaacagagttttgccttgccttttttgacacaccaatcaattggaaaaagggaaaattgagccacaaaaatgaatcgacggtaaggaattttttttaaattacaaaattttcatttacccatacatttttttacgaatctcagttggatttgtggtgacgtgtggatggacattcttccatcttttgaccgtcctcaacttggccttcagaattgaaaagggcgaaggaccaaaagcgaaactgtctgttctgatcgatgacaaatgcgtggcatttccatttcccgaccatccgttgcccaacaaaatccgttttaaggaccttcagatttagtaaatcaaaaaatatacagaaaaccaatcttcattttttcactttatcagctacattgaccattctgtgctcgcatttctccgttccaacaagcaaatttgggacagaagtggcaccaaattggaagtgtttgtgccgttatatatgaccgacgtcaagctcatttgggatgtttttacccgcgaaatttggcctatttttgcgaaaagcattcgccatttttgcattcgtaatgccaatcatctggacaatttgcgtcgtctcatttcaccgacacttctcactgatcttgttcaattgtattcaatcacttcctatggactgtgccccgatggaatttctgacgatgggccaaatgcaactgccggccaagcgttgtccaaatggttgcacacgccgagcaaaaatggaaaagcgaatgaattgtattgctgtgcttatttttgtgaaataacatggatcaacactttcaaggaggtgatcgagctacttaattgttcattaaacgattgactaattattgattgattgcatttgattcgtgaccggaaaatcggtcagtggaaaatgcgtcagtgatacaaatattttaaaataaatttctatggcattagtattgtaatataggactaaacttctataagaaaatcgttctcaatttccaaccccggacccgaactcgaacaaaaaatcgaaaagtcaaaatttcgaaattagattttttcttaaaaatcggtttaatacacggaaacaaactataagccatcaatactgcaataagagatcatttatgctgtttttgaaccaaaaatgctaaattagaaaattttgtactttcgagttttttgttcgagtccgggttcgagattcggaaataggccggaatggataccggattcgtggtcagtgacctcgaaaacgcaaggaacttgtttttaagacaataaaatttcgctgacgcattttctgctgacgctttttccactgacgcattttccgggcgccatttgatttacgctcccttttttgtttagacatttctccgtgccaccacttctgtcgcttacaatgttcggcttgaacttctaatggctagcgaaatgaatacagttgaacaatttgagttggtgaacgaaatgacccaagaaaagttgacactgacgaaggacgaagagatttggctgttgaaacggtgtccaattgttggggagacggcggcggttcaatgggaaaaagacgaaaatttggaccatgtgtgcggactctacttcaatcttcatggaaattgtattgggtgagtggaaaggaggcttatttttggatagagcacggacagaaggatacagtagtgtcctttgtacagttttcccagaatcttggcagggccaggggttcctattaaacaggccttgagtccttgtccctcccgttctcgtccatctcgaaaaccctggtcctcttgtccgaatttttttcaaaattccgggctctacttttagctgttctcatccgattcaaattgcgcttaatttaggccgctgtctccgccagatcaaagcgatgaaaaagtgttctcttttcccggacccagtgatcagcggaagaagaaaaagtgatcatttgagaaatgaccgatcattttcgagttgtgatgtattggattgattgatcatattttgtttggcacatttaatgctgatttgtgatttgagtttggtacaacaacaacaaaaaatttgatcaaattgaagattctctggactccgatttcacatatccattttcatggcataaattaaccattgaacaatccgcgcaacgccattccccattacttaatgtgtacgcataaattaacaaattattgccattattttt

SEQ ID NO: 3607 - DNA, 968 bp, Heterodera glycines
cagacgcatggagaagctgggcgagggaagttacgcggtagggaatggcaaaagggggaaaaaggaggatggcaccatcccaattttggaccgtatggaagagcgaaaaccgactggacgggtccatcgtggcgctgaaggagattcggcttcaagagcaggagggattgccattcaccgccattagagaaggtggaggggggagagggcacaaagccaagaaaaaaattaagggataagctacagatttattaatattgacataagaaattggcatgccaacattagaattaccctcgaagagatttgcactgccaaattcatttgttaattacccccatccttctaattggtttttggacttcactgtggggggggggatggcacttgtcactttttcaattccatttctcatttcaatggcacagtttcgctgctgcgtgcccttcgccatgccaacatcgtccgtctccaccaaatcatcatccaccagccccattcccttgtgctcgtgttcgaattcatggtctgtctcactgcgtttgccaattcctggctttgttcagaacaccgacttggccaagcacatggagcagttcccccacggattggactctttccgcacaaagcttttcctcttccaacttctccgcgggttggccttctgccatgagcaaaaaattttacatcggtaatgataaaatgaaaagtgtccctcttcaattgtttgtcatcgattgcttttcattggagggatttgaagccgcagaatttgctggtgaatacgaacggggaactgaagttggccgactttgggttggcacgggccaagtcggtgccgagtcgcacattctcccacgacgtggtcactctttggtatcgcccttcggatgttctgctcggctccaccgtttactccactccattggatatgtggtagatttgttgggcattccttacacattttt

SEQ ID NO: 3608 - DNA, 2251 bp, Heterodera glycines
cacatctttttcggcttcttccccacaatttccccggtgggtccaaaatttcgatctctaatctcgggaaaattcctctttcatcgtgacccgccgaccaactcccgttttctcaggggagttcggctcgcattttcgctcgaaatcgtgcgtcggttccgcgctcgtttccgggcgcaagcgatgcccttcgaccaactcgtgaacgaatttcacggcaaaactcacagaataccttttgttttttaagggaccggattttctctgtccgtggcactccctcggcaaatcattggccggaggcaaatttcacccaccaattatcaatgcttgtgaaataatttggactatttcaggctcttcttttaccaaagtgggagcagtttcaactggaggattatccagagatggattgggtggacgtggatgccaagctgatgttcaagttggatgagcaggggcgccatttgctcacccaactcctcacggtgagatgaccaaaaaagtggcattggcactgattgacttttggtttcagttggacccgcggaaacgcatctcagctgcaggtgccatgctgcacaaatatttcaacgaaatgccaaaaactttgcacgcactttcgcccacaggtaacagaagaagaaaacatttctcaaaaaaaaatttttctgccatttttagaatcaatttttgccgcatttgatggaattattcagcaacaaaaactttcaattgcatcagagacgacaaatgacagtgacgaaagaagaacgtgttatgtttgagaagaaaggagggggcttgtttattttcggtggaattgtgttaaatgaaagagcgatgttgtataaattacatcattatcatatcaatgcggcgcttatccacacactacaaacaaaaatttgaatggtcatttgggatgaaagacataacttctctaaaatgtttaatcgttctccggttccttcagtgtaatgtcaacttcactgtgcaaaaaaaaaccgtactatctcgtcgtttctcttttaaatattgttttgttatcagtagggctgtatttcgagatttttgtgcatatttgcatattttggctttttctgcacatatttcgtgcatattttgccattttttgtgcatattttccgactttttgcatattttgccatttttcttcaaatattttccgattttttgcatattttgccatttttcttcaaatattttccgactttttgcatattttgccatttttcttcaaatattttccgattttttgcatattttgccatttttcttcaaatattttccgattttttgcatattttgccatttttcttcaaatattttccgactttttgcatattttgccatttttcttcaaatattttccgattttttgcatattttgccatttttcttcaaatattttccgactttttgcatattttgccatttttcgtaaaatattttccgttttgaatatcccttaagtaaatttcggcagacaataggatgagctttagtgctgaaaatcttgagaaatttttgattttcaattgcaaaaaaaaccgataaaatttatgaggaataaaaattttttattgaatttgcacccctaattttcaagtttttttgtgcatatttggtgcatattttgcgatttttgtgcatatttcacgactttatttgcatatttatgcgcatattttggccacttttcgtgcatatttttggcagccctagttatcagtgtattttttgaattaacgccaataagcaaagttggcattatgtttaactagggcaaaattttgtgaacaaaattttcgccttttcagcacacggcgagtcaattttgggctccacgtacaaataagtttattatttatttagtaatcagaacgccaaaactttgcaaaacttgaatttttttggggattttcccttgtaaaaatggaagagccgatctcgagatagaaaagaaactttcagaaaacaaaagagaattcgatagagggggacaaaatatgggcctatacaaaatttcaaaaaaagttacccacaggaaaaaattttttcccatggcaaacatttcaatactttaactcttttttagccaagtgcgctatttaaagccaaatcaaataaaacttacaatattctcccttatttttctctttaaaatgaatataaaattattatatttggcctattatagcccgagtaataaagctggaaaatttca

SEQ ID NO: 3609 - DNA, 654 bp, Heterodera glycines
ttgaatatgattttttttgacacagaaattttataaataaaaaatatttctgccttcttcttaaaaagaagaaattgaaatgaacacacaacataaggaggacttgaacctgagaccccccttttggtgactaactcacagaccactaagacgaaaaaaccaacttaattgtacttggagcccaaaattgactcgccgtgagcaacacggtttcagcaaatattgtataatgagaatggcatatcccggcgcagaaggactgtgcagccctgaaattgaaatttctgaaggcggcacaatgctcgatggcaaagggaaattcaacgatttaaaagcgatgttggacagcaacagggaaaacatcaaaatggatgcaatgcgcaggataataaatgcgagtatttagtaatcggatcacctttacccgaaacaattttaaatctcattttttgttcattttttagatggttgctcgtggaagggatgtttctgaactttttgctgctgttgtgaaaaatgttgctgtaaaaaacttggaggtctaacacttaattagcttggattaatcaattaaaagagcaaatttttagctcaaaaagttggtttacgtatatttggttcgttatgcggaggagcagcaggacttggcacttt

SEQ ID NO: 3610 - DNA, 5742 bp, Heterodera glycines
tttctccggttgttatgttggccattcgcgaagcaattctctacatgagtccgtacgtgcgcaaagttgcggcacatgccatccccaaactgtttgctttggactacgaattacaaccccaactcattgagtgcattgacaaccttctcggtttttcattcaatacattcttatcagtaattaatatttctttttttattttatgtgacaaaaggacgttggtgttgggttcagcagtttatgcattcgaagagacttgtcccgaccggttggatttgctccaccgtcactttcgactcttttgccgagcattggctgaccttgacgaatggtcttttgtcgcgataatataaagcgctcattagctaatggccattcctttaggggtcaggtggtgatgattggattgctcactcgctacgcccgcactcagttcacttcaccgtttaagaactcagaaacaaacaacgaacagaaggaactgtacagcagcggggaagagagcgaagagaaagacggcggaagacaggtaattaaatatgagcaaattaatggtctaatacgttttccattaacgagaaaaggtggggggtgtagaaaaatatacttaaaacgaacctagattttttaaagaaaacaaaggatattgtttaagttccaaaatgagcaaatgcatttggaccccgactacaatttgctaattgcctccgttcgtccgttgcttcaaagtcgcaatccggcagtggtcatggtgaagctgattagttcatttgagtttctttattgcttcctttcccattaggctgttgcccagcttttctttcacattgctccccatgcccaactcgtcgccgttccgcgtgcgttggttcgcctcctccgcggccctaccgaagttcagtacgtcgttctcgtgaacatcgcgacaatttgcgcaacgcgtcaagcggaagagctttttgcgattaataaggtgagttttttaatttaaaatgtattcaaaaatctttttcttttagaaccttttccagccctttttgaagagttttttcgttcgtaattccgacacaattcatgtgaagagaatgaagctgtacgttctgtccagtttagtgaccgaagcgaatgttcagttggtcgttcgggaattgcaggcatttcatttagtgccacaaatgcttggccaactcctcttaattgttaggcctatctccaaatgacagacattgccgagacggccatcgacacaattggacgttgtgctttggcagttccctccgcttctgaaacatgtttgagttgtctgattcggcttatttcaacgagtggcaacgatcaaattgtaatttttatttatttttaaaataccctgtccattattttttataattgttacaacataaggtttgtgcttccgtcgttgtccttaaacggcttcttcacgctgatgccccaatgggactgttgaagaaaatgttccatttgattaataccgtcaaagtaagaatcagctgaatttgcatgccatttttacctaaaaattcatggaaattcatttgatacaatatttaggctccaatggctcgttcatgcattctctggttggtcggcacacacattgacaaagtgccgaaattggcacccgatttattgcgaattgttgcgaaaaccttttgcgaagaagctgattttgtcaaggtgatttaaaatagtattgttagtaactttatttcaacttcgttcccaatttagctccaggcattgaatttggctgtccgaatttgggcgattgattccgaaaaccgcgaaggaaaatgtgctctgctcatcaaatatgtgttccaactcgcccgctacgaccgttcttatgacatccgagacagatgccgttttctgcgcaattttttgtttgacaaagaccaaaattcagtgagtttttaaatttctcatataaatgttaaattaaaatattttatttattttcagttaaaatttcctttggacattttcctgcaagaacgtcctgcgcctgctgtgaataattctttcactgatcgggctgagcatttccaattgggcactctttctcacctgctcaaccaggcgaaaattatgattattagcttacactgatagaatccattcatttatttggtttattaattagttttttttcaacctttagaaatgcaatggttacactgaacttcctgactttccgtcggaacagcccgacccaaccattcgacgttcggcataccctttgccaagcgacggtatcgtacaaggaacggaaattgcaatggacgaagcggaggaggaggaggaggaagactcattggatgaagaggaaagtgaagaggacgaggaagacgaagatgaggaagaagacgaggaggaggaagaagaggaggaggagagcgagggagaaaaagtaccggatggtgggtttttgaattttaaaaataaaaaaagaaatgggcaaagaaaaactttttccgtaacaatcccatgtcactcattcacaaccaatcagtaataatcatttctacgtgaattgttgtaataatattcctgtctgccgtcgtcttcgaccgttggctgtttcattgctgcagggtgcggaaaattgtgcacgtttctgaaacaaagggacaaataattcattttggaattcattgagactgacctggcattgtagaaaacgatgtctccgtcagtttgtaccggatttcggaatgatcgtcggatcaccctaagggcgtagaacaccaccaaagcggagcagcagaggacgattaccaggaaggaaacgaccaaaatccacctgattaattgttgaggcattggacaactttttctatctatcgttgttttaattcttctctctctgaatgcttttacatcatcggaacgagaacagacgtgagcagtcgcgtgtcgaagggcaaacacgcgtaatgcgcattggccgagtcgccacaattgtccacgtaaacgcactgcgaagatgcggagcatgaacgagcacctccaaaagaaacgcaattcaaaaaaacaaaacaaaaatttgacggcttacaatagtcggcactttcgtaacaggacaacttgtcagaatagacaatgtttcccattttgatgactaataaacaaaggaaaatgtccgaaaatgggttaaaatttaagtgatttcattttcgccacgcctcgaacgcccgaaccggttctgtcttcgcacatacagttcaaaaaagggaaaaaattaaacttttgaaaaggtgatagtaaacaattcggcgagaaagaatgcacatatcaaattgattttatgaattcaagtcgaattaacgctttttttaaaaattaaaaaaagccatgaacagtctttttgactttggcggcaagttcaaaataaatttccattcatttttgaaggagggggagggattgggggacagtcgaaaaaactaatatatctcaagaaaaaattacatcaaatatatttgaaacagaaaaattaatgaatgttttgattgatacatcaacagcaacagattggaatgttagaatggttgcacttttggtttgattaattggcttaattcgtcacatgtattcgtaacttcaaacaattgaaaagggaactgacaaatgaggaaatgaaatggaaacatttgtcgcaatatttaccaacatcgaaaacatcaaataaaatttaacaacaaattacattttttaagtcataataagtccattaagatgaagatgcaaagttgaaaagtcgtcagtttgacattgaagcgatttcaacaaattcgacgacgactcgcgaagatgccatttccgaagaacaaaaagccgaatcgcagcccctagtggctaagaacgcttcgaaaaacgatggacagaaagaattacggtccgagcatttgcttctcttggacatcgattttgcacaaacaacggcacaaagtccgaatgaggagggcgaggacaaaatgaaggactaaaagcacaaaagcaaatgcttaccaacaaaaatatagaatttttaacttccagttttccattgctaatgtgatcttacaaattattgcagttaaatcatttgtgttttttctcttctgtaaaaatatttaccatattttttcgattaccatactccgttcgattagaagagaacttgttcaatgcaattttattttaaaaatgacattatatcgggaatatatttttaaactttttggtttcatagctagcgtacagtcaacagaacagcagcagtgtcacactgcataagaccttcgaaaaaacactcattgtcaggtgggtacattttaatgtcactacaaaaaaaggaaggattggaaaaacataagatcggatattaatgcgcaattgtatttttgtgtttggcatcgcaaaaacggcacagtcaaagctggccattgcaattttcctcaaaaatttggcagcaaagcgtaggcacatgtgggacagaagcgagcaatttgcatgcctaaattccatttatggaatccattttcatggcataattgaaaaattggttatcaaaaaagttaattattgcgaatgtttgacaatgtccgtgaagttcgcttttgctacctttccgagttgttgctccatacgttcgtcgtgtttgtcagcccattcgcgtactctgcccaaataattgtccatgtaactcttgcaaatgggcaagtcgggcctcaatgtttcacatttgccttgggaaattgggagaggattgttcactgatttcaatttgcttctcactctttgccactggcaatttgatggtctgtgccttctcccctttttccctttctttgtttgctggcggaacaataattgtttcgttttgctgtccttccattattaatccgtcagttgtcccactttcagttgtatttgctgcaaatgttgttggtgaggtcggaattcgggttgttgcctgaacatgccgtttaattttaaaattatttgacatttccataaaccgttgtctcttcagcaacatttaatgagccgtgttcatttgcaattgttgtgttgctaaagtgttattttgttattaaaattcaataattaacctttattctttactttttctgctgctcatcaattggcacattcaaagatgaattgtgaattggtgtcgtttctgtttctgttgtcgcttccgtcctttctgtgtttgctttttctgctgttgttgtatcgtttccaatggtttttggttgtttttcgtttactgtacttggtgaagatgtcccattggatgtttggtcatccaatgattgttccgttgtctttgatgtcgccgtggtgctagcttcggttacagtaggcgctgttggaatttctacaacgaattttcacatactttttttatttcattccgtttagacaaccttcttcaacttcaattgtcgtttcagttgaattttgtgttgtgtttccacttgcgatgtcttcaatttgtgtggttctatttttctctgtttcattttttattgtaaaatcagttgtattcatttcgctcgatatgctttcaaacgcgtgagttgtgctgttattttgcaaatcggcactttttgtgggtgaaatggcttttgttcttctatttctgactgtccatctgagggtggaattgaaagtggcgaatttgttgtgctgttgttgtcgccagtaatggaaatattgctcattgga

SEQ ID NO: 3611 - DNA, 1457 bp, Heterodera glycines
gagggggatccatgcccattttgttggggattttaaatgtctgtcaaaaataatttattttattaattaatcattattattttactcactctgcatccagtaagcaaccttcgttcattctcccccttcaattgacgtgcaaattcgacaattatttctccattctgtcgttttttcattgtgatttctctcactctatttgctgtgttgtcagaattcagttcaaaaagtccttctgtgcctttggcttttgctctgatcactttcatttctccatctttttgctttgaaattgcaactccaatgaattcggtgtgttcctgcgcagtaatattaatgattaattgggactttaaaccctaatttcacttacttccgcttcaaatgctattcctgttgttagaattccttcactgctcaagtttcttggtggcattgttttcagaacgaacactatgctttgtgtttgaggctcgaatgcccatttaattgagtagtcggcccaatggaacccacatttcgtggacaaataggccgatttgactgttttaagtaaaataacagcaatcaacgtgatgtttagaaatttgcacattttgctgtgcttaaatttttatttgaaaaatagggaaaacccataattttaggaacaattattcaaaagaatttggaccaaccattaccgcctttgacgaaagtaaattaataaatcctaattcttacaaatagcatagccgcagaaaatattttagcaaaaataatgaacatatagaaaaactaaatagtcgagaacaagaagattgttaggttcgtttacccttcattgttttgtttagctattaacatttgattatcccgtcagctgatcaagtctgcttccatcatcgggagcttttttgattaattttagttgacacagaaacacaaaggcgccgtttccatcctataattcgttgttcgtccgatgatgatcactcccttccccccccccctccgtattcattccttttttgagtgtacataactaacagttttattgtgaaagacgagaggagcctttcttttgtaaaaaaagatgtgagcaccaataaaaattgatgcttccaaaagcaaagtcataaagggaagatttttggaaccaattcaaaatattttctgaaagatattactgatggaaaataaatgttgatcattaaaggtttcaatcgtactgtgaatcggataattttattattatgtatggttttatttggagatattaaatttgagtcttcaaaaatcttttatccgttcctcatacaatgaaaaaaacggatgggtcattagagaaaaatctcctaattgttgaagtgctttttttgtctgaagtgaggacgatagaaatttgtgaatgtatatgacagagcttactctcttcccccattcaccgccatttgttttcatgctaattatgttat

SEQ ID NO: 3612 - DNA, 7111 bp, Heterodera glycines
ctaagcctattttggtcatttttatggcatttttgtgcctatttcactttttacaaagaatttttttccaaaaataaccatttaaaaaaaatttatttacatattttagtacataatatatatttgggggtttttgtacatatttcaaacatattttagcattttttatacatattttatttacataattcgtaaattttcttacataaaattagcgtgatgagacatttgcgccgcgaaatttgcgccgctcagcaaagtcgacacttgcgccgcgccatttgcgccgcagacagttgcgccgcggatatttgcgccgctccatttgcgccgcgacatttgcgccgcccagcaaaaatggacttttgcgccgcgctgtcaaaaatattatattcataaaaattccactattatcaataagttttactaaaactataagccatcgacaaaaataactaattgaaaattcgaaaaaattactagtcacaaagattgacattcaattttttaaccattaaaatcttaacattgaataggttcatcaaagatatgaaaaaatgattaagaatacaaactaacaaaaaactgaaaaaaagaattttctgtagaaaccccaattatttttttgcttcgaaaaaagaatgaaattcaattcctttgtaattaattttctcaataagttattttcatcgattttaatttaatttcattgaaaaaacgcactgattttcaaattttcgctcctattttaccatttttcgcattatttcgcaatttttatgcccttatttatttacctatttttttcgcttaaaatccgccgcttaatgatcaggcaatacgaaggcttgttatcgcatatggtcccaatgaaaaccaaaatgatcaagatttgatcaatcattacgtgcacttcaatatggaattgacatgaaaggcttcgaaaaaggaattaataatgaatatctatcaattcttattctataaagcacataaatttattttaatcagagcgcaaatgtcttttttcgctgtacggcgcaaatgtcgtttttgttaggcggcgcaagtgtcgcggcgcaaatggcacggcgcaaatgtccgcggcgcaagagtcggctaaccgtttttatgtgtcaataaaatttttacacgtcccaaaaaaaaattagatattccataaaatttttacgggtccaatgattttacgcatccataaatttttacatttcacataaaatttacgtcccattttttacacgtcacataaatttttacgcgtccacagtagtttttaatgtcctagtttttatgtgtcaataaaatttttacacgtccttaaaaaaattagttattccattcaatttttacgggtccaatgattttacacgtcacataaatttttacgcgtctgaaatatatgaacgagcggggaagcctttgagggaaaaactatggggtgggccggctttgaaccggcgtctctggctttccggaccagtgttctaccagctgaactaccgaccctgccctccagctccccactttgctcgatcatataggatcaattgttgcctcaattgatccattaatcttcctctcggggaagcttcttcttctctatctcacgtccataaatttttacacgtcccctataaaaattttactgccgcaagttttttcgcgtccataaatttttcatgtctcaaaaaaatttagatgttccataaaatttttgtgcatcctataaaatttacgtgtccaaagattttcacaataaatttttactcttcacacgtttttacgcgtccataaaaatcgggctataaaattttcaaggtttttacgtcccgcggtgttacgattccataaaatttttaacgtatcataatttacgcatctcattgtttttacgtgttctacaaattttatacgtccctttaaagtttttactcgccgtttttacgagtctataaatttttcacgtcccaaaaaagtttagatgtaccattttatacgtccggtaaaattttacgcgtcccatttttttttacatattcatacacgtcataaaaaaattttaagcaccctacgctttttacatgtcccataatttttacgcgtccaaccgtttttacgtgtcttaaaatttcacacgtagtataaataccgtgtcccatagtttttatgcgtccaccttacgtgtcccatcgtatttacacgttttaacaaaaaattcttttaaaaatagataaatgaattttgttggttcatttcaatttgtaaattcaattatgaaatattataaattaataataaataaattcccaccaattatgtcatccaatgtcacggacactgacagtttcccattttgcctgcttgccaaacttccggttggacttggcgtatgcgaagttggaaatggagaggacagcagtggcagagaaaatgcgtcattagccgttggcttactgtattattattattattgggaaaattagtgtttttcaggggattaataaatgatttaaaccactgacttggcatcctgtaacggtgactctggaggcaacgtcaaatttggggccgtgttttgttcttgaataaaattaaaacatgagaataaattaattatcttatttgtaagtgctcccaagtgtacgtgactgactgattttttcagatttgtgcggatttttgagggttgggagaattttttttttttttgaaaaactattaacacacatatttttagaacaaataaatcaaattaaaaattttaaaaaaaaaattcatgtggcaactttcggaatcattagattcaaaattcatattattattattttaaatatgattcaagactgcaaaatttagtcatttttgattgtaaaatctgttaattataataaaaaaaaaatcccctcctgccattataggaaaatgattgagttttgagttgaaatgcgtcagtgcatcagaattttttgaaaacgacacaagttgatatggtagttgaaattttaggcttgaattggaaatgggaacaaaaagttacaataaacaaagcacagtaggcctttttcataatcttttataacttttcaattttctatgaaaatttttaaaataatcaaatacagtagacctttttgcattggtttttgtaacttttcaaattttctataaaatttacaagcatttgaaaaaatgaattgaaaaattcggaatgagcttcttatacaattttcaccttttctaccattattaatgctacacaactttatttttgaaatactgtaacgcattttccaatgacacattttgcgggagtttcgcctgctccctccttggtacttccgtgttttgcttccccccccccccgaaaaattttaaaattcatattttggggttttcaaaatcactgatcatgaatatggtgtttgtttggacatttgatgacaccatattcgtgatcagtgactttgaccccaaaaaattatgaatttttaaaatttttcgggagggggggggggggggggtggggtaagccaaaaattcgaaataccccctccttttcgaaaaaattttttagaaaaaaatcgagccacaagtgtaaaaatttaaaaagttcattttttgaactttgggttccatcgacaatggtatcagtcttaaatttcgaatttttagggttcgtgcccggttttcagaggtaaaagagaagaaaactggtgataaacattaaataaattgattttttcctttaaaaatttagtaaaaaatttcttttatcaatttttgagttttggccatggctcttccttcccttggccacaatggacatttgaccacccaccattttcattgttcggcaaggcggctttttcgagcttgtccacatgggcacgcacaaaattattgtctgaaatgttcagctttcggcggtggaacttcccacaatcgtagtcacaccaatcgccacgaatgcaatagatttggagctgcgaaaacatggaatttttaaaaaaattttaatttatcattttcttaaattattatggaattttcgaaaattcttgggttattaaaaatttaaaaattcaaaaatccttgttttaagcattagattacatggttgaattgcagaagttgtcgatacatttttctgaggcaaaaatttaatgtgaatacaaataataattttcccctaaattcaaatacataaaaattcaataggtaaatttattaataaatattattttttaataatttaaactattttaaatataaatatataaataattatgcgtgtgatgccaaaaattccccattttaaatatatgtttttatggaattttaatgggcagacggcactaatgcatcctttcattaagctatatatgtaagattggacttaacgcggttgcgtcacagaagagagattttaagagttgaaaatgaaaagggatttggaaaaattttatagtatttgctgttggtgacatagagagaggggaagggactcaagggactcacaaaagccattagctgtaattaatccatgttactataacattaatttttgaatatttcgtcgccatttttgttatcgtgttgtgtactttaaaatatgtttttgaaataaaaatattatttaatttattatagagatagtttcatgcattttaaatactgcgaaaaaaattatattttcgaatattggaaaataagcaaaaagtataattgaaaataattaatataaaccctaactaaaaatgccaaaaatatatttgagacagtttcatgcattttaatctcgagtttttggaatttttctgcgaaaaaaaaaatttatgtttgagtttttcttggaaaacaataaaaaaaagttccaaaaataaaaaataaataaataaaaccctaaacataaaatgccaaaaaggtaattcaaattattcaacatttttggcatatcattaaaattatttacatataaaaatttaaaaaatgcaacaacataaatgaacttttaaattgtttttcatattaaaattagaacggaatgaaaaaaatgacggaaaattggcgcctaattaacgccgcaccgcgttcacggacaataaaatattcgttctcctcctcagtgcgcatgagaagctgacgacgtatgtacgtcttcccctcccctccccctccataaatccttccctaattatttatagagcatcggcagggatggcattaatgccattcttatgtattattattcattcatgtcagcaacagttgagccattttgaatgtgatgccaaacgacgatggcacaaattgtggtgcgcgagcggacaggacgggcatcacacgaaaattgatgaatggaatggcaaaagatgaatgaaatgagagaagatggtgtgacggcacttttagtcatgtaaatatgctgaaattggaaattgttgtttttaggatgaaactaaattgtaaatatttggaaaacggcacattttgtcgcgtaaatatgccgaaattggaaattgttatttttaggatgaatcaattgtaaatatttggaaaacggcacattttgtcgcgtaaatatgccgaaattggagtttgttgtttttaggataaagttagtttgtaaatatttggcaaaagagacactttactgtattgaaataattattctctagctaattaatttgtaaattttttgaataatttttatgaaaaacaaaattatttatataattattaatttaattaaataataacggatattttaattgaataaattacataatgattcatcataaatatttttctgattctatcgcattgcccatttattctgtcacaccaattcgactaaatgttttctccttttttgtttgaataattatttttgttttttttcgacggatcattccatcggttttatattttatattatggttgaccaaatcgtttagggaagggttgaatagaaaaaaagcagatgtactttatcttcattatcccgatttggttataattatctattttttggaaaaaagattaatacgaaagcggacgaccgacttttattcaggcaccatttcaaagtttttgggctgggacaccagcgccgaccttgtcccccaaattccggcaaaatttgtccaattttggcgatttcccggcctcgaaaatctataaattatgatgatgatatgagtaattagcgtttcattgtttttcagcccaatgcacaactcttttttgtcattttgcgttcttttgtcgctttttcattataattttgctggtgccagtcaatgtccgacaaaaccgtaagtgatgattattacgctcgagatcagatttttcaagttttaattttaaatccaatgacgagaaatgaatttttgtctcgaattctctggtctcgagcatagaaaaaaaatttcaaaaatataagcaacaaatttgagaattttgttgaccggcacaatcaaagtgccaaaaaatgttgtcgattttaattcgtcggcacaatgcttgccatcatgcaaccaaacgggtcaagaagggaacaaaacttttgggcttactttccggcttcccattgatgttggacaatgtgacgaagggtaaaaaaattattaattaaaattaaaataatcatgaaaaatacaataaaaaaatttaattatcctatttttaaataatttgccggatttatgcttttttaaagcctgcttatctgctatccggggacattagaacgtgttagcggtggtggtggcggaggttggcaaaatatggcggctgccataaaaaaacaatacaaaatcagcgactacaaaaatgtatgaaaataatttttaattaatttttaattattcaattaaaataattataattaaattcaatttcagaatacaaatattccaaatgaaaagtgcaggcaaaattgggaaaaagatggcaagaaagatggaccaatttggcatggtgtttatgtgtacacagaacggaacaatgaagttcggcacataatgttggagttatcattttcaagcgaaaagtaggttaacaaaattgtgaaaaattaattttgagt

SEQ ID NO: 3613 - DNA, 1612 bp, Heterodera glycines
  misc_feature (1597)..(1597): n is a, c, g, or t
cgaaaaattttatttttgccaaactttattttttgatttaaattcttggatgagaataagtgatttgctgatcaaatatgatcagttggactataaaaataaaattttatattatataatcgtataatggacttatttaaaaaataaactttcaaggacgtacttggtaaatcaatttttaatttgaaatgattaggctagactcgaaataaggacagccttttaaataaggacaatgacgcgccatttaaaaaattcaaggtacaactttggcccaaaccgtcgacaaatttcgattccattttttggcaatcaaagtgaactcgttggctacggtaatgttgaagaaaactgtacaaaatttttttggccatttttaaccataattccaattgtcaggaggagatgctttcaaagaatttgacgatgcttctcttggcacaagcttcatccaaaatatacaggaaggtgcatttttgaaggattttgtcggactttggacgcttggccatgacatgatggcaccaccatcggcagcaggcacccagcaaagtgttgtgctgtacttttaccgtagttgcagctgttccatggaggcctgggtgagtgtaaaatttgatagaaattttatggaaaaaatttaaaaataatgttatttttcgacttgggtggggtggggttacaaaaatcagttttttttttaacttggtttaatactttttacacacattttttatatgtctttttgggattttttatttaatctttttttttgataacttgaaataaaacatggtcactccaaaatcacaaattttaaaattttttatgcctaatctgcaaaaagccaggtccatgaaaaatccagcaggcctggatcccagatccagattatctctaattaatcctttttgtttgattaacttcaatccgttaattcatttatgaacgcacaaaattaagtttactcggccaacggacacagaaatgccggccaaccgagaagcaatttctgttgggactgctgattgtgccaaaacagtggacacaatgatcccatttgactataatgaaaagagcgaatttgccttcaccatcaatggcataactgatgaaaatgcggtcaacatcagtgtccaactgttgcaggaggctcgagctggtcattcattagtccttgaatttcaaaattcttattttatgaaaaatatataaatttcaataaaaacaaatcggacttggaatttcaggtaaagatgaaacactcttagccgtcattagcatgggaacatatcaagcaaaaaaaatttcaattgaagtaaattaaggggggccgaaaagacaaaaattatttttataataaataattaaaaatcggcgctaaaaattttttaatgatagagatgtaaaatacgtataagaaaaatcataaaaaaaataagaatataaagtctcaaaatatgtaccaaaattattggaaaaaatcgttttaggggtacatataaaaaaaaaattttaatttttataagaaaatttctaaaaaatctcaaaatcggtaaaagaaaatgaaaaaatggaattatgtagaaaaatatgntatatattttatcat

SEQ ID NO: 3614 - DNA, 7873 bp, Heterodera glycines
ttctgttccatgtgcgctctttcatttgttgtccatcctcttcactgttttggcatatttttaccctggtaagtgaatgttttagtgtaatcattggttactgtattttctacagtatcaatttcgcttttcttccctttagttatctcactttacacttggccttatctgatcgtttcttcctcattttatgtcgcaattgcaattcgtttggcgtggatcaaaggtaaaataaataattaatttttcgaaattcccaatttatccacttttaaagcgcataatcgcagttggaactcagaaggggcttccgcccaatcgtcggacaaagacagcggacgaatcactgcgacatgctttgccattcatatccaagcttgggcttatgtgggggccaattcagcggccaattacaagtggtactccaactttatcaactgtcatccaatcggacaaattgcttttttccccatccaacttttcgtgtgcatttatgtgatatcggacgaggcaatcaaaattaaaatttaatggaattttgaaaaaatattttaaataaacatttcttaagctctttttgctggtgctttgtaaagaaatgcgcgttatttttgtgcgaatgattggcaaaattttgccatttgtccggaagagaaatgctactgaaatggcgccattcacaacccaatacagtagccaaatgccgaagccaaaccaaacacagcacagtaaaaggcagatgcgaatgatcgatgtcaataacacggcaaatcattacgcagagaacaaattgaggagataacaactgatcaatcagtcagcagaaaagaagtttttgaaccccgagaaaaattggccaatggatgcttttcttttaattgttcattgactctttttattattttattagtaatgtatttttaaataaatttttgaaggagtgacagtaaataaactgttttaaaattattttatataaattgctatattaccttttttaaattacaaaaataattaatggaatttatttatttaaattatatttgttttattaaattacatttttaaacgagagaatctcttcacaatttatttgtgaagagattaatgatatggaaaatatgattcatcgaaagtgtcagtggtttccatccaaaaaagagagaaaatgtaaatgacggacatttttacaccacaatatgttatgttgatttgtacacaattatttatttttcttctcaaatgaaaataaatgtatttccaaaattcactttttgtattaaataatttcgtttttcaatttttctttccagttattaattaataataattctttagttcctctaattgcctctacattttccaaattgcggcatgtctctgttcctcaactgggccaccttcactatttttaccattgctttggctgtgccaatgtttcagtctttttccggtgtccaatcgtacgctaatgatgagtgaatgaatgactattaataacccaattaatattctaattttatttcagaaatgcttcttcccttacgggcgaatcaatgaaaaaacattttacgaaggaatataacgcattggaccaatgcaccaaaacggaagttggccaaaggatcggctccttctcattgagcttccaaataatcggagaatgcgtcaaagggtgcaaaaatacataaattagtgaatttaattaattaaaacaattaattagcatgcttttttgttacccgggctctttggagcaaagcggctcacagtataattatgggatgacggtgggcatgcaatacaacgtgaaaaacagccaaatgtaaaagtttatcagataaaaccattttattgcttaaactttgtcagaattccgtcgcgaaggaatgcgaagaaaagcattttttattgtgctcgagtgaaaaaaagaggaaaggcggctttgcatggaaagcccagtttggcacggcatcagaataagcggcccatttgcggcatcggcgctagttgcagccatacagaagtagaagtcctagtctgttcgccggagatcacttcagaattagaatttcggtcgagcaaagccaatttaacattgacatccatggagcccgagttgccttttttgtgccaaaaatgcccacatctactggcaatgttttaggggtgagaaagagaaggggtgaatttaccgatttgagaggtccatgacaaaaaatttaaattgattttcgactttttattttgcctgattaagattgcgagagacttaaaagagaaaccaacggtcaatgtgaacagagcgaagacaaatcgaacagcaggaggggtccgtatcgttttggcgccgacgttttggcgccatgtagggaggtagaaatgatgaaatcgttgtaattttttgacgaagtctatcaaaattttttcaacaatatttcgatttaaacaaatctaagaaactgcaaaagattcaaattcatttcttattaattttaggtaaagataataatttaaaaattattatcacgaaaaatgcgtttccaccattaaactgggtcatctcttattaatttaaaaaaataaaagaaaaaataattaacaaaattcagattgatggcgatttaaaagcagaagagcgtggaactttcgtgacgatcgaaaatgaggcaaaatcattagagagactattgacatcactcatattttaatcggctccttttctgcgcgtatatgcatttaaactacaaatggagattgatgattgcttccaagggcagggttcttaaaatgccaaaattggaaacttattcatatgtaaatccaaaagaaatctagccaaaaaagtagtgctttgttgttgtttggataagagatttagattatttatcaaaataagagacagacccaggaattttgtaaccaaaaatgggcctagccatggcacccaaccattaaattgtcggttgcttacgtagaaatgacacatgtaaattattttttgctttttactgccggatgcataaatatattgccacgagaaaaaaaaaatgtttttatttacatatttattaaggctgaagcaacaattcagcgaatgattttaataatattttaatttttgaaatataagttattattttaataattataaaaatcgtgtgtttcttttcttatttcgttttttcagatatttaagtggtaaattgataatgcaatttttcattcgcttttcattagtctttgtttgtttttatggcaaatttgtgccgaacattggccaattgatttgcaaaaatgaagaaaaacaaaatttgatattagtaaaattatacaacgacgaattagccacaaatgacgacactggcgaattatgggaatttatatgcgaattggagcaacaaaatttagcaatggaaaaagcattcgaaacacaaaagcaaaatgggaaaatgtggcgaaaaagttcggaaacatttgatggagaagcggaattttttaggcacaaatttgaaattatcagacggaaagacaatgaattggccgaattattcacaaaattaaggagcacattttattcaacagttttaaagggtattaaacgactgactcccagacatttcatcaaaaataataaaatgaatggaaagaaatggacaattaggcaatggcattacgaaatagtgtccgtcactctgcaaatgtgtggtagcttgatgagctcgattttcgctgttttaatgtccattgtcattgtccatttttgcccaattcatttcactgacaaaacactgttagaaatgtgcaaaatttcaaaatgctccgccataattatctaataaataatgaatagcctaattcttagatgggtccatggcagaatgccttagaaatcaattaacccaatttgttttgatgctgacacaacgcttcaaaatctcaaaggaagaaataatgccaaaaaaagaggaaccgacaattgcgttgaaactgataaaggaatttgccgaattgtggagagagattaaagtaaaacaaaaatcaaaaagcgattacaaaggcactgaaaatggaaaaaataatgggcaaaatgagcgagaaaagtgttgggattcggatgaaaagcaacgaaaaatgttaaggcttgtttttacggctgttaacggagatggcaacataatggcattgaacggtgccacaaaaggtacatatttcccaaacacgaattaatatttcaaatttaaaatgatcagttaatggcggaggccgccgttcgcaaaagcgccgccgcaaaaagcgcgacttggtcctcctaattctgctaattgccttgctaatttcgctcttctttaccgtatattcgtattgtttacacagttccaacgacgattcgcttgagcaacagaacgcggacatggaaatgcttctcgttgttcgccaagcaaacgaaatttttgtcaaatttcgttacggcgacgatgaaacggataagaaaggcaacccgaaaagtgaccatatttacattgtagtggacggtaaaggtgaataacctgccaaattaattattaataagattatgtattgcccttttcccgaccctcaaaaaatgatgggattcggagtttttgagaaggcattatacagttaaatcttacttaaaattaagacatttttttgtgcaatttgattttcggcttttattctgagtttttggctaacggaccatctcgtataaaaacggttgttaatgtaaaacaaatgtcagaatcatttttacgcaaatttttattttataaatatattaaaatgaatattgataaggttaagattggggggtttcaaatttctgaagtgtatgtatgtacctgccgaaaatttggatttttgactgcatttcttcccttcaatttggcccagaaataaagattaattatgtttttttttaaattttaatttagaattcgatttcgttggcgatggagcacggtcaagatcagcgtaagcatataaaatacaacaaattgtttttcttttttacgcattcattttcaaaggcatttttgcaagaagtgtcccaccggaatgtttcaattcgatccgccactaattgtcccaccggaaaccgtcgaaagtgttgatgccatttttgaggcaatgctcactgggcattggcctcccgacagtcacacttatgccctccactcgtgcattgactttgcctaccaatttgtgtgccggttgaacaacggaatgtgcggcacatttgattatttttattcgtaaacttaaatgttaaattgttagatgtccggagaaggaccgttggccgcggccgttcgtcgaatttgaccagcgatgggtgcacagaatggcccatttgggccgtttgtccgtgtttgactttcgctatcgcatttccccacaaaattatgaactttcgcgcgacattttgcttcccattggcaacataattagcagcaaaaaacaatcgtagcaaagagaaaaggataaaacgaaaccaaagggaagaagagaaaatattttgatagaaatggcagaaaaaaaacattttatatttaattaattgaggaaataaaaacatgctaattcatggcggacttttgtggattttcatacttcgcgttttgtcaattttttccaaatttcgacaattctgcaaaatttttggtatttaattcattgattagaatgtacattttcgattttattaattctgcgacctcaaaacatgttttgattttggtcgtttcatgctctccctgctgctcactccccctctttaaaattgtacaaacatcggcggacggatggtgatgactcatcctccctccgctccagccaattatttacgactttttacatttatttgatccatttcaaaagcaaattcgcttcaaaattttctgtttacacagctcttcccctcccccccccccaccttattcgccctattcatttgatttccttgctattactaataggggcaattaacaattaattgcctggcattgcttaataccgcccgcctccttcgatcttttcggtcgaaaaccactcattcgtcgatgttctccgactgaataacaatttatttattctatccccccataagataatttctccccaaaatagatgatgctgatgatcggatgagtttattgatccatccgcctgctgtcatcccttttttccgtttatcccaattttattccaaataaatttaattcaaaaattttctatttaagccttttttttagcaagaatatacaaaaccgaaaaataaacctccaaattatcctctcacttctatttttttctttttaaaaaatgaataaaataactgaattttagctaaaacccataatcacttgacccttttatatcctatggtcattgggatcctcccttcccgatcaatgatcactttttaagcctgttgtttcccctccacaattgttcatcccacgattcatcattcctgagcattcaattatccagagacgatcaggaagaagttcttccaaagtcgacttttttatatttacatttctcggcgattaatttttacatatttttgcgtttattgcctttttaaatttttttgtccatttaggcctaatcttaaaaacctgctcattggtaaaaaatgaaatccttctttaatttcccatttgtcttttgtattcttttgctcattggctgcgttgacaaatgcgtcggaggagtcgcggcattgccgccaaaatatttgggcattaaaaaccatgacaaatgcttaaccgagtaaattaactctattttaaatgtttagaataaagttgctttttgaacaaatttttaaatttaagcgagccaataggctcttcgcgtcggctttgtttgccagcgcagaaaaaaatcgaatgccaagatgaaacgttgaaagcgcttaatgtacatttaatatttaataaaaattaatattatttaataaataaaatttaggatttggaagaaggccaacatccgccgacttgcgcatgaatccgaagacagaagcgaaagaagcaaatgaagggattgaagaatgacagggaaaagcctggctgaacaaaattttgtctacaaaaatgaaataaaaagttattgaaaataaaaaaatttattgatttgattgaaagaaaaaaggctgtattctattgaaattttcggcgcccaattattctgattcggcataaaaaatttccatttgccatgccatttaacgaatgtgattgaatttcaatcacggatgatccgccggtgattacggatggcaaaaatgccggatttcatggtccactaggtaattcaaaccatgagaccaaatccgtggtgagtcgaagtgacaaaagtgcagatgtggcgaagtgacaaaagtgcgaatgagtgatgatcagaaggggcgggtcatttcagtacggaataaatgaatttaattaattaataatataattattttaatttataattagatttgctgaccgtaattataatttagatttattattttaatatttcccaaacaaattacatttttatgagaaaatatagtcccaaaaaatttttactcaaacctgaaaaactatcttatagttcatttaaaaacttgaaataattcatgcttgcacaacttttggtgctgatcaaaaaagtctcttacaccaacttgatcagatcactccttcctagtgaccgggacacccaaaatacacttaaaatcgggaaattttcgaaattcatagggggttgggaaattttttctagaaaaaatgggcaagcccactggaaagagcacaaaattctctactgatttgacttttgaataatgggg

SEQ ID NO: 3615 - DNA, 1024 bp, Heterodera glycines
attaattaattaaaatcattgttcggtactgaaatgacccgcctcttctgatcatcactcattcgcacttttgtcacttcgcccacattcggcactttgtcactttgacccagcaccgaccaaatcatgtaaaagttaaaaaaatccattcaattggcataattttgatggatacgcacgcattcacagaaaacatttgctatattcgacgtgggaatatgcgcgaaggcatcaataatcagatatttctacatcaaaaatgtggaattttctgaagaagccagcaattaaattgtaaattttaatttattttatttttttgttttatatatgacatttataaaacataaatatttggaagaaataaaattaaatttatagacaaaatggaaattgtttttttcttcatttcactggccaccattctgctaataggtgaattgcggatgctaaccaagctcaatttttgagtttacattcaatcgcttcgatttgcttaaatttcttctaaaacccattaaatcagtttaaaattttaaaattaaattataattttaataggcaaaacagctcgacttcccagcaataaaaagggaaatgatgcaaataaaagtgattttgcgagcacttctaactccgcagatcaaacacaaaataaacacagtaagacaaaagacaaaacaaattgaaaaatattaattgaatttagttaaaacgacggatgacgcatggaactttttgaaaattgtgaaggtgaaaagggttttgtgtaaaaactcataatttttaattttgtttaagcaaagatttacgaataatccgtcggtgttcagtgaatttttgagtgtcatgcgatccttcaaagacgaagtaaatccaaaagaattaatttttgccttgaactaaaattgcaatcacagaaagtggacagtgtcgaattacatcaacgagttgcgcaactcttcactaatgagactgatttgatgcgcgcctttgaatcgtttatgcccggggcatgtttcaa

SEQ ID NO: 3616 - DNA, 2721 bp, Heterodera glycines
  misc_feature (2689)..(2689): n is a, c, g, or t
ggatcctctacgagtcttcgagttaaattttgaaggatttaaaatgaattgtgtgggcacagtgaaaatttttgcaaataattgatacaattttcaaaaattacctcatatttcaaacaaaaattttttaaggatccctggttacgggtctgggtccgtgggatgccttttatgcatccccccacccctgccctcccgccatcggcccaccgtaaaccaaccacagtattccgctcgggaatagtgtcaattagcaaataatcggccaattctatttgctccctcattttttcgacaccaacagctgtccaatccatttcgacctgtaaaaaattaaattgtttaatcaaaaaagaattttgattaattataaaattatataaattttataactatttttttataaaattaaataaaattttaaaattatttttatggtgtaaaaaactgacttcatccgtattgtaactgtaagttgtatttgttttttattgttttaaaattgaacccacttgaaagactcaaaagttagggaacaagtgacattgtcaaatggaaaactgaaaaatatgaaaatattattttttaaaacctaaaaataaaaacctagaaccttttagattaaaactccaaaaaaaatttattagaaaatataaattcattttgagcctttttaagaaaatttctaggcctttttaaaagaatattatcaagcaaaattttcgccattatttttgccgttataacggcatttttttgccactttttcagttaactattttgggttttttgtcacaaaaatccacgccctagtcatggttccgtaaatttgaaatatgaatttttatccgattttaaaattcatttagaccgtgtcaagtccatttcacagggtccctgaagctttagtctgtagttagtccatactaaaaaaaagtgatatacagtaaccgaaaaaccgtaataaattttgatttacctgatccattggcataaatgagcagaaaaatgtttggaaatggagagcgatgaatgtcagccgtctttgaattgatgaaacactggaataaatattttattttatttaatttaatataaaattttttgacaattttactgaatttggagtccataatttctccaataaaatgctgttcaatgagaggctaaaaaatgtaattttattttcaatttcacaatatatttacttgtatttgcatggctctaaatatgaatagtccaaagcctggtccttaaaaatatttatttatttttattaatttattttgaatattttttacattccacatttcgctgatgtaaatgtccaactaaaattagtaaaaaaaaatcctaagttaaagccagaaaaaataaataaaattgcctggaaatctgaagtaatgtccgaaattgtcgtaatttcttgcacccaaacctacaagaaaatgttttaatgtgaataatagcgaaatgctgtaacaaattctcgaatacagtacctctaccataactttaacacggcctcccggtattttgtgtctgttatacccgtcgagaatgctaaaattaattgggattctttaatgataaaattttaaatttttgcaaaatatttattaatgtttttaaatttattttaaccggtccaaaatatatgaatcgttggcacaatatcgttgttgtccctctgctgttactgctgttgtcggactgtccgatgcggtgacgtcacgtgaaaaacgcttttgttgtgagggcggtatgatggggcggaaggcgccgcgttcgtcaaccttttcaagtgaaaaatacggaaatttgagtcccattggctatgaatggaattctgagaccctaaaattttggaattctgaattccgagttcagtatactgagatcccaaaatgttgtaagttcggaatccgagcgaagccctaaaaaatattcaaaagtcgaaactcggaactcagcaacatctctggcattggcaagcgtttcgtctaaaattagatttccgaaaaaattttgggattcggaattccaaccctggtgcatacaacgcacacccaattcataagaaaaaaaatcgcttcacttttagcggattatgaaacgaattagtaaggattttagctacaaattttgattattttgaataaatagtaaggctattttccgccttctaaacattttttttttacttacctcccaatcgtaaagccgggaaagtctacgaagttggcgagaatttcgacgaaagaaggccttcctgaaatttcatatttgtttttttccagtttgaaaattaacttttggattttactttatttttatttttctatttttatctcaacaatttatcccatcgatggcaattttgcacaaaaagatttggcggaccaccaaattgaataaattctctgccgtccccacataaatttgccaattttcgatgccaatggcaaaaattaaatttgtgtcgagcagcaaaatgaggaaacgatttacttccttccggacgacacaaatttaaatagaagaaattaatttttcaaaatattagattgttatttaaattattttttaaaaagaaagaattaataaaatatattaaacaatatatatttttttacgatttttatttattagtttttttattggatttgaagcaaatattatttttctnaattttaaaaagtattttttaaatattttttc

SEQ ID NO: 3617 - DNA, 3443 bp, Heterodera glycines
  misc_feature (3422)..(3422): n is a, c, g, or t
gctgacgaatgccaaaatgggcggtagaggaggaggagacaaatttaatgcggggaaattttgtgcccgattttatgggtggggccaacgaaaatttgtacataaggcaaaatggcacgaaatgaaacaggataaaatgatgatagatgcattaaatttatataaaataataaaatattaattgaattttatgttataaaattattcgtaattccagaaagaaacttttcatgggatttttttagaattgaataaaaatttgttttcatcgaaaattgtacataagacaaaatagcaaaacgatgatacacatatttatataaaataataaaaaataaaaatgaattggattggattggattatgctataaaattattcgtaattccaaaaaacttttgaggcggaaattttttcaaggaatccaagaaattttttttttcatttaaaaaatcttttaggccaaatttgaggcattgtttttttctatgccataaagagctcccattcagaaaagtgaaaggagggcaaaaatgtgtcaatttcgcgcctgaatggggtgggcttttgggttcgggcggaaaagggggcgggcggaatgcatgagaagaggcgttaaagaagaaaaacgatttttgatgggatttaagtcgaggcgtcaaaattgcttaatgtacataacatatatatttgagacaaataaaaatgaaaattacttttaaatagtaaaatgaatataggaaaagttagaaattaaaatttatattttaaaaaattgggaattttaaaagtaataaagcgatatatattttaaaaatgagacacataaaaataaaaatatcaatatttttaaatagtaaagtaaaacatagtcaaaaataagaaaaaaaaaattaaaagtaataaagcgaataattcattaattccataagaatttgcattttttaaatttgatatgtggagaaagtgcctgctggagtcaatgctcaaatggcggcacaacaatgcttgtctatgcttagaagcgcatttagttttgctttttgaggcaagccatgccttttccatcgaatgaacatttaaaagtggccaaaagcgttgtggaagttggccaactgacaaacaacgaagctcaaaggaataaaaattttattcgagagtcatgtttcaattcccgaaaattaaaaaatatttatatttatataccaaaattttttacattaatatcaggcttggtcctctcacatcggtctggattttttttaccttaaaccttgtttttcataatcttttcggcacagattttactgttaatacatacatatagcctctattaccatccattatatataattagaaattaaaaaaaatatgaaattttatgagaatttcttcgtttatatccaagttggttgaaattttgtgtgtcttaaaaggcccatattaattcccaaaggaatttgaagccgaaaaatgccactgacaatgagaagccaatggaaggaaatgagtgacgaggaagcaaaagcagcaaattctgctgacgaaatgtgatgcaaacatttatacatacgaacgacaccacaaaattaaaaaaaagaagcattatgaatattaaataaaattaaaaaaaattgatttgaaattctgtaaaattctgctgaagggaaggtttttggaacaacaaataagtgcggtttttcatgaatttcttttgtattttttttcaaaatatgtagcataattattaagtattgtgatcgttagcgtctgcaaaaaaaccttataaggatccccctgccgatagtgatgggattgtgatggtccataagaccggggtcgggattcccagaattaaatcaattttctgcgactccgacccattatatgtttggaatatttgcaatttaaaaaatggggtgtgccttcaaaacaggaaagtaccattttttgccaaaatctctttgcgttccaaacccatcaagcacaggttaaaattgtaaaatatttcttttaaattttagtaattaaagctacctattttagcccaatgattaattaacttttaaacggaaaagtcaaatgacttccaaatcacttggatcagtcagtgatcagtgatcacgagtctcttgctgttcaattattcctttaactcatgtggaagacttttgttcttgtttcaatttttatttcattttttaaaaagtcggtaattttaaaaatgtttaaaattatttttgtaaaataattttatcaaaaaataaattgtaaaagtttaatttcaatctcggcttaacaaaaataaacctatggaaactatataattagctgatttgatacgtaaaaaagttcgcctttctttgttgctcatgtgacagctgttacccattttattttatcactcgggaaaagttgccaaaatgcgaaaatttctgttaactcattaattaagaaaaagctgcttttgatctgatcacatttctttttaaaagaagaaattgcctttccacaagacacaagacaatctcaatcaactttgagagttttaaggttttcattttattattaattaattaattccctattatacagccctcctccccctgaattttgccacctgcagaaataaggcgctcctttgatggggtttagaaataaagccccctgatttgtgagttagagccttcccctgaaataaagccccccccccttttcagcgggcttgaaaaaaagccccgagatagctctatttctgaaaatacggtaataaaattttttttcataaatttaaatattttgccaaacttaaatttaaaaataaattcgtcatcattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaaagttgatctttaggggtgtatttttcgtttttttttcatttttcttgtgaaaatttccaaaaaatggcaaaatatggactaaaaacccaaaaatggcgaaatatggatttattcccgaaaacccccaaaatatggatttatatggactanaaaccttcaccaaatcaaaaa

SEQ ID NO: 3618 - DNA, 3994 bp, Heterodera glycines
cggataaaaaattatcatggttttttatcttaaaaatattacggaaacaaaagggtccccccttttgtttcaaaaagcctcacttttagtatagcgccaacttttgattgtttaatattaaatacccaactccgtagtgctatgcagcaagtcaccagtggcacagatcattctcaatctcaaccagttcattctcctgctgtccattgtctggtcagttaaatagaaaatttggcacttttatagatgccttgccgagaatgaaggaatggggttatattacaaaaaaaaaagtttaggaatttccatgaattttaggtctgtcaatgtcgcttggaattgcaccattcattgtttgggccgactgaggacggcaccgactgtgcttcttccaccaaatcgtatgctttgcgcagtgacggggcttcctgctcgacaacaacagatgcgaagcccgactttgcttcaacgtatgaggttttatgaccgttttttcaaaattttcttcaaattttcaacattttttagcattgcattgacttgacctccactgttggcacgtctcaatctgcaaatttgttggatttagtggccgaatccaccagtccattggaagtgccgatgtgtaaggtggcgataattcaccattttcggaaaccagttagagcccggactggatcccgaccctaaaatatgaaccaagagaccaagacttcgaaaaaattggaatttgaatcccggtaattatatcccagcctaattcccagtcccggcatttttaaaagtctgggttctaaaacaaacatggattttttttgggtatgaaaacccatcaatttttagaaatgtgccaatgcagtgactgcggagctgaacaagcaattgggtcatttggagaaggaatgcatccaatacaaaaagtcgttggaccatttgttgcaacggcgtgcggactgtccatttgacatggaggcatcgcgcatcaaattggacgctttaaaagtgtgtattttcatttacattaaaaattttttttttcaaaaacctagtttttcaaaaagaaacccgtaataagttttaaattttcagtctttttaaaaaaaattggggctggaaacattgcaccccgaacatacgtctattaatttttgacatttaaaaaaaaatcaaaatttagtcagaagagcgcgacctattggaacaactgacgctgttggaagacgaggaacggacactgcttcatgaattggatacaaaacaggaggagcgcaagaaaattggtgaacgagacgagcaactttatcgacagttgcgagacaaccacaggcacttttaccatgaaattcggacttttgattatttattttaattgaatttcagtatactcattgaacaatcggatgaacagcggtcatttaaattgcaaatcaatcaggccaatgaacaaattcgacgtctgtcccgcatgaatgtgcttgatcttgtgttccacatttgggtggatggagagtacgggtgtgttgcaatttgagcttggaacagaggagcgcgagacctgtcagattcacaggctcccgccaataaatcaattcgaaacaaaccggtacaccccaaaacacagccgggaaaaaaaatttttttttttaatttattcccggctgtgttatgtctcggctgtgtttcggccggctgtgttttgggcggctgtgttttgtcttgtttcggaacaaacaccatttttaatcctgaaactcggtctccggagatgcaatttacgaatcctaattttgatccaaaatttttaaaacttggttaaagtttagccaataaatggtaccagaaaatagtgacactctcgaaacgcgtataatattacataaatacaatgaaaagctcgttttttcagcacaataagcggcttccggttgggtcgactgcggcatgaccaagtggaatggagtgagatcaatgccgccttgggacagacggcctttttgttaaaggtttggtgtaacactcgcgcagacacaaataaacaatttctggaaccttttaattttgcttttactaaaaaaaaggtcatcgctgaacggctcggtctcgattttgttggctacgagttggtcccatgtggaagcacatcactcatccgaattctgcccaaaaatggtggcactaccactgcttcatcaacaactgctccagccgcacatgccggtcagctagtttcatgttatttccattcaacattgttatttttggcgatttagtcgaggaattgcccttatatggaagcggcggttggcgaccatttggtcagcccgcattggacaaggcattgactgggttcatggactgttttcatcaggtattgacaaaaaattacattttttggaaaattgatgcatatttttttggacaggttgaacagcggttaaaacagtactttccgcctggtactcagttgctgccttatcgaatgctgaaggacaaaattgtggacaaagactcgcaataccttgtcaaaatgcagttaaattctgaagtatttccatttcttaaaaaaaaaattcgggtggcctagtggattacaccccagtcatgacacctttctgctcttccctccatctctcttacccttttcctcattccatgagccattgtgtcgctccttggcacattgagttcgaaatatgaggacaaattaatgtctttcgggggctctggacgttaccacttggtgcaatattgcagttgagtttatcagtccatggacatatgtgtcattacaaaattgtttttaaaggacgacgaaagaccaaccaaaaaatagccaatttaaaatatacccaaatacaaaattttatactttttaggaacgctggaccaaagcgatgaaatgtgtgttgttgaacatgaaacgtgtcattggcattctgaccacattgccgccgacgctgatggttaacccaacaactgctgctgctgcagcaaccgctggaagcaggacagcgaacacaaccgccataattggcaccgccattcccactcactcgccatcaacatcctcttcttcccgttcatcctgcactggcactgctccagttgtccattcatcgcaaactgttccagcagcaaaagatggttggtgagggcaaaaaaaaatttttttttaattttccatttactttactaataccagctccaagcagttctactggacaaagaaagcagaagtgagcaggcgactacaaccagaaaatgtttgacgagcgccatgacaaattttttttaaactaatttatttgtgtaataaagaattttttaatatactatatatatacacacatttattttttcattcgttttatgtcctatcaatattttttgagacaaactaaaaaaataatatcattttttgcgcacagttcagtgatttttctgatgaacgacgccaagaacaaagaagctgcttgtagcaaccagcggaagcgccgggaaaaatgtgacactggcaatgagtcgaagagagcaacgacgacatcatcttcaagcattacttgtacctgttctcagcgacagcgcactgaatgggcatggtgaaattttattttttggtaaataactgttcgaacttgggggatgaaataatttcaattttaatatcccatagagtataaaatttcatttttgttacagttcattttgttctgccactcaacggcatcctccttctacaggaggacgtcggcctctgttgcttccaccagtccaatggccaatggcaactgcggcaacaaaacggaaatatttacgtcgaccattcacactcaaaaccgccgttgttgatccaagtgaacatttttacaaacatttcatttttatgcttgacatcacacaaaattcatagccacgatcacttcgttcgtcttgttagcactgatttgtctgtcgtcatggctcaacaattttgctggtctcaagccaccgatca

SEQ ID NO: 3619 - DNA, 4180 bp, Heterodera glycines
  misc_feature (64)..(64): n is a, c, g, or t
  misc_feature (76)..(76): n is a, c, g, or t
  misc_feature (80)..(80): n is a, c, g, or t
gcttgctgcctgaggtcctgcatccggtagattttcagtgcaggatgtgtcacaagggggtttntgtaggcccatntatnaaaaatctttatttatccacagataaattatttttaaataaattcatacaaaaattgtatttacagtttattttaattaaatttatttatgtgttacaatggtggacaatgcaacgttgttcagttgctcttggactgttaattcctgaataattgaatttaaaagtcttaaattaaaaaatcgcttgtcgagtatgcttcttccttcccaagccatgaaataggcaaaataattgttcatagactgtcattagtggttaaattataaacaattaattaaattaaaatttacgtcttttatgttttccaatgagtattttgcctatgatttttatcaataaataaaatctgagtgttgtcaattttatttttaatttaaaaatatgtgcacataatgtaaaaattattaaataatacgttatttactactcagataagattaaataataattcgtttttttttttgaattttaattttcttaccctcaaaccatcgtcccatgaatttgctaagctcaaagtcttccggtgttgaaggtagcaatgcgtcagtgacattgtccgccaatgtttgcaagtgatcgggtgggatcacatcggccaatgttgtcccgtttgacacacggcgagtaattgagcctaattaaaacaaaagcttgctcgtgaatttgggacgacattttagggattttagtaattttaaaaattaaaaatcaaatgactcagacgaaattttaattgtaaatttttgaaatttaaaactaccaataagctggacaacgtcaatttggccttgagaattgcgtggaatgcctccgggtaaaattgggataccttaaaaggcaagattaaagaaaaatttcataaattttttaaacaaatttcgttataattaaaaattcgagaaccaaaacaaaaaaaaaattattaagatttccgatcgcaccgaattttaatgaatcataataatgcattattcattaccaggaattctaggtaatccagcatgggctggcccattggcattgccgccgccacccaatgcggaagcgaaaccggcaatggcacgctctgcaggcgattgttggcgacgaattccttgaaataaattaaattgatttaaaaaaaaaattagttttttggatatttaatttaccattcccactggtggatgaagcaccaccaccaccagcagcagatgaactgctgcttgtgccagcggaggatgaaactgactcggcggcattggcaagtgccgaagcgatggatttagtgtcagcagccccatttgggccagtgtttgtgccaagcaaatttggcaatgagttagacaaagcatcagccatgccagcttaattaaatgttttattttcattatgttctaatgatttttgattttaatttaatgagctccatcaattttatggagtgcttaattaggattttagaaccaattaaaaaaaattacatattcagatttatggtcattgaataatttttttctttattaagcatcagccatgccaacttaattaaattttatattttcattatgttcattgatatccaccaattttatggggtaattaatttgaattacggcaatgagtcgttaaataatttatttttactttattttttcttgctctattggacctgaattttcgttattaattaataaaatgattaagttaaaaagtcaaagtgaatatgttaattggacccatcaaactttaatatactcactatctttgacaatttttcgcactgagctgcttaataaaccgatcaacccattctcgcccggtttagcatctggcaagctgaaaaaaaacaattgaattttgtttaattaataataaatgggcggacgctcacggagcactgctgccagatgggttgaatggtgctttggcactttcaatgaacgtgttcaattcgttgccaaatttcggattcgcttggacaagtgcttcattctgaacgacaaaaaacttaaataattaacacaataaaatataaaaataaatacaacaaatcgctttataaaacattttaatgacctgcggggcatgaactgtttgtcctccaatatgctctaacggtattccctgaactggaatgccggctgaacgaagttccttgacagcacccgcaaatccctccggatgatttcccgtaaggccaggaattccttgaaaattgcaaaaaataattaaattaaattagaaaataaaaatccgttcaggaaatcattcccaaccactatcatatgaatttatcatacaatatgaacacttttaccaaatgagtcaaggccaaggaatttgatcagttgattttgcacatcggtcggaatattcacttaattttaaattataaaaatattttaaattaatttttactcggtggcgcgggcggtggcgttgcgtcttcacgcgggttgaatttctgttgtactggattcaatggtaacacaggctgtaatgctgcaattggatttgatgttgacacagcttgttgaccattcttaagaatttggatgcaattaattaattatttaggacttaatgctaatgaaaagccaatcgggaaatgacaacaaatataataattagccaccaaattgttttaaaatataataattttcaacaattatttcatatttcaggacttgtaaaatgctagaaaaaagttaaaatttatctgattttaatttaaatagggccatcaatcagtcaaaacaattaaaaaattaattaatgttcaaaaagtcattttttccattcttaagaatttggatgcaattaattaataaatttaaaagttttaatgggtattttttaaatgatcaattaaaaattttaaaaatttctaaattttaataatcagttttattacagttgcagatgatggcggaactgaagagcgttcagccatcgcagcaacatcgattggtgccgattgcttcgctggtgatggcaaatgtcgtgtggccgcttgcggcacggcacgaggcggatccgcctgccgcataaatgttggctttgccggaagctaaaacaattaagaaattatattaattaatttacaatttttaccggttccaatcgcataacaacagtccgctgtgactgttcattgggctgctgttgatattcatattggtatggccgatgtgcagcttggccaagaattgaagtgaacaagcacaatacaaggatgaatagatgtgttagcataactttccctttttaaaatggaatttaaaggaacaaatttaattgatgtaataattaaaataaaagtttgaaaaaacgaataaaaaatttaccgttgctaaggtagggtttgttaactttttctttttttttattaaaatgatttagataagtgctaatgggattttttttaacttatgaataattctgatcatctattttgcataaagagttaaaaaaattattttatttaagtaataaataaaacattttcagaaattgtgctgccgaatagaaatgataattagaaatttatccgatccgaataaatgaaaatcacacatttccaaatgcatcattacacagcaccttatggaggagaaagggaagggatgacccaaaatgatcacagcaaattagctgcaactgctgctgctgctttcttggtgctttttggatgttgtcagtcggaatagttgtggaatcggggttggattttggggggaaatgcgccaacaaaatcggcggcaaaatttggggcatccggcgaagatttttccgcttttccccccccccccccccccgcgcgtccgccacaaacggcgaagattttgggatggtaaaaggtgcacattttataatgcaattgaacacaataaaattaaataatttttgtttcgcagcaaaagaatggaaagtaaaaagagatttataaaaaaaaatatcaaaagaatggtataatttgaaaataatttttgtttttttatcagttttaagatatgatgtaaatttgctccggaacatgaatattgggaaaatccgaggcgggacttgccggagaattttgaaatgtaaattaaaacaacgataatatttacg

SEQ ID NO: 3620 - DNA, 3982 bp, Heterodera glycines
ttggatttgattttaatgtcctgtaaatgcggaatttttttccattttttgaaatttcttgattcagccgatcctactattttgactatttatcagttcaacaatttcacaaattttgtttgatcgatgaatgaaagcaataagcagaacatttgcttgccatctactggagatttaatgaaagcagcagctgttgaagaaatacgtataaagtcaaaggaacatttattttcagtttcatctgtttattaattattttaattttgaacaatggataaatatacatattatttttatatgtttttccacatatttttgtatgagaatgcacaaaattcatttttgaccgaaatattttgtgtaaaaacaattttaaattaaaaaaaaattgtactccgtggtaaataaatattaattcacaatatttattattattatttatttccctgttttgtattctaatacgggaatcattaatttttgattacagataatattttaaggtatttttactaaaaaaaacaattaattttttgtgtaaaatgcgtctttgggtcgcttcactttgcttttacgtttccattttcatattttgtgaaattttgcgcggatttgcatacagattcgagctgcacatacaaattggtggtgaacatcatcaactgattacatctttgatttatgaggtgggtaagttgaaattaaaactttttttttaaagcctttgttaaattgagaattggaaaagctcaatttttaaccgcttcaaacacttctgatcaacttctttcattctctagatcgatttgtctcattgagagatttgtcctgatcgggcctcaaagaaaaaatctcccttactttacaatagccgccgggatttcgcgcgattccctacccggaccgacattttaccaatttacgttttttctgactgcgctttaacttttaacacgttaaaatattggcattttattgagaaagtcaaatatgtaaaattattgcgtttgataggaaagtgagaagacacattaacagaggataatgataaataattatttttgattaataatattgaaaatttttaaatatttaagtgttatcaccatgtatggccccataaaatggaataaaattataataaaactctcatttttaactctatctttttttgttcgttatttttttttctcctaaaaaggtcagaaaatcaggcaggttagttagtacttcttcttattcatttttctttgctgaaattttctgttgttatgttcttcggatcgtccgcctctttttgcatcacttttttctctggcaaataaccacaacgcattcgtagctgttcaaagaagacaaaaagctgaaaagaattttaaaaaataattaatttttttttaaataaaaatttgcttatgattaaataaaaaatcgtccatatgccaatgaaactccaataagcatccaaccgcattaaaataatgaaatattttaattccgaggaattcggtcttttttttctcttcggcttcgaaaacggtatttcgatatcaattttaaagttttcaatatataggcactgttggtcgaaaaattgtatttagcagttttttcgctaaaaataatcatattttgtgcattgtaaatgcaacgcaaccatttttctggggaaacaaaaaaaaaaaaaattaattttcattgaatatcaccatttaaaatttgggaaattcccaaaattcgtaaaatttaacagtttacaacaaatctagcctcaccagaatggtgtgcggagccaatcgcacccatgcagggaaaaagcccttgaaaaagccggtcgggcccaacttggccgtgtacacacaacagtcccataggcccttgaactgtcccggcggtgcattcatcattcgcgtttttagcacctgtaacaatccgggtcttgattctaataataaaaaatatgttttcacacggaataattgcccattaaattcgatgaatgggacaaaacaatgccaaagttttgtgtctgacataatgaggcaatttgatcaaaaaacaaaaacaaaaaaaccaatttacgaataaaattttgactcaaaaactttttgctgaatacggcaaagcatgcatagtatagctatgtcaattatatgcaaattttgaggcttttagcatattgcgagagcccattttaataatggtcttaatgattcaattattataaatggggactaattgccccctacggcacaaatttgcaaattgggttgaaaaattgaaaaacgcacatccattggttgcgttaaaacggttgcgcctgaagcagccaaaaatgatgaaaacaaatgtgtgtaaatgttgtcttgagccaaatttgcggcaattagcatctgtacgcgtaagtgaaaataatttaaatgtacgaaaaacatttataatttaattttgaaaaatatagcgaagaaaatagtgattattccctgtccgaaattttgagattttcggaaaattccctacagaaaatatgttaacaaccatgccatgacaaaaaataaaaattaatctttatttttttttaattttgcattttatacatggtaaaatacaaaaaaaaatttttttgcaatttttaggaaaaatatttaatttttatttccaatttttttccccacctgtttgatttgatcataaaaggacagttgtccaatggtcatcagcactgctctgcctgttgccatggtgcacccattgaaccattttgagacgccttcctcctgaaaattaaatcaaaaaaattaattcattaattaattattttaatcaattaaatttcggaccctggccatccgaaacaatccatcaattgcatttttgtagttgcgccgctcagccggtggcaatttgatgtcattttgcatccgaacattgaccaaatcggctggggaaccggccacaccgccgcaagcgcctgaattttttaaaaatatttcatcaaaatttttaaaaaatttgtaatttattttttcggggaggggaaaatgaaggttatttgcccactaatagtgcaaaatttattttaattcttaaaaaaacacctgcaaccccggccagcaacattttttggccaaaattcaagtcgcctgacgattgctttttcacctaaaaatgagaaaaaaaaattattttaataactttttaaattttgatgaaaaaattacagtttcgtacaccgcaaatcgtgttgtggtgtaagtgagctgtcgcataattgacgcggaaagtccgttgtaaaaactaaaaaaaaaaacatacataaaataaaatttttcaattttttttgaaaattttctcaccccgaaaatccgtcggttttataaattttcgcagacattccgggcaaagacaatttgccctgttgttgtgtctgaagatgcactttgagtaggtcaagagggtgagtaaaacctttaaaatggaaatttttgggattttttaaaatttttaatttttttttttacaagcagccattgagccggcgatgcccccaaaataccagcgcgaaacacgacgttcatccgcttttaaaaaatccattttttttttgctaaacagaaacggaaaatttaaaaattgatatacatacataaggccaaaagagagaaaaaaaggaagaaaataaaatcggtaatttgggaaggaatatattttattcaaatattttaatttatctccagagaagtgattttcattatctctaatttatctcttttatctacataattatcttgcaggttaaaaaaaagtaaaatgagcgatagaaaatggagaaaagggggaccgtgaaagggcaaaacgaatggaatggaatgcttattgattttgaaaagagttgctccatatattttttgttttttgttttcgtcatttaatgtgtacaatagggttgccaagtgcgctaattttttcaaaatttgtccct

SEQ ID NO: 3621 - DNA, 1573 bp, Heterodera glycines
aaaattttttttaatttttaaaaaaaaccccttccacccccggccaacaacatttttggccaaaaatcagggccccctgcggattgctttttcccctaaaaatgagaaaaaaaaatattttaataatttttaaattttgatgaaaaaattacagttttcgtacaccgcaaatcgtgttgtggtgtaagtgagctgtcgcataattgacgcggaaagtccgttgtaaaaactaaaaaaaaaaacagacataaaataaaatttttcaaatttttttttgaaaattttctcaccccgaaaatccgtcggttttataaattttcgcagacattccgggcaaagacaatttgccctgttgttgtgtctgaagatgcactttgagtaggtcaagagggtgagtaaaacctttaaaatggaaatttttgggattttttaaaatttttaatttttttttttacaagcagccattgagccggcgatgcccccaaaataccagcgcgaaacacgacgttcatccgcttttaaaaaatccatttttttttttgctaaacagaaacggaaaatttaaaaattgatatacatacataaggccaaaagagagaaaaaaaggaagaaaataaaatcggtaatttgggaaggaatatattttgttcaaatagtttaatttatctccagagaagtgattttcattatctctaatttatctcttttatctacataattatcttgcaggttaaaaaaaagtaaaatgagcgatagaaaatggagaaaagggggaccgtgaaagggcaaaacgaatggaatggaatgcttattgattttgaaaagagttgctccatatattttttgttttcgtcatttaatgtgtacattagggttgccaagtgcgctaattttttcaaaatttgtccctgaattttaaagaggcaattaaaaaatttaaatatactgaattttcagatcaatataaaatttgagggctgctggacaaattttccgcaaaaaaaatgtttggaagagcaaacaaaaaaagtcatcaaatacatacatagcaaatacttttaaattaattctctttaatctttttttggcaaaaaaatcaatttagaaaaaaaattgaatataagaatcaaataataatttttttaagctgtttattcagaatttttttttttgaaaaaatgaaatatgtatttacgctgtttttttaacaaatacataaaaaataatagcctaaatataaaattcgtgccaaaattagattggaattaaaaaacggagtagggcgacatatgaaaaacgggcgcggacagaagtcccggattattttcgaaaagacttaactccttttaaaacgcccataggcgggatatttgccggttcataagtaatggcttgcttccaaacgtgaaaaaatgacatcacgctcaaggcattttttccaagttttcgtcagcgccttaatttgatcgatcaaaaaaaaattattaaatcaaattatttaacaatacatttgttttatatctatcaaaaagaccgtgttccaatatgtaaagacatgaaatgaaatttgcaa

SEQ ID NO: 3622 - DNA, 2051 bp, Heterodera glycines
aatttatgagtggtgtgagcgatcaatgaaaaggaattttcttcaaatctaatgattgtacgtacgtacatatatggccttgccagaggctcgaccgctcggaatgcctttgatttttttttcgaattttttaatagttctatatagagccaaaattctttaattgtgaatttaataattgcaattaatatatttacggacataatttgccattacttagaattcttatgacaaaatttgggaaaaagccaatttccaagcctgttctgactgctgggaggtttgaaggtttaaatcccggcacgagcttggcccggctaactaatcaatgaaaatgtcacagatggcagcattacttgaaaaataattattttataaaaataattaaaaataattgttggaatgtctgatacaatgtgaaaaaatgaaaatgaaatgggtgaatgtgttgtttaaataaagaaaaatgaattggtcggagacgggacggaggagagagagataagtgttgggagaaaatggatgagatgcgcattcattgtgtggactttggactttcaccggcagcaaaaatggactttacgacaacgcatatggacgagcaatcgtcataatagtccgtccactcactaattacatagctctaattagttatcgcggagttatatttatagtattatcgttttgtgcttcgcatgcacgtgataaccaaaccaacaaaaatctgatgattgggtgatggatgaccttgattcggatgatctttgaaaaacaggcgacacacaaattacctttaatagataatcctaattcttcatacataatgcacattactgatatgaacatgcaaatgagaagataaaaataagaaaaattaaataattaaaattaaagaaattaaaaataaaagagagcactgtgagaatttaatttcggtttattatggttataattaaaataaagcacttaaggaattaaaatatatgtgatttgtacaaacggaattcgttttatttaaattctatttttaaataattgtcatcaatgttttcattattcgagacttattcgggattaatgttttgccagcgagtcctaattttttcaaaataattttagatttatgaaactttttaatcattaaaatatataacttttatttttgaaaatttctgttttaattacattcattagatttaatttatttattttgggttttctccacatgagtcaattttttgcatttttttaaaataaacattaaattttgtataaatttacagttcatcggaacggtacaattatgtgcgccgatgtttgatgtgaattttgtgatggacaattacgggttaagtggtgtgttccttgaaattgtgctgattgaactcgtcaatgcttttctgtttcaacgagcttttgccgacccatgccaattggcaagtttcaacaaacggcacttcaaattaaaatgacgaatttaattttaaaactattaataattaaatttaaaaataataatagttaatttattaattcagttttacaactatatgaaaggaagtcattcaatgatttattcgtcacttttattagctgttcaattcattgcaggcatttttatttcttatgcaaataaatataataaaaatattatttaaatgagtttaatgattcataaatgaattaagcatatgcttcatggttgctttccagacaattttttgcgcttaatcttcattcacaacacattaatgcctttgaagaagaatgtagtgccgatttgacggtcgatatttaaaattaaaaaatttaaatttaataaattatttattttttacaaaaaggtcgccattctttatgggtccattgtggaagcattggggctttttgccggaaaatttgttgatttttgcatagaaaagagagcactatcgccaacccatgcaaatgtgatcaatgcaatttgttctgggatcattacaattttaggttttttaattaaattctaattaacaaaataaaataaataataataaattaaggaattaata

SEQ ID NO: 3623 - DNA, 3028 bp, Heterodera glycines
atagcccctaatgaattttttcgtacatattttgcaatttttgaggatttttcaaggaatttttattgtgtcccaaaaaagttcataacgtagttattattttttttgaaaattacttttaaaacatcgattttaccaaaaaaaaatacaaaaattaatttttaaatactaaaaggtgattctaagcctatttagctcattttttggcattttgtgcctatttcacccgttacaaagaattaaaaaaaaatttaaattttatttatatattggtggttttatactatatttcatctttttagacataatttatttacatatttagcgatttttcttacgtaaaaaaggaagccctaataattattaaatataattcgaattttaataaatgtaaataatttaaacttgctcagattgcgggcgatgtctacccaagcagtattgaagagccccaagtgaaggaaagggttggaatttgctgaaaaaatttaaaaatgaatttacaaattaggcactttttggaattttttaaaatatattttgattcatttcgaattttttaatttctaaaatttcaaaactcttaaatgattttttcttcttcgacttcaaagggttggaatttgctgaaaaattaaaaatgaatcgacaaattagggactttttgaaattttttaaaatatattttaattcatttcgaattttttaatttctaaaatttcaaaactcttaaatgattttttcttcttcgacttcaaagggttggaatttgctgaaaaattaaaaatgaatcgacaaattagggactttttgaaatttttaaaatatattttaattcatttcgaattttctaaaattcttaaaaatcaaacataattgattttatttcttcgacttcaatttgtttttactttaagcctgaagctgtcaaatcaaaacgccaaagttggtccaaaaaatttgaaaatgcactgaacgccggggacaccgttgtaatcagaggcaaaatggggaggccagaaatgggcgacaaacaactgagtctgtccttctatcttatgcacaattcgcccgaatttaatcgttacggtaggcattttctaccgtttcccaattccttattactgtatgccttttttcctttatttttctctctcattgtcagtgtccaaagttgcctggtttttgttccaaaaggatggcaattttacgatgggccattataattttgcggtatgaaatgttttattattttaaatatatttgattgagccgttattacaagagctagtaaaatcaaaattatggacatcgcaaaagaattcaatttgcaattaaattttagtgtcgcgagcaatcgaaattttgaaaaaactttttttattactcaaaatacataaatattaaaaagataaaatctagaaaaagaatcccagaaaaagagttttattactcattggtacaagggatggcattctgaggccccaaaaaattttcggaaacagattttgttaaagaaatgactaatttaacgaatttgagcaatttttaagaaaattatgaatttagggcaaaattattgatttttagggtccggcagagctgataggcgccgccgggaaaaattgaaattcaggcaatttattaacagaatttgttcaaaaattcaagtttttttgaaaaaaactcaaaaaatttccgaaaatatccgactttttatcaaaaatttcgggaatcggaattccgtgcctcaatttaatttcccaatgcataaaatacagttttactgctggcgagatttgttttaatttgatttctttcaaggaaaaattccaattcggatcacagcccaacatgagtttgtttaatccaaacgaaccgttcgaaatgcgaattgaaacggtacaggaggagggtgaaggtaaggcaaagcaaaggattcgaaaaatcggcataaatccacaattattagccaattttagtccaaattataatcatttatatgttgaaattttggataaaactgataaacaacataaaatgatgaagcaaaatcacattttaatgttctggattttgacaccaaaaatatgctttatccgaattatgtttaattgaaataagtaattttctaaattccttttcattttacccgattgaattaagcgatttttcgaatacaatgcaaatttagtttttcttttttttgagcggatttcatctcacattgaatttattgtctttggcagagtttgggcagctcaacatcactattagcactccaaatggaattcgtcaaacaatctatcgcctcgtgtcaatgacctttcgggacattaactttattaatgtcaattattcctactaattatgactaattaattaaattaattatttttcctttttcagattgtcggttctcttgaactatttgaggccccgtttgttgttgccccagaggtagaaaattcatttgattttgagaatttttcaaaatttaatgtttaggatggaataaagcgcaaacagaacggttggcccgtgttccctttgctcgttgccggcgattcgcttacgcttgagggcaaattgcgtgatgacgctaaatttttgaacattgaactgctccacgactcgcccgtgtcaaacccatactgtacaactaattcattcattaattattaattaatggatctttaaatgtgattaatgcatatgaaatggtctttgaatgtttagttgggaatgtggtgttgcaaatcgttttcaatcttgaacaaggccaaatgtttcttaacacattcaccagcaaggtcctttttaggattaaattaatttggtacttatgtactttaatgaccataaaaaaattatttttcaaatctttataaaaaaaagatttctagggatttcaggatcggtgatcacgaatctgacatccatttagaccaaattcgaacccctaacccgtattcaaattatattcacgctataaaatgtttttgaaaccttgaattttcgaatttga

SEQ ID NO: 3624 - DNA, 4693 bp, Heterodera glycines
tgccattttcaccaccgatttggacggcaacgtcgctattcatttttcttatgtaaatttgaagggtgccggatcgttacttcaaaaaacatcaaaataagaatttttgaccaaaaattattcaaaactttgcccaaaatgaatcaaattttaaaaccttatattattcgagaggccataagtgtttcctattgttctgaaaatttcaaaaaagttatgacctgagaaattcaaaaaagcaaaagttttcttgaacatttttgtcataactttctttaaatttaaccaaacttttgaatagaaaacacttagtgctatcgaatggtatcaaatataaaaaatttggttgcttttgtgcaaatttagatgaaaaattattttattttgatggtttttgagtaaccttatagcaccatttgaagaacaattcatttcaaccttataaattagtcaattaacaaatttttaaagaatgaagaagtcgaagagcatcatttgaaatcggcgctgaccgaaggacaaaatttccatctgaaaatcataatgcgaagacggcccatgttccatttggagggcttcggcaaattcatgttcggcatcgaaacaatgcccatgtgggcaatccaatacattcgggtggatgaaaatttgaaattttcgaaaaaaattgaaaataatttaagatcgaaggcgatttgaaactgcacgaacagccacgcattgaattcttcgaaaagaaaggacatcacaaatgaacagagagagaatggaatgattgggcataatgacggcacttttatatatgcgcaccatttttgattaaattttcattcgattttttgaaattttcaaggaaatttttagaaataattggcaaaactgcaagatatttgtataaaacagggctatgatcgtaccaactcactttccaagtgcataacgggggaaatgtgtgaaatccaagtacatataaaattttatcaacatgcaattaaaaaacaagtccagacatttgcgcctatgtccaaaatcgggttaaaacttaccttttttcaatcttatatgtctttaaacagcgttaaatttaagaaaacttatttggtttattagggtcaaaaattattttgcttaaaagatattattattttttcaaaatttgctaatgatcaaattattgcacacaatcactttcaatcgcttatttaaagctgtttacatctgggattgaaaaaatgtaagtttaaacccgcttttggacatggtgcaaatgttgggtaaccttaacaacggtgattttttttttacacaaatggtttatatttttccgcggaaagaattttttgcaaaaattttttttatttccttcagatagagaaggagaagcttccccgagaggaaggaagattaatggatcaattgaggcgacaattgatcggatatgatcgagcaaattgaaaccgaccaaaatttttacctcaaaagtttccccagctcgtccattttttattttcatatgtaaaaataccggtttccaggtacaatttggaaataagtacagttaacatttcccaaccatgtcgaatccgagataattttctctgctaattatttgaaaaaatgtcaaatattgtgtaaaaataagtgtcaaaattattttaggggctaaaatttaaaaatacggatttttaggttcgaacatctaaaataggaattctagggtcgaataggcgcttgaaaaggaagcattttcgcgctacaaatatgtttttcgtgcttttctcattgacttaaagacgcggaaaaataagtaaaagtctaaaaatgaatccgctcccaaacagatgataataatccaattttcattgtctttcagatcaattttgcgccactgctgatgggttggcccataaagataaagtcatccgttccctggtcattactcattacatttctttttttatggaaaaataattctgtgaatgttttttttgtcccactgctgattgatgataatgaataatcaaaattcattttttattgaacataagcattaccattttcataaaataataaatgaattaaattaaataaataataattctgccttaatcccttatataccgtgccgtaatcattcatttccccctttctcggcgggctgtcctcctcgtcttccgccgtgttgttgttctcctcttcctcctccgtttcgccatgtccttcttcatcctgactgtccgtggaggcgctgtgcgcggagggcgcggggcgttcattttcattggtgctcttgcagtggcagccgtcctgcagggggcaaatgctgaccagcaggctgccgacagcatacaaattaatgtaggtatattcaaaaatctaattctgtttttattgtattttttgcttttttcaaccactttttacttttatttttttgcctttcatactaggggtgggacggcggcgttttttccgcggttcgcgaccgcggcaatttgaatccgcgactgtgggattttttttttttgcgcggcgtgccgcggatattctgtgacaaatttttgtttgaagcgattgtcttttttgaatattcaaaataaaatacatttttttttgaaaatttggattatttttcacaaaaaattcgtttcaaaattccaatttttcccctccagagctgacaaaacctttaatttttctttaaattttttgattttttggcacaaaattttattttttttcacttttgtaaaatttttccatctttacttaccagtttaaaagtgcctttttctttaggttataaagcatattaaagagggagcccggaaatgcatagagcatcaccgaacgacaacaaccaccacaacgccgccgcaagccgagggcgagttttggcactttttagcaactataaatatcatcccaaattattacttttgcaatttttatggcattgattacttttgacatttttttgttgtcatcatttttttcaatgaaaaaacctttttctggaaattaaattaaatcaaaagaataatttaattcaatgaattaattaatattttttcaattaatatgcattgatttgcggatataagatgtttcttgttgttattagtgcatttttttctttcacattgttcgtgctatttattatcttggagacataagtgccacaatttcaattaggattgagctcgggctccaggctctccgccctattgtgcctctccccgatccccgaatctggcctctcaaacgtcctgagatttcttccccgaggggtcggggcttaaccccaattttaagcaaattcatcaaatgggccgttttttgcggtcctttggcacataaattggaatcaagagtaaattactcaattacgaaccttgtttaaagattaactcatttttccttgatttattttgttacattgcttacacatgcaaatgattgattattctatggcatttttccactttccttaggtaccacgacccggaaaatgagccgtgcgggacgaaagcgattggatttgatgcggaagcaatcgaacgattggaggcggaacagctgaaggaggcgctaatggccgaagcggaacaatttgggaacaaagacaacaaacaaaacgccaatcagatggaaatttgaatggaaattgaataaaatattttagcaacagaaatatttggtaaaaaggaagaaataggctttggcttctttgaaaaatcagaagaaatggatattaaaattaactttgataacaaacaacccgaattattaatattagcatttataaataacttttatgggttaaataattcctatttatttttatcctaatttcttctttgagcaattagtgaaattaatctcattaaacaataatatttaaaaaggaatagccgatcagaaaccaagtcaaaatggcaaaagtaaggttagaattgaagacaatgtgaccaaaaatgggacagcgaaaccgccgatggccaacggaattgccgcgggaatctgaaatttttggcataaatttaaagaaattcacagcaataaaaagttcacacttttgataaattggcataatgttcgacaatcatttaataatttgggtttttaatatatcttctaatattttgaaaaagtctgcatctgtattttttttactacataggttcaatgtcagcaaaacgaaaatttagaattaaatgtgccacaaatcacaaaatgcttattgctaaaaaactgctcaaattgatcatggacaatcaaaaatataacatttgaacaatttaagagtgttttgaatgaattttgtaaaaatgcggctttttgacctaaaatgaggcttttgaaaattttaatctgggagccctgattaaaatgcttaacgattgaaaaatcccgggtcatatttcagcattttaatttgttatctcgggagtttggacccgagcggagcaaattgggcttatggcatgagtcctgaaattcaattccaagtgccgaaccaccaggaagtaagtaatcactaaattgtcaatttcaaaagaaaagtgaaaatttaaaatggagttggaatgggacggagtcgctatttaaaaaccatcaatatgaaaattttttcatgaacaatatttattattttggtaaaaccaaccaaatttttaattcttgatgttat

SEQ ID NO: 3625 - DNA, 6658 bp, Heterodera glycines
ctatgtattagcatgtaaaatttaaaaaaatttcgttatgttttaaaaaagttacgacgaaaataaatgttgttgatttggtcatattttgcaattacttcattcactatgttatgtgttacagtatcaatttttcttggtacaataacactttttcgtactatagatatgttagcgcatggtaacgcttttcacctaccataaataagtaatggttaagcaagaacggttaattttcttgcacccaaagatggtgatgtttaggctattagcagggattaaaaaaactcagatcggaccccaattttagacttaggcgcaaatgtccgagactcaaagatccggggcgcaaatgtccgggacttaagagattgcaattccaaccctgtaatacagaaaaaaaaactttttttttgcggaaaatctttaaaatttagcaggaatatgtaaatttgaagcttggctgggcaaaaaaaaaaggtgatggacgacccctcttccccccccccctaaacacagcgatgactcatgccatcattatattataatatttttcatcgctcgccgcgcccattcattcatttgcattgctttctttctttctttctctccgccgtgccctgctgctcttctcgtcgcccttttggcgacaactacaaaacttagtacaaacaacacacacacccatttattattattatagtatacaaattgtactaatattattaatggcactcatcagtcagtcatggcacgcaaagtgccgaaagttaatgactcatttttgggattagataatagaaaaaaaaaggattttttaacccaatttttcaaggtgtccttggatttttaaagttttaaattaaatttcaagatgtcgttgaattttttaaagcttaaataaaattttcaagatgtccttggattttttaaattaaagtctgaagatgtccttgggttttttaaattaaatttccatgatgtccttggatttttaaataattgtttgcctttcgattaatgcttttcaatatgtccttggatgttttaatgtttcaaatcaaaatttcagatatcctttttcaagaagtccttagatttttaaaattttaaatgaagttttcaagatgtacttagatttttaaaattttaaatgaagttttcaagatgtacttagatttttaaaattttaaatgaagttttcaagatgtacttagatttttaaaattttaaatgaagttttcaagatgtacttagattttttaattttaaatgaagttttcaagatgtttttgaatgttttaaattaacttttcaagatgcctttgggtttttgaggtttttgaatgatttttttggctctcggttttaccgcatttcttccaactttattttaattgacaccaatatcaatatcaactgctaattactgttccttttttgcttttaattgcgcaatgagtaattttaaatggcataaaatcccttaatgtgaatatttttatggcacgccattttgtgtgccacggcatgacgcattcatttttgtgtgcgtatgttgagggcgtttttggacacggttccgcccctcccacccccgaggccactttaaatatatgctaattactttcgcttgcttacctattaagaattcccattgtagcggagcaacaggtgctcttaaaaaagaaaagatttcttagaattaaaatttgcatgtgaaaatcattttaattttaaattaggcgccctccctcgggcaaatggcgcaaatgaatgaaacaaaatttaaaaatgaaacaatatttaaatggattatttctaattttggcactgaaggccccagattttttgaatatttgtcagataaaattttaaattaaatttttaataacaaagaataaaaagcaattagactaaactatgagtcacaacatttttcccatttatttgctctccccaatataaaattgccatctgtaattttttttttgcattttgccaaacatttaaacatttttacccaccgacggaattgataatggatgaatgactcacacatggctcgtgctatgtgccatcaacagcaaatttgtgtgactcaattattgtgagaaatgtgtactaatgccaatgccctttggctaaggtgccgccgcctcctctcccacgcgtcgcccgccaatttgccaagtgcaaatttttgccaacacaaaattagttgggactgtggcattccaaaaaatccaaaaaaccgcaagaaaaacttattttaatagtagtaaaaccctggcgcttctttggcccaacaaacttttggcaattatttttgggctttcataatttgcccgtgcaaatagggaatcatgtttttttggcacaatcctggcaatttcggcacaacttggcaatttgggcacaacgttcggcacacccattgtgcctagcccataaatttgttgaaaattttgcataatttttttagcatatttcatgataattccaaaaattttccggacggcgcctatcggcaccgcctggaaccccattgttaattgaaattttagcgcccaaaatggcaaaaatttgtcttttttggcgcaaaactgcgacaaattcctgtttttcgcctcgacacccaaaatttttttaaataaaaccgggaaaaaaaatttgactcgaagagcagaaaaaaactcttcgggtgccctcaccgaattttttctttctggatacgggcctgcgttctgtcttaattagtctcgactcaaactatcaaattcacacccctgagatacattaaatatcctcaaaattttttcggtgccatcactttggcccacccccgaaattatgatgcccaccagctgtgccaataatgtaaaacgcatcactttttcgccaatgacataggtctgctggccgggcattcgtcacccttcccccgcccaccgcccaaaatcgatgcatatgccatgccactcagtccctccccctaacaaatccttagtcacatgtgtcttcggtcccatcccccgcccccggggggacgtcgagagtgagtttggttggtgccatgcctttctcagtccaaggagtactactactgctggcctcctgccccgcccattgcgcccccttttcattttgccaaagtatgtgccgtgccattccctcccgcccatccgccgcttccccctatccgcgccatttaatccttttgcttcccctaaacgccgctttaagcatccatcccatcatttttgttttatagccgcttcttctgccgggtagaaagtggcattggcatcttttttttgcaaattataatcccgggaaagcatttgaatccccggcacagcttatgatgggtgagtgctttgcacacaaactacataaatattttagaaaaagcgctttatgtgagggatggaagcataatgccaaaaaaaaatggaattcatcgccctatttggtacggtaaatcttcttacaaaaatggtgccctttcccccagggtacggtaaatctgctcaacaaggatttgatgattaggcctggaaaattcatgtaaatacatattttttcctggattctccatgctctaaatagtaggaaaacatttcaaaaatctaaaatttcgaaaaatttttgtacatatttgaggttttgagaatttatgaaaaattaaaagaattttttttttttagaaaaatggacccattaaaaacaattttttcaaaaaaaggaaataaatttttaaaatacctaaaatattattataagcataaaaaggtcagtttatggcattttatgcatatttgcgcttttctgagaagtttttatcgaaaaaatcattggtacatatttggggctttttgtacaatattttaaatatttcggcatttctttttttacattttttatgaatttccctattgatgacaccttcgacaatgttgttacccgtcattatcatttaaattttccctcattttcgctaatctctgacatctttttcactttttaatttggtttttaaaaatttaaatctttttttgatcatttagaatttatagctaaaaatgttccaaatccaacaagcgctgccgccagtgccggcgaccacaacggtggcgacgaccaccagcgtgccggcgccgtcgcagaagccgccgcatcgcgctcgtcccaccacgctcgcggtgcctttgttgcaccacaacagtcaacagcagcagcaaccccaacgcggcacgcgtcgccgggccatggacatggacgatcagcggcagcaacgcgttgcgtatacgcttggcgcggcgggaggcgatggcgccaacaatggcacgcaatggccgacgtcgcgcaacagcaacaaagccggagaagaagaaaacacgccgtgccgccgggcgcgcctttgttcaccggtcgccaatggcacgacggatttgggtaggctgcttttggattttaccggatttgggtaggatggtttagattttttaaatgtctatcggttttgaaaccaaggggatacttactgtaataatgcatactgtatgtggctcgctgacttggcgtggaaagctaaatgttggagaaaaataatcgaaaattatttggcagttaggggatgtggatctcctgaacccgtatgctttgtcaggaagccatgctttggagagggggagtcattaaaattttaaatttaaaaaaaaattttgggagtgaggggagtggactcgaacccgtgtgctttaatggaaaccgccaaaaatgcctaaaatatcgcttgagaggggagaggggcaagccgagggggtgattcaagtcgctaaaagttaaatttcgaaaatttttggatgagttaggtgaggggtcctcctgaacccgtgtgctttgccgaaaagctccccgccccccgcccaaaaaaatgcctaaaatatcgcttgggggcgacaaaaaatgtgactattgaataatgataaatttgtttggtggatggtgtggatgaatcatcatcatcatccatccatccgtccgtccgtcggtggtcgtcgtcgtcgtcatttcccaattcctcccccgcctcaaaaaccgcgtccgtcgccccattttcccatttttcatcgccggcgggcggacggacggcggcggcggcgtcgattttattttttatttttgaacaaaaacattcccaccaccaccacacataataatagcccatccacaagctgtatttatgtaccattcatatgtatgtatgtgtagcaaacagataataagccccaaaaatcaaatttattcattccaaaaatgtgtaagtcttcatgaaaaagtgtaaaaattgatcactgatcgatcattgatgaacatttcaaattcgatcatcatcattcattcattcatgaatcatccttaatttcaattttgtgtaaccacacaactcgatcaaccctaaataactaaaccttgatcactctcctttttccttatgatcaaaagaaatgctgcttatgatcgatcacttaattttatggggcttactgaaaactgttaattaatccgcaggaagccgtgaccgccgctctccattccgtgaccggaaaatcggtcagtggaaaatgcgccagtgatgcaaatattttaaaataaaattctattgcattagtattgtaatatagaagtaaacttctataagaaaatcattctcaattgcgaaccccggacccaaactcgaacaaaaaatcgaaagtcaaaattttcgaaattagtgtttttcttcaaatcggtttaaatacacagaaacaaactgaaatacatcaatcctgcattaggagatcatttatgccgttttgaaccaaaatgctaaattcgaaaatttggactttcgagtttttgttcgaattcgggtctggggttcggatttggccgaaatggataccagattcgtggtaagtgcccccgaaaacgcaaggaacttgtatttatgacaataaaaatttcactgacgctttttccactgacgcattttccgggcgccgcttctgatcaattagcaaaaaattttccctaaaaagtccagcctaaacttattggcccatttaaaaagcaattaaaaatttttagaatttttattcatctccctttttgatagtaaaagcatcagagtgccttatttaacatgtaaataaaatttggtgcgttttagagcactttctgaaaaaatatttatgaattaattttgcaaaaaaataaattaaatagtgaaactttaaaaattcataaaaaattttaaattcagaattgagtgaaaaagttcatttaacttctttatttatcagttattttaagatataaggtagggttgctccccgaccctcgggggcaaaatgtcgggggtcgggtcgaggaataagcccaaaaatgtcggggagcaaccctaaatataagcattagagtaacaacagtggcatgaaataaattaggtgcgttagaaattaatttagcaaaaaataaataaaacatttcaattttaaactttttaaaattttgtttaaacccattcagtttttatatttctcagccttgaagaaaatgcttttaatttttcactttttccattaagaaaaagcttagcctaaatttgtct

SEQ ID NO: 3626 - DNA, 3412 bp, Heterodera glycines
ccccccccctgaaataaaccccccccctttttttgaggggattaaaaaacacattatagaatgcccgggggcatttgtctcaagtaatattgtattttcctcggagaataattacccaaaggtggcggatttacggatcaaacaaaaaaaatggctccattaaatcggaccatattttattttatttatttgtttttatttgttcctctcaatgccttttctccaccaattattaattgccttgtttatcattcattcaaagtcacattattcgcttcgctgctgctgctgctgctcattcaccgtccaaataataaatgttcgctgttttcgtgctgattcgactgcccctcacttaataacccatgtgatggattaattgagtgatcaatagcgcgacaaataattatgtacaaataataggatccataaaaattaatccgatcattcattccattattgattgatcagaaagatcacatgtaattaatccgattaattccattatcgattgatcagaaagatcactgtaattaatccgattaattccattatcgattgatcagaaagatcacatgtaattaatccgattaattccattatcgattgatcagaaagatcacatgtttccatggttagagtcccaccgggcggaaggcgagccgaacaattttccgattcttttttttaaaatttacttgcgactaattttaaatgccgagctttgacaccagattttgtgaaacttggccgattcaattaatgccttaatttaaaaatttttcattttctgaaatcttttttttcaaatttaaatttcgcgcacatagccaaatatatcccggcttaatccccccccctcgtgtttaattcgactccaattcttggaaacttaattctcaattatccctatccatcactatggctataattaatcccatatcatgctcacatcaccatccataattaattttcgcgcctttctccaattcattttttggcacaatttaaagcggcatagaacctaaaatgtcaattaaaagacggtagattaaacaatttctcccatccattagtccaattttggcattttccccatgcgtgccatatttatcgccacaaatcccttcccctcatttattcttcattacacacaactttccctaagtgccagattaggtaatgggggaggggagagtggtgggtttccatttttggtgtgccaatctggccgtattataataatccctcgtgtccaaagtgccgagaaaatatactttgtcatccccccaaacaagcaattagtcataagccatgccccattagtcatcataatgagtggtgtttgttgtcgtgcaaagcctctgaatacaattaaattttgttggcattttctacggtggttggttgtcatggcacggctctccctactcgtgccagaaaatttggttgtttacaaaagcgtaaaggttcacggtttctgacatttgttaggtcgaaattcttccgacgaaattcttttttatgcatcgaaatgccgaagttttcaaatttggcacggcacgaaatttgcatttttatcatcggaatttagttttttaccgtaactccaaaatttttgaatttttaacatttgttgggtcgaagttcttccggcaaaattctttttgatgcaccgaaattccaattttttaaatcggcatcgaaatgccgatttcacaaaatctccgaatgtttttttgggcatcggaatttccctttcgaaccgtaaccataattttagaatttttgactttcgttgggtcgaaattctgtccggcattctgtttctgttgccagaaattttctgaggaccctggggggggggggggggcatttttccgatttttgatttccaaaatgtttttgacgtttttcgtttttcttgcttctttctgctgctgctggttctcgagtttcgccactccgccgatgactgactgactgactgagaatgactcattctttcggcataaaaataataaatgacattttatcagtccgtctttcgtcatcggctcggctcggcacggagggacggaccaaagccattaggccataaaatgaataaataaatgaatgacgaatgaatgaatgaatttttaaattgaaatggccaaacggaaaatggaggggacgcaaagccacctgctgcttctgcttctgctggggctcggtttcttgtaaataattaattgatggcgccacttatgttgtgttttgaaacatttgaggaaagaaaagcatgggaaaaatccaattagcaaagaataaagggtacttatatgtgttatctgtgtacagattttcaaaaatattttatgtttttggctataacttttttctttggcatccaaatccaacattttgttggtatcattcgaaagctcttcagatgctctattagcctttcaaaaaacctaaaaattttctagcctggaaaaaattttactaagaaaaaacttctaatttcgactttttcgcaattttcatgtataacttttttggtaattgtctaatcgcgaagcgatagcttcggaacatgttaagctttcgaatgataccaacaatgttggatttggatgccaaaaaaaaagttatagccaaaacataaacgtttttgaaatctgtacacagataacatataagtaccctaaattgtcctttcgacccctatagacaagaaatttagccatttttgaatagctcagaaaaaaaattttttgaactttttgggcatatatttttgaccgcccagattttgagcacacattttcaaataatcgtataggcggttgaaggcaaataaatttaaattattttggaagctcggggaaaggattaaatgtgtgaagaaaattttcgcttttgtaatttttattatttctacgacattttactcaaactaaattcaaataagacagttgtccttcggcggcccattgtcagcaaaaaagaagaaggaaaggaaaaatgaggacgaaaatgcacgtggtgagaagaagtgttaccgaaatgggacagaaaatgccttaattaaactaaaatgttaattaggtaattaaggttgtccttggaccgaagaaagtggggaaggtaaacctttgagataaaattacaaattgttctctcgaatagcgtttatttttcactatttcattgacatttaaaaaagattttttcttcagacttcacttttgaaaagtctgatcaatcagcacgacccaaagccaagcacttcctcgtccgatggccaagtgacttaacttttccttctctaatccgtccctttgtcgcgttaagtgaatttttcaaaaattcaatctcaatgccaacccccattcccaaagcctccaaattggagggagggggt

SEQ ID NO: 3627 - DNA, 947 bp, Heterodera glycines
ttttccttagatagagaggcaaatcctagtcgaaaaacggctaggaatcgaacaaatggatttttctgttgacaatcattatttttgtaatttggcggcaattttaccccggcgaaattttgtcccggcgaaattttggggtgcacccccagtggtgccaatagtcgtcgttgaaaatttaattaagattttacgcgatgggaggggatggatgaattcatttttttgtaggaagatgttgtgcagaagaaaggtggtgacgaaatgggatgggagaagatgttttccttagatagagaggcaaatcctagtcgaaaaacggctaggaagcgaacaaatggatttttctgttgacaatcattatttttgtaatttggctgcaattttaccccggcgaaatttttttgtttgtgattttgtgttagttagttgttagttttatgcaatcggcagtttccctattgattttgttttcgccttattaatttgaaattaaaattgtcttcggcattgggctgtgttgctttgggctgttgtctttgctgtgtgcaacaacaacattattaaaagctcctgacaacaatcctatttgttttttacgactctgtgctcataatttttattcctccattttttttgagaaaatgtgacggaatggacactaataagaaaaggaatgaaagtgatggaccaggaaaaaataggcaaaatgagcgaaaactgttcatcaagcagtagcagcaccaacagcaacttaattgatcatattaacagcaacttgaatgatcaatcgtcaaaattcttaatttttcccccggcggcgcctgtcggcaccgccggaccataaaaatttgctcaaaatcacaaaatttggtcatttttgtggacaaatctgttaacaaatcgcattaaaaattacaaaatttttccggtgctgggacgttagt

SEQ ID NO: 3628 - DNA, 7042 bp, Heterodera glycines
  misc_feature (352)..(352): n is a, c, g, or t
cgaatgatgaaaaattagaaaagattaaacagtattttgaaataaaagaaagaaacccaaaaatgggtgacgaaataattgccaagaaattggggattggatgggcaactctgaatagatggaaaaaggaacgttctcacccacttgattagtgattttcgatgaaaatgacattttccccttttcccatgcaacaatgtttctttttttaaatttgttgcggattttttggacgtattagtgtagcaaaaccatcaaattttaagttttattatatgccaaaataaaattaattttttatgaataaatttttttctaaagttcttacaaaatcaaaatttttcgattttanatggtgaaattatccactttttcatatttttcgtataaaaaattacagtttcacaagtggccaatcaaccttaagagctatcaaatgaacaaaaattttttagtttggttgataatgacataatttataacaaacggcgccgaactatgcgatttccgcaacaacagctgaacaaaagttttaaattatgattattatttttgtttagaagtaaaacaaacccactttaattaattaacttttttcattggccacattaaatattttttaagtcttaatttaattgtaattaagagaaaaacaaaatcaccagggagggaagaattatataagtattttacattcaaaatcttaaaggttttattaacattgggataaaaaaatttataacactgattcttagcaaagaatacaatatgaaaattatttaaatatattaaacttttataagaaaaaataaataaataaattatttacaatttttcaataaactaaaaaacttatttctaaactttagtttttttcttagcggcaactaaaatagcaattaataattcaaacaatttttaaacgatcgatcatttcagcagaagagaattccattttgttgcttaaatcaaaaatttaaatttattttacttttgttattatttacatttttcatcgcaaatttgctgatccaattattaagtgttcggtgactaatattaaattgctcagcaaaggaatttttagaaagatgaggattcagctttatcattttgaaatattttttgacaatttttattttctctgaatcgtcatgacaatgattgctatctgaaaaaataatttttcaaaataactgaaaaaaccaattttttaataatttatttttaccaattaatctgagtaagaaatgtgattatattgaatttctttaaaaaagtctcaatttatatattttatttcttaaaaatcacttttacaaaaatttcaaattgaaaaaataataaaaactaatgcagcaagaaataaaaatattacttttaataaaaagagaaacaaaattttcaacgaaataaaattgtattgggtaaatatgtcatcaaaaaaataattattttaaatggcagaataaaaattgacctacaaaattttaaattttcacttgaaaaattaacttttcgaaaattaaaaaaccaaaaaataaaaaaatagtcagaaattttatgaaaattcttattgaatttacttgtcatgccaaagtcctttttccattggcatatcactgaacggctgacccccaattccttagcaatttgttggtccatttcataagccgtttttgcgatggatttgcctttcatttggcttttcatttggtcaaattgctgtacaatttcgaatttttgttctttagaatatcttttgattttagtttcttaaaacaatgatattaataaagcgtaaatatgtcttaatctatttaaatttattctattacaatttacttgcattaattccaaactttttcttccaatcataaactgttcgctcatgaatgccaaaagtgttggcaatttttttctctaacattttcgttggcattttttcattttccaaatgttcttttaagttgaaaaattgtttcgtaattctcttcttttcgtggtcagacaattttttagctgaaatttaagcatttaaaatttaaaaaaaacataaattttagtgatgatttcccaaaataaaaaaaaatacaattttcaattgattttaaatttttttttatgttaatataaaaattttgaaaaattaaatttaaatagattccttttacagagaaggaggagaaggattcaaagttaagtatatttaaattatgtacttttggttgcttttgcctgagccaaacgcactttctcttccgtggagctcattcctcggaacaatttggctaaaaggtttttttagacgaaagaaccccgaaaataaggatattttccaaaagtagattattttaagaataatcgctaaatattgagcaaatttttcataaaaaaaggaaattacctcaatttcatataatactcaactgattttacttaaaaattaatgtatttcttccatcctctcactcaaattcaagctccattcttaccattttttgggccatcttttttggtgaaaatccctcttaatctcttttttgttaaatgcactctgttttcttgttcactatctgtcaacgaggaatctgttaaagaaaaatttcataatcataatttctcaatatgaaaaatcgacttaccctcattaggaacattattgatatcagcatcatcttcgctgttatcataaccagaccgaacaaaaaggaacttcaagttcggctcctcctggcggcggttgatattacaacccaatttattagtccgccacggcaatattgtgttgtcgaaaaacactcagatttagagttgaataaaaggggaggaagtaggtgcgaaacatgagaaacatgtatggcactgaaaagccgagccaaaaggccaagtggactacaccccagaccgaacacccacatataagcgctgtcttccctccctccctcgttcattctgtcatttattcctcccattgcaattcccttcgccttgaccattttattattatatttgtgcttcaaataaatatttgttttattcatatctgttgttctcggacacaacagattttggcgcagtcagcagagcaaaggcgaactgaagtgaagctgagcaaaagcatcaacaaatttgatttgctaattccgagacggaatagcaatttccaaaatcgtcgaaaaggagagaaagctaattccgagttggaatagttgttcacccaggtggtggcactctcaattactggtgttaatccgggaaggataacaattgcaatcacttatcgaggccaaacagagcaagaggaaaatttgttggaaagcaaggctgaaagctgagtggcattgttaatccgattggataacattgcctcatcgattttgattgttaatccgggacggataacaatttactctcactgttaattcgagttgaatagcagttgagcagcaccaattttcattgttaatccggtacggataacaattgaatcactgtaaatccaagtcggattacagttgatcagcatcttgaatttgatccgagtgggacaaattaagaaaagtccaactatggcagcggtaataaaggctggaaaaggccccggaccgtttttgccagagatgtgctgggcgacatggtgggaacgtttcgaattcttcatccagcttaaaggcgtgaccgatgtcgcaacaaagcgtctgctcctgttcatcgaaatgggacaggtgtacgaagagcttcggcgaatggcacagcctgaggatgtccgaaccatggaccttgccgaaattgaacaactgatggtggaacgatttggcgaagcaaaatcgattgccgcgtcaggcatgaattgttttcagccaagcagcagacagggcaatcgataagggactattcggtgctattgcgaagtttgatagcaaaggcagaatggagccgcgacagcattgacatgtgtctatgcgcattgtttatcaatggcatctctaatgatgcaattcgggttgaattgatcaaaaagggcgaaggacctaaaattcaaggacgcagtcgaatcagccgttttgttggagcagtcaatttggatgcccaagcaattggctcaaattcaatgccggaggtcgcaaaagttggcactcagcaaagaggaccaagaacgccgacgaaaagcacgagaggttgttttcggtgcggaaaaccggggcattttgcaaatgtgtgcccgaatcagaattcgacatgcagaaaatgcgggaaaattgggcattgggctgttggttgcaaaatcaaaaacagagacggaaatgcgaattttggtcaacaatttgatcaaaagccaaagaccaacggacgaccaatcaagaagattgaatgttcaaatgtcagcgtcattcacgaaatcaagggaatttctgccgatcctggtttcattcaactcaacattcacaatggaaagttggagtttgagttggacagcggtgcggacgtcacagtgattgacgagatcgactggaaacacattggaagtcaaaattggaaccatcccaaggattggttgcctatggcgggaaatccattgcgggcattttaggaaaggcaaaagtgaaactgacgcacgaaggaagaacgattgagtccaatattcatgtcataagtggtaagcacaaaaatttgtgcggccgcgatttgatcatgggactgaaaatcgatctgaaccgagctttcggaattccgacaattcgtgccgttgaaaacaaaaaggaattggaagcatgtttggcccatgaagttgaaaaagttttggaccaatggcaggcggagaaaatcatcgagccagtggcaaccagtgaatgggccactccgctggtcattatgccaaaggcaaatggcaagctgcggttgtgctttgactataaagtcacggtaaatccttggttggatgtacaccaataccctctcccacgccccgaggagctattcagtatcttgaatggtggcgaaaaatttacgaaaatcgatttgaaagatgcatatctgcaacttatgcttgacgaaaaagccaaaaattgtcttacaatttgcacgcacaaaggaacttcgctcgattgccattcggagttgcttcggcacccgcaatttttcagcaagtaatggaagaagttctgcagggcattgatggcgtggcagtttatctggatgatattctgatcacagcagccactgatcagcaacacgtcaaaagaatcgaccaggttcttaaacggctgtctgagaaaggacttcgagtcaagcgtgaaaaatgtgaatttctcaaatcagagatcgaatatttgggacacattgtggacaaaaatggtttacatgcgtcacctggcaaaattgaggcaattttgaaaatgccggagccgaaaaatctaaagaattgcagtcatttctgggaatggtgaactactatggaaaatttgtgccatccctggcaacgctttcagaaccgctcaatgaattgaggcgaaatgatgccaaatggacatggacaaaaagccaacaaaaggcattcgataggatcaaaaatttttcacaaagatgaaaaaagaaaagttggtgtgattgcgtatgcctcccgaacgctaaattcttcggagcgcaattactcgcagattgaaaaagaagcgagggcaatcattttcggagtcgacaaattcaagcagtacttgtacggtcgaaagttcgtacttcaaaccgaccacgagccactaaaagagatttttgggccaaaaggagagctcccgattgtggcggcaaaacgacttcatcgatggtcactgacattgatgaacttcgactttgaagttgtgtactgctctacaaagaatttggcaatgcagacggtctgtcgcgattgccgtgtccggaagagacaaccatcgactgtgttggactcgaagttcagcaagttcaggccgaaaatatttcatgcttgccggtcacagtcagtgccatcgcaaagaagtcaaaaaggatgaaattcttcgaaaagtgaaagaattcatcgaaaaaggatggccacaaaaagtggaagaaggactaaaaagttttcggtgctaggtcgatccacaaaaaagctcagtgtgggcgttccacaaaaagctcagtgtgggcgttccacaaaaaaagctcagtgtgggcgttccacaaaaagctcagtgtgggcgttccacaaaaaatgctcagtgtgggcgttccacaaaaagctcagtgattgataaaataaaataataaatttaaaataataaatttaattattgtattggtaacatccacgttgaaatcaataaccatcaatacatataattttgggctaccactgaaaatgtaaaattaatacaataaatttttatatgtttaataaaattataatttagaaaatgaataagacttttatttttatttttttgttatttcgatttgagtattcgacctctaccaattccggttttgaagaatttataaaaaatcacaaagctatagaacttgtcaaaagctatcaaaataaagaaattaaaacattaaaaaaactccatgaacaaatgcaactaaaaggtattgacttaagtttttgtaccttaagacgctacgtgtcaagactaactattgtttctgcgcatacaaataaaaatgatgcttcaaactcgaatgcttcaagccatgaaatgccaaaacatgaacttagatttgaaaagtgcttttcaaaaactttaagaaaaaatgtttttataattggaaatgaatctgcttggagaaaatatttattcaaaattgatttccaaaatggcgaaacattataccttattgataaagtgataattttctttgactcctttttaatatttaacaaattataaattcccgaaatagaaaattaactgataacaaaaaactttatctcaattttattgtcttgctgaaggactaacaagaactaaaaataaacccattgaaattttttaatttatcttttttcacagcaaaaatataaaaa

SEQ ID NO: 3629 - DNA, 4505 bp, Heterodera glycines
atgataccctttctctgctgctgatgtccatttatttctctttatgtccatttttggccctttttcttcaccaatgcgacgaatcagcgcctttctgacaattgtctcgatcaatctttctttataactccccttctactaggtttgcctggagccgtacctgcgaatgtttttcacaattcgaccaagtacctgaatttgccaggacaacaatcgaaaatgcacaatgagaaaacaagaggtgttacctgggatcagaaattttacacaaatatgaaaaaagagaagatgtagtgcttgcttatgcctccagaacgctaaaatcttcagagtgcaataactcgcagattgaaacacaagagaaggcaatgattttcggagtcgacaaattcaagcagtacttgtactgtcgaaagctcgtacatcataccgaccacgagccactaaaaaagatttttgggccaaaaggagagctcccgattgtggcggcaaaacgacttcatcgatggtcactgacattgatgaacttcgactttgaagttgtgtactgctctacaaagaatttggcaatgcagacggtctgtcgcgattgccgtgtccggaagagacaaccatcgactgtgttggactggaagttcagcaagttcaggccgaaaatatttcatgcttgccggtcacagtcagtcccatcgcaaaagaagtcaaaaaggatgaaattcttcgaaaagtgaaagaattcatcgaaaaaggatggccacaaaaagtcgaagaaggactaaagagttttcatgtcatccgaaatgagttcgccttaatggaagggtgcatcatgtttggaaatcggacaattattccgtcaaaatttcgcacaaaaatgttggaaattttgcacgcgacccacccggggatggtccgaatgaaggccctggcacgtcagaagatgtggtggccaggaatcgacaatgaaatcgaaataatccgaaaaagatgcaaaatttgccaagaagaggcgccggatgagcggaaagtgccattgcatccgtgggaatcaccagaaagactgtggcaacgaatacacatcgatttctgcggaccattttggggatcaatgtgctgatcagcatgtatgccaaaagtaaatggcctgaagtggtcagaatgcgaacaacaacggcattggccacgaatgaggcgctaaggattgtcttcacagcgcatggacttcccgagcaaattgtatccgataacggaccgcaatttagttcaaaagcattcggtgattattgccaatcacggggaattgttcacacattgatcgcgccatataatccaaaatcgaatggagccgctgagagatttgttcaaactttcaagcagggaatgaacaagctccaaaaggaggggatgaagcaagaaattgcattgtctcaatttctcctgaaataccgtgtcacaccgcacgcagcaacggaattggcgccttcggaaatcctcttcggccgcaggcttcgaactttgttggattttgtaaaaccaaccgcggtgaatgattttgaagaggccaaagtgccaaaagagtcatatgcggaacgaatgaaaaggaatttcgatcgcggggccaattcaagaaaaaatttcgaggtaaaccaacgagtttacgcgagaaattatccggacggatcaaaatggatcccaggacaaatcacccgaaaaattggaacggctatgttcctcgttcggacggcgagaggaatgtggaaaagacatttcgatcagttaaaagagaatttgactgatcagaattcggacaattcgagttcagaaagtgaggacaattcggactcagaggatgaagtgccgatcgatctgatggacgacgaacatctgccagcaccgccggaggaacagcatcaactggagcagccagaacagcaggctaatgctgaacctcgtcgttcaacgcggaagcgcaagaagccgaagatcttcgatccctcggactgatcacggcttcaagaaggagggacgaatgtggtgtagtgaccaatcaataagtggagtgaactttgttcactcctttcccttaggaacatttcatccccacatataagcgctgtcttccctccctccctcgttcattctggcatttattcctcccattgcaattcccttcgccttgaccattttattattatatttgtgcttcaaataaatatttgttttattcatatctgttgttctcggacacaacagattttggcgcagtcagcagagcaaaggcgaactgaagtgaagctgagcaaaagcatcaacaaatttgatttgctaattccgagacggaatagcaatttccaaaatcgtcgaaaaggagagaaagctaattccgagttggaatagttgttcacccaggtggtggcactctcaattactggtgttaatccgggaaggataacaattgcaatcacttatcgaggccaaacagagcaagaggaaaatttgttgaaaagcaaggctgaaagctgagtggcattgttaatccgattggataacatgcctcatcgattttgatgttaatccgggacggataacaatttactctcactgttaattcgagttgaatagcaatttgtgcttcaaataaatatttgttttattcatatctattgttctcggacacaacacatttcatttaaaaatcagttaaatattgatatatttatccaagcatatgaattaatatgatcaatagaataaaaatatttcattcaataagtaaccgcccaagaaatcactcacaatccaaaaataatagagaaggcttatatatattggaatttgcttctaggctttattcatttagacatacatacatttagcagtttgccaataatttttgaattctaaataaatctaataaaaaatagaaattcatttacattttttagcaattttaaaaatttcattaatggagaaattggcaccgcaaaattattgtctagccgattcaacagcatcatctttggcaaaagctgcccaaatggaattggacttcatccaaagcgttttgttgggcccacagcgaggaaatttgacggcaattgaatgtttattggcacaaaactttagcaaacattcatcaatgatgcctaattatgggacggaaagtaaaaatgcaaaagtaccaaaattagaaatggaaaaggctggtggtggtgatgaagccaaattggacaatggaagcgagaccgatcaaagtgatcagaagcaaaagagaaaaggggtgggacgaccgaaaaggcatccgagtgaatgcaaagtgtgcgggaggaagagcctttactgttattacagtgtccgatgttgtgaaagtgagtgatggaaaaagaaataaataacgaaatcccgataatcatgtgggatccccaaaaaaagccacgtgatagccgggatcgggaaatgcctggactccgtctcgggatccctcccgatggttttccaaaatctttgggattgatcggaatttggtcgggaacccgactcgggatccctccgacaccagtggccggtctctagtgtgaacaggagttcggcggaagtacagcactttttgccaaaagaaaactgaaaatgtaaacatttttcaatggaccgaaaatggccatccctaatttgaaatgaaaattgttcagcagattctcttttaaattcattaatatataatatttacaaatttgtataaattaaggctgcaagcaattctttcgtcgtattgttgccaagcgaacattgttaaactgttttggagcgaaaaattgtcaaattggaaaaggttgataaagagataaaaaaactaattagcccaaaatattggaatatttatttaaaaagtattaatattttttcagatggcattcgatgccgcggctgtcgcctggacaaatgccttttggccggcatggacccgacaatgatcaatgcaatgcaacaggaaggaatggcccaatatttggacagattggaattgcgaaaaaggagtgctttgttgagaaagaattgcagagaagggaataatttgtttttgtgaccaaaattatgctaaaaattttttattttattgtattgagaatagaatatttttgtgattaggtctccaattatatgtaggaatccatatatgtttttatcctagactgtgaaagacaaaaaaaaacaacatatttttagcttggttgggagcttttaggatgaatatctatatccatatttttcatatttcgcattatgtccataatttatattttcatatattatgcccaaaagttggtgagatcgtgtcataaataagtcaaagagttgaaaaattcgctttttagcttctttttttttaataaaaatctttaaatttaacctttattattatttttcttaaaaatgaataccatatttagccatttttgaaagaaagactttatatttagcgattctaaagatattttcaaaattta

SEQ ID NO: 3630 - DNA, 3735 bp, Heterodera glycines
  misc_feature (2165)..(2166): n is a, c, g, or t
  misc_feature (2256)..(2256): n is a, c, g, or t
ttattgtttattatatgattttaattaaaaatattaacaaatttatttgtaaatgattctgtttttctatttttatgtgtaataccaaaataatataccaattttatttaatttattttttttgataattttgattttgctattatcattattttattataattttttagtaaattttcaagaatttttaatggttttgaatgtattctttttttaataacttcttttcgaaattatttatttaatttattggtttttttataatttttattttgataattcattttttgtctttttactttttccattctttgcattttgtgcatcaaatcgaaacattgcgtcgaacacttcggacgatgagctcagaatcaatttgtgtgccgaaatgagcttaaaaattaaaaagtgacaaaaaataaatatattttatttaataatatttgtaaatattgttttgtcatttcgtaatttatttcaattttatataactatacataaattacgcaaaaagaaacagttaaagtgaaatttttttaataatttttattttaattattttattttttgtcatttcgaaatactcaaattttttcaaaattaaaaacatttaaatttaaaatgttttctttttgcctctttttcttcttcttcttgcccaaccaaaaagtgcacatccgcctcattttcaccagcaaaactttgcaattgttcgaccatttttgccaaaatattttaatgtccaattaattgtcaactttttttaaattgaataataaatttaattattaataaataaaatacaattaaaggaattcagccaattcaaatccaataaaattattcattcattagtttagttgcactaatgaggaccaattaatatgaatgacctcataaatggatgaccccaacagaacgggcaaaaaatatgcaaataaaataatgacacggcgcaagaatcaataagcaaaaaaaaagtgtggttttttttagaaaaactaaaaaagagatttagtaaagcttttttttctggaaaatttattattttatatatttttattcatggctcccgtatttgaaatgcttaagcatttcattttggtgttttttggctgatcgaatgaatgcttaaattttcaaatgtttttattttgactggcattgggactgttagttcctgagccggtacacctcattgatttatgcccaaaaaggttggaaaatctggtttttttttcattcttctgcccataactttttgaaccttaacgaaatttttcaaaattttggaggctaatagaggacacttagagctatcgaatgacaccaagattattgaattttttttattttggcatccgataactgattttggaaacgaatgggggcaattttgtgaatttatcattcatccaaattgccaaatgtgtaatatacaatattattgccattccattttattcgttaactctcaatcacccattggtcgctttgagcgtgtgcaaaaacaatatttttttcatgtcattttcaattttattattttatttatttattctattttagatattattccaaaaatacctttggcatctttatgcatatagccgatttggatttattaaaaatttaaaaaatttctgggcttcggaattcaaaaagaaaaagaaaaaacaaaagtaaggggtcgtcaaccgataaaattgaaattttccacttcctttgaattttcaaaaattcaccactctgtttcccattcgtattcaactttttcaaaaattgctttcccccacttttgccgatgaatgaaccccccgggggcctccaattttgccgacacggcgtaagagacaaaaagcggcaccaataaaaggagttacttctagggagaattggtgggtaatagggggtaataaatgcacccaataatcatcttaatcgccatcctcatcatcatcatcatcatcattatcccaccatccaccccactcgcccaattacgttaattaacgtaacgatatggtgggaagaaagacggcgttttcgtccgtccccagcatccatcttctgcggaattgcacaacactgctgctgacagggaagaggaattgagtgggaaagggggggggggcacacaaagtaataaagttttgggcatggcnnccttcacaattccccggagacgcacccatatacggtagacgaacagacacaggcatactgtaattaattgtgcggcagagatactgtatncaatgtcgaagtgtttgttttttaaaatcaaattacaattcttatcattaactattcgaatttcgttataaatttttactatgtatctgatgatcatatcaaattcgtaatgtgcatcaatttttttaagatgccattcctctaacattggtcactgatcaaatttccatgtaaatctttcgccattttggaattttcactgatcacttttcacttctctatttgtctcccttacatttttcaaatttgtatttacatgaaaaaatgttcgttaattttttgttttacttttttggcatttctcacttttgctttttaaatgcctgcttctacaaatgataatttggcatttatgctttactgatcacttatttatcaatttttttttggcatttcattgctgtttaatctttcaagtgccattcctttagactaattaattaattagtgcttttcgccatttagcttttgttttttcttggccacaaactgtgtgtgcgccatttgccttacacattctctcctctcctcctcacactttgtccccatctttgcggtgtgctggaaaatttggatggattgattgactgctgtgctgccggggacggtccccaaaagtcaattgactcccttccccccccattagagattgatgaccttttaatggggcttttgcgttccctgcggcggtggcggcagcggcggccaagctttttgttgtgtcgattcgatttgtcggcaacgaaacaaaaggcgcatcgcccgaggggccaaaacggggggaggggggccaaaaccgaaaagaaaacatttgcttttacacaaaatggtcccgggggcaagcaagcattcattggcaggcagcgggagccatttggccatttgtcggcacttggccacatcccctcgggggcgcccagttgagcaataagcaccaccgatcatcaaaccaatttgagtggataattgggcaattagtggaacaaaatgaatgggacggacggggcggaggatggtggtgatctggccaattgttgatcaccactaacaatgcgtttaacatcattgtgatcaatcataatcatgggaggacacattattgccaagactcaaacatttgccgaattttgggcggttgttgatttaatccaaaaagctatagaaaattaaaattgcaagtgatcaatcaaatttgttaattatggaaacgccatttaattgatcaaaagcggtgaatcctagaatttgtaaggacgattgatcaaatgaaccaactggtgtaattttgtctctgatcagtagatggccaatccaaagattttgtttggcactttggcaaaagattggcatggatcatacatgtattttctggtctaaatacgataaattcggatacagatttttttccgattgtcctcgaaatcctacggtaccagacgatttaaaatatttttataattttttatgccaccccaagaa

SEQ ID NO: 3631 - DNA, 2053 bp, Heterodera glycines
tgacccacaaggtcatggattcggtcagggtcacctcgcttcttgatcacatataaatttaatcggttttgagtttcgggatcatattcaagagcaattagctcactgagcaatgattaaaacttgtccagtctcgagtatcggaataagaaaacccgtatttgttcagcattgtcatgcctatcaaaattatcaaaactataattgctatcaaatcattaaaagcaaaacggcatttcatttccgttcccgtactcatccgtccgtgccattcaccacgtggtcgtcattgtttggcattttgtcactaccgtaccatttgccattgtcgctgggtctcccatcgtcgtagcgacgccacccgcttcagtcgctcgggcaacactcgcagcgagcacgagtgccgcgtttgcctgcgcaaagaacactttttcgtgcgtcgcttcttcttggcgctttgctttggcacggcggttctgcaaaaaaggcgacaaatattaattgtttttaattgtcctcaggcgaacacatagtgccaatttaaatttaaaaaagatttatttaaaaagattttaatgaaattaaattaaatataaaaaacggtcgagagggatcacgaggtcgagatcccgtccaaatcccgtcggtctctaattaatatgacattaaaattagtgtgattttttaaagtcaaataccattactttcgattcatcatcatcatcataataaatcataaatcacaagactctacttttttcctgaccttaacaccaaaacagataattaaaaagccctctgggggccccgtgccacaaaatgaaagaattttccggtgtcgagactcttgacacgtaatctcgatgagtgagtcaccctgctcccataaaaattgttgcacattttggatgatatatgatgacctcatgcccacccccactcccaaatggaccttggaggagagggacattataatatcatcatcatcgtcgtcacctttttgttgacccccgaggggaaaatgccaaaattgggcgtgcgcatttgttaccgtaataccgtaacgcataattatcggccatcatcaaatttggaaggcttggggcggcggggggataattggctaccgaattaacggggacgggggggggggcgtctcatcacgcgattctctcccatgtgtgctcccaaaaattggatcagcatggagaggattttggggtcctctcagggacgatgaagatgatgatgaattgactttgtgactttagttatggggactttgctgggggcaaaaaaaacatttaacccctcgggggtttatgggaaaacaaaaaagtcaaaaaaaaaaaacaattacttaatgagattagtgaaggaggctgaggagttgcatatttgtgcaaaacaaaaataacaaaaataatgggaactgctgctgctggtgaacaatgagcgcgtaaaagatgggcaaaatgccaattttttgggattaattaaattcaaattaaattttcaaatgttagtttaggcatttgctgtttttcaagaaatatttcctcaataaatatacatttgaaaaatgttaaattcgaacattgaatctgtcaattatttttttgattgcctggtccaattaaatattgccaaatactgttccaaaatgccaaaaaataaaattccctattttcggcacctcgcgctctgccaaatttggcaaatgtttgtcccaaaattatttttggtgtttgccgaccaccatcccaacagcattcagcaccgtaattaaacgcttcccacttaagtgccatcatcgtaatataattgggcaaaattggcgcattattctcccccccccccttctcctcaccgaaaagggaacggagccgccgggcgccgcccgaggggcggcacggcggcacaattggccacttcctttgggggattatctttccaaattgaagaccgattttgggaggacaaaaagcggcttaattggatcatcattgtatgtgtaatacaataagaaatattgtttccaattttttaattt

SEQ ID NO: 3632 - DNA, 1933 bp, Heterodera glycines
tgccgaagccgtgctgcactctcagggctgactcggtacctgagttttttttttggaaatttataaaaaattttaaccccttgtaagggtcaaaaaatttttcgatcctcaaggtttatatctcaaaaatccgcccaactgtaaggatttttttccaaaaattttccaacaaaccctagttaagctgggtataaaattgatctctggaaaaatttcatcattagcctggcaagcaggacgtgacaaaaaaatcagcatttggcatgaaaatttcaaaaatttccactacccctgctgatgttgctgctggttgatctgctgatgaagccacaacattgctgcggcggccattggtgacccgggcataaacgcggccgcggcaaccgccgcatgatgatgatgattcatttggggcggcagaaagtcggcatttctgctgcccggcggcacaatgccaccaccagcgacgggcgggaaaatgttgttggcaccgccggagggcacaaacatgggaaatacagcggtggctgggcagcaggtggttgttgaaggaagatcaaagggtgccgccggtagcggcgcggggcaattagtggaggtggttgtgccaggcttttggagcagtagcagcgaatgattgtggtgtttatggtggtcaagaaggggagttgttgaagctgttgttgttttaagtgccaaattgtcgatggaaattgcttcatgtttctgaatgggtatattatctaattaggccaaattagtttttaaaattaattcttaattcagtataatgggattagtctccaattaaagttaattaatttatttatttataacggaaatttaaaatttatttaaattggttttttgactttccccgtataaaattttcgaaataaaaaacaaattaaacgtaattttgctttgtaccttttcgagttcgccgccattttcacttttcgtgccacttttacatttcgtgccgttttccgctagcagagattgaacattgaacatttttctaaaattaaacacgctcagacgagtaaaaattgcaaacattcttaaatattcaaacgtgcccttaatttctatcaaaatttccaggtaaatgacgaaattttaaaagtgatcatattttgaaaagttcggggttcggcacaaagttcagaggcattagatgggccatgagaaagttgaaacagttggccaaattcagtgccaatggtacagggaccaaactcgacttttgtaaccctgaattgctaggatcaacaatcaaaaatggcaggtaccccagtaaatttttcaaaaattagttaaaaagttgaaatttagcacagcaatttttgaatcttaaaattttttgaaaattgaaaattttttgcgtgaacgcttgttaattgggcctgccggggcgcccatccctccggcagcacagaaagccgtcgaataaaggggacagaattgggggcggagtgaatccgccgccgatatcccccggggggccaagcaaatatccgacggatgggcggagcttgccactaatagccgccccaggcaaaacccacaatcataagcgccgccgatcaatgggcggtgtgctttgttttgccaatttcattatgtcatggatgagaaaaatgatgaattttgaattcaaataaatgaaattaataattgactttaaattatgaaactactgtagcagtacaattgggacaaattaccgttatatatactgtaacggcaaaaatattttttgtttcgaaataaattgatcgtcacaacttgggaaatcttgctattcttcgatttttcgaatttgagttgaagggtatcgaaattttaaaattccatgggttaatgaatttgtaaattccattctctgggaggcagaatttcaaaaattaaaaatttccgatgaaaaatt

SEQ ID NO: 3633 - DNA, 1202 bp, Heterodera glycines
  misc_feature (76)..(76): n is a, c, g, or t
  misc_feature (79)..(79): n is a, c, g, or t
  misc_feature (1129)..(1129): n is a, c, g, or t
  misc_feature (1132)..(1132): n is a, c, g, or t
  misc_feature (1140)..(1142): n is a, c, g, or t
cataatggattaaaattccatgagttagtttacgaaattcaaattttccaaaacaaagcaaagaaattctcaggtnttntactcttcaaaatctctcattaagtaatgaatggtttcggagtgaaatagaagataactgaaaaatcaagcacttctaatttatgacgtttcaccgtctaaaaaatattttaaaaaatttttagtttttgatttttccgaatttcttaagtggcgcaaacaaaaaaattcatttatttgcccccctcgcccattgctctggcccttaaatgtctttaaacggtgcggaaattggccatttccccgcggggcagatccatttccatccattttggcttcttccggccaattcgcgcccccaatttccccacatttttctggtgggtgccactaattgagtcgccgccgatgatgcgattgttggctgatggattttaatgggagatgaagaagaagaagcattgggactactactaaatgttctctctgctttttattccattttatacaaaaaatttatgtgatgggttgagaatttttgatttaaactcaaaaaagttagaaaacattttttgttcgaaaaggggacactaattttgttgttaattgataaaatcattgcttaattttaatgtctaataatggcattttataaaataatttgtaaataaataaaaaaattcaaattaaaattaaaaaagaaaattaataatttatttttctcaattaaaaaacatataaattttatttttttaaaattaaaaataattataaatttagaaaatgcataatcggaaacttttgaaaattcaaagctttaaaaaagtcctagtactaccatatacgcacagatttggaatattaataaataaattcataaaaattgcgattaaaatttttaaaattctttgtaaattttttttttgagtctcaatttaaaatttcgaatctttatgaaacccaatttttgaagctcacaattttattaactagaaacactttcgaaggcattttcgtcgtacaaataaaaatttgaagcagcgatttttgcgcccaaattggttttggcgaaatgttttgcgtatttcgaagcccccacccaataaagatnatnatcatttnnncaccaaaaacataatagcttgtgaaggcttccttccactgattgatatggagtgaaaagt

SEQ ID NO: 3634 - DNA, 1680 bp, Heterodera glycines
  misc_feature (15)..(15): n is a, c, g, or t
  misc_feature (71)..(71): n is a, c, g, or t
  misc_feature (145)..(145): n is a, c, g, or t
taaaatttttaaaanttctttgtaaattttttttttgagtctcaattaaaaatttcgaatctttatgaacnccaatttttgaagctcacaattttattactagaaaacactttcgaaggcattttcgtcgtacaaataaaaattngaagcagcgatttttgcgcccaaattggttttggcgaaatgttttgcgtatttcgaagcccccagggaatgatgatgatgatgatttgggcaccaaaagcataatttgagacacattgcttccttccactgattgatatggggtgaaaagtgggaaaattgaatttagcggaatattttttgcccaaagattttagccaataaaaaataaaatttaaatttaaatttttaaaatgaatttttagccaagaaaaagaaaattcaagtattaaagcttgtgttttaaatatacttgatattaaatatgtgaaattatgaattattcaatttctaaaattcataagtctcctaaagaatagtagttgaataaacttattaaaaatccaaaaatctaaaaactaaaataataatatttaaagttttacatttttttaagggtgatccctcccaaagatatttttcaacccatatttttacgaattttatcatttttcgtttctctgaatatagaaaattccatttttcacctcaaaattaaaaaaaaaaaccccaaaaattcactaaaaattataccgaagcaatcgcttcaaaacaaaaatttgcagttcagttttaggcaaaattttttgttttgatttcaatggacggaattttttgtttcgcaatgccttcgggcgacaactttttgctcttttgcgcgatttgccgccaattgcccacggcacggcgctccgttgagggtgtccatttcatttttcatttttttcacccatttcaatgccgtcgcctctcaaaatgcccccgggggctgtccaattgttcacaaatggaacaaaaagaaatgatgatgaaatgtgccatcaaaatgccatcttttatgggaggcaattccgaaaaatttattgcttatccgccatcttaggtgatgagaaagtttctatttttttcgtaagaaattattatttcggatgagaaattaaaatttatacacgattatttttcgtattttttgtgaatttataaattaaattttaggaatttttttgtaatatttttccacaaaaacagtgcagcaaaatgtttaacggcaacgagaaaaatacgctaaactttgccaggtctccgttcatacgaattttttaggatcattttttaattattcccggaatttcgaggtccgattcaagaaattttgggcctcggaaccagcttggttcgggctctactaaattaaaaacgtttttttttatagcattaaattatttttcttaatttgatagattaaaacaaataaaaaagtcaaaaatgccgacaaagtttttcaaaaaattggggaattgttttgtaaaacaaatgttgctcaatattggccaaaaatgatttatggcccccaaaacattggtggccctttttgatggcattgacctgccgatcccaaatttttttgatttgattacccaactaagcatcttggcattttaaaagtacgccttttatcggcatggcatcggcagaaattggcgtaataaaatataa

SEQ ID NO: 3635 - DNA, 888 bp, Heterodera glycines
cccccccccccccccaaattcgtccctccactataaaaattgcgtatttaagcccaatttaccaccacttaaatcactttttgccaatcttttgatttggcattgccatctctccctcacttgcttttctcctgcttcggtcccccgtttttaaatgtttataaaaaatccacagaaagccacccctccccctctcaacaggctatattctatttttcgaaaatccgagcccaaaacttgagatttcaaaaggcaaaaatcgtcgatttaaacaaatatatgttttaattttggattatgaggatgtatggctatagagaagcattaaaagagattctcacaattttatgaattctttcttgtgccttccataattgtaattaaattctgtcaattttactccaatagatagatggccaaattcccacaaaaagtgcttctcttctctcgcttattcttcctttttttgcaaagctcgcgaggatcgggcacacaaagctcgggaggatcgggcacgcaaacgcgggaggatccggcacgcaaaacgcgggaggatccggcacgcaaaacgcgggaggatccggcacgcaaaacgcgggaggatccggcacgcaaaacgcgggaggatccggcacgcaaaacgcgggaggatccggcacgcaaaacgcgggaggatccggcacgcaaaacgcgggaggatccggcacgcaaaacgcgggaggatccggcacgcatagttcggcaccttcgaatttgcaattcgtcattcttgaaggaagtgaattctgtctggataaaattaattctgtagaacaaaaaccatatggatcagttagtacaattcaaacattgaggtcatactatgacgagggctatgaacttgttggt

SEQ ID NO: 3636 - DNA, 1153 bp, Heterodera glycines
atcaaacaatgagatttttaacaattttttgcgggtgcagtttttccataaaacttctggtgaacgggcgaggggagggggtccggcggaaaactgatttgttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaaccctccgaccaaacagacgccaaattttaccaccccgccccccttcctacaaaagcatttgaattgaagcacatatgagcatttattaagcacaacaacaatacaattacataggcaacaattaaatatacattcatttgaagtgatgatcacagaaatttacatacagatacaacaatttacatgatgggggacaaaatgacaattttgggacggtgggtgggtgggatcctatcatgtccatgttgaggtgacgaagcatccttccatcagacgttgtactcgatcggcaagttcttgcggcgcaccatcccgtctccctggaaccactcgagcttgaacgcggtggcggctgggtccggcgtgttggtccactccacggtcacacggtcgcccttggtgtcctcgctgccggggtcgaaggcgtcgcaggagacggccacgttgacggactcctttgggccgagcactccgttcggcgggttcatgttgatgcgcttcggtttggtggtcttgaaggcgtagccgatgcgcttcgtcccagggttgatcacctgaaaaaggggggggggggttattccgcatgccacgtgcaccacgccaaacgcacccgcatgtagtaggtggccttgttgtcgaacggggcgttgaagacgaccttctgcgtgggcattgttgcgacgtcctctggtggaagttgcgccattgctg

SEQ ID NO: 3637 - DNA, 2582 bp, Heterodera glycines
cgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaaccctccgaccaaacagacgccaaattttaccaccccgccccccttcctacaaaagcatttgaattgaagcacatatgagcatttattaagcacaacaacaatacaattacataggcaacaattaaatatacattcatttgaagtgatgatcacagaaatttacatacagatacaacaatttacatgatgggggacaaaatgacaattttgggacggtgggtgggtgggatcctatcatgtccatgttgaggtgacgaagcatccttccatcagacgttgtactcgatcggcaagttcttgcggcgcaccatcccgtctccctggaaccactcgagcttgaacgcggtggcggctgggtccggcgtgttggtccactccacggtcacacggtcgcccttggtgtcctcgctgccggggtcgaaggcgtcgcaggagacggccacgttgacggactcctttgggccgagcactccgttcggcgggttcatgttgatgcgcttcggtttggtggtcttgaaggcgtagccgatgcgcttcgtcccagggttgatcacctgaaaaggggggggggttattccgcatgccacgtgcaccacgccaaacgcacccgcatgtagtaggtggccttgttgtcgaacggggcgttgaagacgaccttctgcgtgggcattgttgcgacgtcctctggtggaagttgcgccattgctgttgttgtcgctgttgtcgggctggctttgtgggtgcttgatgtgtgatcgttgagagcgttgcttgaagtgttgctgctgctgagtgaggagaatgtgcaaaatccacctccttatatacaaaattcgggtgcaaaaattcatgcagcaaaaaaaagtgtataaaaggcgacggttttcttcacttttcaccagtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggagcctcgcccgcgtacgagccaccagcggttggtttaagggggacacgggagcaaaagcatcactaatcttttgtttttgcagcaggagaagtccccggatcagagcgcctacatgtgagaagatgcaacaacgaccggcggatggatggacgaaacctgaagagcgagcgacctgtcagaagatgcaaagctaaagaagatgtcccataatcgtgatctgtatttattgatgtattgtacatttgtatgcatatatcatttgctgtgtattatcactttatttccatctgtgttccgaaataaattgaattgatggtcattaagcgtgtgtcaatttattaactgaaatttggtcctctccctccctccctctctctgtttgacgtagacatttggatggcataaagttttttgggttctagtgcagaatacgcgtcccatggacttttacgcgtcccatggacttttacgcgtcccatggttttttacgcgtcccataattttttacgcgtcccatctaatttttacgcgtcccaaggtttttcacgcgtcccattgaatttttacgcgtcccataatttaaaaaaaaatttgattaaatttttatatgttatcacattaaagcaaatattttaggtacgatcacatcacacattatttgttagacagggtagttatggcgcatttcttccaaaatatgctgaaatatttttttgttttcgtgataacgacgaaatgcgtactgaaacaaataagtaggtaaaagttcgggtgtagtcccatgtaaatgtttaaggctttgctttaaagccctccaggtagcctcaattccctgtgtatgtatttgagggttggcgggatctacgaagtaaatttgatgatttatccattcgtggttgtattgctgctgcatgttattaatccctccgtatgccgcccacccatccgatactatcgtgcttcccacctcaatattttcagcgataatgggcagaagagtgtctgcagaccgatcgggcacagggaaaaaccggaccttattagacccttttgaatcatgccaaagacccattcgtatggacgatttagcattcgaccaccgatggtattttgtcctatacaccttcagactcgtttatcagtcaacggattttgatgaattattttgttttcaactccgttgataatgtactttgtttttataatttttttatttaacatttcaagctgaaacaaagaaaaaatgaataaaaatcgatgggacgcgt

SEQ ID NO: 3638 - DNA, 311 bp, Heterodera glycines
ctcggcctcggcatctgtcagtgaagctttctttacctttggaacggatttccaccagtggatccgtaatacctttggaatgaggttcgatcgtaattaatggtaatgttaccgcctgaaaaacaaagaatacacaagcatttcaaaaaaaaggaggatttcagaccgtaacaagcccattagatacgatcgaagctcattacaaagatattacggatcaactaaaagatcggcacgttcccgagataaagaaagcttcattgacggatgccgaggccaaattggtactacatcaccatatcatggtctga

SEQ ID NO: 3639 - DNA, 1036 bp, Heterodera glycines
tatcaaatctaacactattaggtattttgaaattgtgctaggtgtcgtttcgcaaaatccgccattttagcaattttttcggcaaaaaatggcattttaccttgttcaaaagcaaccaaattttacatttcaggttcgaaaattcaatgttaagaatttagtactcacaatcagaacatcacgtggtgctgtgttaattccttgacatttggcaatgaattcttctttatagtgggaacgcacctcttctagtggatccgttatacctttgtaaacatagtcgataatatctaatggtcttacaaccgtctgaaaaaaacatagaatacacaccaggaatggcggcattccgaggccccaaaaattttgggaaatcggaattccgagggtcgaacaattgacaaataaaattatattattttaaattttcaatacgttttgatagtccgttccaataaaattatgtttgattgcgttagattcctgttgtctgtgtctttggagagcttcaaactttgtttttataaattcgtgcaattctttgatggctttttgctcatcggattctggcttaaatttaaatatatatatatatatatatatatatatatataatgcaaattgtaaataagtacagtatctcttctttgtaactaactgtggacccagaccgggtttcagggttttaaatcctgtttttcaggactcctgacaagggcacagctaggggggggggctgtagagagccaatatctatatcatcgtttttccttttttttcgtatctttcacaaacaaaaaatagatttcattctctattcccattaatttacctacttatgcaacactaaaattactcatattaatgagaattgtattccccgaattatatttgagatctgatcatttagcattttttagcggaaccaaaaaaggcattttccgtcccaatgccgtcccctccctttcctactgctcttctcattaccttccccttttcccgcaattccttccatttctagttccttccaaatatc

SEQ ID NO: 3640 - DNA, 2010 bp, Heterodera glycines
cccgaaatcccaaaaaaagtaaaaatttccagcaaatcgaaaaatacacccctaaaaatcgaatgaaaaacgtaaactcgagtttaaaaattcattaacaggggaacgacaattgtttaattataaaatcaaataattttatgaaaaatacaatttttaaagagaaaaattattgggtttttggagggggcggctctctaagaggggggggggggggctctattgttatttataaaggagcttctaccaggagggtagggggagcttaaaattatgaatacggtaaataaattttcaatcaaacaattttttactccaaattcgatatcaactgctctcccaatgatggcgcccactgcgcctgcggcacggacgaattccatggcattttcactgacaaatctcaactgattaacaatgtcccatgttgaggatgttagcgatgaaaattgagttgccatttcattcacagcatctgttgtttctagaaaagcagaataaatttgtcattacaattaatagggatgggaattttacgtaagaaaaatcgcaaaatatgtaaataaaatatgtgtaaaaaatactaaaatatgtatgaaatatgtacaaaaactcccaaaaatgtactaaaatatgtaaataaattttttaaaaaagttattttttcgaaaaaaaaatcttcgtataggcttagaatcaccttttaatattttaaaattaatttttgatatctcatttttgaaaaaacaacgatttttagagatacattaaaaaaaaattgtttttaaatttttcacaagaaattttataaattttcaaaaattcttcctactttttagagcatggagaatccaggaaaaaatatgcctttgcataaaattcccacccctagtcattacaattaaaaaagaaagctaaataaacacaaccgcttgacaatgcatttggccatgagatgaccaaagtcaaaaagctcgatctttaaaaaaaattaacaaatatgtgaatattataaatttttgtaccaagttcacaatttgtgccatttggaagtgccaaatttatcacaaaatttttgattaaaaagtccagcaactccctcacactagtgaaaaccttaaaaatcattatcacaattgaaaaccacgagaatatgttaagaccagggctgccagattaaaattttcaaaagcctcatttggcatgcaaaaaaacctcattttgggtcaaaaagcctcatttttacgaaatttaagcattttgtgaaaagctgagcacgaaaaatcgaagttgattttttgcggcgctttttccaaagaacttttggggaataggggggccggcggcgtcgataggcgccgtcgggggaaaattaagaatttttaccatatttttaacatattttcattgattggaattcaaaatttttatgggacgggatcccgcatatataaatcccgcaatttccaaaatgtgggattgcggattgggatcccgcaaaatcccacaatttccaaaatgtgggattgcggattgggatcccgcaaaatcccacaatttccaaaatgtgggattgcggattgggatcccgcaaaatcccacaatttccaaaatgtgggattgcggattgagatcccgcaaaatcccgcgcgggatcccgtcccgcaccgggctataccaatttggtatcatgtgagtgtttttcatgtttaagatctatgattatgaaattgcaaaatgttagaattagaataattgaattttttttctattaatcgctttttaaatacatgcatataaattcgataaattgattgaaacatataataataataatattaataataataattgcgcaaaatttagataaacatattttattttgaccgaaatagccggaagtgtttgccaacacttatttgcctaccggacatttgcggacagacatttgcggacggacatttgcggacggacattcacgaacaatttcgggaaaaaataaaataaatt

SEQ ID NO: 3641 - DNA, 4881 bp, Heterodera glycines
attcggtgagagtgctatttttatctttaaaaaaaattctgagacatgcttaatcgcaaacaaaatttactggcaatttcaaaatgaacaggctattatataaatgctgaaattagctgtactaaaatccgattccccacatttttgggcatcggatttccgatttcattttctgaaaatttgtggtgcctcgaaatgatttactgctgatgaaaagtagatcaagacttatgtgtcttgggttcttctccaacccgaacaaataaggaaaagaaaattcagggggcgggtaacaaattcccctacaagatttgtctgtatggctagagaaattttaaaaaatgtcggtggaaaaaccctcgttggaaaataaagttttataagttatttatgggaaaaagcccaattataatgtgcataaaattttagttttttttatccaaaaagaaaaaatatatgcaaaaagtggtaaaaaacaaatatatgtaaaaatgtggtataaaagtggcaggcgggcgtgcctaaattaataaacatttttttactcaaaatttggctgtccgccggccaccaccacccgcccgtcccagtggggacagccgcggggggtgaacaatggaaaaacaaaataaatatgatgggggagggagggtatatagggaataaaaaacaaaaaaaaatgagtaaattccggtggtgcagcggcccgccctaattttgagacacgcaggcaggcagcggcccgcctcatttgtatttgtacgtcgagagcggcggctccccagtgggcaccagggggccgtggaggacggggcggtgggtcaggtgcaatgccgcaatgccagtcgcctcgtcgcactggtagagcagtggaatttttcggccactaaagttatgaacattatatacatttacattggtacccctgtaaatgtacattttgtattgaaaatcataaaaaaaattgaaaaaaatggcaaaacgtacatgcaaagcagtgcctgtgcaaggccatggcgcttgtacatttcctgcgcctttgttgccggcacgaagtcgtagccggcaaccggtggcttaacaaaaaaaaaagtttttttttttaaattttgtgaataaatttgaaaagcattttacctccttcttcggtttctccgtgtaaataacattctgaacaccggagtgcactcgctgggccacatctgccagttcgtcccagcgtcgctgcacagcagcggcccggtcacagttgttcaacatgaagtctgtaaagaccatccgcaaatttgggcgaactggaaaaaagttttaatatttcagttttcaccccttttccccacccatcggtacatttacgggggtacccatgtaaatgtaccgataggtgggtaaaagggttaagctctttataccgaaatgcttaccaaatttgcgctgggtatgcgatatgcagctgccctggtcactggtggtgaccatgtcggtccagcgaccttttgggtcggagtggcgctgcactgtgtggttaagcgactacaaaaaaaataatgttattttatttaaaattatttgaaaaaaaaaccttgaactttccaaattcggccaccaatttggtgtttgagcagcggcccttggggtggccatcctgcaggcagatgaagcagtttttgctttttctgtccgcaacacgcttgaagtgctccatgtactggccctccagctgtaggaaggcagcggcccattccactgcaaagagaaaaaaaatattttacaaaaaaaaattaagaaccccaagcttccaaaatccagcactccgccggcctgtggccgatacccaggcagcacacgcatgctacccgggtaccgccatttggccctgtcgctttgtaggacgggcattcggaaggccggtgccggccttcgttgcagaccttgcacaaattctcgtgcccggtcttccaaatgctgttggcagcggcccaatcgccgttgattatgctgctgttgttgtacataaaaacgaatttacgaaggaggaagagagagtagtattaatttcgaagtaaaaatgttcaaactaaacaaattaaaaaattttaattttaaaaacaaattaaaagacaaaataaatttaaattgttgctcgtttggcattatgttattagataaattggaattaaaaatattttttattttaatttacttattaaattttgcctgcggctttgtaagccatccgcttatccccccgtatcccttttaacctaaaaccggttttttctgtagagaacatatttttctaaaattaaagcttaatttcaaatttgtatttagcagatttaaaccgtaattgcttttttattttttaaatcaaaatttaaatatacttttaagtgatgttctttggttctttgatgcggaagagcaaaagatcaacccacggtgggactcgaacccacgaccccagctttccgtgctgtgctctaaccaactgagctacgcaggcatcctctccattgctctcttctctctcctatcttaggaggagaatcactctcttaatctccttcactgccgtcttggcacaaggggagagagtgaccgcatttatcacatccccggcctttgagaagaccggtccccggtctctttgatgagaaagctccagtctttggatggacaacttctctcagagtggggagggggagctgtcggcttgacacaaactccacaccgaatgtgattccatgacaggagcgccaagtgatgttctttggttctttgatgcggaagagcaaaagatcaacccacggtgggactcgaacccacgaccccagctttccgtgctgtgctctaaccaactgagctacgcaggcatcctctccattgctctcttctctctcctatcttaggaggagaatcactctcttaatctccttcactgccgtcttggcacaaggggagagagtgaccgcatttatcacatttattaataataatatttgttttccagatcaaaatgcctatgtccatctactatatgaatgtcgttcacgacatcatagcgtcctagcttgcactcaatgaggacgaaaaaatcgaattcgacgccaagaagaaccacttcaagcgcaaacttgggccgctgagttatggcaaccggatcccgaaggccgaaaaggcccactacaccccggaacagcgcaggaggccgaccgctggttgtccaaccacgcttggctgcccccagcgcccttcaagggcatcctcttcccggccaagagtaagtgctttaaaatttttagtctgggactggaaaaaggctttaagactgtaatttctgtacatttatatgggtacccatttaaatgtacattaagtattgtttttatgtaatgtttgatttttagtctggaactggaaaaagggggcagctgcgtatgctgcgcactggcgagatgagttcattgggtccgataacccggacgtcagggcagctgcaaaggccgctgccgagggcaactttgtcagactcggcaccaacgagtacgtgcgactggacgtgcgcgatctcacgcagttgaacatcgacgatgcgctgggaaacaatgtttgtttgttttcctttcggtctataagaaaatgctttttaagtgtgtgttttgcagatacgtaactatatactataggcacatttatgcgggtacccgcataaatatacctatagtatatagttacgcattttttatattgacaggaagacgtggcggacgtggatttggtaaagccgctgaccgctccgaccttgaagaacgtcaacgccgacacgcgccatgagatcatgggcacgatcgtcaagcgcagccttcgcgcaaaagccatcattgggctgctgcagcgaaaggtaatcggacttgaatttagctttgatctgactttaatttctcattgtcttccaacaggtggtgttgaccaggcatgcactcgaccgcaccaaagccaagtttcgaaagcgcaaaagggagctgaaacgtgaggtcaacactgccattggcaccatccgcgctgccgaagacgacctttttcagcaagtgcaacagctcaaagagatcgctcctaaggctaagctgaagaagctcggtctcgcggacattggcccggagctcagcagcgaaagcgaaggggacgaggaggaagaggatgcggctcacaacaccgagcagcagcagcaggacgatgccaacgacgtcccagacgacctgaccatggacgaaagggccgatgctgctcgccgccgtgaagttctcgactttgagacaccagtctacgctcgggaactgcgggttttttttttggaatgttcttagacccttgtaattatctataaataaatatgtactaaatatacatttacaagggtgcccatgtaaatgtacgttttgtacatccttttatcatgagtccgtagaagcggccgaatgttccccacaaaattaaaaaaacgggcgccaagcgcccgtcctgaggccgcgaagcggccgaatgtcccccaaaaaaattaaaaaacgggcgcgaggcggcagattgttccctataaaattaaaaaaaggcgcgaagcgcccgtcctgaggccgcgaagcggccgattgttctcaacaaaattaaaaaacgggcgcgaagcgcccgtcctgaggccgcgaagcggccgattgctccctacaagattaaaaaacgggcgcaaagcgcctgccctgaggtcgcgaagcggccgaatgttctcaacaaaattaaaagacgggcgcgaagcgcccgtcctgaggtcactaagaggccgtgcgtcccctgacagattatcaaacggaattgagagttcttgattat

SEQ ID NO: 3642 - DNA, 5980 bp, Heterodera glycines
  misc_feature (76)..(77): n is a, c, g, or t
  misc_feature (84)..(84): n is a, c, g, or t
  misc_feature (129)..(129): n is a, c, g, or t
tttagtttaaaaatggcgcgtgcctgggcgttgtgccgacatttcatccgaaaacagaactttcggaattgcgacnncaacaancacaaaggcgcgaaattttgaactgaaaattgtaagtgatttcanaattaatttttgagaaaaaaaccatcgctaaatttttcaacaattttttcgtcattttggccttctttttcacttaataagaattcgaaacaatcaatgcttatcagtcgaacatccaattggcagcaaagcctttccatggccaatttggccgcttcgaagttcgattggaacaaaactaatgggttaattttgcttaataattaatatatttaatcattttgcgtttattttacctttcattttcatttctgagcaattgcaaaaatatttttgccaatttatgtgccaattcccttataggaaagggcaaaaagtgatggagtgccaaatttgaatgttgggggaaacggccgtggaaagaaaacggggaaaggtcctcaaaacaggaggagaagtcgcgttgaacaaaatgagcagctgaagaagcaaaagaagaagaagacggaggaaaggaagcctaattggggacggattaatgggaaaatatgtcaattaggaaggtcaattaaataatattcattggaattttcaaatggcgaaattttcactttgtaaatgcggcaattcttcggatttgatgatacattaaataaatcgccatcataaagcaacctaaataaaagaaaaaagcatttaaaaagtggcaaataaaactttggctctctaaaaaagttgctgagttcctcttcaggctccaatggacactcaaaaggaaatgagttaatgtgttggtcaattaatttgacatgaaaagagggcgcaaatttaggcgatgactcaacgcaaattgcattctaaaaaaagaaattaaaaagaaataaaataataaataaaactgacaacgagaaaaacatttgtgaattcatttccaattgttgagattccaaacagattaaaagcagtaaagggcgaaagaattgcaaatcgaaaatttagcaaagcaaaaggaaaaggacggacaaagcaaatgcgagagaactgatcaatctgaggggaaattttaaaaatagaaaaaataaataaaaataattaattacaattccatcggaggaattaatagaagacgtaaaagaaagctcatagggacggtcgcattgaaaatgccaccgaagccaagtgaatgcatcgacgaaaacaatgctgaaaagggaaaagtgccaatcagtcctaattagtcttaattactttaatcatataaacttttattttgttaatttattctattacttttgctgcttttcattcctcaaatggtcaatgaatgtcaatgccatcggagtgctaaaacaatgcaccggcgatgccaatgatgacagtgcttcagcagtgatggcattttgcatgaattggtcagaaattttttgacaaaattttgttgggaaacgaaaaaaatggcggatgaaaagagccaaggaacatttttgtgaatttagcaatttattaaaactttttttacacattttagcaattaaaagccctaaaaatatatttaataaaataaaaatgaagaacatttaattaaaaataaataaataaacaaataatgagaaagaaaaggaaaattacataaaatgtaatacaataaaatgaaggtttaattgattgtattcttaggaaaaaatcaatgtgaataaacaacggacagtcgtcaccttccttcttaaatatacaaaattaaaattgtttgtaacttttatttttattttttcaccctttttatgaacattttatttttggtacattcaaattatattttttgtttgggctttacaaatagtggtgcttatttttttaaaacattttttacctttttgaatggtcagatggaccgtttcgtttggtcggtctttcatcaaattatcatgcggaagtgatatcggaggaatctcttctaagtgattgtcggattctttcctatgcaattcaattcaaaacaatacatttaatttgagtgtttgcgtttattctttcgacataaaaacgattaattaattaattgcactaataaaagtttccatcagaggagcatacatcattcattgctaatctctctcttcttttttttatttttcacatgccaaactcagcgatggtatcctccaaaaacatccgcactctctgcaaaagttccgtccgtttgtccttctgttcgttcggcgttttgcctatcaccgattccatgtgataataacaggaggcgccgaaacacaaataccttaaaagctcgactcacagatgaaaattcgaaaataagtcttttggtgccaaaaaagcctcaaaaacagtaaaaacgattaattattattatcctttttttcacactgtttcaatcctcaacaattttttgctttcatttttcaaaaatttgttgtttatgagtcttcttaaagatttcgtctaaaatgtctaattgtgatgtttttaggccgaaataaaggaaaataaaaatttctatgctttttgatcaaaaaatgacaattgctttacaaaaagcttcaaaatttcaaaaactttattaaaaaagccactgccaaatgataaaacattatcacatctgctgggatccccaatttacggtgaccaaaccggccaattcagccccggacatcgcttcggggcatttcttcgccttaaacaaataatcgttttgtgaaatggggtctttttagtttattttacaatttctgtgatgcttagtccatcttccaatttaattttcttgcaaagtgagcgcaaaatgcgctctttggcgattggatcatttgccggattgatggggacgagtttgtcgaagctgaaaaaagccaacatgcacttccaaacggcaaatttgaaggacaaccgtcccggggaaagaaggcacgggtcaagcagatccgggcgatttgttgcgcccataatgaacacagctttgttgcgagtccaatggcacgaatcgagttcagtcaaaaactgagagaccattctaaggaaagaaagggggagggattgggggatgagggggatcggattaaacgaaatttaaataaatagcaataattaagctaattgcttttaaagttccactatggtgccaattcgaacatccttgcattagccgcttcttttccatcacaatttgcccacctgtccatcaccccgcccgagtccgaattggcccctcgcgcgggcactaatgagtccaactcatcaaaaaacagcaccgacggggcagtacgcttcgctttagagaacacttcgcgcaaattgcgctcgctttcccccacaaattggctcagcaattcgggccccttcacgctgacaaaactgagtcccgcttggttggccacggctttaagcacgttttggccatttttcgttgttttgcccaccttttgccaacatcgttttcccgcaccccggggggccatacagcaaaatgccggtccgtcgtcggagacgacttgcattttcttcgcctgctgaccattttcgctcttcgaccttaatttgtgtaaattagcagctgctttggctggccaaatccttttccaccaattcggccaatgcttcggatagtaattccttcgcctcttccaatcccccaatgtcgtccatttgcacgtcggaatagccaccggcccttttcgaagcggattcccaccgtttgagtgccaattcaaaatggccaatgccaaggcgaggtgaattggcaactgtgaacgaatggcgatcatgctcaccaatggcaacgcatttggcatcatcaaacaatttgatcaattgcgacagagagaagctctggtaaatggaaaataaacgtgaaatacataatttatttttaatgacttatttaagagtaagttatttctaaacttatgatcattgatccagtcatcaactctgataatgatcatattcatgacaactgatcaccgattccttccaataagcgaccgcacttcgcatgatcagtgatctgtccacttcttctgatcattctagtcttaccgatcagtagtaaggtccaccccttattaatgatccatccagtccttctgacaacaaaacaatcaattccttgcaactgatcttgttgaccccctgtatcagtgatttgatcatgtgcactcattctgttcactgatcacatcacttctctgcctcccccccccccatctgtcacaaattacctttgaaatttcaacaattttgttcactaattgggtgtctgtccactcaattggtccgtttttgagtgcccattccgcatattccgccctctcttccgcacccattcgttcgtcgccctcttcaagccgaaattcccaatggaatgctttcgcaagacgttccggcacttcgctcgtgttaaacagtggcgaaatgttcaaaaagaaaacggaaggccagcgattagcagaagaagaggaacatttggcagcatttaagcaccgaaccaaagcatcgaacaaatctgttaaaaaatagaaacattttattttctgttttttagtttaaaaatggcgcgtgccttggcgttgtgtcgacatttcatccgaaaacagaacttcggaattgcgaacccaacaaacacaaggcgcgaaattttgaactgaaaattgtaagtgattttcaaattaatttttgagaaaaaaaccatcgctaaatttttcaacattttttcgtcattttggccttctttttcacttaataagaattcgaaacaatcaatgcttatcagtcgaacatccaattggcagcaaagcctttccatggccaatttggccgcttcgaagttcgattggaacaaaactaatgggttaattttgcttaataattaatatatttaatcattttgcgtttattttacctttcattttcatttctgagcaattgcaaaaatatttttgccaatttatgtgccaattcccttataggaaagggcaaaaagtgatggagtgccaaatttgaatgttgggggaaacggccgtggaaagaaaacggggaaaggtcctcaaaacaggaggagaagtcgcgttgaacaaaatgagcagctgaagaagcaaaagaagaagaagacggaggaaaagaagcctaattggggacggattaatgggaaaatatgtcaattaggaaggtcaattaaataattaatattcattggaattttcaaatggcgaaattttcactttgtaaatgcggcaattcctcggatttgatgatacattaaataaatcgccatcataaagcaacctaaataaaagaaaaaagcatttaaaaagtggcaaataaaactttggctctctaaaaaagttgttgagttcctcttcaggctccaatggacactcaaaaggaaatgagttaatgtgttggtcaattaatttgacatgaaaagagggcgcaaatttaggcgatgactcaacgcaaattgcattctaaaaaaagaaataaaaaagaaataaaataataaataaaactgacaacgagaaaaacatttgtgaattcatttccaattgttgagattccaaacagattaaaagcagtaaagggcgaaagaattgcaaatcgaaaatttagcaaagcaaaaggaaaaggacggacgaagcaaatgcgagagaaatgatcaatctgaggggaaattttaaaaaataaaaaataaataaaactaattaattacaattccatcggaggaattaatagaagacgtaaaagaaagctcatagggacggtcgcattgaaaatgccaccgaagccaagtgaatgcatcgacgaaaacaatgctgaaaagggaaaagtgccaatcagtcctaattagtcttaattactatagtcatataaacttttattttgttaatttattctatta

SEQ ID NO: 3643 - DNA, 7006 bp, Heterodera glycines
tcaaagtcaaaaaccttaaagctactaggcgattggaataaatgaaaaataaagcatagtcaaagactaaaccttacagcactaggcgattgaaataaatgaaaaataaagcaaagtcaaagtcaaaaccttaaagcactaggcgattggaataaatgaaaaataaagcaaagtcaaagttaaaaccttaaagcactagtcgattgaaataaatggaaaaaaagcaaagtcaaagtcaaaaccttaaagcactaggcgattggaataaatgaaaaataaagcaaagtcaaagactaaaccttaaagcactaggcgattgaaataaatgaaaaataaagcaaagtcaaagtcaaaaccttaaagcactaggcgattggaataaatgaaaaataaagcaaagtcaaagactaaaccttaaagcactagtcgattggaataaatggaaaaaaagcaaagtcaaatacttatcctacctaatttcatggtgacgaggcatttggctacctttaagactcccttaagagagacccttctcttctcatgtgcaagaatattgctttctcgcctgcgcggaatttcaatttagaggtgtttaatcataatcctttaggtggtagcttcataccattggtctatcgaccaagcccagctcatgttccctattcattggcttaacattcagagcactgggcagaaatcagacacggtcagcgcccttgcgcttatgctgccatcctttaattgccgtaagcgaataaacccttggctgaaatcatgcatgtctaattgtgtcaggaatgaacacatcgttcagacaggataaaccaaaaaactgacagcgagcgttaccggcgcttatattacagcctttataacagccaaagttacaaccaaacaattccttacgtcactacatgcctgacaaaatgctcaagccagcacttgcccccgacgggtgcgctcaaaagagcgaaatactcacaaaatccaaaaagtgcaaaatggaaaagtgtaaaacaatagtattaagttaaaacactagtccatttatggaaatattgttacgaatgatgttcgtaggaatctgttacgagtgatgttcgtatcaatgtgctacgagtgatgtccgtaggaatgtgttacgagtgatgtccgtaggaatgtgttacgagtgatgttcgtagcaatgtgttacgagtgatgtccgtaggaatgtgtatcgagtgatgtccgtaggaatgtgtcacgagtgatgttcgtagcattgtgttacgagtgatgtccgtaggaatgtgtatcgagtgatgtccgtaagacgcacggtaccgttagattcgccacatcatgctgagtctacggacaccgatcgcgtcccgttccgttgcctattcgcggcacagcgactgctttcgtcggttcactttttaccaatccactactgttgtaaggattttcaccaaacttcgtgcacacattgtttagcgtatgggcaacggaacgtgacgcgcacggtaccgttagattcgccacatcatgctgagtctacggacaccgatcgcgtcccgttccgttgcctattcgcggcacagcgactgctttcgtcggttcactttttaccaatccactagtgttgtaaggattttcaccaaacttcgtgcacacattgtttagcgtatgggcaacggaacgtgaggcggtcggaaccgttagattcgacacgtcatggtgagattacagaaacctaccgcagtccgaaatcgcgtgtatggattggaccacgagtgcaaacacgggagcactatccgataatgggctagcgagacattgagagccatcgacgaagggcacggaggagaagaaccaccacgttccgaaggcaagtgcagtcgctgaatctgtcggcgcaaatccatgcttcgaccttttggacaatggggacgatggcagcgatctcagcaatggtttggacgtcatcattggcaggcttgacttcgatggtgatgggccaacgatcctcgggatggataagccaacttgggccgttccaccagagtggatgggaggtgagttcaagcacagtacatccgcgtgaggcgacatcggctgggttttgctctgtcgatatgtagcgaaagcaaacttggtcgacggcacggatctcctttagccgattctccacaaaacgaggttgctgctcggaagacgacacccaaccaaggactggtttggagtcacaccaaatgaatttgtggcgaacggcaagtccgagctgtttctctgcaaattgaagcatccgaatgccaatcagcattcccatgagctccatgcgcggaatagtgagatttgacccctttggcttcactcggctcttggcaaaaatgagatgggccgtgattgtgatttcatgttgtgcccgaatgaagatgcatgctccgtaggcatctttgcttgcatcgacaaaggcatgtagctgatgagaggccacttccaacgggatgactcggcgcgggacacggaccttttgctggttccaagtcgtggcaattgtgttccattcttgcactttgtcagtcgaaagaggatcatcccagtcaagcttggtttcccaaagtgattggaaaaacattttggcatcgtgaagtgccgggcacactagtccgagagggtcaaaaacggaggcgagctgttggagaacagttcgacgagtaacgcaacgactttcggtgtccatgggcggaaagtcgatgtaaagcttgtccggcctcaactcccagtgaaggccgagcactttgggcacttctttcacgagttggtcttccttcggaattcggcacatgacttcgtctgagttacagatgaattcgcgaatgttcatttgacaggcgcggaacagagtcttgctgctcatgtatttgttcagcgcttctgagggtgaagtgcattgcatgagcaggttgtcgacgtaggcattttcagccatttcaatggccaatggggacccgtcctgcttcaggtgcttctggatggtggctgccagcaaaaagggcgaggcaatgactccgaatggcacccttgaccatcggtagatgaccacgttatccggcaacggtggtttacggacgtcgttaacccagagcactttgcagaattcgcggtcgcgctccagcaagctgagtgaattgaaggccttttccaagtcaccccacagcgcaatgccagccaagcggaagcgcatgagaatcccagcgagttccggcataattacgggccctctgaacatgcacttgttcagagagttttgcccctttggatgggcagaagcgtcaaggacttgacggaatttgtgtgtgacaacacaatgatgcggcaggaaatgctcgagtcctcgagtacgaacggctggttcgatgagccccagtcgaagctgttcctggattgtggcttcgtacttggcaagaagttcgggaaaatgttgaagacggttgagaattgaagacaatcggcgatgggccatggcaaaatttgagggcaggtccggcggaaaattcttccatggccatcccacgctgtatcttccgtttgccaggcgcgtagtcgtctggtcgaagatttgttgtgccgtctcgtcatcgttttcgagtggatcatctctgatgccaatgttttgaaggtcccagaattgtcgtagcgagtcaagatcagagatggattcgtttctctgaattccgctgacagccgtattgggcatctcgtcttcattggcaggaacatggacagtgacgggcataacggacagtggatggtcggcagttgggcgggatggaatttcatcgcgtccgcagacagtggaaccgatcgaagttttgactttgaaaagttgcggagagactcgttggacaccgttgaaaaacttccaaaagtctgccattccaacgagaatgtccggttcttcatccacaggcactaacattccctggaggaatgtggcacggcgcactgatggcactatccagtccgtccgatgggcaaccagagtttcgtatccgccgtcctctcgttggacgcacaaaacgtgttgcggcgctttcatcttgatgggttgccgcgtgtggaaaggattcacctctagctgatcgtcttgtagtttcggaaggctcagttgccttatcagtggcgtcttgaccatagtgacttgcgcaccagggtcaaagaagaagagtgcgtcacggcgcttgttcggtgcggattctgagaacacaggagctcggagggccatgagcatgacgagatgaggaacggatggggagacaattgccatgattgtgttaacagttttcggctcagtgattgagtcagcctcattggcaaccgcggatgacaccaatggccttgagttgcgctcgtttccgaaactctgtttgttcctgggcgagggcttctgttgctttgaacgggcagaagatgtccctttggcactagggcagattgcagaatgatgccgttctttgcacactcggcatacttgctttgaccggcactcccttaattggtgacccttccgtaggcaattgaggcaccggttctgctgcaaaaggcaacgttttcgagtctctgcatctgtcactttgttacactccgaggcccaatgccggccagggcagaacaggcaggacggaactcgcttgtcatcagaatttctgacggactgagcgacggaaaaaactcgcgcattttcatgccgttctggtcgctgaggtcgatttggccttgcttcgtgccgaaatcgtgtttgtctgtcggcattggcttcgcgcaggcatcgttcgacctcttctctgactccgagaacttcggcaagtccagctctgagctgaggagtaccccatggaatgcctgctgcacgttccattttgatgagttcggacagaacagtcgacggcaatttgctgcggatgatttggtacatgaatgggctgtcatccggcatgttgaggttcaaaagttggcggcacacacgctccaaagtctcgaggaagtgttgcagtgatccaacgctatcgtccacaggccggagattgatcagttcggactgaagtgcttcggcaattttccgtggatctccgaagagtcgcctgagtgcggcaacggcatgggcataattgtcccctccacggtaggcggttacggcacgagcagcctttccgcgtaagcaaccgtggagatagttgagcttgtcgacgggctcaagggcggcacggtcgacggcactctcaaaactctgccaaaacgcgggccattccattggttcgcccgaaaaaacaggaagactgagctgcggcagccgagcagtggctaaaggcgcaggcgcagcaacagccggcaagtttggcacgatttgttatttggcaccaatcgtggctgattggcatggttggcaacagcagctggctgttgaacattggcaccgccgagaaatgcggcattgttgacgaatggcacggctggcacgggtggattcacagcaacagctggttgctgtcttcccgccgcgattggctggttgggctcatctgcgagttccgctgctatgtgagccagcatttctcgcgcatcttccaaccactccgtcaagtgccggtcatctcgaataaaggcagtgaaaagcgcttcctccgcctctctcgctgggccttgcagtccgttcatgatggcaccccacgcgtccagctcgacctccatccttgacaggatacgggtgatgtgcccccgttcctgttcaaggttttcggtcgtctcggcattgatcacgggctcgtccagcaaattttcggccgtagtgacatgttgccgaagtcggaacagcgcgggccccaaagccatccggcatcgagctgaagacatctttgattgctaacggcaccacttgttaactcgggcggcaaaggggggcaaaaatggaagggcgcgagggagagagggcggggtgaataaggggggaaaaaataccgaataaataaaagaagttttatttggtaaatataataagatgtcagatgaaaagaatgtgttgaagcgaaaaacgtgcgtgtttaaatagagaggaaaagcggaggtggagcaatttagacagaacgatcaacaacaaaaaagagtgactaatactaagcacgaaaatcacattgaataggaaatatcacaatttagataataagaaaatcaatcacaaatattaaattattccaattaacacaattaattcttcttcctcaattctctctctctttttccattttccatcatttcttctttttctcctctttcttagtcgctttggcgacattctgactttttcattatttatttattttttgcaaaatttattcataagtattttttcagaaagtgctctgaaacgcaccaaatgttaattaaaagttaaataaggctctctgatgctttttctatcaaaagggagatgaataaaatttttaaaaatttttaatccctttttaaacaggccaaaaagtttaggcttatattttaaaaagtttcatcgaacctagcgcactaaaatcgatataatctctccaaattttgcaggccttctccattgtaaaggactaacttaacctgaaaaaatgccacgcttgttgtttttaaaatttttcgaaattctgactttttcattaattatttattttttgcaaaattaattcataagtattttttcagaaagtgctctgaaacacacaaaactttatttacaggttaattaaggctctctgatgctttttctatcaaaagggagatgaataaatattttaaaaatttttaattcctttttaaacaggccaaaaagattaggcttatattttaaaaagtttcatcgaacctagcgcactaaaatcgatataatctctccaaattttgcaggccttctccattgtaaaggactaacttaacttgaaaaaatgccaacgcttgttgtttttaaatttttcgaaat

SEQ ID NO: 3644 - DNA, 4855 bp, Heterodera glycines
aggttcatgtaggagaatttcgcgtggaaatatgtgcaatatagcgttgacttcctcgtcattcctgtcagggattgtgtccttagagctcgagaagctcacctggcccttgacgtagtcgaacattgtgctatatgcgttcaggaaatgagtgccaaggacccaatgatggaattgaatcatcggtcatcagtacaatgaacataccgtattttctttatattatcgctacgtattcaataattacacagtctacagatatccctcccacctttctgaggagattgaaaaataatccccccccccccccggggtgataattagaaaaaatccggtagattggttgtgaaaatgcataaagtggaagtgccaaaaagtctttcagggatcagccaatcctgggaataaatgagttaacaatggcacaatgagcacagatttacgcaaaaatgccaaagtgaaagggccgaaaagttttatagaccagtcccaatcctggaattgaatgaatcaacagctcaatcagcacagattggggtgaaaatgccaaagtggaagtgccaaagaaaattctaaatgttttaccgtcgtgaatccgacgccatattggccaaacagcccaagggcacattttccatccggcagattcaactattgattaattaattcattaaaattggttatttaaaatcaaatttcacacacacatcaattatatattcctccgctggcaccacaatgtctttcccattaactttcagcacaattgaggccaatttgggtcgttggtcacatggaacagtgtacaggttgtcctcctcgcagtaatcagcatttgtggcagcaactcaaaaggattaaaaattgaattttattaaaaaattccattggggcgatgggatttttgggtgcttaaaagcttcatttgatggctttttttttataacggctcagcacagtacaagttatcctagtacgaaatcccgagctagaattagtgcccggagctctctctcctctctctctctctcctctctctctctctttactaaactttctcgtctcttctgattatcgtgtttgccagcagaacccactcactgatcatttccatcagatgaactggtccaccgatcagcgccgtgcccgtgtccaccgcagcagtatagtcacgatatgaacgatatttgccgatctggaacctgaaagatttccaaaaaaaaatttttgaggaattttcgagatcgctaatcacgagaatccggaatgcgtttattctttatttttttgccaaaaagggcggaccaaccacaatacctattaccaaattttggtcccaagacacctgcccactcccctgtcttaatcggtcatcatatatcttttggtctccacccgggtaaatcaatttggattctcacccatccactcgaaatgtccagctgttccatcgagatataagtggaacattatgccatggtccagaacagtggtcattgtccggaccaccaattgtcatgaagccaccggagccgcccagttcagcaggacgacgccttaagaaatgttttgcaattttttgttattttttcgaactgcgctggttggtttccgaccatttcagtgccaaaaattatttaaataaataaaattatttttcaatgtgcaatattcaaatttttaaacaaaacaattattaaaagagaaataaatccaaaaccaaaagtgccgtgaaaagagatcgtcaattatgtaattgaaaaatagaaaatctttaaatttgttgcatcataatttttgctcaccagtccgaccatatagtgaagacgggctggtcaagctggtccagcatgttcatcaacggaggcttatggcccaaaatcattgggtcgtagggccacgctaagcccaaaacgccatccaaagggaaattggcccactgatgctcgataaagtcgaccaaaagaatgccttggttgtcaaaatgcaacggctctatctgaatgattgtggcactagttgcaaatggttgctatgacgaagaacgaaaaataaatgcaattgatcaaattaaaattcaaatatttatttgaattaaaatttaatagtaattatattatttaaatattagttacattaaaacttttttcatttttattgataataacggaaaaaattttttttttagaaatttaggcttttccacaattgaccaaaacacagttaaaatggtgaataagcattcctaagctgaaatttatcccaaaatatttggaatcatcgattgtacctcgattttcgaattctaccaaaaaaacgagttgagtttttaccaaaataaaaatgaaatacaaaagaaaataatttgaaaaaaaagaaaattaaaaacgggcattttataacaagcgacactttgttaacaaaatttaggggtgactttattttcaggggcgcaaatttttgaaatacggtatctacagtatgtcgaatatttttaattaaatcatgtaaatcatttgaatttataattaatttatttgtttaaacaaattcaaatacctgaaggagttctcgatggaaatagcctttgttccgttccttttgccacggttctgttatgcaaaattaaaaaatttaattagactcccaaaaacactgcaggcctagaaattatttcaaaaaaaaaatttaaaaaaaactccaaaatatgtgtaagaaatttgtacaaaaacccccaaatatttaccattttttttaataaactttttatagaaaaaattcatagaaaaaattgaataagaaaaaaatacagtaaaaggaaactaattaggcttatttgttaattttttttatctttcttttttagaaaaaatctaatttttggggtcattttcaaaaaaaatttacattctcataagaaatttatataaattcgcaaaaatatatgaaaaaaatgcgaaaaaatcgaaaatatatagaaaaatattgtatacacattatctaaaatggtgaaaaatcccaaaatatgtagaatattttaaatgaaagtctcaattttttattcggaacaaaatttccaactattcaaagaatatttacatgaaaatttcaagccctaattattattatcaaaattgttttgttttttcttatttaatgagacttttctcgactcgatgcccatcacctgctgcttctatgtcatccatacaattatgacatggtatggttaatttgtctccactcccatgaaggcttgtcgatttgcttgaatttaataatagttttttcgatgaaaaatatgttgcataaatgggcaaaattttttttttttaaatttgggtgtcaacatttcgggttttttcgtattattaaatatttcggcattttcgcatttttagataaatataaattcatacgatagtcatacttttaaaacaattgccattgtttttctctattagagataacgtttcaaggccccaaaatttcataaagcggaattccgactcaaaaaatgttcttggaaatcagaagttggaaatttcggaaaacctaaaaaaattatttgagttttaataggcgaacgcaaataatttgtcgcttaattatgttctaaaaaaaacttttgaaaatttgttcaaaaaaattgctattaaacacaatttttgcaccataaaaaccaaattttcagagcagtgcaacagtgcccgcccagcacagacctggcgttaaagcaatgcttttcatattcccaatccttggcatagtgacaattttggtctgtgcatcggcagtcaattacccaaaagaaggggtagcaggtgtcaagcgccacttgcagctgctgcgctaaatcactgataatgtaaggactattcgacgccatttccctcatttgctaattcccattagccattaccaaaagaagccgggaattttgaaaaagtcgggattcgggatttgaacaaggccatggatagaaagggttactgggattgaaatccccgttcgctgcttgatcattcctgctgatagtcgagacttatttactaaaatctcgtggataatcggtgtatcaaaatcaagttaatccctatgatcaaaatctcatggcggaatttcaaattttcgctcccccaaaacggcgtaatttgcgtaagccgtaattgcgccatgccctggttggatggaatacaatacaaaccttgcgattttcccactagacagggcggatgcatcaggtataattaattaagtggttaaatctctcacttaatttaattactcctcaaaattgtacggtaattaccgtacattgaaagtaagccaaacccccaacaacatacgtggcgtgccaactgtgatgttagcaaggtagaagccacggtagtagtactcttcactgtcatcctccgcgtccaacgcagtgaaacggtcaacctcctctaaccatttgccgctgtgcaaaagccggctgcgcaatgatccggtgaccgtaatgggcagtcgatggaccaggcaaatacagtaggtgggccaccataagaaaacacagagcaaaaacagtcgcatgggattactgtaggggaggtttgaaaggtgctgctatgtcgttacttaaaaaaccatcattatgatttgatgaaaaattatttataacttagctgaaaatcaaccgaatttttaattcttgatatgattcgatagcccttagtgttctctataagtctacaaaatttcaaaaaattttgttaagtttcaaaaaagttatggctagaggaactcaaaaaaccttgattttcgagcattaatcgagcatctttggccctaactcttttgaagcttgatgaaa

SEQ ID NO: 3645 - DNA, 4523 bp, Heterodera glycines
ggaacacaaaaatccttgcatttcgagaattgttcgagcatctttgtccctaactcttttgaagcttgatgaaattttttgaaattttgtagactgatagagtacacttagggctatcgaatcatatcaagaaaaaaaaattcggttgattttcagctaagttataaataatttttcatcaaatcataatgatggttttttaagtaacgacatagcaccccgtttgaaattttcaaatgtgaaagcaactacggtaagttgggatggttttactgttatttgaaagagtcgataaatgtatttagaaattaaaaatggaaattttaatccttcaaatatttttctattatgtcatttttattttttctatttgtttttttactttagtttttctagaataaaaataataatccttcaactattttttttatttaatttaaataaatttttttatttatgagaaatttttcattaaaataaaaatggacaaaaataatttgtttataaaaattttttactttagctttttctataataaaaaagaataacaaaagcttttcgtcgaagctgccaattttaaaatgaaaatctcttgagataattggatgccattcttataattggggctgctgttgttacatttttggcacaaagtattataacgtgttcaaattccccagcgaggtttcattttcggcacaacggcaaacatttggttgcagtaaattatttaaacaatgcccttattattttgaattattacaattattattagaatagtagtagccacaaagataaataaaaaaatgacatcataatatttttaatatatttcttaatcgaattttgctgctagataatttcaaaatttaaattcatccattcttcttttaagtaaaaattttatatttaactcaatttcattttaattacttaatgtttttaattttacatatcattattttattttttaaaataatttttatttcaacaattcaaagtataaagatgataaacttaaaataaaaattgctaaagctgtcaaaaacagattctctttgcactaaaatatgcaaattgcctaaaaatgcctccagacacgcataaattttctaatggaaggcatttgacaaagcaaaaaattgaatttatgtgttaacaagctttttttatactaaaattgctagaataaattaatataaatatgttttttgctttatatttttaataatttaaaaatattttattttgaaaaataaatttgtaaatattaaaacaattttttagcaatgagcagtgcaccacaacaccatgcttcatcgcatgaacaacatcaaccacatgccaacggcagcatttttcaaagtacacgcgaataaataatttgtaaaaaattattcgacataatgccaagccaaaactggacaaaaaaacattttatcttattttttattccgcaatctcggctctcgggattatttaccggtctcgatcagtagaaattttcgaaaagctctgtttgtttagacccaacgccattcctggactccgcttcactgctggtgtttgccggtgctcttctgttaccgtaggattgagatcaaacaaaattattgattaaataccttaaaactgattaaaataaattaattaaaattgcttttacattcaaacaatcaccacagttctctcttctacatggccgtcttaattttggtctgttgtcagtgccctgagcgacaacgccaacggcaccaacaacgtgaacaacaacaacggcaaaaacgacgattgaccgggtcggccggtaataaaaatggaattcaaaaatttcggggcggattttcaagatcccgtcccgtaattcctgtctcaacataaaaggggcatcatgtgtcagcaaatttttaattaccgtattcccgaaaacagggcccctcagggtgctttattttttaacccccctcggtcctctaatttagtggctgatttacatgatcccgtcccgtaattccggtctcgataaaaggagtcatatgtcagcgaacttttaattaccgtatttcttaaaatatagccagctcggggtggtttatttttcaaccccctaggtccattaattttgggggtttccttttttttaggaaatgcggtattaaatatttttttaatttagtggaaatagttgaatctaaagcaacgacaatttcgacatcttctgcctcctcaaatgtggatgttgaacttcaagcaaatgaacaacaaatggggaaagaaattgctgagcataaattttaaagaaaaatttaaaaattgaaactgccttattttttttaataatgctaatattaattaaagcggttatttttcaacgaaatatttaattcattttaataaacaattgatcaaaatgttaaaagtttgagctgttgttctccagttccaaaaattaccatctgatggctgtagttccgcagctgaataaacacaaataatttttaattatttaaattattattaatatttaccacaatttcgtcattttgtccatcaattgcgctcactgaacgcccttcacaatcccttgtccccaccgttccgtcgtccattgaccgaatgacgaaaattcgtgtggttgcctcataaccaaccctttaatttaaaatattttaaatttaaattttctcaattttgtggccctatttgggtttttaataataaatcctgccgattttttcggcttatgtaaatttaaaaaatagttttctaaaatgaaaattcctactttgaattaatgtcatctaaaaattgggaatggcatcgcatgccattgacaggattgcacggcattgcccactcaaaaagtcggcacaaatggacagcttcacggttggcaccgccaacgccgatgaatgtatgcaccaaatgggttaatggtgggcccaattgttcttcgtcccatactgtagccaataatatccacttgagatgaatgagtaaattgtgtgattgcacgaatcattatgcgaatctgaattgtgtggtaattattttcgaagagaaaaatcgattaaaataaaatattaattttttaattagttaattaaatttttatttttaaaattaaactgtgattaatttaattattttattataatgccttcattagacacctactgaggtaattgttttcaaggaataaatcgaataaaataaatttaataattatttatttcgacgaataaaatgatcaaaatacaaattaatttttattatttaaattaatatatttttattttaaaattaaactgtcattaatttaactattttaatgcgtatttagacagacaccattttcacatgatcacatttcattgcatcacgtagccatttccatcccttcataccgtaaccgtaagtggtcgcgtacaattcgctgtcacggtagccgcctttttcgcggaacagtcgccgaacgtagtccaactctcccgctaaatttgttaagccgtgcacaaaaattacaggacgttttcttaaaaatttgaaattggcttcaataggctaattattgaatttaattttgaaaaaaaattaattaatttataatttacatactttgccttaattcgcccttttccaccgccaaaacttccgtcagtgcccaaatctctgcgtgcaatgttcttctccacctcatcattgaagtaattcgtagaaattgtgaaaatgccgtagaaatagtgccatttgtgggaggaaaagtgccaaaaaacagaagcaggaattgacaaattgcgacaaaaagtgccaaattcatttgctatgattttttaatattgggatatttaatattaaacgactaattattcttctaattaattgcttcacgttaattagctagccaaaggatactttgtaaagatcaaaaaatagtattgaataaacaaaaacggttaattaccaaatattgagtgtctgatcaaaactgattaaaactacttctttttgaaagaccattgatagtctaaatcattaattataaataaatgattaaatagcataattaatgacaactcagagcaatgaagaggaaaaatttgttggttggataatttgaggttcattgaaaattttttttttaagacttaacaaaggcttggttctaaccagacaccgatactgattagatttttgagaatttatcagttcaagccaactatcattgaataaaacttgacaaataagcaataatgcatgtataatttgacctgatcaaaaaatttttttttctttgatcacaaaatgtatttgatttgtttgattgtcatttttaataacaataaaaactttccaatgtgattattattattattattttattatttatgaatggcgaaaagcagcattattttatttatttagtaaaacacacattgatggtctatgtatgtaccatcaatcccaaacgccaaaaagacaaattgccaacccggtttttatagtctgaagaatgccaaaat

SEQ ID NO: 3646 - DNA, 1132 bp, Heterodera glycines
  misc_feature (66)..(66): n is a, c, g, or t
ccaacccggttttttatagtctgaagaatgccaaaatgtcaaataaacgaggcaatgatggaacanaattgaaatcacataaaaatttgaaaagatcaatcggtgccaatgcgacacttcgccaagcatttctccttcgtttcgaagcgattttcgttgccgccacatgtctgcgcaccaaacggataacattgagcggtgaccgcgtcaaaatagtagcgcgtcagcaacggtgttgacgcgtgtcgcagttgcgaagcgtcgtcgtcgtcgtcaccgtccgcaagcccctcgcctacggtagcgcgcgaatcgtctactgtagcagccgccactttgatgtgatcagtgtccgttgtccgatttgtcgccggcgggcacatgccggattctgttgattggatttttgcatatgtacataattaaaattccaaattgagtgcaaaattttcttaaaaatcgttaaataaagtattaactttgaagaaaaccaagtaaaagtcaaaattttccatttttggcttattttaaataaatttcttatttttgaaagtttaaatgaccaattagttaaatgtctgaactgagctaattaataggatgattgactaattatgaaatgccatactgaaacttgcctggaggcaagtaacaaatgcttggataatgggaaatggcctcgaagattggcggcccggcagccttggggatccgtcattatggggaagcagtagcagaacaagcacagcaatccttctcaacaaaaatgatgctgctgatgaggaatgtccaaattggcgatgtgttattatgggaaagttattctgataagctgataatgccattctaaatattcaaaattgttatagctcataattttcattattacagtaatttgaggagttgaaattgtatatttcttttaaatattttggaaaatttcaaaaaaagaaatttcggaaatttaacgccgataaagaaataaaattgaataaaaaataaatattggtaaatcattgctcaaaacatgttaggttggtggataataactatttcgattcatttaacccatgattttgcgctgatcaaaacaggctctgctgtccaatttttggatggatcaaaatccgaa

SEQ ID NO: 3647 - DNA, 1918 bp, Heterodera glycines
taatttttgttaaaataacatttttactaatttttaactttccgtcgaaatattgtacaattggcccagcaacatttcggaagcgtcgtccagcagatcgaatcggtcctcttccatcatttccattgagtcgggcgtcttctccttggactccgattcgtccgaacattccgtcattttgggcgacgacgacacttccattcccattgaatacgttgatgaacaatggcacgattgcgacgattcatttgtcccggttgaacttgttgatgatctcccaaacgaaatgccggactttacaaacgaaattgagacactgaaaaagcctcaaaactcgccgccaaaagagaaaaaaaaagtgggaaaggcaaagaaacaaaacgccaaaggatgcagcaactcaatttcgaaattattcaaaacgaaattcaaaaatatgttgaagtcgccgaaaaagaccaatgggagcagcagcagcaaaacaagcgaaacacaaaacatggccaatcagcagaagcaggaggaactgcagccgctaacttcatatttgttggatcagaaattaaatggacaggtaaaaatgggggcaaattaatacaataatgtagaaaattgggtaattggtcagggatacggtataacaattagtagaggaatgacagacgccgatcgaaattcccggccaacaaatcttttatccctcaaatataccaacattagagcgcggatttgacggcatatgccattttctgctaacttcttacgaattaaaatgcaataaaaactattaacacccttaaaaatcgaccgaaaattttcaaaatgatccccaaaaaatctaattttttaaagctttttctcattttttaaaaaaatatttacaaattttgcatttatttttatttttttactttggtcccagaaagttgtttctcataatcttttaagaaaaatgccgtaattacggaatgtgtaattgcgtccagtcctgagcccgattaaaatatattcactgataaatggctaacaaaatccttccgaaagttgaaaagttaatatcgctaagtgtttgttctcttcaaagggcacttcgtttggcggcggaagttttgccgattaccgcgactcggacgaaagtgtgccgtcagtaataattgtcgacacggagcaagagaaggccgactgtccgaaggaaatggaagaaaattggggcccaattcctttctcggcattgttacggcgatcggatgaggacaaatgccgaaccgtgcaagttttgcggcagaaattcgaagtggtgcccaactttttagacgaggccatcgaagtgagtggaatgaaaaatgaagcaaattccggcatttatttatacttttttttgcgtattcagacaattatgggggccgagtcggagggcgaaattccgtcggtgatcaatttgcgattgggcaaccaaatttcgttcaaaaaacagagaattttgaggggcaaaacgaacaaaggtagtcagtcaacagggcaggagcgcggacagaaaaatcccgcggttcgcgcatcgcggattcaatttgccgcggtcgcggatcgcaccaaaaaattgccgtgaatcgcggtcgcgcatttgtcaaaatttttaaaccattaaaatttttgttttaaattttcttatataaaaattaattaaaatcccggtgtatacaatatttgggaagggactgaatgggcggaggaggggtgggtcagtgtctaaatttgcgaaggggttccagtcatgcaaactctatgatttttttttttttgcttttcaaactgctttttttaggcgcgctttttctaaaaattcatgaggaaaagggggggtcaggcggtgccgataggcaccatcgggaaaaatttttgaaaatttgagtgcaacttg

SEQ ID NO: 3648 - DNA, 4591 bp, Heterodera glycines
  misc_feature (48)..(48): n is a, c, g, or t
  misc_feature (60)..(60): n is a, c, g, or t
aaatgtttctattattttaaagagattttatgacaattctttattttntgctaaattatntatttatttttgttaagaaaccgaatttttttgtcgtttagtgacacattaatgtgattcatcatgtgcaatgttcattcttttgacaatattttcgagaaaagattgattcatcaacgccttttagcttcttcacaatccattaaaaattatgcgaatttccccaatcttttcatgatttctgacagttttattttattgcatatttaaaaaacaaattccgaataaaaaacattctttttcaatgtttgctcttctttaatttgcttttgattctgcatatttttttttacaaaaatgcgattgaatttaaatttattttacaaaaattattgcgaaatcaatcactttctgatcatttaaatttatcatgccaaattattttttacaattagaaagtccaattgaatgaccatctcttataatttggacatttcttcctcaaatgcgttcacttttcttcgaattgtgttcagatggcgcggctctgtgtggaaatcggttggttggcctatttttgcttttcgggagtgatcggacaatccctaacacccacaactgatcaaccattgatctgttggtcattccaaaaatgttgcactataaatttatggttcaattctccttttgattacaacgttaaatccaaaattaatgtgtcgttaatggagtaattaattaattacgtcatttggaattttccattgtttctctgcccttttttagtctctccaaatttgagcaatgcttttcaggtgttcaacgaatttgtggcttggactgttctttattattcggtttttatgctctaccgttccgcactgccaccatacgcacaattggcattcgaagagatcggacggcacattgacgagagagtgtcccttttgcctattacatttatgtgcgaaaattaattaaaaattgaaatatacattggaaaactattaaaatagcgaaaattaattaaaaattgaaatatacattggaagactattaaaatagcgaaaattagtttaaaatataattattaaggcttggctttttcgtgacaattgttttcgaccggtaaaaccttttttattaattacagacaaataattcgttattttctgccttttctcagatggaagcaaatctttcaaaatattggcttcgtcgatagccctgcatttttcattggcacttatatccgtggtgacagcccccaaataagggcaattaggaggaacataattaggtaattaggcagcaaatgaatgggtgagccaggggcaatgaagctaacaataatatatttttaaactccttgcaatttaaaaggtatttgtgtttgacccaagtgctcgtcctccgcgacatttccatccaagtccgaaagcgttttccaaacatggagtcactggttgactccgaactgatccaagtcagtcgaacgacaaacattgatcaaaatggaatcatccgattcgaatgcaaattaattaagctaccagaattggacctaatggaaaatgtgaaaagcgaattcccaaaatattggatgccaattaattggtcggtcaatcattatttatgctaacaaaaccgatgattaacattttgaaggatattttcactttgctatgagctgcgccaaaaagggaacattgagtcggacctgcagatgaacatcattttgcaggagtgcaagctgtacagagaagtgcttctttcttcccattagcacttaattacccataattaataaatttatgtgtctgtgaattcagaaactgcaaaatttgtgcaattacgattgggtccccgtcccattgggtcattttacacattttaattaagtgtaaatttgcttgctctgttcagcttatccccaggtggtgtttctcgccgtgcgcatttactttttgctctgtctgatcgcccgtcaataccgtgtccacgaaaatgcggaagaacagaaccaagtggacagagtcattccgctaatgacagtgcgcgaaattctatgccaaattaaatttaattaggtaacaatttcagatgctgcaactgattttcgtgatgggatggctcaaagtggcggaggtaaaaatggaaaagcattaattttaatgtttttattttcgtttttaatttaaggcactgttaaaccctctgggcgaagacgacgacgattttgaatgtttaaaattattattattatttataatatgtaaaatgactgataccccattaggcaattacataattgaccggaacattggcattttcctgacaatggtcgacgagtgttacgatcagaaaccgccccaatgggcaggtgaaaggacacttggaattttcaatatttttaaataaataacaattttaaagaaagcacaaacttaaaaaacacgaagaagcccctctacgcggagaattgcgcgctttacacccaaaatccgctcgtcggctccgcaactttgtgccatttgccaggggaaagtgatcgcgtccgaatggtccaacggcggccgagtggtaaaaaaaagcaattaattaagggcctaattagaatttgtgtacaattttttttcgagatatgggcaggcgtcacagcagcaatttcccctcccaacgtccctatttgatctctccgaagagacttcgttttcgccattcgttgccaattcgtcccgccgaattggtgctttttgtacataagtgtgagcagcaggtgctttcccgttgtacaacagaacaaggcaaaaaatattgcttttaatgtcaaaaatttaatgtaaatttaatgtttttttgtgttttattccaaattatttttttggcgcctaaaaatgctaatgatcggccattattatttagtaataataatactaatacaccgaaacaaattcaccataaaaaattttataaagccggcatcgaatcttttagcttgtttgaagaagcaatatttgctctgctcgagtcccacaactgaaaagtgcccgttgctaatcttatttaacaaattgtgccattttaatttttttaaatatttatttttagccaattattatttcgagtggactgtacgaaaatgatattgtcaaatcagcagaaaatgtaaaaaaaaacggagaaaaaaatatttgaacaaaacattttgccattttagcagggcatttcgtcgccgtgtccgtcctcggccgaagtgccgcgccatttggacacagtgaaagaggacgaagaggtggaaacggcaaatgacatcgcaacggaggaaaacggcacaaagggaaggggcgactgagcgactgatggaaaaagaaattttaaaaagccgaaataaaataattgagaaaaattagacttttatcattagctgattaaccattcttttcccatttgccctttttgacaaattctgaggcaacaaattaaataattgatgaagaaatcattcattaatcctttctttctctgtcaaatgttcacttttattcattccgcagttttgtcaccccacaaattttgtacattaattgcataataattattagcgagcaaatgttttttgctgttcattgaaagctcatttaaattcaatgattaaatgacttttgattttttgtttttaattgtgatttatccataattcatcacataaattaaagaaaaaccagtcagtctcagcagctctcacaattacccacagttttttttaattgaatttgccatttggcacatgagaatactatttaataattaaaaaaataaacaacgaaaaataaaataacaataacatagtttttaattagaaaattaaaatttattttcattaatgagataagtctaatcaaaaatgatcacaaaaaacaaaaaaaatgccgtgaaatccgttggtttaacgaaatatattttatgaataatttttggtaaaagaatttaatattttttggaaaacattcgaattctcaagattcctttcacttgtttgcatcacaaattgcattgatcgtttattgaaaataaatttttagctgaaatacaaaaaaaatattttaaaagaaaataaaataatgaaaaataaaattataaattattcaaatatttaagctttaatctatgaaggaagcacaaaaaacaaaacaaaagtgccgtgaaattgtgttgttgtgcagcgcggcaaaaagcttggcggtgggcgtttggatggcgatgctctcgggtgcggtcggagccactgtgaccgcgcgggagattttgcctgctcccttgcgggcctgagccgttgctctcctcattgtgcgaccggcacagcccgggctcccccgggccgcccctgtcgacgcggcccttggtcgcgacacccaatcggcgcacgcccgccccccgcccgccttcgccccctactcgctgggtcacaagggcccgccacgaccctcggcggaggctacggaattaattgactttataagcgaagaattgggaagagaaaatgtctgtctctctcaccaaacacacactattaattgctttttcttcc

SEQ ID NO: 3649 - DNA, 1646 bp, Heterodera glycines
attctgtgaagagtttttctaataaaatatgaaaaaatatctattatttaactaaattcttataaagtaggggagaaaaaaatttaaacctttatttttttttatcttttttttacaaaatattgaaatgagaaaataaattttgtgcctattcttaaacaaaaataatttaaatgtaattcattttcttctcttcgtaattgggtccaaccaaaagtcaatctctctatattttatatgacttttgctatccaattaattaaacaaagttttttgtttgccatgcaaaaatttggtcgcaaattctgccgcctttctcccgggcaaccgaccgaccattccaaaagagcctcgcttcgtttgttggcttttccctcctccctcacccccttctctcatttgtttgcattcactgccatttatcaccttaatgaagagatccacgagcattcaatttgatcacaaatccgccgatcattctcctcccgctccggcgacgatcgccgccggagagagtcgaaacagcggcaacagatcgcctcatcagcctccgcccgcaacggcgcccattccaatgaacctgtcaactgcaagtttcgtgccgctagcgccggcaccaacggcgggtgtacccccggggcgtctctacccgaccattgcgccaccggggaccgtcgcggtacaatcgacgccggacagtcactttcacagtgagtcaaatttaaaaaattaattcatttaatatgggtccaaaggcgataattaacacaaaaaggctggtaatggcatttcaaaaaagcctaaattgacgggtgaaagttcgagactcaaaaagtcattattattactaattgaggctaaacatgggttggacagctgaacaaaaaatttgtttaagcattgcgcgagtcgcttgagaatccgccacttccaccgattgatcagcaaccgtttgccaaccaatcgcaacaacaacagccacttccttttccgacaatcgctccgccgccgtactacgatcactttgctggaccagccaacggtgtcggtagcattggtgtacggtatttagtgcacggaccgtcacaaacgcacgaagttcactccgtgcacgcagtgccaagtggaaatgccggcgcagcaaggggaggtgggagacaggcgaagtcatgagattaaagaagaaattcaaattcaattaatcttttaattggtaatttcgtttttcccgtgccattcagagacggtgttttactacgtctcctcctcctcttccgccgccaatttccatcggcgccctttgccccgccttttttctccccacccgcgccgtctcagtttcacttcgatggccattttcacagtgattgccatcatcatcatgttcttctccttcaaaatgcactccaaattcagtcaacagtttcaacaaaggcacaacgcccacgacaattcattggcattgccagaacaaaacaatggggagaaacaatgacagaaaaaggggtgctaattgaattccaaatggcattctcgagactcaagtgcttcccggaaaccgagtccgtcaaaacaaaacaaacaatcgaggatgagaggtttgacacttctaaccttcgattatgccacttattacattaaaatat

SEQ ID NO: 3650 - DNA, 1887 bp, Heterodera glycines
acattttaaaatttaatttttgttattgtatttttaggggtatatttcaaaaaaaaaaagttttttaatttttcacaacaaatttctataaattttcaaaaattctcagaataggatgtaaaaaaatgaaaaatttgccgaaattttggattttttttgaggatttccaaaaatttccttaaaaaatcctcaaaatatgttaaaaaatgaaaatatgtaagaaaaagtccaaaatatgtacaaaaatatgtataaaattaagaaatatgtaaaaatatgtaaatagaagtcccgatttttgttcgcaaacacagaaaagaaagtgtttttcctactatttagagcacggagaatccaggaaaaaaaataatcgagcacagaattgcaaaaagtacggccaaaattatagcgggagcataagtgccacaagttgagctaagattttcctcaaattgagctgcgccacaatttaaaaattttttgcgctagaggaactcgcacaaataggagttgatgattaaaaaaaataatttatatgccccaaaacggaaaagtaccgtactggtgtaccgtacatctatacaaagataaggtaaaaatactttttgaaactgaatttttcgatgaaatctttttgaaatttataatttttttgagaacgtcgtgaaggggtgcccctgtaaaatgtttctatttatttaaattgaacaattaatttttagaatcaaatgacctggtgctgtacgaacagaattagggaaatgaccaaatttgcaaataacaataaggaaattgagatgaaaagcaaagggcgtctgccaattcggtcgacaaaaagcgaagcaaaaattaaggaaaacttaaaaattgtaaatttaaaaattaaattagttatgtataaaatgcttaccaagccgaaaatttgaatgccaatgtaaacgaaggaagaggacaaagcggagaagcccattgtctgttgtaacacttccacgatgtaagcatcgatcactaattgcaagacaaatttggcaataaaaacaattaaaaagttggccaataaatgcccaccgctgatgccacaaaatgccatgcaaatgcttaggaaaatgccaatccaaaggcccctcgctgtgccgatgctttgcttctctctcaaaacttcgagcattcccatggcatttgaacgttttgtttgttcagtgcgaaatccatccaaaatggcattggcacttttattttgtccccagtaaaatttggcggcgtcggcggctttgtcgtgctggtcgtggaacagtagaaaactgaaaaatttaaaattttgcaattatttaaattggaagcattccggcctcgggctttcatgaagcgtaagcattgtgacggtgaccgcaattagcacgagtgcctccagcagaaaaagcatccaccaatgcgattgatcaccgagcaattcgggcattgccaaaagagcgccgacgatgcaaccgaattggatcattatgcctaatgaacggataattaaaaatgtaattcgattagtgaaggccttcttgatcagaccagtgatcattccaattccgcctcgacattgcactgggcttaaaaatgttcaggaaaatattagcaaatacggtaattgtttgttcgacctgcactcgattaggaaaactgaactgatgccaatgccaattgtgacaaaaagtccgagaatgaagcgactcgcaacgaaaagttcgatgctatttaactggaaaagagcataagtgaaagtgatcatttattaaacaatcattttttcaattacaaatttcgaaacggatgccaaaagggcacagaatgcaatggccgcgttagacaaacaatgccaaactttctgccaaaattgtc

SEQ ID NO: 3651 - DNA, 2325 bp, Heterodera glycines
  misc_feature (2238)..(2238): n is a, c, g, or t
tttggggcatacttttgtacggcaaatttttgaacaaaacagttgactttccaattggttaatctcttggatatgtgaaaagaagagttccccgcccccgaaaaagaaaaaaaagaaatgtcgtgatgccgatggttggattctgtgtctcattcacgttgtcaatacttgaagttgttaatctttacatgcataaaaatgaggacgcttttgagtaaataaaagcaaaaaattgtttgaaatcgggttagggattcgaaataggtcgaaatgaatgttcggcacatatccgacccgaccaaattcagtcttaaataggcactcacgcgaaaacgtactccacgcgaaaacgaaggaaatcagtacattttcctagccatagacagtttttcaaaatgggtaatggcaaaggcaatttccgaccaacgtgcggaaaggtggccgagacattcatagaaattgcaattcaccaacattctacaccagaaacagtggtcacagaccagggaaggcaatttatttcacaaattttcggaaatttgacaaaaatttatggatttgaacatattatgtccactgcttatcatcagcagtcaaatggaatggccgaaggttctatgagaatattggcaaatataatttccacgacaataaatgcacaaggggacaattgggatgaaatattaagtcatgcaatttttacttataataaatacatcagtgcatacggcaacaaaatattcaccctattttatcatttatttgcgtgaaccccgactacccaccgatcaaattttgaaattgccctcaagtaatgaatttttgtcggacatttccgtttgtacacgaaaatacactgagaaggcatcaattgcatggaaaattgtaagggaagaaattttgaaagcccaggagaaaaacaaagctgaaaatgaccaaataaggaaagcaaatttcagaaatttgaaatggcccacttaccactgataaaaaaggaagtacttaaacataatttgaccaacaaatgtacagagtacatataatcaatttagtgcacattcaaagaatacccgaaatttgggtttcccataaagaaaatgtggaacgaagaatgagtgacaatgaaaatagcagaacagcagctggactttgataattatgttgcatttaattaaatttttctattttctaataacaaaaaattaataatcaaaatataaagcaaaattaaatttaattgggggcgatccctttaatgccaacacttatccccttccccactcttccccacgatcagtctctgtcccgactgcgaatcgggaataggcggaccatccaattatataatactcttgaataaatgattgttaacaccaccgctaccaatttgggaatgataatggacccgcctggacgcacagtattcaaacccaaaaaaatatttcaaattattaaattaataacaatatattagggttcgagcctcgtggggcgggggtggcttttcgcgggggcgggggttgcgggggtcagagtcgcgggggcggtgacgggggcacgataatccgccccgcgggggcgggggtttgctttgaattagctccaaaaaatctcacaaaaaaattaattttatgaatgatgtgttgcctccacatccctttagtcgatgtatgcctcgattcaattcttttggcataaattacacagattttgtctaaagaatgaccaaatttagggatttttgggtaattttttaagaaaaaaaggtttttttggggggccggcgtgccgataggggctaattttaaatttatttctaacagataaaaacttgatgaatgtgcgaggagaggtccggcggtgccgataggcgccgccggggggaaattttaagaatttatatgaattttgttagaacttagccaaatttttcagaaattttcctcttttagatgaaaataaggccttacccccaaatcagaacatttcttagaaacaagaacataaagaaacactgtattaatcagaaaaaaataaataaatttaaggaaaacgtcaaccggtgctgaactcataacaaaaagtgttgttaatgttgaagcactaaccagtaatccacaaatttatttaaaaacgaaaataaaatttagttgtttcataaaatttgttaagatggttaaaaaaattcaaaattgtataaattttttgccttatttcccacgaatatgccattcttanggggtgtattttcacccccgcggggggtgaagggtcgcggggggcgggggatgcggggtgtctgagtcacgggggcggggggggggg

SEQ ID NO: 3652 - DNA, 1532 bp, Heterodera glycines
ttttggggggccggcgtgccgataggggctaattttatttttatttctaacagataaaaacttgatgaatgtgcgaggagaggtccggcggtgccgataggcgccgccggggggaaattttaagaatttatatgaattttgttagaacttagccaaaattttcagaaattttcctcttttagatgaaaataaggcattacccccaaatcagaacatttcttagaaagaaacactgtattaatcagaaaaaaataaataaatttaaggaaaacgtcaaccggtgctgaactcataacaaaaagtgttgttaatgttgaagcactaatcagtatccacaaatttatttaaaaacgaaaataaaatttagttgtttcataaaatttgttaagatggttaaaaaaattcaaaattgtataaattttttgccttatttcccacgaatatgccattcttaggggtgtatttctgagtcacgggggcgggggcgggggtgaggccaaaaacctgtcccgcccccggcgggggtgacgggggcggggctagaatcctacaattattatcaaaaatattcgctacataaataaactttataataaccatttatgtgcagagccgaagctacactatttaatatctaattacagcaaaatgtttttcatattttgcgctcaaattcgtgttcgatagagtcgcgtttctacataaaaaaaaaaccaatttccattcaatattttcattaaattttttttgtccaaattaccaaattcttaaattttcggtaaatattgatcatatggcccagagccgaaaatggtcgaaatatgtaccatcgatagctctcggtctgtaatggaagaatccgaaagaatttttttgcggcaaccaatccctgaagagttacagacccgggactgaaatggccaaatgcctttgggactgaaacgtccactgacttaaaacacatggaattgctacaaaacacatataaatcgattcctcacggtctgctattcatgaatccgaaggaattttttttgataaaaaataaattggcaaaagttatgggtcctcaaaaacgtttaacctcttttaaccgctcagttaaaaaaaaatagcaaattcgtcaaatttgaaaattgaattttgcttattgcgctaaaaaaccgccgcacactcgactacggcgaccaggggccttatgctcgtctcgcggtttagtaaaccacggttaacgcattaaccacggtttcgttaaccgtggttaacgaccgaccttaaccggtatgctcgtctttaaccatggttaagtaaaccatggttaactcaaccgtggttaagagaatttatcttgaaattgaaaaataattaatattaaaaaatataattaaattattataataattattttttgtttatattatcaatattagcatagattttattaaaaaaaacccccgaaaaactattaaatcaagaattggttttctaaaattttttgccataacttttttaacacagcaattttttttttt

SEQ ID NO: 3653 - DNA, 2363 bp, Heterodera glycines
  misc_feature (2302)..(2302): n is a, c, g, or t
  misc_feature (2316)..(2316): n is a, c, g, or t
ttcagggatcggtttccgcaaaaaaatttttcggattcttccattacagaccgagagctatcgattggtatatgttttgaccattttgggtttgggccatatgatcaatattttccaaatttcttttttttgaaaaataatagacaaattcatagattttatctcaaattggtgaacacattgtgtctttcttctgtctgtctgtgtgtctgtctcttcatcttctgcactgtctgctgttcatgttctgctgttgctcatccacacttccatgccccgttttcgttgattcatcacatttctccccaccacttcgccgtcggcactttcattttcacgaatgttttgtgccaaattcgcctcctccgcccaataatggtgccaaagaaccaactttatgggcatcaatatattttgataaataattttacattattatttactattttttcaaatttaatagacccaggacatgttctgcggcttatatcggaccagaatcccactcaaatattgtatcccggaaacattatcccggtccgttctgtttccgaatttcggtcttgtttctaaattcaggctctaaataattttttatttttaactgtaaacatccagtttagcaaaactcctccaatgtaaatgcaaaaggcgattcccaacgcgttatcaacagatcgactcagtgcttcaagctaaacttaataaaataaataaagctttcatttttattttctataattaattatttgaaaaccatttttggagttgtggccattgtcaaaatggccattccaagcacataagttgattgcataaacagagctgaatgttatttctaattaatattgaattatacaaaaaataaatttgacaaattacctggccaataaagccaaattcgttttagcgataaaataagaacaatgagaaggacgaggagagcaagagaatgctcaacacacctcaaaaaaagaaatatttaaagaaaataattttgaaaatatatgtaaatttaaaatgcaccatgaaaagcggagatagccgccatccttaaaattgaaaaaatgtataaaaattaaaataatttttaatttgccaaataattcgcgacgcatttggacattttcaaaatgcgatgcatcaggccgaagtcaaaaatgaccaaatcgtaagccaaaaggcgctgttcagtggtggcatccgccgaaatattcgacttgcatttgaaacttaaaataattatttataatttgtaatattttttttgctttttccgccgcttacacatgcccaaattttgtccatgaataaacgtgctaaaatgagaaatgtttgaactgaaacaaagcattgaaaacaatttcaaacttgaaacaatgaagccaaaacgacgagaaattgggccaaaccgaacaaaaagcaaagggttcgattggacacgcgaaaacagctgaggaattgcgtgtggtgatcagaaatgttaagcaaataccaaaagcgcatttctaagaaaacgaaatgaccaaaaatattttttattttttcactaaaaatttgcgataattttaaaatgttaaaccaattgaaaagtttggaataggatgcgtttttctgtcacttttagcccagcaatttcttaatggcaagggaacactttgtcatgcttcacactttgttcagttggcactttttggtgctaaattgactttaatttgttgtggcatttgtcaatttaatttttcttcaccaaatctccgacgaaaataaaactcgaaaatctccccggattcttcctttactaatttcagcatattacaattacaaattgatcacccaaatttagggcagcaaagtctaatttgctgctatgtttgaagctaaaaaaggagaacttctcagtaagaaatgtttataaaatttcacatttaaatttagtaaaaattattaaaaagtaatattttttgtggcaaaaatctattcacaaatcctattctaaaatccaaacaattgatatttgtgggtaaaatccgttaataaattgcaataaaaatccataaatttccagacggttggacacactttccatttgaatttgtttattatgtcaaaactcaaaaagtaatttaaaaataactttcattgatggaatgtttcttaaataatgtttaatttaattttacttcttttttacttacaatggaaccacccgaactgtaagtcggaaaatgcatatgtgttatataccattggatagagcaagggtgacttctatttgtaattttaatatacgcccccatangaagaaaacaaaangtatgaggcctcaaaaacgaaattttaggcctacgggccgatttcca

SEQ ID NO: 3654 - DNA, 1681 bp, Heterodera glycines
tgctaaaatgagaaatgtttgaactgaaacaaagcattgaaaacaatttcaaacttgaaacaatgaagccaaaacgacgagaaattgggccaaaccgaacaaaaagcaaagggttcgattggacacgcgaaaacagctgaggaattgcgtgtggtgatcagaaatgttaagcaaataccaaaagcgcatttctaagaaaacgaaatgaccaaaaatattttttattttttcactaaaaatttgcgataattttaaaatgttaaaccaattgaaaagtttggaataggatgcgtttttctgtcacttttagcccagcaatttcttaatggcaagggaacactttgtcatgcttcacactttgttcagttggcactttttggtgctaaattgactttaatttgttgtggcatttgtcaatttaatttttcttcaccaaatctccgaaaataaaactcgaaatctccccggattcttcctttactaatttcagcatattacaatcacaaattgatcacccaaatttagggcagcaaagtctaatttgctgctatgtttgaagctaaaaaaggagaacttctcagtaagaaatgtttataaaatttcacatttaaatttagtaaaaattattaaaaagtaatattttttgtggcaaaaatctattcacaaatcctattctaaaatccaaacaattgatatatttgtgggtaaaatccgttaataaattgcaataaaaatccataaatttccagacggttggacacactttccatttgaatttgtttattatgtcaaaactcaaaaagtaatttaaaaataactttcattgatggaatgtttcttaaataatgttaaacttaattttacttcttttttacttacaatggaaccaaccacccgaactgtaagtcggaaaatgcatatgtgttatataccattggatagagcaaggttgacttctattgtaaatttttaatatacgcccccataggaagaaaccaaaagttatgaggcctcaaaaacgaaattttaggcctacgggccgatttccaaccattttcactttctattaattccaaacctttacattttattatattttttgcttatttttactaaagaagaactattatagtttttttttactctaaaaaatggttcttaaagtatttagttatattatacattaattaaaatgatttatttttatgttgtattttgaacccgagctcctaaaatgcgaatttaaccaactgagccaccaatttaaagcgaaaacaaagccaaaatttcagtttttgggatcccataactttttagtttctttctatgggcatgatattaaaaattcttaatagaaatcgaccctgctctatccaatgataccaaatttatatatgttttccgagttatagttcgggtggtttcccttgttagactttatgttttttccatttttgcaataattttcggttcgttcttattttccaatttaacctgaacttagttagaatttttcttttcatttccagttttctcagttttttctttaattaccttaaattttttgtgtcttctttctctgcttttcaattaatgtgttctttttcttttatgtattcctccattttcgtgttcttttttagtatttgtttgggggcactgatttccagagaagggattt

SEQ ID NO: 3655 - DNA, 3162 bp, Heterodera glycines
ctttctattaattccaaacctttacattttattatattttttgcttatttttactaaagaagaactattataggtttttttactctaaaaaaatggttcttaaagtatttagttatattatacattaattaaaattatttatttttatgttgtattttgaacccgagctcctaaaatgcgaatttaaccaactgagccaccaatttaaagcgaaaacaaagccaaaatttcactttttgggatcccataactttttagtttcttcctatgggcatgatattaaaaattcttaatagaaatcgaccctgctctatccaatgataccaaatttatatatgttttccgagttatagttcgggtggtttcccttgttagactttttgtttttctttatgttttttccatttttgcaataattttcggttcgttcttattttccaatttaacctgaacttagttagaatttttcttttcatttccagttttctcagttttttctttaattaccttaaattttttgtgtcttctttctctgcttttcaattaatgtgttctttttcttttatgtattcctccattttcgtgttcttttttagtatttttttgggggcactgatttccagagaagggattttaagacataagttttggcgcttctgcatgaacttttttaacggtctaaaaattcccaaaaatacaccccataaaataataaatttttcataaattatctcccaaaatttcatttttccaaataattttttatcatttttcttttttttcaaaaaaaaaaactagaataagtgctaatttttgtgcttttattccattttcatgcctttcttatgccttttttcacagtttccgtttctattttaggtgcagaaaatttcattcctaaaatctgcttttttgttagctttcgactgttcctttcgagacacagttctatgctgctcgagaaccttggctaaaaaatgatcgcactttattggaattttcgatttcgaatccgacctggaaaatgcgactggattttttgggttcattcgtgaaaaattttgatttccgattcggcactaacttttatgggtgtattttcattttctgcattgcggcggctttttcaaaacgtttttattttccgtttcttttattcataatgccaataaataacaatgtcaaaacttttcatgctaaattcaaatcccaatcagtcagtcccttaaacattcattcgtttatcgtgccaaatttggttgccaattgccctcagaaaggggcgcactgattgccggcccaaatagctgagatggttgttgtcgaaaaagttggccaactgaatttgctcatcaaatgccgcacatttgtccgtgcgcgcgtcacagaaatgttcggcgaggtcaaattggacacattttggacagttcaacagacggagacgggcataggaaaagcgatttgtgacgtaatgctcctaagaaaattggcagtgttttgtaaattggcacgggaaggcgaggattccccgacgagggcaaaacaatgaaaaaggaagtgccaaagagattaatggcaattaaaaaaataaaaaatattttttaaatcagtaaaatttagaaaacggaggcaacgattaacaagctttacccgaagcgatagttgcaggtcgccaagcggagcgtgttgccacaaccgtttggccaactctttggccacgtcatgtttgaattgcagtgttggggccgagacgaatattcggttgctgacgaatttttgaaaatgccgcaattcatggcgaaatgctttcaaaatttcgtcattttttgtagtcccattttcattaaatgggacattcagaacttcattataccacctaaaatttaatataaatgttaattttaatctttacgtagttttgatggtttaaaaaatcgttataaattcacagcaaacaaaaaattgttaattaattaattattttaataagcgaacaattttttaatttaaaatatgtaaattaataattatttatattattttctttctatttaaatgtactaccgaaagaccataaatacaacgtccggtttggtttgttctacgatattcctcacagtacgtgtgaaaaacgggcacggaatgatatggccggggtcgaaagggatcaaatgctcgggcatggcgattggcatacagcctatgaaatactatataaatataatacttcgtcaagacagacctaaaaaatagagaatttgttggaaatttactaatttttttcaatggattaaaaaataccataaaaatagaaaatttaattctaatatgtaatttcaatgtaaaaaattctcatcgcaaaaaacattatacatttgttaggtgtcttgtaacaaaataatatccaattttgtaattttttaggatttgctcacatttgatatatcaaatcaaattatgcctaaaagatttttgatttttaaaataaaaatattcctttttgctaaaaaaacaattttctggttttaggacaattgttgcggatttttgtccccggttttgtcctttttgcctcgcttacccggcattgtaaatacttgaaaatcgtggtaataagcattcatttcctctcccaattcacgcgccaccacatcggcatgactgttgccgacaagaaggacagtgccattcccggtcccctgaaatttcaaaacaatttcagtaaggttttcgatttataaatatttttactacttaaactagagttcgacttattggaaaagcctgtgtctgtattccccggtttattctaaaacctatttaatattcagaaaccaataattattaataatttatttaataatttttaaaaaaaacaatctgtacaggcattaattactctttttgaattaccttaactttacggtcaataacaaattttaacagattttgaggtgttttgttcccttcttgtactaataattgctttaattgttttgtccatcgctccgtccgttcttctccgggtaggattttataacggtccttaattaatttatattttattaaactttaaaaattagttaaatttggctgtttctaagaaaattatcaagtgttgaatctacaaaaaaattgatggcgcaagacataataagtcat

SEQ ID NO: 3656 - DNA, 1489 bp, Heterodera glycines
  misc_feature (131)..(132): n is a, c, g, or t
  misc_feature (134)..(134): n is a, c, g, or t
ctgtccgacctttgtcagcctttgttggccatgtcccagcacataaggccaaccaatttggtcaacgctttccgctgtctcatttgtttccttttcattttgttggtcgccggtgttgaaaaatggacaannanttccggcaaaaaattgccacaggcgacaaaccataaggccaaaagagagggcaggcattacagtagtgagcagttgtgtaccaataaccgatgcaagaagtacggtggagcagaagaaatggcgcagcaaacgggcggtgtaagccgccgaagtgacagcagcaaaagcatggccaacggggcgagcaggtaaaattgcatttccacgccaagggaccaacagtggaggaagggacggtaggagaacaccttttggggacgaacgaaattgggtactgtaagcaatactgtagtagcatatttcgattatggcttctactcctaattctttttgacaccaattttgcattggtttttgctatagatcatgtctctaaattgagtgtcaaaaagcgtaaacaatttgaatttttggcaatagttcaaaatttatttaaaatggccaaaacatttaattctgacctaaagaccaatttatgaataaaattttgctatttttgagtaaaaaaatctatttcaaaattacctctgcgaaatagtcgttgttttcaaacaccggttggatatttgcgacgaatgccaatgcccagtacatgtcaaagcgtgccttttggaagtccgagtcgagcattattgttcgagaaacgctacaaattaataaattaataaaacaatttgacgaattttgtggttacctcaaagtgccacaaatgactgcgacatacattggcacaattcgctttacacgacgggcataaaactggaacaatttgttccgaattttatctgatttggcgccacaacatttgccagaaaaatttgctagacaaacggccatcagatgaccagaaatgacgaaaaacctaaaaacgagttaaaaatgttatttaactgagtaagataaaacaacacgaaaatcgaaatgcttatggaagagaaattccgatattctcagaactttttaatatttaatgctttttcagagattaccgacggagtgaaattataatcaaaaaatgattttttctaattgaaattttgtcgtattctgacattatgctttaggaaaaaacttattttaattattttatttttactgacacgtcaacgccgagaaacccattgggaaaatgtgtaggccaaatatggtagaaaatgactgccaaaatggagacggtgcgaagtccttggatgtcggcacgtttcatttggcataaaattagataatttaattattttctattttagttctaaaattaaattttaaatatttctcaagcaataatcttttattttttaaattaatgcatttatctttttaattctttatcttttatgtgaattaattaaatggt

SEQ ID NO: 3657 - DNA, 1396 bp, Heterodera glycines
  misc_feature (21)..(21): n is a, c, g, or t
  misc_feature (1349)..(1349): n is a, c, g, or t
  misc_feature (1369)..(1369): n is a, c, g, or t
actgttggcagcaatgagcgncaatttggaaaaccaaaacgctttttgtgcactgcaacatcgcctgcggcgttcctaaaatataacttgaatctattgtaatgttagttattcttttttaatgaaatggtttatgactgcgttaagagtgattccctattcgttaaaaattaatgacgatttttaaattcccttagagttactgtaacaaaaaaacttatttatttgaattcctatctgttaattagcagaaaaatgaaattggttgacttttttatttgaagaatgttttttaaattgtagataaaaatgaaaataattgcctaatttaacagcgcctcagaaaggacggtgtttggccttcgttttctctgataagtgagccgattgtgagatggcctgtttggtcttatgacaatcaaaactgttaaatctgctaatagggcccggaaatttcaaatttgcgaatcccctgggggattgtaaatgctgctaaaacataaattaaaattgattcgtgaattgaataagacaaatgtagaccattgacgtgttgtcgaatgagaaaaaaaaatacacgaaaacgagagattcaacggcactggattaatagtgctgttcaagaccgaaaatttccagagactcaagaccgagagttgccacggagacaagacaccgagacttgaccccgagacgactagagaccgtgagcattaatccgagagagacattctggagtcgagaccgatttgagtctttcttaacaatttttttttattagtgaaaaagctaatgcatttttgattctaagataaaatataccggtagcgcagcgggagggtcacaggattttagcttggatatgataccgccgcactagacgacaaattttttgcttttcattccatttttgcggcgcactttttaaagaatgggagagtggaaagacaaatagagagagaaaaaatttatatttcagacttttcggtttcgctgactacgaatctggcttccttttctataaattgccgaacccctaccttctaattcgcgatcaattcactgcgttctgcgcaacttcaaaaatcgcttagatttcaacacattcactgcaaaataaattttatttcaagttaatattttttaaattatataataaattcaacacggcttcctttggcaaattcaccaaaaagcacaacaagcaccaaatgcagcataaaaaaggggccaagcacaatgagagataaaataaaccaaatgtagtgctgtcaatgaatcattcgtctgacttttaaatgaaaaaattaataaatataaaactgaaaaaaatcacgcacataatacgncatataattattataaatanataataaagcaccaaggggtatggatg

SEQ ID NO: 3658 - DNA, 952 bp, Heterodera glycines
ctgtccaatgcatttggttgggtactgctgtttgctcaatgtttggcatggctttgtgaattcggccttgggatgcctgatgagggacgacaacaatcatcaaaatcacaatttttaacaaaatgtatgatgtttttttaatatattttttgttctgttcgtcattggcatgttacccgtggtgttgacgagatgaagttcttcgttcgtccgaagggagagtgactcccgaaggagtcggccaaatttgccccaaggcgggcagtgtctaataaatatgcgcataatttttaatgtcacttattttggcgttctgtttttttggggattttcaaaaaaagaatgcagcggcacggcgcgccaacgattcgtcaactcagtcaaaaattgtttcaaagtttccattgcttctatggcgcttaacaaaattaattataacactcattattagactaatttagaaagaaaaatttattcaaaaagttgtataaaacgaattttactaaaccaaaattctaaacaaaaaacgtatcaatatgatgatcatcgtgagattagggtaaacaaatttcggaaaaagtgaagaatacttacgggattgaaacttttattgttcaacccctccaaaaaggggcctttaattagagagggccttcaaatagagaaagtacggtatataatgttgtgtaggctgccaggggcttgaaaaaacttaattttgaacccaatttttgacataggcgcaaatcgggtaaacgaatcccgagctaaaaattaactaccaatttttaaaatttttattaaacaacgtcctaaaaatttagagagtcatgggcctcggcccaaaaaccggggccgggattcccggtcccgggataaagccccgttccattttccatgtcacggctccaacgtttcgaaattctggtctctactatttatttgaaataat

SEQ ID NO: 3659 - DNA, 746 bp, Heterodera glycines
  misc_feature (31)..(31): n is a, c, g, or t
acatcatggggcttctttcaccaatgggcgngacctaccttcttttgttttgttttgttgtttattccaatggcatcgcttcctcccagctttgccgtcgatgtgcctcctctcaccgccgcgtgtctgaccacttggtcgaaaaaagtgcacaaaaccatccgattggtagtgcctggggcaataggcttccgcgcgtccagtgaaatgtgttcatacgagcgcagtaattgagaaagaccacgtgcacgggttgaaccgcgttggtcagcgccggtccctggggggggggggggaatgggaaaagataataatggaaaagggcattcaaaaaaagtattcgaatttatacttaaaatttgaaaatttcttcgctttgccattaagaaaagacagagttccatatttattaatctgaagacccgatccagtaaaaaatttagggaacccgaaagcattttttctttgctctcccaatcgtaaatgttttattttccaaatttggtaccatatgtgaattattggaatttttgaccattttgggatctaatttggaaaaaatatgcacaaatttgtgacccggcagtgctgttaggaccgccggggaaaagttaaagaattttggatcgattattaagaaaagcgaggtaaatttgaaaaaaatgttacataattttcttgtttttattttttccttttttagggggtggcggcaatttccccccttcccaccccctgggtgcggg

SEQ ID NO: 3660 - DNA, 2036 bp, Heterodera glycines
ctgaaactggttacatttacatttggtgaaaataagaatttaaacaatacccaccgacaatgagaattgggatggtgtaaactctgtccatgtccaatgcgataaagcgctccccgcttccgccgtcaaagctcctctccggcgatacgatggaggaggcgtcgctcatgcttaggttgggcgaggagaccaatcgcgaggagttcagcccatggcgacggtggcgagtgctgtgccgttttgagcatcgtttcgcccttttttttgcattgtctcctcacatttgagcatacaaaagatccacccaaagtgccaaattctgctcactccgcacattgttaaggtcgtgcaccaaaacgactccgtccgccccgtccataaacactgcactcgccttgcgatgtgaatttgagccgcccacatcccaaaactccaacagttcagtggcctcattcggagttccggcttgaaactgatgggggaaaatctgcgaaaagggagggcaccatcaaagaactccaaactgaaaatcaaatgccttggcccaagcaattgaacgttttaccgaaacaaggcacagacaacaacgacccacctgaactgtgcagccgagcgtgctttgcggtggtgagccaatgccacagagcgaattaaccagcgaagttttgccgacggaggaatcgccgaggaaaagaattttatgatgactgttcattttcactaaaataaaaaaatcggtaaatacaaaaaaaaataaatttggcaataaaatcagaacaaattacatcgtattgtataatagtatagggatttgatttctgaagatatttttatatgttgtgtttcttattacaataataaaaagacaatatttgcataataacaaaaggacaatcgaaataaagccataacaaaaagcgagatgatcaccaacataatcgacaacaatgtaatattaatgcttgtacgaacaaatgtgcgcttccaacggacaactgaaacattttgtcaaaatatatacgataatattaaatcaatgtttaaattattaaataaaaaattgaattaaatttgacccgtcgggatgcaatcggtggaaaaagcaatggctccgcgggggctttcctccacttttccgtgcgaattcttcgtttacagtgctccattttcgcattgaaacaatgcctttgatgacacagaaaatttggtgttgattgcgtaagaaagtctgaagtcctttgtcctggttggccaacattcgccggtcgtcggccgtgagaagtttttgggccaacaattgtaaagaaatgcttccgccacaacgccacccactgaaagattcaattggaaatataaaccaaatacaattaatagggctgtgaaagctcaaaaaacgcatttctgcattaaaaattttcgattctgatgtcattatcggtcactagaaatcagtattttggagcttcgtcactaaaatagtgaaaagtcactatttcggcattttttggaaaatttctcaataaaaatgcaataaaaacgaagattgcacacctaaaaatcacttaaaaaatttcagagaaatacacccctaaaaataaatgcaaaaatttttataaaatacactcctaattaatgaaaaaattttctcaaaaattcattttcttggcaagaatttttaatttttaaaattatttgttaggtacctatttttggttttttgcccttaaaaatctcagtcctactcattttcaactgcaactggtgaataaaaaatattttacttaatttttggctaaaaattaggtcattatttcgaactttttgccactattttggcatttttactcactcttttagttaactatttcgagatctttagtcactaaagtcgcagccttaacaattagtaataaaacatactcaatgttttctcctggggcaattttgatcagacaattcacaattcgtttaaccaaatccattcggtactcaaatagcaattttgagcaattgcgcacctaatgtaagaataacaa

SEQ ID NO: 3661 - DNA, 4593 bp, Heterodera glycines
  misc_feature (20)..(20): n is a, c, g, or t
  misc_feature (74)..(74): n is a, c, g, or t
cattcgccggtcgtcgccgntgagaagtttttgggccaacaatgtaaaagaaatgcttccgccacaacgccacncactgaaagattcaattggaaatataaaccaaatacaattaatagggctgtgaaagctcaaaaaacgcatttctgcattaaaaattttcgattctgatgtcattatcggtcactagaaatcagtattttggagcttcgtcactaaaatagtgaaaagtcactattttggcattttgtcactatttcggcattttttggaaaatttctcaataaaaatgcaataaaaacgaaaattgcacacctaaaaatcacttaaaaaatttcagagaaatacacccctaaaaataaatgcaaaaatttttataaaatacactcctaattaatgaaaaaattttctcaagaattcattttcttggcaagaatttttaatttttaaaattattttttaggtacctatttttggttttttgcccttaaaaatctcagtcctactcatttgcaactgcaactggtgaataaaaaatattttacttaatttttggctaaaaattaggtcattatttcgaaatttttgccactattttggcatttttactcactcttttagttaactatttcgagatctttagtcactaaagtcgcagccttaacaattagtaataaaacatactcaatgttttctcctggggcaatttcgatcagacaattcacaattcgtttaaccaaatccattcggtactcaaatggcaattttgagcaattgcgcacctaattgtaagaataacaaaattaatgacagcatttttgaagagttgacctgttctttggagggacgaggcgtaaaaatgtcctttgtgccaattttagccaaagataaaaggccattgatggcggcttcaatgcgctccgatgagccaaggccatcggcagggacaacaccgaccaaacatttctaaaaataaagccgaatgaccggacatttttaataaaatacgacaaaattacgcgttttcgagaaggaattttcagttgatcaatttccactttgaaaccgagttggtggcaaatatgttcaatgtaggcaaagtgttgttccgcaattcccttcggcgccccggctgccaaagccttttcggatggcatttttttggaatatttgccaaaaaaatcataagtgcagcatggcaaaaggaaaaaattgcaacgaagtctgaaaatgttaacggattcgaaaaactttgaggatgaaaattgacaccttgcagcgatcactggtatccacggggtcaattcgtcgctatgatttccgatcaaaaagtcgacccctttcaaatgctccgcaacggaatcgcgggaggagggatcgaacttcgtttctctcaaatctgctccttgcatacgaaattgctcccaaatattcctttcgcgcacgtccaagcccaacccacggaagccgtgacagctgagcagaaagacaagcagtccattgccacagccgaggtcagcaaattgtttggagggaccgatgccgtaactttgccaaagttcgagaagatacgcgacaatcccgcaatcttcgtaaacgaatttgctagggtccgtcttttcagtccacgccttaaataaaagaagctaaataaacagcaaattcagaattaatttatttattccacaaaaaaaaactttaatttataaaattcactattcttctctacaaaaatatttcacatggcaggaaagatgaagtacataaaaaatgtgaaaaaggaagtaatttcattttcgaagttttttggttttcgcatacacctgtcagaaacctaccaacttaaaaaaattattaaaaataaatgagcgattgaatctcagcgagcttccaattctacggattaaaaaattttgaagatattaccgaagcgatccttttgccgaaagcgttcttaatttctttgtatctgctgcagtacatctcatccggcagaagcttattggacattgcttttgtaattgcggttctcaatcgaaaaagttttttctttacatatgaaaatttgtctatgagatagacattaaaagtaaacaacggattacaaacgattctctatattctaggttcaaaaacaactctttattaaatttaaagatgaaaatgtgtcaaaattggagatatttgtatcgcttcgttggcacattctgcccgacttccgtttgcctttggtatccgtaccctttgagcaattcttcggcatttgaatgcattcgttttgagcctggtaaatggttttcggcagctaacggaggagaggattgagctggcggtggtggcggtggagaaaacaaaagagacgtattcgtcgaagacgaagaacggacagaaaaagggactgattgtgagacattttggggaatggcattaacaggcgaaaactgttgaccaactgaaaagaaacaaaggtaaacaagagaaaataagtgaaggaaaacgacagaaataagcagtcggtggaatgaagcccatttgctgctgttgagccgctgcccgcgtcgcctcctccttttgctgttggatttgccgtttttgccgaatgatttcctgccgagagataatttttttggcataaatacgcactccctgcaaaaattgcaaggcgcctctcgcgatgcaacgttcgactgaaagttcgtcaagaaaatcaacgatccaatactcattgacgggattttgctttgcttcctccgacgaagttgagaattgttggacaatttctttgacaatgccaaaagagctgagatagccgaaaattgcgggttcagataaatcgtttcgcgttgcctcagcgatattgtagacgattaacaaacgtcgagactgaagtattttcggcaaatcgtcggattggtcgcaatatgatgaagaggacgacgaaaccatcgtggaaacaacaatctgtaaaagaaaattaaatggaatgaaatcgtatcggcgcaataggacctcactagttgggaaagcgggccgaacgtcaattttatggtgtccaatgtaatgaggacgaccatttaaaatggcttgagctgacgatggcaaggcgtaagtgataaagccgaagccgcgactcattccattttttgagtccttcagaatttgacattttgtgatctcaccataagcagtgcaatatttgtagatggtgaattcctccaaatcacttgtcaaattgtttataaaaacacgatttgttggttgagatgcttcgacagctttgggctcattttccgcagaaatataatgtgacatgaaatagcttaatcaatgataaccaattaaaaaataactcacaaataaatttaaaatagattgacacaaaattgaaaaatcactaagcacacttggaaatcctgacaacacatacatatgcttatgcatatgtaatttctttccctactcaataaaatatatttcgatttaattaataaattcttttttccaatttgataaaactaattgtaaaaaattattgttttttttctatttttttagattaatcaacatagctatgcctaagcgttcaattggatctgaagacagtgaggatgaacttagagaaagtccaagtgggccgaacggagagtcaccatgtgccaaaaggagaaaatgcgtcgaatttgagccagtcaggatttgcagcataggaagcgtggtgagttttaactttttgtataggtaaatcaagttttacttaagaaagaaatcgaaaatagagttctgcttgcacagcattacaaactttgcgaaagatttcgactgaaggagaagatcagattagagttggagaagcgaattgaagggtttgaacgtcgtcagatccaagacgatgcggtgatgtgtatcatcaaccgatactggaacagagtgtgttttagttagatgaaaccattttagttcatcatatgttatctaatttcattttcccaatttagttggatgaggaaattcaacttttgttacaacgatttgacagagaaacagcacaaattgacactgagatgaaaggtggacaattgaccttgtttagcatacctaaactattagcaagcaaaccaaagggctttttaatttttgataaaatttaaataggaattaaacttaaataatgaatgagttgagcctgaataaatttgatggatttttctgtaagatgaaacggcgaatagcactcagcaagacgacacacatttcctcagtgtaattgctcaatggacttgtgaagagatggacgaaaagctgaaacaacgcgtcgaatttagtcagcgatcgctcgcaaaattagtgcaaacattcagcagaattgacgagcgaaatgggcgaatcatagcactgctgcgaggtttgttaattccaaatgtttgtcggttatttatgagtttaggcgatggcgaaacatcagtggaaaccgacattaatgacgagacgaatctcggaactgaaaaggacaagaaaaagggtaagacaatgtctaattgcaagacaccgacgatttgctaaaaaatttgaaaattctgaagcatcgccaacttt

SEQ ID NO: 3662 - DNA, 8546 bp, Heterodera glycines
gcccgggatgttgatgggaggcatccttccgtttggttgcattttcatccaactcttcttcattctgaacagtatttggtctcatgaagtatgcaagagggattctttcatttgctcacattttttaatgttttgattagtttttatattcttatttgcaggtgttctatatgttcggctttttgtttgtcgtcttcctcattctgattgttacttgttctgaagcaacaattcttttagcttacttccatctttgcgccgaggtaattatttttaaacaataatacacaaaattacgtgaactgcaataccgcgtgggatcccgcaaactttaaatgcttgattgcgtgattaatcccatgtgatcttgtccagcaaaaaaaaaattttaatttgttaggattaccattggtggttccgttcctttatgacttccggatttactgctgtctatttgttcatctactgcattcactacttcaactcaaaactcaccatcactggtgtatgtgttcattgaaaactgagtttcaattactattcttaatattttaggtcgtatctaccatcctctacttcagctatacttcgatttttgtctttttgttcttcttaatgaccggttagaaaaattttggtatcttaattcatttctcttcagggaccatgggatttttcgcaacttattggttcatctacaaaatctacagttcagtgaaagtcgattaaagatgtaaatttgatttgtgattagaatacatgttaattttttttggtcattggtttttgagcaatgatgggcttctttcaatgtttaatatatttttgtttcccttgtcttaatgttttttttataaatgtgattagaagtcgaagttcggataactatgaaaggagatattccccaaaaaatggcatgggacgagtcaatagcactcgtacaaaaggcaactcgtacactgttgtacaaaggaaacttgtactaaagtcaactcgtaaaagcttaagcctaaacctagatccaagcaagcataggcctagcctaaaccttaggcctaacctaagcaattgtatgagttgtaaattcgatttaaatcaaagcaaacgcgagtcaattttgggctcccagtgtaaataattttttttttattcagaacgccaaaattctgcataaaattttttggggttttcccttgtaaaaacgcaagagccgatctcgagttaaaatatgtataacttccaaaaataaacagggacggcccgagccggtcagttatctgtccggttctttcaaaattccgggctctagaatttattttccctgtctgtgttgattatttttttataaatttgaaaatttgtttattatgccaattgattaatttttttttttgaaaaatttcgcctgtttgagtagctgcagtgaagcacacgtgtaacctgttgctttataaagatcatataaacgcttttgcgtccgtattgggctgtgtctgttgagtgggcggtagggggaagggaaggctgacttagggaagacagccgaaagttacacaaatggattaaacattcgataataatgcagtgaaaacaaaaatgaatttgcagcagcgcaaatcaaaaatggcaaatgctcggcgttctgattttggcgaagaatttgtggaaaggcttagaaaagaccgcttccgaaaggcgtacattttggtgaatggacttagcagtggcgacgaggaagaggacgaagaagagctttgttttgaggatgaggacgacgaaattgtcagttgcattggtggggtgggtgccacttttgtgttggttgtcaatcctccctggggttgctttgaatgtctcatgccatgcccatgcaattgcattttttcaggccagttacactttggatcccccgcgtccccctccctccgtccattcctcgcgccgtccaccctccgtagccaatagccaacgtgccggcggagcctctggctttgatgcgcgagacttgtactttttcggggttttatccgaacttaccgacaaatttacaccggtttgttatgttttttgtgtgtttattcaacaatcttttcccaggaacggacagcccgtctcatggccaaaacccctccgcctgcggactttcgctcgctcgtctctatcgaacgggtcgcatatttgctgttcttttcgctgtacggccgatatttgagtgttggcaagtttcacaatgttttcaatcgcgagtttttcaaatacacaagtgccggagattcggagagagtcgctttccttaaggtgccatcgccaatttatgggaagggacagcaaataatatccatctttcagatttgtcgaataactttcgaggaatacaagcgaagagtaattgaacacaacaaacgggcctacaaactctcacaaaagcatctgttcagcgatgggcgggcgagtcccgacagtcggtgggacaaagcgcgagtgacttgtctgattttgctgtttaaggttaagcgatcgaccaagcatagaaagcgaggacgtgaacagcaccgactcgctggctaaaggtcggaaaggatcgccatcgcctctttttggccctgactactaacaagggaaccacccgaactaaaaattcacaatagaagtcgaccctgctctatccaatgataccaaacaaatttatatacgttttccgagttacagttcgggtggttcccttgtaagtcgttcaataaaaatgaattattttccttccttccaaaaattattagtaaaaataaaaggtaataataaagtttattcccttcccttcgaaaaatttttagaaacgaagtgaaagacattattgcttcaataaaaatcattcaaactaatcattcaaaactattagactaaaatgaaatcgaagtatttgagtttttgactttacgaatttcggtccggggttcggaattggttgaaatggatccccgaaaaacacttggaaatatgtttccagcctcatctttatgaaacgacttagtaattgcctcttttagttcaaattggcgttttctcctttccgtttagaattgatgtttttccgttttccccacactcccgttcggtttggccgtggtggaagaataatttacgtggacccaacccgctcagttagcactgtctgtattgaagacctgaagcgtttcattaaagatgctgaaggacggagatacgtcgaaattttggaaagttttaaaggttggcttttgccttttcaatgtcggcctaattttcactgtttccacaggccctttgcttgtcggtcacactccgtctcaaacgccgctgctattcatccaatgccaaatcaatcggctcctccaatcggatgtttaccgtgccaatccctcttccggtgatgccaatgattgtctgctcatttggagtctgctcgaaatgctcattcgccaacacggagtgcgcttttctcgatttgttcatttcgatccttacaattaattttcgtgcaaactgtataatacttgtggccgtttaatatatggataattccagaaagtgactggccctgaccttgctcgtctgctttgttccaatcagccaaatcatttggccgctctccgaaaaaactttctcaaaactgacgctgactttgtgcggagttcttctgccatttctcgccaagactctgctgatgctgaaccatcccttgacatttccgccattgaacgaatgacacattttttgcttggcggtcacattgacgtatttcttaccattttttgccaatttatttttctctccaggaagccattgacagtgccatcagcgacggacttctattcgacgcgcttttgctggcccatcgtttgtttcgcgacgacaaggaccgtttggaagcggttgaggggcgtttgatggcttataggtcgcccgatcatccgatcaccaccctgttgagcgtcgcagccgatcagcccgtccctttactggttggttttgcgtttcttacggaacctttcttttccaacttgacatttcccttcagaccaatccaacttcatatgaaaccaacggttggcgttcgcacattgcaattgttcttgccaacttacaaagtccgactgcgatgaacgccgtttatcagcttggcctggctttggcacaaaaggaattcaattcggcagctgatttctgttttcttgcagtaaatttgttgtacggattcgattgcttccaagaacaacaatcgtaaatttgaactcattcacctgtcattttttctttattttgactggaagtgatgaaaatcaccgccgtacaattcgtctgatcagcgccactttgcctgacgatggggcaaattcattccttacgcgttttgggttcgattgatcttttgcggaacacattgttcttttcagctggtctattttggattatcaggcgaccgaactgttcgatttcgccctgcaattagccaacccaaacagtcccactttgttgtccaaatcccattattatgcaaaggttcgtcttcaatacgcgcaattgttggatgaattgggcggattcaaacatgcggttgagctctatcgactcggtaggatttacttattttgttgctccaaagaaggaattggtgtggagtgttagttcggactacattcattttctgataaatttcagagaattccaaccattcgaagacaccgtcgcctcctccactcgttccttctgttcacaaaaccaaattagctcatctcaaaaggcaggaccatgagccaacacctgccgttgctcctgctccacctacttttctaccagtgcagttgcagtcggcatccaaagaggaccatgcgccaaccccttttgccgttgctcctgcttcacatactttccaaccagtgcagtcggcctccacgcagggccaagagccaacggcttttgcagttgctcctgcttcacaaactttcctaccagtgcagttgcagtcggcctccaaaccggaccatgagccaaccccttttgccgttgctcctgttccacatactttccaaccagtgcagtcggcctccagtcaagaccacgagccaacactttttgctgatgcccctgttccacatactttacaatcagttcagtcggcctccatgcaggaccaagagccaatggtttttgccgttccttctgctccacatactactttcctaccggttcagtcggcctcaaaaggaattccggatcactctgttcgttcgcccaacagttttgacggtgagacggcattttgggtggatagataacatacatgaaaaaagagagggcgggggggggggggtcagaaacttgcctttaggaaatacccccctcctgtctacctatgatagataagcagcctttagataggcccgtatagaaacatttgaaaccaatagttcggcagtgcggacatgctcctcctgagaaattttgttggatcttttgttgagaaaatttctccaaatttttacaaattgtcagattgagagtaacccccccccctcccaaccgccctggtaataagccgtttggctttttttctcacaaccaattttttgttatttaagatcactatgaatataagcaccgcccttcgaggagtccgtccccgtcctccgctgccattttgacacattcttccaatgtctcttctaatcataaatttgtggaagattccaaaaagagcgaaagtggtggtggtggcggaaaaggatttcttcgcggctttctctcgaagattaaagcgcctatggagtctaaagaaatgaaactgccgaaggacaataacccgaaggtattattgaatcggtcgatttgaccaacctttccgaaattggtaaaatgcttttgctttgactgctatttcggtgttcagattgtgtgggactcgcagttgggccgttacgtcgaccaggaacaagaacagcaaccacaagaggagctcgcgccccctcctatcatgccgacatatcagccgcaacagtggcaacaaataacccaaccagcggagcagcagcaaccgccaacagcgccgtctgttggccgtgctttccaaggagtaaaagtcggtcgaacgccaaccaaatttatttgttattttagaagtcgagatatgccaatgcatggaattcgtaaaacgcataagaataaagcagttgttgtgattaattgactttctcttagtttctaacggatttacagtcattgtgaataaataagaatcaaaactttttcgctacaatgtgatttttaattcatgggaagatgataaatttctggcataattattgcatttttttatctcgaatagacatttactcatcttggctgaaatgcacgaccgtaacatttttaaactttgcccgcctaattatgaactccttgcaaggaaataccacgatttcagagtcaaatgttttattggggcgggtggaaaggtaactatcgaaaatgtcctcatttttgctctgcatattttggtgtctttttaggtttgtgtgaatttcgcagatgctgagtccgtgcgtttgttgtcccaaattttgctgattgaatacttccaattgaatgtccaacttccaattggtcatctcgtgccgcgcgtccctcagcgattaaattacattttattagtggaggatttgatttgcaaaaataacttcgatacttccaacgtttgggggtttgacattggtactaatctctctctgactcggataacttaataatttctgggacgggtgcttcgtgcatatttccgcttttgggggcacgtctcaatggatggaattttgtggcgacagaagtggacgcgaattcattcgcttacgcagcacagaacgtcgaccgaaacaatttgaaaggacggattttagtggagcaaacggagggaaattcgcttctgaaagttattgtgtgtcttattttagtgatcgggtaattcggttcaggaagtgatgtcgaagggaccgcacaaagacaaaaagtttactttttctatgtgtaacccgccattttttgaccccgacgaagccacgcaagttagtcataattggtataatccaattgcccacttaatcaagaaatttaccgtcaattccgctgggaatacaatgacaaatttgttagttagcgatcacaacaaccccccaggcaaatgcccgccccattctgccaccactgcaacgcgcacagaactttcttatgtggtactttttcgttcgctaaaaaggaagtgcttacattattagggaggtgaaagtgcttttatcatcaaaatgttagaagaaagcgtcgatttgagcaaatctttttggtatgatttgcattcattgggctgacaattacactaatctttttctttttttgttagtttttttacaacgatggttgggaaaatggcgagcttaaaactgcttaaggaggagctaaacagaagagaaattcggtggtctgtccactcattgtgccaagggaaaaccacgagatgggtaaacatggaaaaggcggagaaagaaactattcgattgttttttgtttaggttttgacgtggacatttttggatgacttcaaaattgaataaaataataataatttacctttcttatggcacaaaaattgatcatttttataatactattttaattgttgttttatttcaatttttgtttgattaacagaaatgaatcgtgctactgcaaacgaagtctccgtttttgacgattttcattctgacatagaaaagtcgaagaaaattaacaaagatcggttgtccaaattttgtcctaaacttttcaagaaggaaaatgggattggaatgtcttcaattgcttcggtgccttttgaagcacttttggccggtgaattcgtcttcccatgttcctccatccattcgtatgttcacaatgcctacaaatcgaagaatcccgcagaaattgcggatgaattggaattgttgctgaataaattaacggatttttgccgaagtgactccgactttgagaaggtgtgttcatttatttccaccacataatttccacaaaactgtttaggttctgaatttttctctcgcattgtccgattgttttggccgtttatttttcgattgcaaatcgctcgaattgaatatgaaattagtgcggatgcaggaaaaagttaaaaacctggttggcatttcaatacaaagacggttgaattactataaataacaaattaagacgtcagcacaatttttattcgcccagaatatggccctaatcaagaacaaagctgcttttgtcccctcatttgatgactgttcagattatattgtaaaagaaattcgaatgcgtgaactctaacaaatattttttgttctcgctaaatttttcttttgttaaaattctcaaattcgacgaataattttgattttcatacaattaggtacttataaaaatatcaataaagatatcgtactgagtgtcgtaatattccttattaaacccgttatagcaaccaa

SEQ ID NO: 3663 - DNA, 5352 bp, Heterodera glycines
  misc_feature (2214)..(2214): n is a, c, g, or t
tgttgctgaagtaccatgccagcgtcgatgccaccacccattcggggctggcaccgctgcacgtggcggcattcatgggctgcatcaacattgtcatcttcctcatccaacaggtccccctcctgaaattttattttactaaaaaatttgtttattatttagagtttgtacgaaattatgaaaattttgaagaattttttggatattaaagaaaaattctttaaaaaaatccttaaaaattgtaaaaatatatacaaaaaaattgcgtaacagtccaaaatatgtaaaatatatttacatgattaaattatagaaaaatcagggaaagctaaaaaagtatgtaaataaaagtccaaaactttgttcgtaaacacaaaaaaaaagataaaaaaaagtttttttactactattttaagcatggaaaccccttgaaaaatatatttataaatatttagttataatttgcagccctattaattattttacataattgtgtttttttcagggggcaaatgtggactgtgaaacggtacgtggcgaaactccgcttcatctggccgccagggctaatcaaacggtgggcccaattatttattttattttgctaattatatatatttttttaacaaattatttttaaatgaacaattaatggaattccaaaaattgtttggctaattttgtgcaggacattgtgcgcgtgttggtgcgcaacaaggccaacgtggacgcgcaagcgcgcgagctgcagacgccgcttcacatcgctgtttgtgtctttaaataaaaaaatatatataataatattatgataaaatcttcgaagcagctcgtttccaccccgccgtcccttctccccgattttttttaaatttcaaaattagaaattttttataagaaatttcaagaaataaaatttgaaaatttattggtgattttttgatttttgaaaaatttattaattgattttttcaaaaattttcttcttgcattatttttattaaacaattttctatgattttttcttgtaaaattactgtttgaaattgtttttttttcggtgggtgcgtggtactgatacgagggggggggggggggggggggggataaatgcacccataaatttctacaatggttggagtcagtgccaaaaaaacacaaaatcgtgaatctaaatcccgaggcttcaaatttcaagaattcgatcatgatcaagtttaaatatataaagatttcatcagaaatactggcgatcactacatatatatatatatatatatatacatacttttcgaagaattaatgaatagaaaaaaattgcaaaatttcgatttcataattctgctgtttatgtctcattaattatgcttcttggcaatattcaggcacggcttggcaacgctgacattgtgatgattttgctgagcgctcatgccaatccgaacgcggcaacgcgcgaccaatacacgccactacacatcgcagcaaaggtaaatggagtgagtgggtgaacttttgatatataatttaaatattttggaaattaaataataaattgaaaaaatataaacaaatgaaattcaaatttttgtttttttattttcgcttcaaaaatttattgaaaaaatgaaattttctttttttcagatgagaaataataaaaattaatttagcattaaaaatagttttttaaactaaaaatgatttttaaaattatcattaaatgatttttaaaaaaatatattaatttagcataaaaatgattttttaaatgaaattaatttaggttttataagtgaaattatttacattaaaaatggtttttaaaaaatattaatttagcattaaaattatttttaaatgaaattaatttaacattaaaaatgtttttttttaaatttatcattataattggttttcttaaatattaattgggcatttaaaatgtcttttaataataaataaataaaaaaaattccttcccattgcaggagggccaagaggaggttgttcagctgttgctggagaaaaagtccaacaaaacgctgctgaccaagaagggcttctccccgcttcatttggctgccaaatatggcaattacgcggttgtccgtctgttgttggagcgtggcacacccgtggacattgagggcaaaaaccaagtgactccactgcacgtggccacccattacaacaacgaacgggtgagagggnagaaggggggagggaagggggaaaaggcataggttgggctgatcgagagtctcggcaaacgagttttatactatgcttgatcaattttttttttgtcgaaattttgactaaaaaatctcaaaattagtcattttgaaagggcgaatggcataggttagactgctcgagaatgagtctcctcggtaaacgagtcgagaaaatttttattcaacgcctgaccatttttttgccgaaaattttacataacgagggaggggtgtggagtggagaatggcatcgagagtctcagcaaatgagtcaagaaaatttcttaaaacgtctgaccaattttttgtcgaaaattttactaataaaagcctcatcagtggtcattttgaacgggttcgagggggagggcgggtggtactgctcgagagtctcggcaaatgcgtcaagataaatttttgttcaacgcctgaccaatttttttgtagaaaaattcgcaaaatttttcaaaatttgttattttgaacgggtgggagggaagggtaggcggaggaatggcaccggttggactgctcgagaggagtctcggcggtaaaaaaaaaagtcgagaaaatttcttggcgttttttgtggtttcataacttggctaaaatttcccactggcgactggaggcaccgcctgttgccttaaataaattttttaaattaaaattttagctagttgctaactttgttagttacctaaattaaaattcttaattagttgcaaactttttgttttcacgttcctcattccccctaaaggttgcccaacttttgcttgagcgcggtgcgcgtgccgacgcgtgtgcccgcaatggctacacaccgctgcacattgcggccaaaaagaaccaaatggaaattgcgcacgcactgctcgcctaccgcgcggtgccaaacgcggagagtcgtgccggcttcaccccgcttcatttggcatccgaggagggccatttacagatggccgcactgttgacggagaacggatcagaggtgattaaagatggggtggccaactttggttttttatgcgctgttcgagagtctcgaatcgataatagtctcgggttttttggtgtcggtctcgtgtctcagaaaatttttggtctcgatagcactggtatttggccatttaattaatggcctttgcaatttagcgcaatcctttttggcatttcattttttttcatataaattttaattcaaaatttagttttttggttaatttacaaaactccaattttaattttaatacttatatttcttcactgtcgttcaattaaaatgctttttatccatgatttccatacatttcactaacaaattgtttttttgatcaatcgaattttgatgaaattttattttgctgacatttggtggaggttcaaaatctctgagaccggccggcactatcgatttatcgatagaacttttcgatatatcctacgatattttaccgtacaaaatcgatcaattttgtattgtttgtgatttgcgatccgatctgagtgagcacagtgcaaaagctaaatagcacaacaaaatcaaaaatgcatcaaattattcaggtcaatgcccgcgcaaagaatggacttacgccgatgcatttgtgtgcgcaagaggaccgagtgcaagtggctgatcatttgttcaacaacgaggccgacattaatgcgcaaacaaacgccgggtgagtgagtgaattagtgagtgatcagtcagtcagtgcgggtggcccttttgggcaaggcattattttgtattatatgtataaaggtaaaattttgagcccatgttaatttgtctaatggataatctccattaaacccacattaattaggcaaattgggtaattagtaaattcttattaagagtggtagccatacacaggcaaatttaagagtaaaattgacgacagtacactacatttatttgtctaatggataatcccattacccaccttaattagtcaaaatggctaattagttgcatcatattaagaagagacccaaaaacacataattaattaataaatgggtgattagcatcataatatttaagataatattgaccataacagctttaatttatctaatgctatctatcattacacttatattaaaatgggtatttagcagcatcattaatgaattttactgcagctaattaatttatatatgtcgtatatcctaatacacatatatttcctttaaagaatataaaaattattatttcccgagcaattaaaaatgacataaaaaattcactgacatttttcacaccaattatttatttccttttttcatgcgattgtcggcttattattttgtgttcacattgtaatatttgacccatttttaatttctctctgtcgttgcattgaaaattttttgacattatttttctctttaccgaaaatctccgaaattcgaaaataaatttttcaataaatccgaaattcttttcgactcaatttttgttggaataaatgacctgttgacgtagagacaggcttgtaacagaaaaaattacggagtgaggaattcaaagactgcctgaacattttttttttttgcatctaatgaaattttggacctgtcaatagtgacaggagctgatgggtcaaatttttcaaatttttataaaactagtaagaatcaatatcaattttcctagaatgcacagctttttcatttcggggagggcacaattcatcccatcccctcttggttaagggcctgtatatataggtctacacagacactatcagaaaattttcttaaaattttaatgcaatttttctagtgttttttttcaaattttattattttttgttttcttattattttttccccgattttggcacaattaatattttttgtgttgttgttcagttacacgccgttgcatgtggcgtgccactttggccaaatgaacatggtccgctggttggtgtcgcatggggccaatgtgaacgcggagaccaagtccaactacacgccgttgcaccaggcggcccagcaagggcacaaccatgtggtccagtttctgttggacaatggcgcttcaccaaacacgcgaacggcggtcagattttcttatttttttgct

SEQ ID NO: 3664 - DNA, 2029 bp, Heterodera glycines
ttggagttgagcgcacaatttatgcattaatcttctatttatgaatgaatattaaatcaaaaacgaatttattcaaatttaaaaaatttttttttgataaaatgcaaatattagcattcgttatatactgggaattaaatttaaaaaatgcgcccacattctcataatttgaatgacattttttaaaattatgagattaaactttttacttatgaaattttttttctaatttatcactttttataaaatttggtttgactaaaagttagggaatgcaaaatgcaaaccggccccctggtccccaaatcaccaacatttttgcctacggtatcagttcggtgccgactgtttcggcgccgccaactttgaaatgccacaacatttttctttgccagttcacgtagcaaatctgggcaccatttgatagcacaatttgtgctatttgtaaaaaaaaagttatggcatgtagcgctgaaaaagctatgaaaaagtcaattttttcaccatattttttttgtaaattgatgaaattttttgaaatttagcttactaattgtgaaccttaataactatcgcatcatatcaaaaatttaatttggtttataatgaaaaaagtcattaccaactgcgccgaactgggcgtttcccttccatccacccggtctttctattcctcagttttttaaaaaaaatttttaaatttttttaagctctccaccctcttaatttcttccaattttccctcattttcccctcaaaaattgaccccccccccataaattgttttctgatgcccattgatcacaatggcaaataaattaatgcgcattgcttttgctttcactccaaattcaatggatgaatagtgcgtgaattatctattatattattctcagtcaatgcttttccccaccgccgccgccgccgcgcgacaattaaacaaaacgccaattcgcgcgatgcattcaaaaatccgccagtaattctcctctattcatcacagaaggggaggaggaggaaaagcgggcttaacaattcgaaaaatcacagagcgaaaaacaacaaacattttacatttgttgaaatttttaaatgttgttttttttgaaaaaaataaaatcttagcaaaaaataaaattaattgaaaaataaataaataaaattataatttagtttttataaaaatgattttaaattaatttcacaaattttcgagcaataaaaggccaaggatttggcatcaatgcggcaacttttagtgttgttgagtacataatgttgtaatttgtcctattttcgtccgcccaatccctctcataaactttttctatctatttttgggtacacgccaaaatctcgtcgcccgaaatctcaagcagaaattaaaaaaaaatttttttcaaggaaaaaaccttagaaaatttttataagaaaatttcaagaaaaaaaaattatttgttgtattatgaaatttatcataaaatttcaacaaaaaaatcgctgaaaatttccaattttttttctaagtttataaaaaaatttcaaagtttgtaattttttttcttgaaatttttgcggcgagattttgttccgtccacctatttttcatcccaaatcccaagccattctttctcctctcatttatcttttgccatttctatccatcctattcatctctgttgcaaatatgccatccattccatcaaaaattctctgtgttttgccgtccttactcctcacatcctaaccaaagttcatccccattgtatcagtttataactaagatgacaccgttggcggagtaggcaaaacggtcgtcagccgaaacgtcgtcgaacgaatttttcgaccataacttttttctttctcaaccaaattaaacattcttggtattattcgaaagcattcgaaaaatgctattagcctgcaaattttccaaaattttttatttatgcacaaaaaaatcagagcaaaaaaagttcgaattactggggtttttgattcccttctgggcataacttttttgaaa

SEQ ID NO: 3665 - DNA, 4637 bp, Heterodera glycines
tcccccccctttaccttattttttgaaaattttgaccttaaaaaggtaaaaattagtcctttaaaggatccttgttttttttttgctctccggcgctgaaattttttaaatttgaaatttttttttggcccgatggcaaaaaaattttttcgggttccgccctccgacttggtcagtgctgttcaatgcctttggcaaatgtcaacaatcctttccaactaactaattgcaccgaccaactcaaaatgctctgtgaattcttcttgaccaaattattaatcacggcttttaaaattcacaattattttgtcaatgcttttccttctagtaaattccctccttaaaaattgtaattttaaatggcttaaaagccacaaatccggggacacaattaattaatgacgagcgtttaggcgccgcttcgcggtttgaattttctactacaatcatctcgtttaaaattaaaaaaaaaacatactattttcaataaaacatccttaaaaatgaattttttcttgtcacttttcccaattttccgtccgtccgtcccacatgagcagcagcagcagaaagggtgtggtggtcgtgaaaaaaaataaataaactcctatttttggcaatgtgtgcttccgtccgtcccaccccccgggggttaagttaataatcgtattgatttggtgggaggctcgggattcagctgccaactcggccgggaacaacagtgcacagcaccagcaataaaatgccccaataaacattttcctctcccctctccatagtccccccccacatttgtttgtgcccatatttttgtgccgtctgtttttttgtcagggatgaaatatggtggtgtttttcagttttttggacactccaattttcggaaaatctagaaatcataaaaaataattaaattaaattacataccaaatttgacattcattaacttgtttttgctttgatgaatacaaaattcgtgattactaattaatccaaaaatcctaataaattcgtattttcgagttttttaatttttgaaataattcactcaaaaaattaatattaaaatattttaaataattcttattttattattttatgatttttaataaaattttcattcaataaaattaatattaaaatattttataaaattttttattttattgccctataatgtttaaagaaattttcttccagtaaaattaatattaaaatttttaattctaattttattatcatttaatttttttcatttaaatatcaaattacattgccccaaaaatttggttgaacagaatgtaccggccgcgtaaacaaattaaatttagttatatttgcgggcaaaacatagtacaaccccctaacacagagaatgtgtgagggatgggtaattcaatttgcccaattatttcgacaaaaatttagccacaaaattttctctcattttcgaaacaatgggcagtgaaattcgataatctttctaaagataacaaaaatttaaaaaaaaattctttttttttaaattatctctaattgattggttttaagtaaaatatttatgtggaaaattttttttaaaaacaaaaaggccattattaaaactattcaggcccgtagttagtattcatgttgcaacttttttataagttgtttaccaaaagcttctaagcatgtagagctttcgaatgatgccaaatttataaaaatttaccaccaatgaaaaatgttatgatgttttatgcttggccaactgacccctaccgaccaattccccattggctacgaagcctgaaactatttaaggcgttaaaaatcatcaaatgttttaaaaaaatttcttgccgagcttatcggcgccggcgcctcattaaattgaattaattaaattactttaaaacctttaaaacgtttaaaaggaattcttatgaaaaaatgattatgcgcccgtcctccatttttcagaatgttctcagactctgaggatgaagcggatgatcaccaggcggccgcggcggagcacgcgcgcgatttcaacgagtccatcacgcaagggctgcgcgactcggccgtcgtccacctgatccacaccggggagcagggcgtgggcggcaaaagcagcagctcaatggcatttgacaccacggacgctgacctggaggcggtgatcaaacgagcgcaggcaatcaataatcaatcaatcatttgattaagtatatcactgagacataggcaattaactaattggtacagaaactaataaataaaacacagttcatatgtcgggcgggaccctttttactcttcgaaagcctaatttttttttattgtggttgcacgccaaattttttgcacgctttggctgcaattaaaaaatggagagaagcggggtccggcacatgcctatttcgacgatggaaaattggaattttttgacagaatttataaagaaaatcgtcaaaagtttcccttttttacaagccctaccccttgcaacagacggcctttccccccccccctcgaataaatgcttttatttttcagaatgccccagtgacaacggcattagccgattccagctttgtggagaatgggaatgacgacaatgtggcactgagtcgccacgatctgatccaaccgaggtccttcctttttttgaaataaaattattttataaaataataaatttaaaaatattttttatttcagcaaattgttcatgaaaacgtgggtataagttgacaaagtttacttctttttttttcatgttttgatatttttttcgtgttttgtgttttaatcccgccaattttttattcaaaagcaattaaaattgtaattaaattattcgaattgattatcccttaaaatttttttcttccctggtgtggttttatactaaagtgccaaatgtgaattggtttaaattagagttcaacattttgaaaaaagcatggattcctggacaaaaatacaaaacattcaggctaactcgaggcctgaacctgagtttctggaaatttgttttaaaaagcaaacagaggtttgaaaaaaatcaattaattttgaacacctaaataactaattacataataaattctttttaaatctattctaatcattttttgaaaacttgaaaaaaaacatcggttatttgaaatgataaattctaaggttttgtctaaaaaatccaggttgccgaaatatggcaggacctgggttcaggaaaaaaaccaagcctgggtccaggtcgagctctagtttaaatctaaattaaaattttaaaaaaatatattttttccttttcgattttatttggcgcttttcatattttccccatttttctatacatacaattcactagcttttccgtctgtgttttgtacacttttttttgcttttttttcacacaacccattgtaattgttggcttaattaccccccccccccctaattaagctttctcgtctcatttttggtggatgcccgcgggggcgcaatgcgcggctgccgtcacagcggcgttcgtgtgattattccaccgcgcaaggcagcggcaccaattcgcatcacatgccgttacctaaagaaggtgaattaattaattaattgatcctttaatttcaatttttatacttatgaaattatttttgaatttgaattttcatttgaatttattatttataatctttgttttttttaattataactttttcgttttaattaattctaacaataattaattagcttcaattattttaattgttttgatcacttatgatcattcggcttaatacaaaataaaaattaaatttatttttgaataaaaaatttattcaatttttatttatgaatattatttttaattttgcgagaaaatcccaattttttaagttataataaacacaacaatttaaaattcttttttttaaagtaattattatattatttgtaatttctttattaaataaatttaccattttctcaaatttttaaaattgccaggaaaaactgactcatccgccgccgttgagcgagggcgaagcgcttgcctcgcgcattttggagatgggcccgcacggggccaaattccttggcccagtgattctcgaggtgccccattttgcgtcgttgcgcggccgggagagggaaattgtgattttgcgctcggacgatggccaacattggaaggagcaccaattggaagccaccgaagatgccgtacaggtggggccaagcacgaaattaactaattaagaaaaggaaattcgaaaaaataatggaaacaataaatttatttgatttgccaatttataaattagtgtgaaaaactgtttaaatgtggtgaaacagtcaaatttaaatatttattagcaaaaaaataaaaataaaatttaaattaaaattttgaaattgcttttttattcgttttttttaatttaacaaattactctttcggatatttgcaaaaaattaaatggacaattaaatattcgtcacagttttgctcaacatcaacctattttgcaatcttggttattacttttggtggctttaagtgtttctattagccttaacatttttttaaaataaattacaggaaaattatgaaaaaatattaccaatgaaatttgttg

SEQ ID NO: 3666 - DNA, 6046 bp, Heterodera glycines
  misc_feature (5849)..(5849): n is a, c, g, or t
  misc_feature (5911)..(5911): n is a, c, g, or t
ttaaaatgtttttgcttagcaataagtaaaaaaatttccctattaaatcacgctaccccctttccgccctcccatctgatatgaaattcttaacgcttttttcttaattattattatttttttcatttatttccttatttttaactatcatcacctattattattattttactaaatttattttaatatttattttttctacaactcttcatctttcattaggcttgggttatgaccccaagtacctattttcccaccccctcctagtcgcccaccatgtcaccaccaccccctcaaataagttttgggttatacgaccaccatttggccaggttgccaactaaattgttcatgctatgccacactaccactaaaatgagtcgccgtctcaagcccagaatatctgatgttgggttttgcataggcacaactgtcacaattaatcacccttttgactcacagctgaaagttaaccggcaatagggaacagctacacactatctgtcccttcgaaaagggtcctttgacttggttcttttgcatgggcacactgtcacaataaatcacccccattgactcacagcttgacctcaattccaagtgggatattattgacacttccgtgggcattatacagtcaaaatgcgtccaaggggttattaatgaccattccattggctttggctcggtcagaaatacaccaaaagaattcccaaggggataattaatgaccactagcttcggttggacagacatgttcacaaaagaatggttaatggcgctcagttggcttttggtacaacagactccacatctcctaaggggatatttatgacactttcggaggcattagttagaaatgcactcaaaggaaagattaatgaccctccgtaggcttaggtttcggcagaaatgcactcaaaagaatgattaatgaccctccgtcggccctgcgttggtcaaaatgcacttaaaaggaatgttaatgactctctgtagactttgactactcaataggctttaggtctcagaactgaaatatcccgtgggcactgggagtgaaatggctaaacttaaaaaataactctggggctcaaatggcggcactgtaaaaataactctggggctcaaatggctgcgctgtaaaaataactctggggctcaaatggctgcgctgtaaaaataaatctggggctcaaatggcatacgcgagcgtttaaatggcacacacgcgggcgctcaggtggcatgcgtcccttgacgcccatcctctgcctccctttccttctctaataggatttgacctcgggttttatccttcagatgttttttcaattatttacctcttctgggattggatatatttattataggtgttttttaaaggtttaaatttggtactgaaatgtccctttccagtgggactgaaatggcggggctgaaatgcaacccccaaaatcttggggggtaactactaaattattccctttattatgtttaattatatttttaataattgtcaaaattgaatcagaaaagaaaacgctgcaacaaaagtcatttggcgaaatatttggagaaaaatgggaagaaaaagaagaagaaaaaagaaatgaactcaaaaaaagagaaataattgcaaaatattataaaataaaagaaaaaataaagcaaaaaggaagaaaatattcagcaaaagaatggaataaaattgacagaaaaatagcgaaaaaattgggaacaaatcgaaattatattcaaaaatggattaaagaaattggactttataaatatcacaaatcaaaaactgatgaacaaaatatgaatttttcaacgctttattgaaatgacaaatgaatataagcaaaaaagaaaatattcgccaaaagcatggcaccaaatttttgccgaaatttgtaagaaaattggagttggcattgggacaattgaaaaatggaagaaacattttggcattcgcagaaatgactgacaaagaaattgcaaaaattgtgaacacttctcaacagaatatttccaattggaaaaaacattttgtggctgaataaaatcattcgatttttagaattaacatgaaaacttttttgataaattttataaaaccatttaggtttgctgtttttttcaaatgtcgtaaatatactgaataaacagaaaactgaatacaaaaattcattaaagcgaataatgcctttttctctaatgagttaattatttttcaaaatttttccactttttccttattactccgattttaacccatttgtgctgtcttaattaatatactatacattcatgattaaatttggaagttgattccatgttggaactttcattttataaaaataattttataatcatttattcagttttttaatcagaaaaaaaatcatttatatgcctcaaaaaatgaattgcgatttaattgaataaaaaaataaaatcattttaagacgacaaaaaaatgaaattattccctttattatgtttaattatatttttaataattgtcaaaattgaatcagaaaagaaaaaattgcagcaaaagtcatttggcgaatatttggagaaaaatggtaatgttattttataagttaagaattaaaaaaatatatattttttttaaaaatattatttataatttattggattttttataaaaatccacaaaaaatagttaataaaaatttttttaggaagaaaaattggaagaaaaaagagaaacaattggaaaatattataaaataaaagagaaaattcagcaaaaaggaagaaaatattcaaaaaaagaatggcatcaaaattatgccgaaatttgcaagtgtagaacataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacacaagaatggagtaagccgagaaacaattaagaaatggaagaaacaatttggaattaacacaacaaacagcgcataacgaagaaagaaaaaaattaaaaagttttgacaaataaaaaaagaaaaacaaaaaatgaatgacaaaaaaaattgtaaaaatgttgaaaattcatagaaaaatcatgaaaatttgaaaaaaaatttggcgatgaacagatgatttagaagtacacaatttgatttaagaacgtgatttattttttgacaaaatttttaatattcttttaagcattaattttgcgcttttttaatggcataaacatgaaattaaaaaaaactgattaactaaacaaatccaatcgagctttccataaactattgtcttagactttcattaggcacccaaataagccaattaattaatggtaattattttatgcgagtctttggtttatttcaaatgccgatagtttattccttatcattggctaaatttcccttcggcaaataaaatatcatttacaaatgagtttttgatgatcaaattttcagtaattaattaattttgaacctaactctttctattattaataaaatcgcaccaaattttaattattacacgttaaaggcactctaatgtttaaatattaaaaatggtttataaattcgaaaaattgtttttcaataaatttatttttttgcttagatattaaatttggaaaagaaatattagttgatctctttattttattatttctttgcaattaaataggatttccttattttattcgttaattaatagaaatattatctttttcaatttttaatcagataaaattcataaagcgacacttgcgtcagaattaaaagaccaaaaaaataagtttggggtgtctacaatgacttttaaaatgcctattttgcctattttggactttttgtgctcatcgaattatataaattagcattacaaaaaaattaaattgtgaataaaatgcaattatgcattttattatttttatttttgattactctaattgatcaaattggtggaacagaaaagaaaaaattacaacagaaatcatttgacgtaatatttcgagaaaaatgggaagaaaaagaagaaaaacaacgaattgaagagaaaaaaagagaaaaaattggaaaattttataaaataaaagagaataaagcaaaaaggaagaaaatataaaaaaaaggaatggggaaaaatggaagaaacaatttggaattcgtgtaaaagaatacggaggaacaaaaaatggaaaaaaatgaaaatttattgggaaatgaaaagtgaaaatccaaaaatgagtgatagaagaaataaacgaggaatgaaaaagggataattaaattaaaaaattgtggcattttgttgtcctccttatttaattttattttcaccccatcagtttttgtgttcaccttattatattcattctcataatttgtgtatccattcaaagatgtcaatagtatagagcgtcaaaagcgagcgggttccgagcgggtgtttcccgcacgaacccgtgcctatgggagggggcatccctttgatgttgccgccccgcacaaacccgtgactatgggaggggtgcatccctttgattttgccgccacgcacaaacccgtgcctatgggaggggtgcagccctttgaagttgcggcccgctcatatcctgagtctatgggatgttctttgaactctgccgcctttcggattttaatttacccaaatccgtgcgggtgttttttcaccccgcgccgcacagcgccgcgggaaggtcatcaatcatccacctgtcaccaaagtgacaggtgaaggaaattcaatttttcttttgcaaattttaatcttttgtttcaaaaccttttggggctgtattattttctcaatcctgaatttttatgatgatttttctgatcctgaaattaaaaattctttttgaaaatttccacaaattgttgcgggttttttcacccgcaccgcgcagcgccgcgggaaggtcatcaatcatccatctgtcaccaaaagtgacaggtgaaggaaattcaattttttcttattgagggaccgtcccaataaatgaaaaatttttatcgtctccctaacttcttttgagccattttcaaataggggagaatatgatgatacatttcctctatttcagaattgtttttagttcccgtaattatgactttaccggtccagaaaattaacgctgtcatgcttttaccccgcttgaaatttaaaccgcaaaatatttctggttcataaaatgcacgacgattttttcgaaactcgttcagttcaatttcacgtccgaatttaaaggtcgaaacaatattttcaaccgtgtgtccggtgtaagaagccccggacaccccgagcccttaattatttctataaattttttaatagcattttcacagtctatcagacttttcgtccccaaacatatcattttcccggattcccataataatgccgtggctttgatggggcttatacatttgataaccgcggcattgaattttctagggttatacttaaattcgcattcggtgatcgtcagagagtttagtttaattccggtaccgagattagcgagagcaattatatttacgattatcggtttttgcatttttgatacaatgtaccaatcaaatggtcctttcactccctttatataccccttctataaatagcaaccaaaaataaaattaaattgaaaaatgaactgtccacataaaattaagtgttgtcattactgcccctgtcattacgagatgtgtaacagatgtaaaaaacacagtcttttgcatatncgtgcatcattttttgataatttctggttatgccccaaatgtgcgaaacatgttccctatgnaaagaaagttttccaatttagctttttttatttgtatccaaatccacaatcttggtatcattcgaaagatcttaacatgctctattagcctttttcaaaaatgcaaaagttttcaagcctgaaaaaatcttaatg

SEQ ID NO: 3667 - DNA, 4951 bp, Heterodera glycines
ttataaatacaattataagataataccccttaagaattatttcaaaaaaaatttttttgttcagaaataattttgctgaagaaatggaaaattataaattgatggattatcaaacgactacttgccaaaaatttggatttacgaaaaatattacggaatttcggatcaacccggacgtggaacgccccgatgaagcgatgaaggatgcgatcgacaacatgataaaggtggctttaaagactacggaagaaaaaatgaagcgaaaagtgcggatgtttggagttgcaattacgggtgccgggcttgctttcccggtgtgggtgccgtatcgggcgtacccccagaataatgcggatgttatcatggaggagattaataagctggggcagagcggggacggggatgaaaataagaaaatgctgttgctctcggagcctattacgatgaaaattacatgcgttacaatgcccagtggagaggggccgaggaatgtccacaaatttgactttggattcaaggaacaccagcggatagggtaagtgttttaataaaataaaattaaaatagaaaaaaactaaaataaaaaaatcaataaataaatttaaaataattatttctaaaaaatttaatgaagcacaaaaaaaaaacttaaaatatttatttttaaataatttaattaggcaaaaaaaagtaaattttaggattgtgaatactgataataaattttgccttttttacgcactggcgtcgtcgatgaattatttaattatggaccgttttgaatttaatcgatttatgaaaaatattgtgagacagagggatgcagctattgagcttttacgtaattgtggaattgatggaaacgaaattagttatggtgtggagcaattgccgaatgttcagaaatattgggtgggttaaatgaaaaaatgcaaaattaataaatttttcaggatgagatttacccaggaaagtaccgggttgtggcatttgagaagtcagctgatccgcggaaatcgatccgtgttttgtggaaggcccctatgggacgagagaaggtcgtaccgatatttttggagaatggtcactgggatggtctgaagaattatgtctgctttttcaaccgtgggagaaagttctgcgttgaatgtgaatgtttttacgatcaggatgtttatcatacgatggattgccgggcgagatgttattattgcaatagagtggggggaatgccatgtgaaaaggagagtggagtgaagattgaatgcccgaagtgtcgacgttacttttacaattgggagtgttataattatcatcagggacatcagacttgcaaattatggaggcgttgcgttatctgtgacaagacttatcgatttaacccgaagaaggaacatgaatgtggtgagacttattgccagctttgtagtgtgagccatgaccccaagcgggggtgttatattatgccgatcgaggagaaggaggaaaaatatgtctacagaattgtagtttgggtaagttctacaaataaaatcaacaaaaataagtctttaactccaggattcggagacttcgcaggattctatttacaagggggaccagaaggagcatgttattaattatatttcggtgagagttacgtgtacggaatgctgtgatgacaaaaacaggatgaattgcaaaatttgtggggagaagaggatcaaggattggagcgaggcggagggacatgagccgaccaaggattttgtggagtggattttaactgcttttacgaattacgatacgtacatatttgcacataacgccggacgttttgacggtaatttcaaaatttaatttttaaatcctaaatttttaggtcattttgtttttaattacctctgccgtaccgggaagaacccgataccgcttatcaatggattgaaaatttatgaatttaaagtgcgaaactcgaagaaacattcaatgctgatatggagagactcatgcttattaatgccggtgaaactcgagtcgcttaaggcgaccttcaatttgggctgtgaggacaagccctttttcccgtattactacaataagaaagaaaattatggagtttgtttggaacatctgccaccaatggaggactattcaccggggtctatgaacaaggagaaatttgcaaaatttgaaaaatggtaagaaaagaaggacaaatcataataaaaattctttttcaggtacaacgagaacaaggggacgcccttttatttggatgaagaattgagaaattattgcagaaacgacacggagatattgctgttatcgattattgagttcaggaggatattgattaacgatattactaagggatttgacccactaccgaggagttgtacgaatgcgggggttgcgatgaatatttttaaggcaatgtttttgttgacggagcagttatcgattgtgccggagaagggatatgagcggtgtgatagagcgagtgttatggccattaagtatttggagtggcggagcaagcgtgatgagattgagatacggcatgcggggaacggacgggaggtcaaagttgggaattacaaattggatggatttattgcgaataacggagctagggacaaatgcatcgaggttatgggatgttacatacatggatgtatgagctgttatgacccggcagcggaactgattggaggaaggacggcccaggaattgaatgatgagacgcaggagagattggcggagctgcggaagactttggacgtcgaagaagtttgggtaagtttatttgacatttacatttttattgtgaatttttagggctgtcaaattgagaaggagctgaaaaaggatgaagagatgcgggacttcttcgacgacagagggaatgagaaagggccgattgatccgcggatggcttatgcgggagggaggactgggccgatgaaattgtatgcaaaatcggatgagaagaaaaaaattagtgtttatgatattgtgagtctgtatccgtctgttaattacgttacagcttacccgattggattaccgcagattattatacggaagagcgatgagattgatgttaattggacgagaccagaggatttgaagtataagggattgtataaagtgagggtcaacccgccgcgggggttacgggttccggttttgcagctgaagtgtgatgaacgattattgtttccgtctatgttggagatgtgcgtcaaaatttaagaaggagactacgagatgtaattacaaatgccctcatgatggggcacagcggagatacgtggcgacatatactagcgttgaattggtaagaatttctaagaaaaaatttaaagaaaattaggacatttttcaggcaaaggcgttggaatgcggttatactgtggacagattttatagagcgtgacactacgaagaggaggcggatgatttattcaagggatacgtgcgattatttttgaagctgaaggaggaggcgagcggttttccgaagggagttgagacggaggagcagaaggatatgtggagagaagaatataaagaaaaatatggaatcgaaattgagttgactaaagtgaagaagaatccaggattgcggtacataagcaagttgatgctaaatagcttatgggtaagaaaattaaaaaataaatatatggtcattaattttaacttttagggtaagttttcgatgagaaattgtttgaacaagaatgcggtgattgatagggcgtcggaattttataaaattgtgtgtgatcataaaattgaattatgtgatattgttgaatattcggaagaggcgattagattgatatacagggacaaggaggactttgtgatggagcacaagtcgagcaacatagtcattagtttatggtgagttcaaaaaattataaatttgtatataacctaattttaggacgacgagtatggcgaggttaaaattattggaattcatgagagaagcggagagccatggcagggagattttgtacacggacacggacagtatttttgttaggcacgatcgggatgtggagccgatcacgacggggaaatatttgggagaaatgagcgaggaatacggcggctatgagattgaagaatattgttgcggaggggcgaagcagtacgcactgaagatgagaaacaagcagacgggggagatcgaatacgttatgaagattagagggattacgttcgatgtggacaacaggaaaacattgcactacgacacattcagggagatggttctgaactatgggaaaggggaggtggacccggcattcttcgtctataagaatgattttgggtgagtttttaaaaattatttgcttcagtaataaatcaatatttaggccaacgcgggattcgaaagtggtgacgagggagaagcataaaatgtacaggccggtctgccagaaggggatcatcgatgaggagcttaatgtgatgccatttggattttgttaattttgtatttttttttgttaaataaagttgaataaaaattaaagtgatattaggactagcgggggtggaacggtctaacgtgaaggcccactcctgttagccgtaatattttataaaaaatccaaaagttcaaggggaaaatagcatctatgaccgttattctggtacataattatgcacgggagttgggggaattgtagcttgacacggtgtctcgagtagagatgctgttcgacagtaacaccgaggaaacctcggtaggcaaaaagcctgtttgaacctctaaatgcatgtcatccggtgagataaactgattgtgcctaaggtgtctcgttattagggcgtgtctttcttcaaaatttcaaattttttcttccgctgtcgtagaattctgataattcgtgaggttcgcattcgttaaaatcgcataaaatttcatgagagaattcatttttgagca

SEQ ID NO: 3668 - DNA, 1516 bp, Heterodera glycines
ttgccgtgcctgtaaaatacaatgggaatcggcgccagttaaaaagtgccttactccccattctaatctaaatcaaaatccatatttttttgcagttttttgaattttttttaaagtgtaaatcgtcacaaaattttgaaaaattattccctgaatttttacaataatattttttgaaacatttttcgtcggggaggacttatttgccactttgggtcaaatgtttcaaaaaaattggtaaatgggggttcagcgatttttcaaagttatttttaactagcaccaaaagtccaataaatttattcgtacttatatgttatctgtgtacagattttcaaaaatattttatgtttttgtctataactttttccttttgcatccaaatccaagattgttggtatcattcgaaagctcttcagatgctctattagcctttcaaaaaacctaaaaattttctagcctggacaaaattttactaagaaaaaacttcaaaatttcggctttttcgcaactttcatgtataacttttttggtaatagtctactcgcgaagcgataccttagaaatagcttcgaaacatgttaagctttcgaatgataccaacaatgttggatttggatgccaaagaaataagttatagccaaaacaaaatatttttgaatatatgtacacagataacatataagtaccatttattctttaatattcttaccgcgggcaacaataagtccaaggttacgagtttcgtcagttattcgtagtgggtcctctggatcgcgtaaaaattctgtggcattgtcaagcaccaaatttagcaattggtcgtaacccttcaaaattccggcagctaaaaatatttggttgtatgtacaaaaataattttaaaaaatagatagtttgtgttgtttaatgtaaaactaaattcaccttctcgtcctccttgaaatttgactctcacttttttgtcaataaaacgcgataaatcgacaatgctttcttttttctttttgctcgtttcgtctacagtcatgctagtgataggtaagtattttttgaattaattggatctttaaataggaattagtcaagtgatggaagtaataggtttttataacttcaggtgtggaattgcggtagaggttaggtctacatgtatgtatttaggttccttttttcatgagctactgattctaaactgaattgtgaggcgtgaggatttaaattttttttatggcgttttttattgttttaaaaaagttgtaatgtcatagcgttttgacttaacgcgctaattcaaaatttacaatgatcagtgccttttttgcattgtttattttgatgatgatcagccataactcgcttcatctccaactaaactgaacaaaattggtatctaaaaaaagattttgaaaaggagaatttttttctaagaaatataaactaatttgatacatatgaaaaaattgtgagtttttcaatttttatcaacataactcaagtcctaaactgctaagtc

SEQ ID NO: 3669 - DNA, 1445 bp, Heterodera glycines
gcaaacagtgcgtttgtcaacacattatgcggccttaattttattgtttagactgttaagcgtgaattgaacaacatatttaataagcctaaccctgagcaccacatttttggcatgccaacgcatccacgcggcaaggaagcggctgaactttggctgaaacacttccgaagggaattggaagagggacgagagaggcgaaggcaaatgttcatggtcgcaatgcgcaaacaattggacataatccgacggtaccagcaaggcaaactgcccaaagaggagttggatgcccttttggaggaggcacgacaacgggacgcacaagttgtagaacaagtcaaattttaaacaatttttgattttagcgtccagacaaagagcagtacgaagagaagattaaacaacacatggcaaaggcttatttcgaagatgttaaaaacgtacaccttttaacattgtttcaattgtaagcattcttacatcagtttcttattaattaggttcgtacctttgatgactactttcggtttcttcgaggcgttcggattccaactcctgcaagaagcccaacacctataaaaatttttgatgaatcatgcccggaaataatggattcgttccaaggtaatatatgtttcgcttgataaacataaacgaacttagggtcaattggttgtcctgtttagttccgtgttttgatagttataggtgaatccgttgaagaaattgagcaagatggatcattcacttcgttgtacatttctttggacaaatcaaaagaagtgtttggggaatccgaagctagggtaaacttgaggccattgccacaattcgaatccattggactgagaacgcgtgtggccaaatacgcggaagcaaacgaaaaatgtttattgaccaagtccggacccgaagaatttaaagaacacacaattccgattcggcgaatggaaggcatagaaaatggcattccgattatagcgaagggtcgggaaaatggcattggtatttacatttcgcttttttaacttgaataatttccaattcagatgcaaaacaggtcataaagcccgtggctggaccggcagaagcgacagacatttccacaaaacagcagcggatgccacgaatgcaagtcgccgccacccctcctacggaaaagccgaaaacacggaagcgaaagtacgaactcgactttttccttagcttctcataaaaaattcagacatgagctctctgatgaaaccgatgctgaattagaaaaatcaaatgcaaaacgtttgagaacatcatctaaacctattacaggttattttccttttttgtgttctaaaaaggagtattggttagactttaagcgaatgagttaatcgttagtctgtgcctaaagcatgaaaatttaagaaaattagcgtaagaaaatgtcaagaaaaaattcttctaat

SEQ ID NO: 3670 - DNA, 3418 bp, Heterodera glycines
  misc_feature (40)..(40): n is a, c, g, or t
cagttgcgtcgtgcggccatcgcctcgtcgacgccgtccnccgccgtggacagtgtcgcggacaaccgcctcttcctcaagccgggcaaacgctcctccactgcggtcctccctaaacaaattctgctcaccctttggcgcgacattcattctcatcgctatgcgccagtcttcagttttccggtcagcgaggagctagtccatggctatcacactgcaatcaaaaagtaaatctattcaacaaattatcactttttctcactaattatttagacccatggatttgaaaacattgaagacgaacatcgagtcgggtgaagttaacacgctcggcaaattcagttatgcaattctcaaaatgtttgccaacgcggttatgtacaacagtaccggacattatgtgaacaattacgccaaggaaatggttgcgtacgcattgaaatgcattgaggtgagcagtcaaatccaaatcattcatctcatcaacttcttgtctatgctcaggttgttcagtttcctaccggccaatttcacgctccgccgcccagtcgccagagcaatggcagttcctccgaggggggtgcaattggcggagggggagcagcaaaatttaccattgcttgggcaacaactctgattaagccgaaaggggtggaccaaaagaaggcaaagggtcgcaatgacgaagagttgaccagcagcagcagccaggacaaggagagggaagtgagtcaatcaacctacgcaaaagccaatcgtaaatgcaagcataaaagcgacgttttcaggcagatcaacgcgatgaggaggaaacacgtcgtcttttccaacgacgtcgaatgtataacaaaaagtacacatttacgtctacaatttaatccccttctccaaatttggtgcatttcaactgctctctctccctttattcatttatttgtgctcaaattatcatactgaaatgcgacacttactaccactcattattgatgttagcaatttgtattttccattttcaaataaacttatttacatttttgggattacctttgtaacgttttatatttcaaaatttttacctactttcattaccccaaaacccattaatgcttccgatgtcaaaaacggggctatccgcggcaattgatgatgaattcgaccctgacattgatctttcacagaggtccaggtcggattgggtgagtgaacctcttaatatatcggctctaatgcagttaaccgtccaattaatgaccatcctcggtttctgaagccttaacttttttcttacttggttaatccatatatccttcgtatcaattgaaagctccaagtcccgggaatttataaatactatacaagaaaagaacaaatacttgcattaagaaaaaattgcaatgaaaaaacctgaaattcgtcatttttcgcgaatattcaacaataattttatgtctgttgcctttatcccagaatttttttatgcgtaaacttctgtggactttaagctctcgattgatacaaagaatgtaagttttgagcaagaatgaaatatgacttaagaaacaaaccgaagatagtcattgattgttgcgtaaaagtcgactggactgcattagagccaaatatgtgctttttaaatttccttttctaggttggttcatttgctggtaatccgtccacagctccgacggtttatgcgatgttcaacaacagcgtttggacttttatgcttgtttacggcgtgacaggccgatttatttccgcaaggtcccaccatccgcggaaagagacacatgggtcaccctcggttttggttttcactaatagttgtactggttgcgcgaaattagccgtgcccagttatcgcccaccctcagccgttttgtttttccctactttttttgccccttccagtgttgtaagtttactcacgatgccagccactgctgctctgtgggtttgggaggctgatcgcgactacgaacgctgggaagggtcgcgggtgttacgtgagcgccgagttccaaaatttgtgctcccgcgaacggtgcggattcgctatgttccgcttgcatttataaacttttttagattttcgattggtctgactttgattatgctcaacagatgagaaaggctcctaccggttaaggaaaaagactatttacctaatacatatttgaataaagagcattgtttcaatttctcaatcatattgcttttttgttgtaattttgtctaattttgatacctccaaaaatttgttagcctgaacaactgactgccatttaacatttgaagcagtgaatggccgcgacttctcttcaacaacagctcaagaggcttaaatcggcacccaccggggctttggcggttgagcgtgattattcttcgcttcttttcaccaaaaaagcggcggctgctttagaccgagacgagttttacaaaattggtgattttctattaagacattgttagaggcgtgggtggggatttgttctctgcaatgattattgcgagttgcgttttttaggacttgctgggctctctggcatgaaaaaaattgacaatgcattcgacacttatgcgccagaattgttttggaaggacaagaaacggttcaatagagcgatgctccagaaggatgaggcggagcagttcgaccggcggattgagacatttttgctccgtctcgccgcccatttccatcaccagtgctgtcggcaggtgctcgaatggctcatccataactatcaggttctcgacgttagaatactaacggaagatcccctttaggaatcgtaatcgatcaattagaaaagtcgctttctgtctctgcctgtcacgactaactttctaggcgtttccccatgtatattggtttgatccttccattttcagattcacacatacaatgccgaggcgcttctgctcgcttttctgccttatcacagcgtcaattccttcggtcggctcctccacattctcaaattcaactccactgcttgggattggctgacggaatatcaaagggacgcagcacctattccgatgaatattttatgtatatttacgaactcgcttccgttttatttcaaattaaatttctaaaaagttttcaaatttaataattgaaaggaaaagtcactgttaaggcagagcatgtcaagtcggtcgttcctatggactcgtttccacactgtcgaacttcgtccaaatggcaattgagcagcttgggtccacatatgccaatgacaaaatgcaaaattattttacttttttggtgtctttgttcggcattttgattgaaaactcgacagctgacggaactgttgatgaccaactccttgccagattgatgccgtttttaagcgttgcattgaagtgatgcgctttttatttattttcaatttgatttttc

SEQ ID NO: 3671 - DNA, 2215 bp, Heterodera glycines
gtgacgcctatctgtcgatgctcctcaaatcgatggacctggagggaatggacagattccaagcagaaaaagccgcgcactttctttctttgcttctggaggaagagcaatctcagcggagttgtgaaaaacgttttcaaccggaggtgctatttgaacgggcgagcctttgaaaggcacttttccttcacatttgcagttgtccggctccgagctgaagggcgctgttttgcgctatgcgaaagcgatcgaactccgtctcgggggagaaaaagaaaaatcgacgaatgtcattatgatggaaagtgctgtcgcccctttttattcaaactgatcaggaggaccttccctagtaataatgctaggggaacctttgtttttcttttaacgccaataaatttattgaccaatcccaaattctcggatgaacatttttatgtgcgtaatttggccttcgtccgccccctttggagtcgataattcattcatttgaaaatttaaatgtcgaaacataagcaattggtaaatttcagtgcatttacacggcgagtcaattttgggctccaagtagtgaacgacaaaacgacgttttagtcgtttaaaaaaaagaaacgatttaacatcgttttgttaattttaacgatgtgcataacgccaacgatgttttaacgatgtttttttaaattacgaattatagaattgaaaaggatgtaaatgaaatgcaggtgtttgcaaattatgcaatcaatctaattgaggtaatttctctaaatatctaaaaaatcattaaatgattacagatggaaaacaaatgctcgcttaaccgcgttcttattgagatggtcaaaatagaaaatttatggagtgaaaaatcttcatccgacaattattttatacaagcactggcaaaaagtggcttggaagcatttaggcgcaaaatgtgtgaagttttttggcaaaaaaatcctacaattgttcaatgtgcggcatttttggaccctgcggtcaatggattattgagtcaaatttgccattcgaattctaattggggaacccaaacaatggttatgagtcgggatttttgaaattttaaatgtataagaatattaagatatttgatgtaattgtcagcgccgctaaagagcgctttccacaatgcacacaaattgccagaaattttgaactttcaccgagtttgtcatgctttcaacagactcctaaaagttgtatcgaagcagaaatgattttttacagaaatctttgcgagtcccttggcgggaaaaagataaatctgcttgatttttggaaagaaaattcaaaaaaacttcactttttgtcttctttggctatggagtttttgtcaattcccgcatcatccacatcttgtgaacgaatttttagccgtttttcaccgctggtttatgattatcgtcgtaatcgctttgaccctttcacaatttcacgccttatttccctacaatcattgtttcgcgatacttaatttatttttaaaaaaatatcgttaaaacatcgtttggcgttgtgaacatcgttataattaataaacgactttttcgtcgtttgaatttataacgacgttttttcgttaaaaaagtcgttttgtcgttcactagttccggaatcgctggtaggttcgaatccatcacaatgcaaacaattttaaggcatttaatgaaataatttaatttaaaattctaaggcaagaacatttttaagatttttctttcgtattgttttataaaaccaaaaacaaatttgggcaatcaatggtaaggttttgtggtttcttcgagaaataaatttaaaaatttaaataacacagggctcgtatcgtccatgctccgtttccaaggacgggtatgccgatttgcaaggacataatgggggaaattcatgaaatccaaggacatttaaaatttttattatatgcaatgaaaatggttaatatttattcaaatggcttgtatttttcaccggaatagattttttccaaaattttttgttttcactacggtgggtcggggcgggaattcccggtcacggtttttcccaaaattcccggtcccataccactttaattttcactgatcattttcctaatttgcgacgccttttttctgctttaaaaacgctttttttgcggcgcgctttttccaaaaattttgtggcataaggggcgggggggggggggggg

SEQ ID NO: 3672 - DNA, 1238 bp, Heterodera glycines
  misc_feature (1169)..(1170): n is a, c, g, or t
gcatacaagaaaggtttgcattcatttttaaatattttaaacttttaaaaaaaagtaataataaatttaataaattcaaattttataataatttaaccctttattatggttttttcttcatttttatttcttattgttttttgcatatttttcaggtgtttgtcaatgtgcgggtcgcctgaagttgagacaaaacgttatgtgccgaggcctttcatgaatcagaattgtagcggtgaaatttccaaagtgataattaccaattaactaatgacttaattatttaataaaaatcatttaaaaacataaatatttattttttggattattttttaggttttgtcctgcgcaatgccacaggtcgacgacagcgattgttgcattgaaatgcgggtacttttcgcttcattttaaactatcagatttcaggttgagtgtttagttgccttctcagtgcctttatttgtgcgattttcgtgtgcctccgacaaatcttttgccgccaatttgcttaaatcacatttcctcagttgaagtaagaaggaaaaacagaataaacattcaattaacaaaaaaaaatattttaaacaaattttataaaaagttaaaagtaaaattattataaatataaaaaataaaaataatatataattctttatttataccttgtttatgatatattaatcagtgaataaaattattcattttagcagtgccgcctttttggcactcaaaaacggccaagttcagtacgcaatttgaaagtggcggcagaagttggcacagtgtcctcctcctccattctgttgcgctgggacactgccgatcgtgccgacatttactacgtttactggcgcggccgaaacgcggcggaatggagcaaccgatcggcacggaacacgacgctaatgaggattaatgtggacgcggcaatggtcgatgaggtgcattaaaacaaaatttggcttactatgaaaaaaaggtcaccggaccggtgaaaaattaggacattgaaaattggtccagtgtctacggatcggattttttttggaaatttttcaaaaattcatgaaaattaatgtcaattagttgtagggcaagtttaaatctaaggatttgatctataaatacatttcacctgctcatggtctttttgcatattaaggtgnngtgtgtgggtgccaacttttacggactttgggcagcgcgtgcgcttatttgaggacacattaactaac

SEQ ID NO: 3673 - DNA, 10381 bp, Heterodera glycines
  misc_feature (135)..(135): n is a, c, g, or t
  misc_feature (10293)..(10293): n is a, c, g, or t
cgtgtatgtatatgatgtgtattttttgggctggtcactaaaacgctaaaatccttctatagaaatccgattattaatctattattaataattctatttataaaatgtgaacccttcccttcccccctggcgatngctcgagaaatgcatacaaaaagcgagagaagtaagcataaacacgagaaaattgaaattaaattaactttattaaacgagtatcgaatccattttcaatgcttttctgacaaaatataccatattcttaagaacaatttaataataagcagaaggacatatttatacaaacttgtaaatttaaaataatcatattttattttctttttttttaatttcggtttttgcttttttaattccaaaatgagtcactcacttttatcgggcttcaccttctctcccccccccccccttccatcacaaaatacggggctggcttcttctggtgctgcaatatgcaaattgtttttattgtacaacacatcgcattttcttttcttggcttttcctcattttctgcacatttgtgtcgacaaatagcacaaaattttccattttctgtcgatctcattccgctaaaaattatttactattgtaattacccaattaactgtttaattatgtcatgcgaaagtataaatgtctctttccttctctcagggtcatttgagcttaccaaacagtgttgttattgttcacattctctaataaaaatgcatttttatgaccaaaaagttttgactcaattaaatttttttcgaaaacagacacaaagaaaattataaacataaattaattcatttttattattatataattgtgttatttcttgttttcctctatgtttaatttcttttttgcattgtcttctcacatttaatgtataaatttttaaaaaatataaaaattgaaacattattgcaatacacatgtgaatgttataaattgtacaatataaataacaaagaatatagagaatatttttatattttttttgactcgattattaattggattaattaatttattttctatgcgtttgtaaagcggaatcccaattaataaaatattaattattcgagccctaagactggggtccaaacgaattttattgggacttccggtccaggtcccgtttttggattaaaggacccgaaaagccgcggaaaacgggttcttgtcctgttatttccgttccggtcccaccaacgctgtaaaatgcataaagcgattaaagttttttgttcattttagccaaactcaatttattatttattaaaaaataagtttttctgtaaaaataacaaaataaacgacaataaataattaaaatacacaagcccagaagaagcagcagctgaagagaattggtgttagaaagtgttgtgaaataattgtgaggccgaagaaaaacaaataaaattctgttaaaattttcctttttatcgaagtttgcctttgttttttaattgttttagtttggaatattaccaaataatggaggacgggcactttttgcagttttattcagcaacattttggaaagtggcggcttttgctgctgcattactttgatgtgtcgtgtacttaataattctaaactttgtttaaattttttgttaatgtttttttaaatttttttaaaagttttcgaaaagggaaatttttaaaattaattttaatttgttattttacaaattcactttttctatggggatattctctaaattccgaatttttatgctccgattccttcacattcttggacgcaaaattgcttgacacgagactaattggtcttccatttactgcaatttgtgggtctaaattaatattttacgtatggattaggatgattttaattaattttctttttagattattttaatatttatttttgtgtctttttactttcttttctcaccctccattttgacattgttaatttgtcccaaattgttctcgtcaaattgcattctgttcattctttccttagttccattttctttctcctcttcatttggttttgttatgttttggatgtccaaatttggcaaaatcggtggcaaatggtccgctaaaataaacaaaacaaaaaattatatcaaaaaagttaatttaatcgactaaaatttaattgtccaactcttgcctacaattttaaacacatgctttttgcatattataccatttatttgtattttaaaaggttaattagtagggattgatgcatttaaaacacacaaacaaataaatttaaatttttcgaagattttacaaataagaatatttaaaaatcaaattaaattttaatgatgaatttttgagagaatttttcaattgaattgaggaaggttttctgaaatttttcggttcggttaagaacaaaaatacgaaatatgcacaaataagcattaaaagtggaaacccttagcaataggattaatatagacttagttattaattgtaattttattttttaattaatgtttattaattattggttttcatactgtatgcgttttgctctgttattgttttttcatttgaactgacaacagtttgtggcacgggtgtccttattgttactggagttgttgttggcgatataaatgctaatagaatctcaatttaaatgaatcgccaataaatgctccaccgtttgccttgacattgccattttggtccatttgtgttaatgacattaatgtcgtcgattttgccgttccgttgttgcctgtggcattctccgtcggcgccatttcttgcacaattaccgaacgtacattaactatcttcatcacaccaaacaataaaaaagtttaattttatcaaagttttaatagtttcggcccatccgtttgcacttcttttttcttaccggcatattcgacggttcatttgctgggacatatggcggcggtgtcggaagttcagcagcagacgccgtttgaagttggcgggttgttaatgtgaaaagagtgccattgacagcagctgttggtgtacttgttgatgacgttgttaaatcaatgtctgcaaattaagcgaaatatttatttataactgtttatattttggaccactaattgttgttgttgttgttgttgttgttgtttgaatcagttgaactggtgaagtgacaatttggtcaatttgctgtgcagcagtggtgccatttttcgtcccattttgcgatggcatttctgttgttgttattgccttgcccccttctgctgttggcgttgtggagagagtcgtggccgatgaggaggaaaaggccggtgccgatgctttcaatctcgctttttattttccataccattttttatttttaaatatattttattttttatttccttttacttttgattatttccatcggcatttgttgtttttgttgctgtgttccctccgtgctattactgctcgtcactgttgctgttggtgttgttgtacttattgtcgtcgtcgttgtggtcgaagtgcttgttgaagttgatgatgtaatgctgatgttgcttatgcccagctaaattgtcatattttaatttagctttccaccaatttttgttcatcggatttgttcttattattgtttatctctcaccacagtttgtgctgtcgccgtgctgttccgcccatctccatcctttgctacattttcgtcgccattgtccaaaagtgtttttgtcaatttttccgttaccgtaatcgctgccaattccttgctgattactgtaattgtctctcttttgggttattaattgaacaattttcttctgatcactcgccttccttcaacattttgagctgatcagctcgacttgtttccttttgctgttgatcagcagcagttggaatgctttcgtcaatcgcttgcaaaggctttcgcaacaaattcgtcttccaaaagtcgagtttgttcgaaattttgccaagtctctccttcaaattttccaaactttcgtccactgatgaccgttgcttctccgccactttgtcgttgaaaccgataagttttggtgggctgttaaacacgccgaaattggcattcctcgcaaagaacggcttaaacagctgaaaaaatgtttttttaataacttcattattttgaccaaaaaattatttttttttaaccagcgatgccttctttcattttgaaaaacctcggttcgatcactaggataagatcatagaaaagcatcaaaaaaattaaagacgaaaaggaaaagcaaaaatcagcggttaaaggattaaaataaacgatgaccgcacaggtttaaataacagaaaaattacggttgatttttttttgaaaaaattggacggaatgatcaaaaaaaaacttatgagggtgtttaattttaatacataaaattctattctctttcaacatcggcattcgtcttacccgtaacggcacttttttctgtgcgctttgctgcctattaattggacccaaaatgcttttgtctgctcctttttcgcttcgctcgcattctttcgcgcatcccttaacggacaatgaaaattgcttttggcacttcataactggcacattattcggtgaaagtaattccaaaataattcttgataaatttacacagcagcagcagcaccggcgcgggcactgtttgccgcagttggcgccgcacggtccgccgcccatggcgcctttgccgtaatgcttttcccattggcctcccttttttgttccatccgattcctcctcctcctcctcttcatcctgctgttgttgttcctcctcttcctcctcactttttcttttctcttcttcttcctcctcttcttccgccctttaaataaataaaatttaaacattttaatgggtccgtaaaatgaaactttgttcgcaggcatcaaaaaatgactgcctgaaataaatccttattcagagtttttacttattaatacattaaatggcacataaaatatttttgcggtccggcaaaaatcggtttcaaatcttggggttttcaatcccagatcgcaaaatgatcactgaatagctgctgataagttatgatttcactcgaaatattcctttttaattaatttctgaaatattaccaattattttaataatgatttaaatattctattatgtttaactctgcttttttcttaattatattctgtaaatacatcctataataagaaatgctaaagtttttggcctcgggtggcaatcgaacccactcgttcacacattccatgtgcaactctaccattgagctaccaaggcacacccgcccattctttttttaatcatatcaacccccttataatgtaatcaacgccccaccaatacacaaataccgtataatattcttctgccctttgcttgtgatcattgaaattttgttttcgagtttgccaatgttgtcacactgttggcactctccgtcaccgcattccgatgccatcgctctctttgactgcgtttggtggacaaaaaaagtgccaattggcactaaaattgcttttgttgctgccgcaataatttttggtgatgccgcggcatttttgagctgcggcccatccgctgactcttgagcttcctcattgaattctgatttttttagtgtcgttataaaatgtttatttaatttttatttatatgtaatttatgttttcgaccttcagatgtttttccattattatcagcataaactttgcaaaaaggtcgccagaaaggatttgcttgtgcagcatttcttctgtagttgatcgtctgcattttgtagaatttgttttgcacgtcaaagtttggtctttaatttgtgtataattagtcaatcaatttaaaattaaatattattatagctaaataccttgaattaaaattgttaatgcaacaacataagtgtccatttttgcttaataaaagtcgtaaaaaatattttgaaaattataaataaaaaataaataaactgacctgctgcagaataaaaatgaatttccaattttcttaatttatctaattaattgacttgacttttttattcatttaatttattaccacatttattattatgagtgcaaaacgtaatgatatcgctaataggccgaatattatccctctgtttttataatacatttacttcccttattaacaaaattgttaatatatttctaattaaaagttgttcggaatgcgcggcgaatgatgaagcgaaatgcgcttccgacagacggaacaaattagcagcccattagcatgacttagtttactttccccgttttttggtccctaaatttgctatacaaatatttgaaagtgaaaatagaacggaaactagttaaataggttcaccaatatttacataaacattatggaagtgaaaaagaaacaaaatattaaaattaaaggggctaaatttatgcatttgaaatgtttacatttctaatgcataatttatgtatacaaaatgatttctgaaccttaaaattttgtttgtttttttcaaggcaaatgacagtctagacagacacttcctttcacggataacaaaaaatatatgcaatggaatagtttgtataataatattgatattatattaaaatggcacttttaggaaacgcgctgacagccattttggctcatttaggaaacgcgcatgggtggcactgtttaggaaacgcgtcagcacgcccccattgaagggttataccccaaaactatttttatcataattatttttaactattttaaagaaattaccaaattggaaacgtaacaccggcaatcggtctaatccgatgcacatttgcatcgccaatgcgaaaggacttgcggataagataactaattgaatgtaatagcaatgtttaagtgtgactgtaatgatgccgaaaagaaagatgaaaaatttaacaaaatatccggcaaagaggaaaatgacgaagaaagcgtacaaagcgatcagaatgttgcattgggagtggatggttctgatcagcaaattgatataaaaattaaatgattttatattaggatccggtcaattaaaaaacccaaaaaaatttgcgattttattaatttatgttaatgaaatattaaattataaaacctacttttggtgatgcaatgagggaaatgttttgctttccatttaattttacctgctgctgatagttgaatatgtttacataatttaagaacggattataatttgtttgatgaaaaatggatttattaagataaagctgaaaaagtgatcagagttcgggaccggattttcaatttttgcttacaccataaacattcaaaaattgtttcagtttatttgcttgaaaattaaaaaaaattattcagtgatttcattagaatcttttttcatgttaatttataaatttatgtgttttcgaaagtttttgggaaacgcactacgtttaccggctcccggacaatcggacagtggacattccgacaaatggacaatcctacagtgaggatttgtttgatgctcgttggtctcgactcgagaaaggtcttctcggttcgtggtttttctagctcggtctcggtgttcgagactcgagactaaagatttaattttttcacattagtaaaatgagatacattgaattaaattaattcgacattttaataaaatgattaggcattctgctttttgttcctattggcttgtcggcatccaattaaatgctcaaaacagcaaaatgaatgattttggcgatttggtcccaatttatgggcacaattccactgatcccgcggctttaaaagaatttgtgatgtgttcattttattcaaggacagaaaagttgaacaaattgtaaaagttgagatttcaattaataataaaatattgaaataatttagaatgcgaaaattgcaattcgaagaaatcaaaggaaaataattcaccaattaaagaaagatgtatttgtttaattagttattttgttcatgctaattagttttaaatgtttgttttacttttgttaaaaattaatgcaaaaatttcatttttatttggaaagcgaaaaaatactttttaaatgaaatgatgttttcagtgcactttgacttttgtgttatgtgcaaatttgtaaagttgaaaaaagatttcacaattaaaaaagtggattctcaaaaagtcagtcttataattttcttaaattcctctgaatttcaacgacggcaaattcctttgatttgctgagttcgtgccgaaaccgtcataatctgatgaacatgaatggtatttctcgatttttcgtttccaattttcaattgtttgctaatgatttcgcgcaattttgacgaagcccacaaaagcaacctgaaaatgaaaaaattaattaaaaatttggtctttggtgttttgttaccaggctgggatgaccaccgtggaaaggtcatttacccatgggttctggttaaaatttgcgaaaaaaagaatgtcattttgggccgatgagacattaaaccattcttggacataggaaaagcgattgttgtgctcgtcaacaaaatttgttgcagttatgcagacaaaaaactgaaacatataaattataaaattgctcaatatttccatcttttggcattaattaatgtgaccataaataacgccatgagcagttggccaaagaatgtggccaccgtgtaaatggtcattttacattcatttgccgcattttggccattttgttggtaattgctgcgcaatttgtaggccaaaagtgtggccacattcagaaaaaggcaaacgatgccaaaaagaacggcagaccaagcggcgatttcgctgctgttcaactcctaaaaggacaattttagtaaaatataattaaaactattaattaaaataatacattttccgtcttatggtcgtccagagtaaaggtggcattgtcattttgaacatggatgtacatgtccaacccaaaaattggggcggtgaaaggcagcggaaagatgaaagagaaagcgacaacaaagggcaagccgacacgccacaactttaattaaatgggaatttaaaacaaatttaaaataggttaacaccttttcatatttcaacgggaaaagaatggcgcttaatcgatttaacagcaaaaaagcggtcaacaaattctccacatgaaaaacgtaataaccaataaaaaacagaaatgccagcaaaagccgcggaaatttgaggtaaatgggaaggaaaaggccaatcttgccaaaacgatgggccaaaaatgcaacgaagtaattgatcagactctgaaaaagagattaatttatgtaaataaagccgtccgtaactttaattgcaatgattaatttttaattattttcctactagaatagcacggatgataatgaggatgaaaaaaggggacgaaaagtgtttgaagttcgcgacgatgaccagcaacagcgagcagtacagcactgcagacggaatgccaatggccaaagcgaagagaaaggggcacaaattcgaattggccaacatggccattgcggaaaagaacggcgcggaggcggaggagcccattaggggagagagtgtggaagtgatgtaacagggataaaagaatgactgaaaataattaattaataattaggtatacatattattttttaattattgttttggcattttgtctgttcagtcggcggcaattcaatgccataatttgtgaaataattttatttaacttacgccgattttttttcagtaaaccggcggcttatttaattattagagagagagagagtgcttttacgcacttagaaacgccaaatatgcgttttccaagatattaactaaaatcccccgcaaaaacaaaataaaataaaagaaaatttgctttaaaaattgtcaaaatggggattcaaaaattctcatacaatggaatatccatattctagccttttcacaaaaaatgtaaaaagcacctccaaaatggttttttttaaatcaaaaaataatttttatttaccaaaatttattcttaaaatttgtgttgttccccgaccttcgaacggggagagaaaagtcggagatcgggcaggaaacaaacacccacgttggggagaaaattttcataaaatttttaaaaatttctcgaaaacaaaaaatattagaaactcatttaaaatagggtcgcatgggtccggatatttaggcaataaactgtttcaggatccaagtttttaaccgggtccatctggtcctgaaaaatgattaataacttattcaaaaataaatgcatattccacgnaaagagtttgtaattttaatttattaaataaaaatattttcgaaagttggatataaaatcaattttattttttaaaaaacgtagaaga

SEQ ID NO: 3674 - DNA, 4315 bp, Heterodera glycines
tttattgagtaaaaatcttgatggaagttagttgaatttgtgaattttggtaccatgaagtgccaataatagtcgattccaattagaatttgaggacatgcattagcgatcgggatttttattccaagtacatcaacagtttctttattaaccatttttgtaacatcagtaattttttccactgtttgtagtgttatgtactctatttcaccttttaatgttttaatgccaactttgactagtcttgatttaattatttttggcttattttgattgaaagtggaaattgctaataatttttcctcaattgtacttaattgaagagtttgaacacattcttcggttatataacttttttgtgacccattatcaaataaaattatttccttttttattttaggcttgtctggattgatgacattgacttcagtagtcataagtaattcttcttcctcataattatagaaatttttatcataatccattgtcatgaatgtctgtgtctcttcatgattttcgtaattttgagccatattcactttggttttttgctctttcgctttgtactgagtttgttttcgggtacagaggagagtattatgtttgtatttacaattaaaattgcattctttacttgcatggttttctctttcgcaaaagcgacaaaatattttattttgggttctagtttgtgttggatttgatttaaactgtgccaggcgtactgggtttgatttcgttgtaagtgcagaagtatatggaaaaggagaggaagatgtgttctgttgattccgtgggtttggtttcatttgattgtgtgggaaatttggatagaattgtctctgtactccgttttggggtggtctattagaggggaaattccggatttggcgattcgattcttccattctttctatgtcttcacgtgcttgggtatgatcgttcataaattccattatttcttttgttgaataaattttgaatttttccctcaatttaagtctaatgttataggggagtttcgtttcgattgattgtttgatttgagggtgatttatgtcttccccttgtgatttcatttgtaaaattattcggtcaattaacaaaataaatcgtcttaattcaattgtggattcagtgggtcttttgaggttgcgtaattcgctatgaagattttctctgattaattgggggtttccgtaccttgattttagtaattttattacgatagtataatttttatttgtaaggggatacggtgacactattctgtacggttcatcatgtaagagccctctaaggtatttgagtttttgtatattttctaaatttgggtcattgtccactgaggatttgaagtcatcccagaaactgggccattgggagaatttgccattaaaatgcgtaagcgtttgaggtggaagctttattcttgatcggtaattgacaaatggtatacgatcatggtgtatttggtcattcaaggaaagttctggcgattcgtcttcattgtcactttcatattccttttcttcttcttgttcttctacttcgtcttcattttcatgttcataatcatttgattcatcttccgggtctgagtctgaagatgattttgctttaagtaattttaatctcctttttacctccaaatttacgtcttttaatgtatcgagaatttcatctatttctttaatggttttaaggtagtcgtgtttttcacgaaagattttttgaactttccattcattattccattcttccttgttcatttttctcattaaattttgccaccttttatttaaggcttttaatttttcaaaatttggctctattttttggataatttcctttgttttattgaatatccgcatgcattctccgggattattttgatcatattcgaatttgttttcctcaatttttgttttgatcgtttctatttccctttttaatacgcgattaaggaggggtattttgctacgaagcgtaccggacatagtttgtattttaaaattttaaaataattaactaagtatccttttatggttatttagtggataatcagaaaaatgagaattttaattaggtatttatcacaagttaataaatattattataattttaatgatcacagaattaacaattgttacgaaatttaaaaaaaatatatataatcacagaatttttttgtttttgttaattatttgctccttttttttgtaaatttctttcagtatattctctgtatgtttcgggcgaagtttcgttaatttgtatttcggtttgtgtttttaaattttataagttcagtcagtgtagtgcttttcgccacttgtttctttttcgtgttggctttggtcgtcggagtaattgaattaggagtcgctctgtccacttaattatttaaattagtgatgggtttgctgtagggtttattatgacttttaattatgtttggctttttatggtgtcctttttcggttttttgattgggtttggtgatccgtgtgtgtgtgtgtgttttttttttaaattgggtttgtcaacccttgattttgtatgggcttggtgacccttatacttccggatgacgagcagttgcgcaacggtgaatttgacgttttgacgtggcaatcaggtgcagaccggacaggcagcacagtaagacgaatgggcacagcaggacaaacgggcagagcggcaggcacggcaggacaaatgggcacagcggagtggacaggcacaacagggcgaacgagcacagcgggacgcacggcaggacaaatgggcacagcgggaaaggcacggtcccgggtcgtggcaccaattcttgtcgtggcgacaaaaaatttgcgtcgaactctgcggggtgaaggggacgggaaggggatgaaatgggcgaggcgcgcagagtagccggtcgggggaacgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacgggaaaaagggggcacaaaaacggtgacagtaaataaatcacaaatggaaaaatgtggcaaaatcaaaaggggtcagaacggcgaaacggcgatgggaaaatgaagggcattcgggcaacggctggtccaaaaggggccacacaatggcaaaggaaagggagggcactcgagcaggcgcggacagggagggcactcgcacagacagagagcagcgaaggccgggtgcagtgaaaggcggtgggcgggtgccgggaaacttcggagggaactgtttgtctcgaatctgaaatttccggaaaagtccacccctttaaatacgatttttttgcaccaaagtacgctacaatttctcattttaattaaaatatgtttttgtgtgttatccgtttggatttgccattttcccattaattgtttgcttttccgttttccctttacaattccaatttctttaatatattaattattaataatttgtttacgaacaatccttaacagaattcgcaatttaatattaattaattttcgttcctttcattcctgaggaaatgcacttttccttttcaaacaattttccgttattcatttcaaaaggtttttttcatttttatgtaattatattttcgatagttttttataatattatttttccaaaataaatgtaaaaatattttttattatttatgttttatttttccccattttattttctattgttttttatttttcctcttttttattttgggttttatcttaggatttcgcgttgtcgcgacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaacccagaggaacaattccataaattcatgaaccaaataaataatttaaaattattttttagaaaaattacccttgtgttgggtactaaaatttttattccgaaatagaggctttttaaataaatatatggaaaaaccagaggaacaattccataaattcatgaa

SEQ ID NO: 3675 - DNA, 2792 bp, Heterodera glycines
tgtttggctgatgtgtttttggtaaaattatgatgtcctcctaagcactttcttcaaacccgagcatgccttacctaccttagtcggcgaatcattagctgctcattttctaatatttttagaaatctcctcttcattttagaaaaaagcactattttcgtgcctttttcagactgaattcatgacaaaatccgattaaaattctctcaattacatccaaaaccaattgcatctatattaactgctgcaaagaccaacctgcgtatgaattctgataaaattatgacgatcaactaaacagcaatttaaacccgagcatattcacttattgcatccaccggtgtataatagctgctcattttcaaatatttttagaaacctcttcttgcatttgtgaaaatgctatatactcgtgcattttgaaaactgaatcccagtcaaatcccaacgaaatttcactcaaatacacacaaaacgaatttattattaatcgagattatgcactgcaacggtggttattttctgtcatataaaatcacaaaagttttaaagttttctcgacgacgctgctgaagggaaaaatataataaactcaccagagctgatatcgaaaataatcaaatcaaatcgtttctccgttttgagaaagcatgttgtttggctgatgtgtttttggtaaaattatgatgacccactaaacactttcttcaaacccgagcatgccttacctacagtagtcggcgaatcattagctgctcattttctaatatttttagaaatctcctcttcattttagaaaaagcactattttcgtgcctttttcagactgaattcatgacaaaatccgattaaaattctctcaattacatccaaaaccaattgcatctatattaactgctgcaaagaccaacctgcgtatgaattctgataaaattatgacgatcaactaaacagcaatttaaacccgagcatattcacttattgcatccaccggtgtataatagctgctcattttctaatatttttagaaacctcttcttgcatttgtgaaaatgctatatactcgtgcattttgaaaactgaatcccagtcaaatcccaacgaaatttcactcaaatacacacaaaacgaatttattattaatcgagattatgcactgcaacggtggttattttctgtcatataaaatcacaaaagttttaaagttttctcgacgacgctgctgaagggaaaaatataataaactcaccagagctgatatcgaaaataatcaaatcaaatcgtttctccgttttgagaaagcatgttgtttggctgatgtgtttttggtaaaattatgatgacccactaaacactttcttcaaacccgagcatgccttacctacagtagtcggcgaatcattagctgctcattttctaatatttttagaaatctcctcttcattttagaaaaagcactattttcgtgcctttttcagactgaattcacgacaaaatccgattaaaattctctcaattacatccaaaaccaattgcatctatattaactgctgcaaagaccaacctgcgtatgaattctgataaaattatgacgatcaactaaacagcaatttaaacccgagcatattcacttattgcatccaccggtgtataatagctgctcattttctaatatttttagaaacctcttcttgcatttgtgaaaatgctatatactcgtgcattttgaaaactgaatcccagtcaaatcccaacgaaatttcactcaaatacacacaaaacgaatttattattaatcgagattatgcactgcaacggtggttattttctgtcatataaaatcacaaaagttttaaagttttctcgacgacgctgctgaagggaaaaatataataaactcaccagagctgatatcgaaaataatcaaatcaaatcgtttctccgttttgagaaagcatgttgtttggctgatgtgtttttggtaaaattatgatgacccactaaacactttcttcaaacccgagcatgccttacctacagtagtcggcgaattattagctgctcattttctaatatttttagaaatctcctcttcattttagaaaaagcactattttcgtgcctttttcagactgaattcatgacaaaatccgattaaaattctctcaattacatccaaaaccaattgcatctatattaactgctgcaaagaccaacctgcgtatgaattctgataaaattatgacgatcaaataaacagcaatttaaacccgagcatattcacttattgcatccaccggtgtataatagctgctcatgtcgggaccaaacagaggcaaattcggcccggcaaaaattttggcaaaatagaaattgggacaaacagtagacaagcaggggaatgatgttttattccgactgaaccgatttcaataacaattccacgacttaaatagggtgtcattcgctgattaatacatttttgtgtgagaaatgaataagaattaatgtaaacaaacaaatcttttttgaatagaacgacgaagagggggaacatttccaattaaattaaggtttttcccatttttaatgaaattgcatcatgcttataaaatttatcatttccattttatttctcgtgacgtgagtcgcgacactccccacagcaaagttgtcggggggttcagttgctgcaagtctgcctgtatgttgttgttttatttcttatgcctcattccgggttgtctgtgctgagaaaggcgggcggttgattttggttaatcgtaaaatct

SEQ ID NO: 3676 - DNA, 1338 bp, Heterodera glycines
  misc_feature (65)..(65): n is a, c, g, or t
  misc_feature (1266)..(1266): n is a, c, g, or t
ttaaacccgagcatattcactattgcatccaccggtgtataatagctgctcattttctaatattnttagaaacctcttcttgcatttgtgaaaatgctatatactcgtgcattttgaaaactgaatcccagttcaaatcccaacgaaatttcactcaaatacacacaaaacgaatttattattaatcgagattatgcactgcaacggtggttattttctgtcatataaaatcacaaaagttttaaagttttctcgacgacgctgctgaagggaaaaatataataaactcaccagagctgatatcgaaaataatcaaatcaaatcgtttctccgttttgagaaagcatgttgtttggctgatgtgtttttggtaaaattatgatgacccactgtcgcaactcgcgccttctctctctcttttcaccctttggactgaataatgggacaagcgcgaattggaaagattgctttttcccagattttccttccctgcccttcccttccaaattttttaactccacttattattcaaattcaaccaagagaataacacaacaactttatttgacgatttcctctcaaaatatagcgatgatgggagcaaaaaagggaacggaattcaaaaaagattggcacataatcatactgaacacaggaaaaaaaagtcacataaaaagggagggggacggggaaaagctgatcgttcggcgataagagaaattcatctttgcggggcgaaaggcgatgagaaagcgaaaaacggctggaggggaggaaatctgaggattacgttgggaggaaaaatagggacattaggctggggttgtggggcaatggcgtgaaattgtccggcatgtacgggttgtgaaataacaggggggcggggggaaacagacattttttccaaattgctttcgcataatgcgacactttgatggatcgtatgtctaaaaaaagccaaattgctatataaaataatttcaaaataaattatataattgttaaagtacttcaaataattgtttgaaagaattataaaatgctatatatataaaataaatcaaaattaagttcaaatttaaagaaaaaaaagtgagaataattgttgtataatttttttaaatattaatgaaaattattttaaagagcataaattaaaaatcaaatttgaattgttttgtatgaataatataaacccatagaaacagtttttgaaaaagttagcttaaaaagcatgttcttaagaaaaatatacttatcggaacnatatcaatatgttttttaatcctttaaatattttatagaatctaattatacaatacaaaagtaaaacatttt

SEQ ID NO: 3677 - DNA, 4289 bp, Heterodera glycines
  misc_feature (4242)..(4242): n is a, c, g, or t
  misc_feature (4257)..(4257): n is a, c, g, or t
acatgattcgaatttaagaatcgtgaacaaaacgttcgttggatttgatgatttaagaaccgaaacacgatttctaattaatgacgcgcaaacgaaatttcgacgaattcagaaaattcaagaaacagaatccgatttcgaatttaagaagtgggaacttatttgttagtgccaaaaaatttccgggagacaaaaattcatgtccaataaaatttgaagcgaatcggctgcatctcggtgatgtgtttacgggagatcactcacatcctcaagtgcctttgcttcttttttggttttttcatctgctgctctctgctgaaatcaaaaacaattcattcaatgcgttggatggaaaacaattcgactaaaaattcaccgcttcgggaatgagtgttttgacgtttcgcgtcatccgcgacgctttgcccgacatttttgtattgaagacaataaggaattcgtagaataagaaaatgaatgcgtgaattgtaggaagaatgtgaaaaatggtgaaaaacaactccttttatacacatttttgtatcaatttaccgactttccaatttctataattttcaaaaattctataaaagactgaatcattttgaaaaaagcaacattttatttgtttaaaaatctatcaaaaaaattttcgacttatttctttagtcaaaaaagtgttttatgaattttttttaattaacaggctttaaaaaattttctcagataaaaacctttttttttgtgtattaagtttaattaatcaataaagaaaaagccatttaaagattcaattaaaaatggataaaaaacgaaatttaacaaaaaaccaaaattctaaaaggtaaaaaaggcgatttgcttcaagtcgactccaaccgaatgcaaccacttcatgacgacgagtcgtcagatccaaaagccacccccaggcaacacttgaccacaagcatggccaagatgcgttgtatgttgtatcgtaattaaagcgtaatatagatgcatattatgtaaataattgttttttgataaaattatttacataatataaatctatattacactttaattacaatacaacatacaacagacagtgcgcgcaccgccggcggatctgaagcgggaaacggcgtcaacgagttcaccgcgtacgcgcgcaagcgaaccaatgagcttatgtataatgaataaaattttcggtttatttttgtgatgggatgtaaagaggggaagggaacattcatgtcattcattaattaagccccacgcgctctcgcttttctctcatttcttttaccttttctactgcactattttcttacaccgtctgtctggcaaagagaacgctcattaattaagcgtttttctctcgcttttctctcatttcttcccttatctattgtactattttctttcactgtctgtctgacaatgacaagaaaaaaacattaagcggggccaggccgttttcgtacgggccgttttcgtacgaacacatgtttttggactataacttttttctttgccaaccaaatccaacattgttggtatcattcgatagccctatgtatcctctattagcctgcaaaatttcgaaaaatttcgttaaggttcaaaaaaagttcgagccaaaaaatttggaaaatttggttttttgaattctcatctgtctgctggtacgagaagttcaaggcgttataatttttttctttattaaataaattcaacaaaattggtatcatttattaaaaagctgtgaatgattagaagtttgcaattttcaagttttaatttattattattttgtgtcaacaaaactgtcatttttgaatgttgtgcaattcgaattctgatcattttttaatgtaaatgatgattgacgaaaattcggctttttaaatctgaaaggattaaattatgcattatttggcaaatgataaaatgattaaaaaaacaaaattcttaattcaattttaaaatattaataataattaataataatcgttcattaattaattaaaaattgggaataattcacaattacttttcgtttgtttgttcatttatcagtcaattcagtgatcgattatttcatttcagttccaacttccagcattccatgacctcaaattgatttatttctaaaatatttttgaaaatttttgttcatacgcatcggaaaaatgccgttgttttcacgccaaattatttggttttctctgctgaaaatgttgtgccatccaaaaaggtaatgaagcaaagccaaatttatgcgagaaaattttgcgaaaaaatagcttggctttttgaatttctctgagcatttaactgtcataacgaatgacagtttcactgactgatctgaggccggtatttgatcaaaaagattgagaaaatgatcggcggactttttaacacaaatttgttcgaactgatggaattcggatcgccatgaaatttacaaattactaataagttaaggctattttttaactggaaagctttatcgttcagttgctgatcattctaatcagagctgatcagtgatcactcttctatcggtgatttaaaataaatttcagatattttcgttctctgtttatggtggtttttctgcttggcgtccatctgttcgcactttgtgcagccattcacaacattcgcaccgcattgcccgtgctggcgggttggaatttgggggcttgggtcttaaattccgcgacaattttttcgggaaatttggaattttctccccgatttctgacatttctctccccgaggattggagaggaccttagtatatataaaatcgttcgaggtccaaagatttccaagtacagtaaaaatttttcggggtggggcgaaagccccgaaaattgtcaaaaaaacactcctcgaggcgacccattcgtcaaattgtgtgaaatgcagtatttatgtaatacagtacttttcatcggtcatactgtgactgcctacaaattgtttcttcgccaacgacttgagccctttcttgtgcgaccatgtttcagtgctgtgccaactttgcacccatcaattatacactgtattcaaatgtacttatcttttacaaaattttgctgatacagtatccattgttgttacaattctttcagtaccgtacccacagcaataattgtgcttttcgtcgtttggctgatcatcgattcaaacactaaccgaattcgacttcgatcattatttggcttcctttctctgatcactttttgctatttttcatccgcgcatcgtttaagagtgatttttttttattttggcgttttgttttgatcaaaaatgcgaacagaaattaagtctcttctcatttttcaaatcaaagaaattcagagaaaatataaattttcaaaacaaaaacgaataatttaataattaaaataatatttttatatggaagagaaatgccaaaaattttttttgtaaaaaaactaagaatttcttaaaaaattctagtttatggccttgggtaacaagttttctatgccgaaaagacctctgtcccttctcggcagataaaatggcgtcctgtcatcagcggtatactgctccaactcgcgctcggctttctcatcctccggtggtctcccggttctgatgggttccgctgggtttcggaaaaagtaaatgttggcaaaatttttctgaaaattttaattaattttaataaatttcagatgctcaccttgctcaatttcagttacaatggtaccaattttgtttatggttttgcagcaactcctcccccaatttgtgggcttcgccaagtgtttatgttcactgtacggcatttttttagcgcaaaatcaaatttgggcaatcttaattatatgtacagtaatgacagacagcgctttttgccacaaataggaatttataaatattgggaccacagtaaatccggggattaattggttactgatttcacgcatggtgccatttttagaatgatccctaattaacggaatcataacggaattttagttcttttttagtttccattaatttagcttttaattatttccttccagtaattaggtcttattgatagaatttttaactatgccaaaggcagggtagaaaatgccaaaaaaaaaattctgaaatccgaattttgcatgtcaaaaaagttcagtcatagaggataggtaattcaaacacctaaaaaatctggaaatcattcatcaaatttggaaaattcagaanttcccatcaaaatanaatttttaaggcacttcaatcatcatttattt

SEQ ID NO: 3678 - DNA, 2441 bp, Heterodera glycines
  misc_feature (7)..(7): n is a, c, g, or t
taaaaanatctggaaatcattcatcaaaatttggaatttctctccactcgcaatcaaaataaaatttttaaggcacttcaaatcttcatttattttggtgccattgtggtaaatttttgctgtttaaattgtttatttttttgtgaaattcattgcctaaggcacttctttatcactttggcattgttcaagcagtgctcagcacattttcacgtgttctgcagacgaccattggcaccacagcggctgaaagtttgaacgcgattgcctgcatttttcttggccaagtgtgttggcaaactattttaaaaacaaaaatactgtagtatctataatatcaaatcccatccctgatccaaaaaaaaaattgacgaaattgccaaaatttcggatttttaaaatcccgacagaatgtcggccatcgatttatggcattttactcgctaaggaaatttctccagacagaatctgccattctgattgagccgtccattatcacaatgaccgcgtccgaaattcattgcatgatgaccgccggctttgcatgcattgcgggcgctttattctccgcttatatcgcacttggggtacacaattaaatattaattgatccgttaattacattattaataggtcaaggggaagcatcgatttttgttttatattttatgattaaaaaaaaaactaaaattatatctattgaaaagctctaactttctgttcatatacgtgttatttttcagtttttaccacgaaattcttaaaaaaaagtataaaaatttatatgtgaattataacgtatttcctctaatattgtcccctccaacaaagcccaaaaatgggaggttgaaaaacccccgaggcctctattaaatatcttattaattttatttaacaaaattctgggccatggattttgcgtttttcagggcttaatgactcggcacgaaaatcgaaaatatggcaaatgtcatttaaattaattaaaataattttcaaatttcaaagaattgtccaatccatctgttgtccgccactttgatgaattctgcaatttcgttgggcatctccaaattggtctatcccgaggtggaacattcacagcataaggaggccgaagtgcgtgtgtgggtttggcacaaaatgtgccactgatttgaaaattagggttaatcgccgatccgatgcgggggttgaaaatttttattttctcgacttttatgaaaactttactccccgatgaaggtgttgcccaccaacatttttgtctttaatttctcgagccattcctgacaaattttgttgtcttcctcgatccccaactttgctctccgagagtcagagcttatcccgtttgaattttaaatcggaatgccaaggatttcttgtaatcacggaatttatttcaaaaaaaaatcaaaataatattttatttaattcagaagatgaaatttgccgagcgagacaatgaggagacaattttggagtgcattacagcatcctcaattcgtacggtaacacagtgtcattcatttcaaatacagtaatcgccccccccctatcctgctgactccgcccggttcagtcccattttgcaattgccattggtgccaatttggtcacttacattgccctgttggcatttttgaattcgactattggttggcttggctcaatggttggaatagcggaactctcattcaatgtatgtattatattggactgtaatgtactgtactgtatttttcaaaataattggtcgagaattgtggatttaaaatttttatgagagtcgagactgaggaaaaatgccattttctattaaatatatttttcatttatatttcaatatttttcagaaaatcctcggcttttgcttcttcccattggcctgggccatgggcgtctctgacgcacaaaacactgaggtaaaactggacctgatcaatgctttatgtaatcataaaaagctgatcgacactgaaatttcatgcttctttgaccttcggggaagaaattccccccaaaaaaaaaaattgaaaaattttctatcgattttccatttttgtattaattgcttaaaatggtataagagcaccattaaaaattgatgttaaaaagaattatgctaatatgtctttctgctggttaaaactcatttttaggctattggaatctttttttataaaacagaaaaaaaatgaaaatttattatttcaatagtcgtcgaaaataaatttttttgaaaaataattttaatgagagcacattaaataataaaaaataaaaattcatgtgctaaggtaatgttggacgaaacgatgaaagtggctgaactgatgggcatcaaaacggcactgaacgaattcattgcttaccaacgattggctcaaatggtgaccaacggcacacttaatggggtaattaatgcacagtaaaaa

SEQ ID NO: 3679 - DNA, 1591 bp, Heterodera glycines
  misc_feature (1581)..(1581): n is a, c, g, or t
ttttgagcgttatatgcccaaagaaagaaaagtgtttttgccaagttaagttgagcatttctaaattatgcaaaaaatttaatttccgaaatttttttttgaaaattcataaatcaaaaaaaaaaaaaattaaaaataagactgactctattttttaaaacaaaaaataataattttttaaatataaaaatttcgcacatataaaagaaaacaccaataaaatatatatttattcaattttaaaaaaccgctttattttttgaaaaaactttttaaaagccctttctataatgttaataaaaaattttcaacaaaaatttccccaacaatttcaggttgcatttcgggcatttgtttccggtatttgtaccagctttttgaccacttgtgttgccggtagatgggggaagaaacaggattcaaaaaacaaaaaaaaaatttcaaaatgccataggaatgttggtggacgtgccaatggcatgtagcaattcggtgccgcacggaggagacgaaaaatgccttaatttggacacattgattgatcagcaattttaacggtagggatcagagattatcaaatgctgagcaaagagatagtcgatgaacagaagtgatcaattggtgatcagtttgcaattggaattaaagtctctttttaaaaatgtaaaacaagccagaattaattatcacatgatctcactaattatcggattaatttaaaacctattttaatttgggttatattttaaataaaaggataaaatgccgtccgataaaccaatgccagacattttatcggcggattttaagacttacgaaatttacgcaattccgccaatattttgtttgaatcatcagataatgccaacaatctaccaaaaattcgctaggatagtaatgacattttttatatgtaaaattattttttgagatttaatgagaatccattaaattttctataaattactgtaatgattaatcatcacaaaaatgtcgatacagtaacttggtcaaagcattcgctttattctttgattttaaaatttgccaatacatttggccaagaaaaatggaggcaaactcaaaactttacaccgctgttatgccaatggtcaactgcagaaaataaaaaaaaacatttttaagccattataaatatgaaatgggcaatttaaataataaaataatttattcggctaattaaatattaaaaatgttattttattttctgattcctaaattaaaaaaaaattatcttttttttttttgcaaatttacgcaaacgaactttcaaatttgaatcacattttgtttttttcctcttcaatggataattgaaggcatttaacattaattgcggcgattgcatttcccactatttgtttcagcaaattaggcattcctaagttggctgcttgcactttgtgtgtggggtgaatgatccatccatcacccctcgggggaccgaccgtttgaatcatcgccccctcggggaccgaccgtttcgcacataatcgccgggggtcaaatggggcggaaattcagtgaaaatttcaaattttttttgtaaaaattgttcgnttaatcaccc

SEQ ID NO: 3680 - DNA, 4691 bp, Heterodera glycines
  misc_feature (4669)..(4669): n is a, c, g, or t
catttcatttcgactttgtgtgctttttataatttttatttcgttttgagcccttgttaattttcaattctaaccccgaacccggactcgaataaaaaattttaaacaaaattcacattatgcaccaaaataggtcaaaatgctcgaaacaaaatttgctttgtttatcggcacggatagaattgagaaacaagcagacaaaaattattttgaaaaaaaaatttcatcttaccatcacgtttacttttactgatttagagcatataatttttgttttgtcccttttatacatattcacattttatttatcgcattgttaaacataaatctattgatttcagaagataataaagttttattgtcattagagaatggtggcggtgcaacagcttctggaacagaagggcgtcgtcaatggtatcaggtgaatgcacttttctggctatttaaatgaccaattctttccctctctcgcttaattatgcaaagttcgttcagggatgctttggtcttcgcggctggtgccagcaaatcatcagaagttcaccatggacgttgtgcgagtgaggataaaatgcgtgttgcggtttgttaaagtaattgagattaagcttttaaacaaatttatttcagatgagggacagcggttcagtcatcacatgctctatatgcctttatccaatttacaacgacgaatccgtctttttcctgtcatgtggccattgttatcactcacaatgcctttcgaactggatcgttaaatctgtgcctccgcagcgtagctgccctctctgtcgtggcacgttgactgcacttgaagtgctcgcgctttacagctaccagggccgtgcctcagcgaagaatgattgtttaccggcattagcaaaaagtacaatgcaatgagtttatattgtcgtgtacccactgtttttatgcaattgttgtaaaatacgttagtcctcatcgttgccaaatgatctcttagaaattaaacctcacttcatcactgtctgtcctttcaatattgttgttgtcttcgcccatttataaacatttatttatcaaaatataaattttaattaatgggaatataacaaatgaaaaaaaacataaatgttttgaaactctatccgtggtcactgccaatcgttgccccttctcccgaccaccgatgcgtccatcgtcaggcacacactttcgtagttcggtacccgaacaccgtcacgccgcgcgagtgataccgaagactccgttttgagtcgcgatttcgtcaaaccgcgccttgcactcgtccctcacggcgcagttgggccaattgcacatacgcaaaaatttgagtcgtttttcgttgacaaaaatccgaaaagaaaataaatatttacgtaaccaaaaaatctcgttggtccactcactcggtttctgtaagtaatttcgtcctgtttgatggtcgaactggactttgtgcccttcaaaatgtgtttaatgccagcgaaccttaaaatgaaagtaaattaattgaggacatccaaacaatgcttcgcacatggtcccgtaattcttctgcacttcgttagcatctgccgattggaattgcatccaaagccaatcccagcaaaagcgtaagtcatccgaagcgaattgatctctctcaatggccttcttcgaatattcgagcagtgcttttttggaacaaataatgactgaatgaatgcctttcactcacttgccaatgcgttcagtgaatttccgtagccgtagccggcgagcacccgtcgtttgaacagtgtttcagtgtcaatgtcagaagtgcagttgggtttggccaacaatttctcgccgttttcaaagttcagctgcggccccgccgaaatgcaaaagtcaccggaaggaccgatgacggaattgacgtcatcacgaagctaaacacaacagaaaactagtgaaaaaaataagaagcaagacatactttaattatggcaattcgtttcgtggaggcaatcgaatgggcaaaagccattggcttttcttggacaggtaaaagtgccaaccgatcactgatggtcgggtgccagtcgaaggaggtcaaagacgacattccgggcagctgaattcaaagaatgatttacaacaataagttaaatcaaaaaacaatccaaaccgagtaaaaatgaactccgtatgagtgaccatcaatgtcgagtcccttccgttgtgatgggtccaattgactgtaaatgttcgacgatgggtcggcagcgccagtcaaatttttttgacggtcagaaaaggcggaggatgaaatggaaaaattgaaaagattgccacaatctttggccaaagctgtcagatggaaaagacggcggttgtgccacgccaatttgtttaacactttggaatttgactaaaagggcgaaaaatgcaatgaaagaacagaataactctaaataatccaaaaaccattacttcatggctgtcgcttccccatcttttgtttatattagccgactcccattattcaataaaaatattatttaaaatgcatttaaagacaaaacaacacccatttacttacacaagcttcaatttcgtgcaatggcgcagagcccaaagaacgccgatcgtaaacaaaaaccaaattgtgagcaaaacaagcaaaactaaattgaaaatggatgactgagtgaatgaattcatttttcggaaccgaaagccaaagttgggctcactgcaaaggcccatcaacggattttggacactcaaagtgctgtggaaattgccgtgctcgcgaatgtccgcaattcgaattccgcgacttgcgttgatcagcagcaaatttgggtcgtctctaaaaagagcaaaccaattggaggagaaaattggaactagaagcaggggaggaacctgaaccaacagacactgagcactttttcggcaaaattagcctcgaaaattgacattggcacttctcgcacattgcgcgtcgtccgattcaaatcgtacacaacgacggcatgatcagtaccacgattcctaaacatggaattaaacgaatattttaacttgggaaaaggacgtgtttcctgatgatgagatcacaaattataaaatggaaaatggtgatttcgtcagtcgcgttaccctacttggccacatcccccccatccccaactgtacatcgccccatttctcccaactctgaattcacagtttgcatttacctttcataggctgcacagagtcgtgacgaatcattaaaattccaatccaaacaattgatgcctttctgcgcctcccgaatgtcttcgcctcgcaaataccttaaaattagagcttttgctcgccaaatgcattgaatttgcaccaactttacgcccggttgtgtgttagcggaaacgacgcttatccgaccgctggtgaagccaatggccagccgattgtccctggtgtggtccaaggagaaggtacggaccaattcctgcaaaaataacggatggttgaagaccggttggataagttcttctccttacctgttcctgccgctgcaaaaggggggaacaagacgaaaccaaagggtcgacagaaaaagcggaagggccggccaaatgagcagcggaaccaccggggggcttgtcattcacacgaaacagcgaaaaggagtcggagtcgagcagaaacaatttggaggagggacagtcgtcggaagggccattgagccatttgatggtcggaagcatcaaaaacggaagctacgaaaatacgaggatacataaaattctgaaatggaaaagtaactgacaattattggtaaaaaccaaaaaaaggaattggaaaatacataaataagatttatttataaaagatgaattatgaagaagcgatgataaaggaatctttctttgtcatcgtcgtttctggctggaaattgtcaaaaaagccggcacaagcatcgaccatcagcgattggcacgtcggaggccattcggccaacacgcgggccgggttaccgccaacgatggaaaagctaaaaacaattaatttgtgcttaagttggtgaatctgtgatcctttcccgaatgtgttgccagaattccgcatcaatttataaaaagaataaacgaataattgttattttaattatcgaatatttattaaatttataaattttacggggggacgacggtgtcgggcattagcacactgtcaggctgaataaagcagcagtctttgaccacacagttctgtccaacgatgctgttctgaccgatgtgcacaaaactgccgacgtaagcggcaacgaccacacagccctgaagaaatgaaaaggggaaaataaaataggtactaaatgggggtggggagttgaaaagaagaccctcctcgacaaacaattggtaaaaacccttcagaatgatgtcccaacggaaaaataaataaaaatttctttgcatttaattactcatttaatgtgttaccctctcaatgaaaacgtaatcaccaaaatggacgggaaaatacgtaaagcctaaaatggaaaaataatcagaaatatgtaagacgaaggaattcatttgcccattacctttgctgaaatatttgtagggcggacgaatgatcgaaccctcgccaattatgcaatatttgcccattcggatgtaagctgaaaacgcanaatgaggacggcattccgacta

SEQ ID NO: 3681 - DNA, 3774 bp, Heterodera glycines
  misc_feature (1584)..(1584): n is a, c, g, or t
tgtcatctttgatccgaaagtctcttcacgtccctctgatggcgtctcgggaaatccttggaaagtaattaatttatatgtaatggtcattggtcggtcgtttcctttctttgctcactttgaacattgtcgagccaccggaaagaacctaaaaaacgatagtaagtgtatggctttaacatttgcatgtgtaacagttgtccactgctcacaatgttctcgtaaagccctctgcgcacatcgatcggacactgttggatcacctggtcaaccacttccgaaatggacattttgtagtcagagctgacgaactgaagatgaattctgtttatcgtccgtcctattccgcggtgataattcgtgcaaaaaccaaacctcgggatggaagaatatttccgggcccataaatcgctcgtaaccgacatcgaccgcaaaaggctttttggtgatattgttcactccgttatatgctttgttcagccatttctccggctccgagtcgtatttgacaaattccttgtgaatgtccggacaaacgtaacaaaattgttcctaatggaaaaagcaaaattattatatttaatattattataattcgaataattattccatgttatctttcacaaaaatagactatttttgcacaaaatctctaaaaatacttgcaaaatttcaattttccaggaaacatctatcagaaatgccatatgctttttgccattttttttttaaaagtgtggcctacaaatcagataccacaagcaaaaaaagtcacacgccttggtacatctcttgcacatgacgcccagcatttgaacgaataaataatgaatacaaatcgcaattaccttaattgcctttgcaacttcgtacgactgctcactgggaacattcacttcacgatccctcagcatcttaaattaaacattctgaccagattgcatatgaacacgagtcgaatacctgctgcaaaaagtacgtaatgtcgcgtccggcgatgggaatgtgcttaatgcaggaaccgatgacatagccatcacacaccgggatgcaatgggtgacgccgtctccactgtccaccacctcaaaaacaaattaacaaatttcagggggggggggattcacaaggccagtcagagaacggtggttgaactcgcgggtttgccaagaagcggccaaggcgagcagagcctggacagcgatgtaaaggccgggcacattgaacgactcgaacattatctcggcagtgaattcgcggttctccggcgtattcagcggtggttctgtctgaaattttagcaattaaagaggaaatgatggatgggaatacggacgaaccaacagaaagtaatggtcttcaggctcggctcgcaaatatttgaaaatgcaatgctcccaaaaacgttccattaggtcccaatcgtcgacaattccatgtcgaattggatactgagaaaagcataatatactttgggaatagacaataaaatgagaaaaacagaaccttaacaaaataattcgcagccaaaggagacaacgcctcgtcaccgatgaaaaagtccaagtccgggatttttccgccgnacacttttcaaaatattcgcatctttgacagcgatagccgacggaatgataaactgtggctccgaatttcctgcatagccaagctttgtgtaccttaaaagaaaaataaaaaacgcaaaaagcagtaattcttaattacccggtgccacaatcaattacagcagctggcaaattggcatgcatcaatcagtcaatcaatctggacaagagccaaaacagtaaaggctgtgaattttaatttattgtaaatatattactgtcgatggtatgaccccacctcttttttgaaaaaaataaacttatgtataaataaatcactgaagatataattgggaacttgacttttctgaaaattctaaaaacatgttcctaggggtcttttgagaacagtttggagactttgactctgccttttttaatttttggatcaagtcacagaattgtatccatgcgagcattgattttggttgattttttactatttcatttttttgaactttttttttgaatatttttcgatgttcgaccaaaaattcgatttcgggttctgatgtacggaattatgaacgccagattcttaatcagcgatgctgaaacccccggaagctatgctattttacatgaattaaggcaaaaaaattatgtctggtaaagtgcattagtaccaaaaaatgtgctgatcaggaaattaatttctgattttgaaaaaatgttttgtctacgatttttcatcaagtataataaaaataatccgcagccaagcggattcgaacccaaacccccacctcataagaacccagagatcaattattaaatttcaaaaaatcagagaaacgaaaaagttgacttctccaaacattcaacaactcattcgaaagctcttttttttagctctacaatacttgtgcatgtgtttcttacatctgactttaccgttgcagcaaaacgtatattagacacttcgtaaaaatttaagcgttttcgtatcaaaaatttaagccaccaaaaacaatataatgtaaaaaaatacataaaaatcaaagaatcatttcgctttctgagaactgctcgtacttcgtccagcatctgcggacccgggatgagcagaagagggagcttttggctgaattttctttagataaaactcattttgaataaaaattcaattcacataaattcctctgccgagacaaattgctttgaccaatttcacagtttcttcttgtgaataacttggtgcctcgcgtctgtccaccacgtgcaatctgaaaaatcgaaattttaaatctaaaatatttttgaaaagctggcaaactttgtgaaatcagccaactttccacaaagcatgtcaatgtgcgagttcaatgttttgatctaaaaagtaaaggatcgcattaaaatgagtgaaaaatgcgctgattttgcctgtttgtgaatgtctcccttcgaccggtcgcgttcgatgttcagctcgtcttcctccacctccggctttagcttcgttctcagcaaaatcggaacgatattgtggccaaagtttgagagtcgtccctccgttaaatgctaaaacgttggtcagttaataaagttggtttaatgcttaatgcgatgattcacttaaccgtcaaattcgggtcgagttcaagtgaaacattcttcggcacaaattgtgtcattttcatcagtttaacattgtcatcgaaattgttatggcccggctttctcatcagttgttgcagcgacgcaaacattccggcaagggaacagaatttctgtaccatgtcggcccattgcacgtgctcttgcagttcgagggacatcagcaagtcgtggattgtttctcggatttgcaataatttgccctcagtttcttccatcaaagctcgaatccgtaaattggcaatgtcctgttggtccatattaattatctaaagaagaaaagtctaaaagctaacaaaaaaaaattttcgagaacgactattttggtttttttttatttaaataatttttgtaacattcaaggtaaatttaaaaaataaattttagaattaacgttacgcgaatatttcgtgaccggcaatgccaaaatgaattttaaaataaagaaaattgctcaatgggactgaaaaaaggcaaataataaacactgagaattgctaatattttcttattttctattttcggttgcca

SEQ ID NO: 3682 - DNA, 1645 bp, Heterodera glycines
  misc_feature (1606)..(1606): n is a, c, g, or t
  misc_feature (1626)..(1626): n is a, c, g, or t
attccttacaaagcccccctccaccccccccccccctcctctcttctctctctctttaatatgtttgctctttcgtcatcttttgaaggcccacttttcatttatggtcagtctttggcatatttcatgggaacgtgccaacggcacgcgggcgacgaatggcaaagggaaaaggccaaagggagggggaggggaggggacaacattcttctcttcttccctttcttttgcattttgtactccgttctcatcaatatttgatgtcatcaccctaaaggacgactcaaactttgcccactctcttcggcattgcgttttgtttgtcctttttaattcttcaaattctcaaaattcgcccttcgccaatgtttccaaacacaaattccttgtcaaattctccccattcggattctttcaatagaaattcaacctcaaaaaggtgggaggaaacaattgcttgggtcactcacggaaagcgattgtcacggcgaattctaaatccgtcaaaggatttttcggacggaggttgccccggggtgccgatgggttcacccagctttctttgatcactttagcgcttgttgcggagattatcgctcaacatttgcctcgttatgtgttatctttgaattcttttccccaagttcattcgttggctttgaagaaatacaattgggagactttggaaaggttagacagagagagaaggggggatttgcctaacaatgaaattttaaaaattcaaacgaagtttatttttctcgacgcaaccccacctttttgaaactaatttcagttgtcatttgctatttaaggaccgttttacgccatttgggcatccatatctccacagagcatatcgaatctttggcaaatgccgaagagggaaccatccaaaatttccttcccattcttcgatcccaaattgacgatgccatttccaaacggcactttcgaccctcttccaccagcagcagagggccaagtcggtgctgctccaggggtaaccggcaaataaagtgtcaaattcgcatgcttaatgaataggaggaagtcaactccatcttgaccaaattggcacatcggaaaggcaaagagagcagacgaacggcacagacaaaacggaaggaaacggagaagggaatggtcggccgaaagtgttggaagaattggacaaagaccaattggtggaagttagtgattgattggatgcaattagagaagggaaaggcacaaattaagagactctatgccaaagtacgcgaacaagaagcacaattgaggaagaaggacgagcaaatcgaggcattgagtcgcaaggtggagaaactggtggaattggtctgcgaggaaagtgtggtgagagaacggcgagtagggcgggacaaagttaattgggttaattagtgataattaagaaaaataccaacggataactgatcaattatggacataatgtggtgctatgtgttgatctaatatcttccagccttttttcatctttctttttcctcgtccattagaaggcattgataagaacaacagaaaaaagccttttgtttgggagcgatcggaagattaaaaacagtcgatttagcctagatanattatttttttaaaccttanaaaaatgcccaaatttaac

SEQ ID NO: 3683 - DNA, 1661 bp, Heterodera glycines
  misc_feature (19)..(19): n is a, c, g, or t
ttcttcgccactgtttgcntggcgtgtcgccgccgttttgtccatccaactacatccgcctctgtcattccgatcccttggttcatccgaacagcaaaataagcgcgtctaaatagtacagtatgagctattgtcgtcattcattggcacagtatcccccccccaacggcccaccagtgggagtgccctgtgccgataaacactgccccggtccctggccaccgatgcgaatccgctgatccatcgcgcggatcgccaaatggcttcgagtcgctgttggaattcgctaagccgtgccatttggtcattgaacattcgcgtgtcgtcttcaagcagacattggcgttgttcatattgggtgatcttaggaaaggaaaagccgtggaaagagaaggaaagggacaaacagtgagaaaatggtcgagaaagatggacagggagcagtaggaggagaggaagtcgggttggtaagtggcgaggtttactgtgggaatgggaggggtacggtaaaaaacttaaaacaaaggagagaaatgttgaatttatatttttatgagataattactctctttgctttgtggtgactcactcatttggaagaccggcaccggcacagaaacgcaaccgcggaaagttgcgacggccgagccgttgtccgctccctttgcacaggcattcacttgacacacttcctccgcacgcggcatcaccaaaatgagcgagacgtacttgttgagttggacgagacgatgccgaaaaagacgcgtgccgaggatttggtctgagtccaattccaaatggttgaccaactgaactgcaaatgttggcatccgttggtttgccaacgacaaactctgctcgacgccttgctcagctgctcgtagaaactccgctgctccggcagagctttttccataaccaatggcactccgttttcatcgtccgcctccgccagcgacttgagaagggcccattcttcgcgggtgacgtgcgaattcgaacggacgtcttaaaagggaaattatctaattggggagacaattaaagggcaattagtaaaaaaggttgattattatacttgcaaatgggagggaggagatgaggttgtcgggcaccagcacatggatagagttgagcgaggagtgcaggcggaggtaagcgacgtaaaggccgggctccagcggaaccaacgaacattcgtagaagttgagcagtgggagtaattcgcgtgagaggaacttcaagaaagttacaattgtcagcgcaacacagcccaaccgccggtgtccatcacctcaagcgcgggacacgcctgacgacggcggaaaagcttctccatgcgcatccatcgcatggccaagccttgcacctcgtcgctttggccttcggggacgagtcggacggtgaccagcaaagtcgtgccgggttgagaaacgagcggcacgtggtggacacggccaatgtctgaacacaaaacgcagtcagcgaacgcgggggtggagagaatttggggaagcgaaggcaaagagacgcgcctttcaccccgagggcattgtgcatggccaaggcagcgtcaagcagacgcgagcggagttgaaggttggcggaagaggcgacggagcagccgagcgattcctgcaggtgaggcagctgttcccagc

SEQ ID NO: 3684 - DNA, 7487 bp, Heterodera glycines
  misc_feature (7292)..(7292): n is a, c, g, or t
acttgggaggaatggcggatattcgggagaagaaaatgaaacatttgaaataattggacaaagtgttgatttgttgacttattaatgaacgaatgataaataaacatttgcgaaattggaaatttttgggggggggggacgccaattaatgcataaaacactaatttattgtttttaattacccaattaatttgtttcccaataatttaaaaaaagaactggttaaagctttttgttttgtcggtttgaaatcgaattgagactgtggcaaagttatttagccgataggcggctcttggagctgtaaccacgcaatggcacaccattttcgaaaattccaattcctcccaatttcaaatttgaatccattttttccatatttttccaaaaattttatttttttcacattatttgtccatttttcacttttttcacatgtccattttttcacattttttgtccattttttcaccccctccgattgaacacttcgttcagcgtttgcattccgaattcgttctgcacttttttgaattgtgctctcatgaacacattttcctttagcatttccttcaatcgttcgttccgttccaaaagcgacgcctccaaaagtgcgatccttcagaattattttgtgtgctttttgtgttttaattgtcctccttttcctaccgatgttcgcttttgtccaacttttgtctcaattgtccattttcttgctttaatttcacattgtccaaattcaatgaacaaaaattctcaattttctgctgagccgccgccattcgaacgcgaaactgttgaaaagaatgagaagcaatttgcattttaaaactcaaaaacaaattctgagcacttcgccaatgtcgaaacattggcaggggtcgaagcgaagcaattggcggagagaaccgacggcggcggaagaggaggagggcgaattgtggcgaaaagagtgccgaaattgggggagagggcgcagctgaagaagcgaagaatggaagaagaacaaccgacgggaaaatcaatttgattttattaatcgtacctcatccgttttaatcggagaagcggcgaaatgcttttggtggtggccaaattcgccggcagagagagatggcaccaataaaaggctaaaatcggacagtccccacaacacactccctgccaatgttttcctcgcttactcttcctcctccccctgctgccgtttcggcttttcctgtgccattttcggctttgaatttgccgtgccattcgcttcatctgtcccttcgttttccgtcgtttctttcacttcgatttccacggcgacttccattaaccctcaaaatcgtaaattgttcttcgaattgtgtgtccctctggtgacaccttcaaaagtgcagaaggaattcccattggaagtgaatttgcgcgagtgttcgcccattccgtggccactcaaattgagaaaagcggcagaaattcaaacattgacaaatgccacttacattctccgctgcattcgttcggcatttcgactttggtacggcgcactgagcaaacgccggtcggatttaaacatggcgggaggaaagtgctgctgatggtgggacatgtgaaaaaaggcagtcaaaagattggcatcgatttactcaattaattatgtaattaatctttaaatatcctcggcattaatcacataattaaattattaatattttgttgataaattaattaattacagaaagtattctcttattattttgggtttctacctctaattggattgattaattataattagttaattaagtaaatgacaataaatgcgaatgtttcgtttcgtttccttcgatttgcgtagtttcgcgtcaattggaaaaagtcaataggaagaagagaaaagcaaaatgtgggcaaagaaaggaaagcgaagaagaaaatgacagcaaaaagcccccacaatttattttaatttattttattttaattttatcaattctttttcggtttgtttatccacggcaattctttttgatttccaatgagcgacgaattcgttgtggccaaattcgattacgaagcccaagaagaaagggtaaaaccaaaaactcaaataaattgggcattattttgatttttttggtctttttggtcaggaactttctgtgactaaaaatgaaaggcttaaattgctggacgacactaatccatggtggaaagtgagaaggaattcgacattcgaatttttaaaataatttttaaaaaacaggcgatgaacgcccgcggccaaattggctttgtcccaagcaattatatgcaaaaagagtcaattggtgagagaaggaaacggacaaaatcacttgaggaaatgaaaagttaaggcgagaaggacaaggagaaccttcgctcggcaaatcatttgagcaacggacatggaaaggttaattagtagccaattaaccctaattaattaattagtgtcccattgaatccgtccatgcgttttcctttatttctgttttccattcttcccctcccctttcagaggctccattccgtcgccgtcgttctgttcgattacgccccccaaagggttcgttttttccaaatttgaattcgcttggccaaattggcccatttgccatttgtccgtttaaggacgatgagttggcactgagaaggggcgtccgactgcgcgtgttggacaaatcggcggatgggtggtggaagggcgaggaggagggggccggggcccgccggggatggttcccctcaaattacgtgagggaacagccggcggacgacgaattgccggaactcagcgaaaacggaacgccaaaaatcaacggaattggcacaacggcggaggcaccgcaaacgcagcacagtccggacagagttttggaggtatcggcgggaaaaacaaatggaaaagcgcgggacggacagtgcaaaaacaaagggcaaattcggggcaatttcgaacaaatttccattcattttaatttgtaaaaaatttgaacatattttaacaatacgaaggaatttggccagaattaaaaaaccctccatttccataatggcttttaattttacattattttattaggattttatataagttctgtcaactttatcgaaaatttcatttaaaaattcataataaattcaaataataaaacaaatttaatcaaactttgcctgattattcccttatattagcaccatcttttcaccaattgattaggcttttcactttggcatcacaaagttatggcctttgatgaaattaaattcccatttattgaatgaattccctccaatcatcttaattgcactaatattcccaattgtttcctaatctttgcgccgatttgcttaataatgccgtgccttttcagattgtcctctgtctttactctttcgaagcacagaaccctcaggagctttcctttgtgaagcacgaacggttggacattctcgagcaccccgtggatgtgagccgattaatgggccactaattaattaatttatttattatggcaattaggatcccgagtggtggatggccaggaaccaatatggacagacaggtcggtctctgtctgctggtggccgttaattcgcttccccccagggctcgtccccaccaattacatcgaagtggtcgaccaaaaccccaacaggggcgccttcgactcccccggcgtaagtgccgcgcctccgtccgtgccctcctcttccctttcgcccgtccctccctcccctcggccaaactcttacattgacagttccgactggtggttttttttactagatttttgttaattagttaatgcattaagggaccaactgactgggccctacgcgcgacagccgtggcaagtgaaaacggagggagggaaacggcacatttagcaaaggcatagcccaggggtttaagccgactccccccgaattccgtccattctctgcatttgggcgtggcttttacctctcggcacgcccattctctaatggcgaaaaagtgcaggtattacggtcacataacacgggaacagtcggacactctgctgaaaacgcgcggcgttgagggcgattttttggttcgaaaaaatagaatgtttggcatttcttcgaaattttaatttttaggtgcgcgacagcgaatcgaagcccggagatttttccatttcgctgaaagactcggccaaaaacaaacacttttgggtgcaattcgacgccgcgagcgcccaatttataattggcaatcgccgattcgaatccatggaaaaattaatattgtgagcaaacggaaagccaaactgtggaaatttatttgaaattcactcttaggaattatatgagttcgccgatattcagcgacggaattgtgaaccttttcctgcggaaacctttaccaaaataaacgacggaacagaaaagtgagggggaaaaacagctgaccaaaagagcagcgaatgaaccgccaaagaaaagggacaaaaggccaaagaattcattttcatttttttgattttcaaattaaaaaccaaaaactcatccgtttgaatgtataaaataacagacaagacaaaacatggtaacactgcttaattgtgtaattagggagcactttcgttaatagttgcttgcctttctcggaattgcgagagcatttgggtgaaaattggaaattttgctccttcattaatatttgtatacaaagcaacagaacatttgacattttaaagctgataaattaattatgttgtgagtacatccacttataatcaattagcgattggcaaatggcccgagggaatgaaattgcgactgatttctgagtaaaatgactatcttttgtaagtatcgtactttttacaacaatacagtattcgtgcgtcgttcgtttttttacccgttacgcttttctcaagaacatttctccctcactgttctgtcctttttggttttctctcgtccaacttttctttgcttcttcgccttcggcgctttcctcgtccaaaatgaccgcgtccaaatcgacgccctaagacaattcaaatttcgaattttaaactgtttctttttactttcgtgtccactagccacatccacgagacgaataaattggcacttcccaaaagtgaaacggtcaaataggcactggcaccccaatgctcgttgaagaaaaccaactgacaaatggggggagtcataaatatgaattcaatcagagcaaaattaattaaaatttataaataatttaaccgaatttgtctaattcttttaatattttcaatttttaattcatttaaatttctttaaaatttgaactaatacaattataaataattaaataaaattagtaattgttaattaattggcaatgttaacaaaacaaacaaaaagagaaaagaaataaaaaaacaaaaagccaaccacaggcgcaaaaaatccgccgactcgcgcgatgcaactgcaactgccaagggcggaagagcgcaacagagtgggcattgactcaaccgccgacaaaacgttggcatcccaagtgaactcgaggaaaatgacgccgaagagattgatgaaaagaatccatgggccctggggccaaattttgggcaattaattaaaaatatagcaaaacatagggaaagcaaagagagagagagagtgccaaattacaacgaacgcatgggatggcaccagcaaattgccatcaattggcacaccgagtcgatgcccactcagaaagcaattggcaaaactgtgaaagtgacaatcgcccgaggggaaatgaaaagcgtggcaaaggccggtggagggaaggtacagaagcaaaacggacgcacaaagcaacaaaagaacttccaagggttttagcatgatcagtttgattttgaattgccagtgactcaccgccggtgcgatcaaagcaccgaattgggcgaccagcgaaaaactcgccatggccgaggcacgcaaaacggtgggcatcaactcggtgccggagagatagcacgcatcccaagtgaactggatgaaaacgttgcccagctggttcatcaccagcaccgtcgcttgaccctttttagcatatgggaagaaggaatggaataatgggggggggggggggagagagagggaaattaatgggcaaatggcgaatgtattgttggaaacacggcattacacgtcgatcgattggtttgaaaatggcacttttctctctcaaaatgactcacttcatattttagcagcaccagaacggtcagaacaatgaaacagaaaatgacgatcatttgggcaaaatggtggagatttcgtcgagaaaactttggcatgtaagtgtccaaagccaaaagcatctgaaaatagaagaaaaaggaatgggtgatcagaaaagggacaaaatgacgacggacggacggaccaatttggaaatgatcactgggatggagagaagcaactgattgaggaacagatcaccactgaggttggaactgttcaagtcgacggagtaggaggacattgaggaggtgaacctgaacaatggggagacagacagacaaagtgaccgatcgacggccaaactgaccacatcatccaaaggacgagcagacgcgagaaaagcgaccgatcgctgacgagggacctaagaaaagtgacgagaggaattagccaaaacgagcacaaaaggaccagaagttggccttcctctccggaatgggcgccttcttctccaccggcgcgtgctcaacgcccgcgagacgcgcgatttgcttttcactgcgaagcatctcatcaagtcgattctgactgtgaagccaaatgggcgactccggcagaagaaaggccatgatcagaaggccggggaccgacgcaatggcacaaacgatgctggcagaacgccaatcggggaaaagaaagcacagagaagtgaggatcagacgagagatgcccttggggagagaaatgtcatgggaaagaaaggaaacgattggcatttttagtgctcgaaggcacgaaacggaagaaaaacgctaggccttttttcccaagtgccaacccaattgcagaaagtgcgaaggatcatccgatgttccggcggcattatttccattgtgaatgtggccacgacgaccaaagagccgcccataagcaaagagacgatgaatcggccaaacaaaagccattgccaattgggcgacagagcagagagtgccaacgagagaaggccaaagaagaaagtgatcagaccttgacggtgcgaatcaatcgaaatcgatcggaattgngcacacaaacactcaccgattggctttcggccataagtgtcggagagaggggccaaaaggacagtgccgagcaaaacaccgaagaattttgatctgatgtgaatgccacgacccacatcacttcatattgtgccaccactcacttggctgtacaatgcctttgtgtaggcgccggtgccgcaaatcattggaaat

SEQ ID NO: 3685 - DNA, 2261 bp, Heterodera glycines
ttttagggatgagctgataaaatgaaatgactactgctcagtgataaggaccaatcgattgtccctttttattgggttgaatttctgttcccccgggggataatccaggggcaaacactcgaaatcagcgattggcgtgggaatgggcgccgatcagagccgattgggcaaaatgtgacgagggaatggccaaaaaaggcacagtaacagcttaattttaatgtttacaggcaacgtttatttgttgtattttgtgtaactgttaaaacacagaattattattaattaaactccaaaatatggcaatttataaaatgccaaaattggcggcttacaccgaattttggtgtcaattaaaatcacacagattaataaatgtttgtttaaatgatgacattctgtgacattcgtagtccaaccgatctgctgatcagctgctgatcgttgttttgatcacattttgtcgcctctgtccgaatttttttttatttacccaatttgcgaacaattaattaattaattattaacgagtaaattttaaacaaataccacacgcatgtgttttcatacaataaaattatttaaaaaatggcgacgaaacttgaaatattcgacataataatctttgtttgatttgtttaacttttatttatttttacaattcatttttaaaagtaattttgactatttgttttgctaattaatagtcaaaaaatgaattggcttttcaaaaataaattaatagttttaaatttaaattttcttcattcgatttcatttttataaattcataatgtgtcaaatttatccagttaatttatcagttaattcttttctcatcacagatgtgcaaatagacacttttttaattgatgattttattaatcggtaccaaacttaattaatgaattgtccgtttttccttctccgtcacttttttgctgctgactttccccaattttcgcctttcctttcctatggtttcatctccgtttcttcctcaggcactttcattttttctttgccttttgtccttttccaatgctcaaaactccttaatgggttacggttatggaggagggaacggtcaaaatatgggatacggtggaggatacggtggaggatacggtggaggatacggtggaggatacggtggcggtggctataatcagtgtccgcttggccaaacggcggacggaagtcagtgaatggggcaaaaagagtgggggaattagatgggaaagcctacgcctaattaacccttaattgggctgatgactcactgtcattaaaatctcttatgaaagatttaaaaaatgtgataaccttcaaaccgttcactcattttcagcttgtgatggcctcaaattcttttgcatggatcccaaagagaactgttacaacggcatttgttgtgagtgcttccccttccctccctttggccccatttaaccgctttttcctttttaggccaaccttcccaaaaccccggcttttacggctgtccgttgggcactttcgccgatggcacttgcagcggcagcctcaaattttggtgcgccgacccacgagaaacatgcgtaaatggaatttgttgtaagtaattatcacccatttatccgatgatttttggattcaaatttttttaaaaaggtcagcaagggagcagcagcagcagcaacacaaatccgtatggaggttacggtacgggaggaacatcgccttacgggaacataccgaacggatacggtatcggcaccggaatgaacggatatggtatgggaacaatgccctacggaatgaacggctacggtatgggaacaatgaacggctacggtatgggaacaatgaacggctacggtatgggaacaatgaacggctatggtacgggaacaatgccctacggaatgaacggctacggtatgggaacaatgaacggctatggtacgggaacaatgccctacggaatgaacggctacggtatggaaacaatgaacggctatggtacgggaacaatgccctacggaatgaacggctacggtatgggaggcgggtgagtcgtttttaaagggttttgggcggggcgccaacaacctcttataaattcggactgaattcgagcattttaccgtttccagttacgggatgacctctccctattcctcttcgcctctgtcgtccttttcttcgctgggcgcaaatggcctcgggggttcgtcatcgtattcggcgctgctcgcccaatattaccgtagtctgat

SEQ ID NO: 3686 - DNA, 5747 bp, Heterodera glycines
gttgtccgctaaaatgtacgtatcataattggtacatgccgttaaaatacactccacaaaatccttcgttgggtcatgtccctctgcctcgctccaatccttggtcctctcctccccacaaattttacaattcgtcctatgtttgtcgtcacagcattccgtacacgtaactctcaccgaaatataattgattacatgctccttctgatcccccttgtaaattgtatcctgcgatgtttccgaatcctgaaaatcaatatctattttgttaacgtgttgttttattaaatcttacccaaactacaattctgtagacatctttttcctcattttcctcgatcggcataatataacaaccccgcttggggtcatggctcacactacaaagctggcaataagtctctccgcattcatgatccttcttcgggttaaataaatatgtcttgtcacagatcacgcaacgcctccataatttgcaagtctgatgtccctgatgataattgtagcacccccaattgtaaaaatagcgatggcacttcgggcactcaatcttcactccactctccttttcacacggcattcctccaactctattgcagtaataacatctcgcccggcactcaaaagtatgataaacatcctgatcgtaaaaacattcacattcaacgcagaacttcctcccacggttgaaaaagcagacgtatttctttagaccatcccagtgattattctccaaaaatatcggcactacattttcgcgtcccatcggtcccttccacaaaactcggatcgatttccgcggatccgcagacttctcaaatgccaccacccggtatttaccggggtaaatctcatcctgaaaaatttattaattttccgttttctcaatttttaaagcccacccaataattctgaacattcggcaagtgttccacaccatagctatattcgttaatatcaattccacaattacgtaaaagctcaatagctgcatccctctgtctcacaatatttttcataaatcgattaaatgcaaaacggtccataattaaataattcatcgacgacgtcagtgcgtaaaaaaggcaaaatttatcagtattcacaatcctaaaatttactttattatatttttttttgcataattaaattatttaaaaataaatattttaagtttatttttattttttacatcttctttattcttttttttcatttttttctttaaatttttttttgtttcattaaattttttaaaaataattattttaaatttattttttactttctttatttttaattttattctgtttttttgtttcattaaattattattttttcatttttttctttaaaaaaaaaatttttttttgcttcattaaattttttagaaataattattttaaatttatttattgattttttctatttttttattttatttttattaattggaaaaatcttaccctatccgctggtgttccttgaatccaaagtcaaatttgtggacattcctcggcccctctccactgggcatggtcacgcaagtaatttttatagtaatcggttccgataataaaagcattttcttattttcatccccgtccccgctctgccccagcttattaatctcctccatgataacatccgcattgttctgggggtacgcccgatacggcacccacaccgggaaagcaagcccggcacccgtaattgccactccaaacatccgcacttttcgcttcattttttcttccgtagtcttaaaagccacctttatcatgtcgtcgatcgcttccctcattgcttcatcagggcgtcccccgtccgggttgacacgaaattccgtaatgttcttcgtaaatccaaattttttcgcaagttgtcgattggtaatccagcaatttataattttccatttcttcagtaaaattgttcctaaaatttatttattttttaattggtagaaaacgattacgttgtctcttaatattttctttaatattttattaacgcttacccgattgaacggaaatcccattttttggtcgacggtccgcattgaacagagcttccgttgcgttttgaaggcattttaaaacaaaaaccgcgaaattgatgcagtaaaattaaagagtgaagagagattagaaaagaaaaagacgggaatttaatagaagatttaattaatttaattaaaatagagcggagtgaattaaaattagagcgcgaagagagtttaatgaaatccaactatttagttgaatgattttcaatttgggccgggtgtgcgaaataggcaaaaagggggaggggtctagtcacgtgactgtctgggtttgccttaatttaagggggtcatcaatcatttcggtagacagctgtcacattttattcaaaaaccgtgcaaaaatcggttggatattccttatttcgaaagtcatcaatcatttttttttttttgtgacaggtttgcaaaattaggggccatattgcgaaatatttggaaaaaactaaaagtcacgtgcacattacgaataatggggggaaattgcgaaataagagaccaatcaatcacattttattgacagttgacctaatttagaaggccatattgcgaaataactgaacaaaaagtcacgtgcgtattgcgaaataatggaagagaaataaaaacccatcaatcacctgacaggtgacctacttttggaaaagttttttctttattttcgattttacttttaaattggattttattgtccaattcaataattatttatggctttctgccaatatcaattaattcacttccaaattccattatcgattacatttcgcggcggcggcatcgcggcgcggggcgggtggagaggaaatgcaaaaaaaaccacgcactgttttggcacattttcaaaaatgaatttttaatttcaggatcagaaaaagcatcacaaaaaaaaatctcaggattgcgaataatgtaatgtctaagtagtttggatttagcctttagaaattaggattaaatttgcaaaagaaaaaaattgaatttccttcacctgtcacttttggtgacaggaggatgattgatgaccttcccgcggcgctgcgcggtgcggggtgaaaaaacacccgcacggatttgggtaaattaaaatccacaaggcggcagagttcaaagaatatcccataggctcaggatgtgagcgggcggcaacttcaaagtggtccaataggttttggttttgaaacacccccctcccctcctgggttttgatggggcggcaacttcaaagggctgcgcccctcccatagggtttggttcttggcggcagcttcagatgtagtccaataggcacgggtttgtgagccggcggcaccttcaaaagaaaacacccctcccgtaggtttgggtttgtgagcgggcggcaccttcaaaagaaaacacccctcccgtaggtttgggtttgtgagcgggcggcaccttcaaaagaaaacacccctcccgtaggtttgggtttgtgcggtaaacacccgctcggaacccgctcgcttttgacgctatatactactctcgtgtcgggaaatttagcagccttaatgtgtccagcactttgtttgcagcgaatccggcacccattttggatttgcaacgacgtttggatggacattttcccatcgtttgcccatgcccaactcggcctcaaattggcacttctttcgccacgtttcaatgcgttggtggactaacatttcgatggcaaaagcgaattgacaatttggaaaacaatcgaaattcgcaaggacaaaggaccagaaccgaaactttatgtaaagatggatgacaaatttgtgccatttccatggcccgacgaccgttgttgcgcagcaaaattcgctttaaatgccttcatattgagtaattaaaaatctgagctatggcaataaaagcattcattccctttttgcagttacatcgatcactccgtcatcgcttttcttcgttcaaatcaccaaattttcgacaaaagaggcaccaatttagacttgtggattccatcaccacacaccacggatggccagcggatttgggatatttttgttcgcgaaatctggccaatttttttggaaaatattcatcacttgggcttttcccatggtgatcatttggacaatgtcctgctccctcccggaccacacctccttgaaattgttgacccaattggtgttcccttgttcgttgtgatcaaagcaatgcaatcgcttgggttggccatcttttctcggagagtgcaaccatttggacaatgcttggccagccgttgcatttggcacatcaaaatcatcaattgcatcaggcaacaaatcaacggaattgattgaaaccaactgattgagatcagtgaaaattgtcggcgaagtgcgacgaagcaaatggtccaaatgatcaccattgtaaaagtccaaatggtgaatgtttgtcgaaaaaatgggccaaatttcactaacaaaaacatcccaaattggctggccatccgtgttgtgtggtgatggaatccacaaatataaataggtgcctcttttgtcgaaaatttgctgattggaacgaagaaaagcaatgacttggaattttttttgccaaattttctgacactgaattgtcggtttttcaacgtacactgaatcgtcgtcactgaatcgtcgtcactgaatcgtcttaacactgaatcgtcgtcactgaatcgtcggcactgaatcgtcggcactgaatcgtcggcactgaatcgatatgcaccgtccgggtataagggctttttatattcaaaatttaaaaagtttcgttctcgtacatataaatatttaaaaaatcagcaaaatttttataaaacttgaaaattaatgtcatattttgcacttgacattttcaagtttaagaaacgcgaaaaaattcgggatctacataattatcacaccgacaaataaaaaatgagtcctttgaatcgaaaaatttcagagtgatataaaaattttcaagttatttttttctgtaatgtccaatttcacgtctaattttcatggaactcgtcccaatacaccatctaacaaaaattaagacaaaataattatcttagctaatactaaggagcccgaaatttgtatagctttctttcttccgatttgttagttcaaaaatttcagaggaatttgttttactgcaccatatgatcctcctgacgcagtcgtctgtgaacgcagtactttattttattttaatgctttttatttaacccccatttgatttttaattaaacaattcaaaatatttcaaaaaaggtctttggttctttcaaaaaagcatttttaattcaatggcaggtggaatcttcttttaccattgctcaaaagggttttattgcgctaattggcgtcgacaaatgttttcttcgttctgtggatgggattgtgtgcctaatggccactcaatcgaatgcgcgaatggccatttttgtccgaccggccattcgtgctccgctgacggacgccaatgcattccaaatggggcgcaggaatgtggacctaatggggggtgtggaaatggccaaacatgtgagaacggtctttgtgtgccaaaagtgagtgtttttgcttgatttatgacaatttttcataaatctgaattagagttggatttatatcccaattttcaaaaagttaaaaaaagtcttgcaagaaatcgtcctcgaaaa

SEQ ID NO: 3687 - DNA, 1991 bp, Heterodera glycines
ccccccccccccccccggttgagtgatatgctgctgatcttaacattttgggaacggacaattgattaagataattaattatttttgtcccagcactgtctgtagagtttttgaacgaattttgagtagcaaaattttagaatttctgaacaatataagattttttgataaagaacaatttgggtttctgaaaaataggtcgactacaacccaaatattaaaaacgatggacgatatatataattctatacaaatgaatcagcaaattgacatcatctatattgattttgtcaaggtttttaaaaaatcggagttttaacgttaaaattggcgaagaattgtcagacagtttcagaatattttcaggagtgccccagggaagtgtcttagggccattactctttttaatttttataaatgatctgccgtcctttattgcaaatgaagcggcatcagttggcataaaaatgtatgccgatgatgttaaattatattatgcacatgaaaacgatgaccattcaaatcagttggataaagcaattgaggctttggaaaaatggtcaaaaattaatgggttagaaatttcaactgaaaaatgttttgttttatatttagggaaaaataatatgaaaaaagaatattttattaactcaaaaaagatttctgagtcggataatgttcgtgacttgggcattataattgactcgaaacttaatttttcagaacacataagcaaaattgtacgaaacgcatatcttagaagctttcagattttgagtgttgaaaagcagggaaataaagactctaacagcagattataagacttttgtacgacctcaattagaatattctaccgaagtttggaaccctaatttaaaaaaaagatatagacaaaattgagcgggtacaaaaatttttcacaagaaaagtttttcgaaaatgtggatttgtgcccaaattctttattataaaatatgcttcgcgattgtcaaaatttttccttatttaatgcccaaattctaaaatccttcattaattctcttaagaattgagataaaaccctaaatttggtctcagagattcgaccagtttggtcaaccccgacccaatgacccccgacatttcaccattccgacaagaggaggcaatcccctaattttgtaaaattgcacattttggtaccatttctgttaagaaaatctctcccacatttttgggtcagcatttcgctcatttttgggataaaaatataaaaaatggggtgggaagagataaaaaatccaattcagccggggtttacgggagtcccgctcccggaaggtctcggactcccggctcccgttcccgtgaattttcacccaaatacgggagtaaaaatacccaatgcaagaataattttttattgaaaatctgctaaattattttttaccgggctctaatgtagatcatctggaaacagtgtgggttggtacctttgacacaatttaccacagttgcatatttttgttttgattgagcttttgggtaaaaattatttattttccgttgatttgggctcggaatttcgatttccagtgttacttttccttttatacatattagtaaaataattcaattatatcttatgtaatcaaaatcgacagtttttttttgtttatatattccccgattatctttctgaatttgggcatcttaaaacctaacgcagttttttttctcataccaataaaatttatccttcataattttgttttaaatttcttcattattttgcaaattaattcaatggtttttggtttaaattcttggtaaaatttgatcggtcatctcaagggccatgggttgacattttttattgaagcgggtgcactaattttgccctccaccccccccccccccgccgtttaccccgccgtatcagcagttcactccccgtttcagctccccccgagttaattaaaaaaatttattaacttttttgtaaaatacac

SEQ ID NO: 3688 - DNA, 2115 bp, Heterodera glycines
  misc_feature (98)..(98): n is a, c, g, or t
  misc_feature (105)..(105): n is a, c, g, or t
  misc_feature (121)..(121): n is a, c, g, or t
gacgttgttggtcaccttgttgcgcaacttctccttttaagtagtgtaataatccaaccattttttactgaaaaatttcggttttcctttttggtacncactccnaagagctacctccccncaaatttccagaaaatttcgctaaatgccggggggcgggaggcatcccccaagctcgtaatcctgggatagtccctgtgaatcacatggtccaactgctaccttcaatcgcactcgttgatggctgttccaaatgctgacgcaattcatccgttctttgctgaactgcttgctgtccgaccgcctgctgctgctgctgttcatggacattctttcgggcatctgtgttcatcagttttgacttggtcccactcgccacaaatttgctttcaaggtgttcagcagccttctgctgctgctcttggttatcatgcccaactgcattttcgactttgaacgcgcttggggccgctgcttggtgctgttgctgatcagcgacagcattttggaaattctgctgaaaagtgccaaatcatgaaactcttaagtgtgttcgagaaatgccgatgataaccgctttttattctgacttgttggtgctcagccgttttggcttccccaattttttgtgcccgctgatgcagttggtctttgctgtacttcggcaatgtatcgccgcccgtcgcacggtgatctttggccgcaacatcgccgaggttctcagaccggagctgttggtcatgtgcaaagacctgttaaaatttaaaaaattcagaaaaaaattattttgggattattaacaacctgaatttcgaataaacagatgacagcgaaaagcaatggaattttcattttttaaatttcgagtttggttttaagctgaaataagtgacaattaaattttttatataggcatattgaaaaattaatcgtaattagaaagctaaaacaacacagaggaaaatttttcggaaaaaatagtcgttgccatattttaaaatgctaactgatgagtgagtgctttaatgcatggatgagtgaggtttacccatcggtcggggagggggagactttgtgattggacagcaataaaatctcattttgcgactgtgagaaaatggggtgaggaatggcatattttgcgctgtgcgagtcccatttataaggaaggctgtgcgcgcggcactttcttcgtccgcccatctccgcccgctgaaaagaggtcggtccacagtacaaaggtcatcttgcgcaccaatctttgcgcacaacacacacaacaaacctgatgacgattcttctcaacggccttttgccatccccccgggcgacctccgcatcaaattcggagcagaattgctcctcgctcgccatcctgtctttaattcattccccactctctcaccctcttcaccgtatgccactcactcgcttggcggacggaatattcaaattttgggcatttatggcgcgttgtgccggcggcgcccccgccgcgacgcccattcatttacgacgaccccgtccaattcaccgcgcgatgaatatggggggcaagagatggattggtcaaatttggtgatacgcacataacaaattaaattttcagtgaaattggatgggttattggattttgaaaacttcaaatttgggcatttttaatggcatatgaaaaaaatttaaatttattttattctttttttgtttttttttgggtttctgtttgttgaccttgacaaatcttcatctaaatgccatttttggtcctctcttatccgcgcgacccatctccgcttgatgtgagtgaggaacaaaattgacatgaggcgccaattttcattaattattgttattaatgaaatgtgagcaaaaattgccgaaaatgaatgaccctgacccatgtaaattattcgggaaaaatctgagagaatatatttaatgcattgaaaagatttaattgccgatcaaacgaattcaaagcggcacttaaactgattgaatttttaacaatttgaaaaaaattatgctaaaattttaattcttttaattttaatttaaaaaagcagaatcggaaatgaacattgtttacatgaacgtacatgcaaacattacaca

SEQ ID NO: 3689 - DNA, 2360 bp, Heterodera glycines
tttaataagataagaaaattcaaaatcataaactaatttgaagtagaagcagaaattaattttaagaacaatttttgtcatttttggagaaaattggcatattttgcacaactttttggcattttttagttcaaaaagtctcctgtttcgcacctattttggcacttttttggggttttcgtttatatttttggctattttccgatttcgttctttggttaaattcttgattgtgccatttttgtttgctccgcctctttcccttattacctccggcatttgccaccgcctcgctgcctccgtcgtcatctgtagttgacatggcggctcgttcgcgtgccaaagactgctcacggcgcgctttgacagccgcaagaagggatggcgttgtgcgtttccgtgctggccttcgcgtcacataacgcgtaccatccggacgtcgtttgatcttgatggatttttttttatccggcatttaagggttgccgcccgaattccgacatttttcttgtcccgagctctaaccaaaatttttttggccgtcttgccaaatccccatctcgatttttctcgtcctggaaccagaaccggaaaattttggcagtcatgactctataattacggtcccgacttttttctcgtccccgatcaacgtttacggcattcatggacttacccgtaaaacggataacgtatggatttcagtaatttactgtactttggttcaacctaccacccattccagctcaggctgttgtcgatgttgaccactgatttgcttggacgggctgccacgacgcttttcccgttgctgctgctgcttcagttgtggttggtgttgttgctgcttgttgtgcccaaatgcgactgctgtttttgttggtctgaaagcaaacagctcggccaactcggtgccccgtggccaatcgggacgtggcaaattttgtgccaactttgaacattgcacccgagttgcgatgcctgagcagacagatgatgttggtaaattgtcctaaaaatgcttgaaattagtctcgtcgtaatcttggtccttggcaatccatcctcagatattttttgcgattttaaaatgatttaatcacaaattgttttatgcgaattcaaatgttaaaataaattaaatcaattttggctaaaaattccaattttcccattttggcacccctgaatgatgtttttgctgatggccaattaaaaacacatcctcggcagtcattcgtttatccgctcgatgatggctcattgttttagtgttatcagcgatgggccggtacagttgttgtgcttgttgttgtgttctgtggagacttgttccagcatactgtaattgaggtttttgctgttctgccgacagtatttttccaactttctgaagctgatgctgttgttgttgttgcttgtgcgcttgttgatgctctttcgttgccggtattgaatactgtatcggcatctgtcttggaatggtttaatacgatacaaaattttacttgaattaaagcaatgccaaactttttttccacgatttttaataaattttcagcaaaaattggtatgtggattttcggaaaaactttcgattttttgcaaaattttaatggctagttcttaagccgttaatatcttcagaatcagtgctagatcgttttttaaaagtgccatttccaaatgacgatttttagttagaaagtctataaatttgatggatttataaaaacgctcaaagttggagcgggtttttattgagattcgagcaacattttctataaatagtgcctgttgttgttgccgccttagtgaaccagtttgagggttcgtctgtgcttcaaattgcttttcattttgtcccgttgctgatgacgcaccattcttatttttcggattataccgtagtgtggtggtgtctttggggtactgtggaatttgtaactgtggatttacatatggaatattatgattggaatattgttgtagtttctgctgttgatacgattgtactggttgcacattatactgctgctgctgttgttgttgttgttggacctaataaaataggctactatggtacccaatcattaatattctatgatttaatatttacatagattttattttatttcttttaatgattattactttttgtggtttttgggcagcatttgcattcagtacaaattgctgttgtttttctgcaggttggttttttgttctgttctgtgccactaattgtaaatttgatgtagattgaggctgaaccttatttttttttaaatttatttggttttttttcagtaattttttgttattttttaaatttattcacttttttttttctttatttt

SEQ ID NO: 3690 - DNA, 2393 bp, Heterodera glycines
cggcttactgtattcactgtagaacattgttttttagtgtggctggcggtgatcttggccagtgtcaacgcccgtgttatatgccgatgttgtggttgttgttgtgcccggtgacaactgcggctgctgctgatgttcatccaccgacgagctggtgacaggcgctggaactgtatcagctgctgatggtagatggggtactgtaacaaagagatatagcgcgactcagaccacgtgggtaaattgcaacccggttaatgggtcgcaaaaaatttttcttttaaattggagatggatttctaccaaacagggatgttcctggacgtcccgaatcccatcccgaaaattttatccttcctgaccctaatcccgacatttttgttgacttgaattatatcccgagcaaaatctcggtcccgagtctaacctgccaatgggataacgtccttctttttttgtgtaaatatacgtggcaatgaaaaggtcgtcggcctccgattggcggttggtgtcggcatttgcggcatagaatgaggaggcttaaatgaaaattaggaatcgggtaaaaatattaaaattaatttttaattactttctcagattgtacgcaaatattccgaactcgttcgctaaggccttcttcgtgcatgcctttcacataagaatcggagtctacggagtgcaaatctcgagatgacattcccgaatcctgataataatttatatgattatattgaatggtttaaaatattttaaaattattgtttaaaattaattaaaggtttaagtaatcaaatgaattaaatatttgtaagctcattgcttaaaattaattaaccgttgaactaatcaatagatgaattaataaattatggattaaaaacaattaacacacctcattgttatcgtgaagtaattattgatttcaaaacaattaacgcacctcattaatatccttaattgttttgtgccgactaaatatttccctgcgacgctgcatttttcactttttctttattttttaatgtttatatgctagaaaataataattttacaaataataatttttaagcgattatcatttaaaatattgagatgaaatgttttggaaaaatgttttagtgctgacaaaaggtgtccttttcctaagtgcatcatcattccaccggttgtcagatcaattcagccgattgcctgcagcaggaagcggctgtcaccaattttactccagcagcaggcaaaatgctgctgctattttggcaatcaatttttgctagcaaaacaatcaccagcagtaacaacaacaaaaacacccactcaaaaaatgaggccaagattgatcataattcgaactcaaattaatttaaaaaaaaaacctaagggtcaaagttttctaagcaattttgtcctgaattttaaaaagcacaaaaaaataattaaaattaaatagtttaattttgttaatataattaacattggttaatattatttcattcttttcatctgtaatgatataaatttaatgaaattttaatccaaaaaatctctgattatttaacactttttaaaaaaataaataaaatttgttaatgaattaaaataaatatgattgcgttgtttttatctgtaatgatttattttattttatttttgaattttaatttaaaaatcctttttaacgctttttataaaaataaatttaatttaaaaaaaacaaatttattttttgacctttttctttatcaatttcttgcaaaaaatcattttgtgaaatccattcgccaattctcttcttttcttttcttgattcattagagaaccgaaaatagcagccaaccgatcgtccgatccgatcgtcgtttgtctttgtcaccaccaccacatcgtcctgctcagtctgtcctcgttttgtcatgatccatgtgtccgcaaagtttgcgcaccaccagcaccaccgcctggaactcttctattcttggggccaagccaagcgggggagggggcaacaaataaaacactgttttaccccaccgcgatcgcgatcacaatgaggtccgatcgcgggcattatcggtcatttgtgtgggctggtgatgaacagacagcagacagatcccgtcagtcctccgacacacaatttgtggatctccaatctccccccaccatcccctccacaaacaaatgcgtgcctcgatcagcattttcccccatcttcctcccacatcctcctccgatcacaatcctttccgattcggggagggcgaggatttgctgggacgcgatccctgattaaggagagctcaaatcagtaaatgggtgctcttcacctgaagacatttgtgatcaacggccggggaaatggtgaatgaatgtgtcctttttgcgggaccggg

SEQ ID NO: 3691 - DNA, 1927 bp, Heterodera glycines
  misc_feature (119)..(119): n is a, c, g, or t
gggaaatggtgaatgaatgtgtccttttgcgggaccggggagaagcgggggatcagttagggtgatcggaagcaaatagaaaattgaagaaggtcaagatgggtccgatatgaaattcnatgaaagatgatcattcattgcgtagagagagagatgtgtgcttttgctaattttgaaagcttcgagagcctttggttcagcaactaaatccccccaccgccgcttcccactgtcccaatcaaagtcctgcgcaggagagagaccagacccgtactgctcttactcggaagctttttgtcccattattgagagcgtttttgggggggggggtcatgggagaagagctctccgcggtctcctcgagagtcttgaggccatgggtcactactattatatgtgtgtgctctacccctttcccaactcccgcgcagcagaaccaagaagccgtcgccgagctcactggttactgatcagatatatcgcaaaaatcgccgagcccactgatcagtgatcactgatcccgtatatcacacaaagcaattaagcagaaaaaaggaaattttgtcaagaatttgtgtgcttgtgattgattgtgcctacaacaataatcatcatttcctaaaaattgatgtcactaatgctattacgtcttcttcttgttttgctaatgtttgctgttgaagcaggtaaaatttcaaaaaaaaaaaatatgcaaaatttcaaaaaaaaattatgaaaattttcttaaaaatcaaaaaaatttcagcccatcaacaacaactcggtacaccagtaatcggcggcatatgtaagctggacacaccagacgtgcacataggcggcaagcaaacacaattctttctacgctgtgagccgaacacggattcggcacagggcgaaggcgtttgggtggtgaagagtcggcatgccggttcaacagctgccaagtaagttttttatgtatgatcagcagcagggataggacttacacatataccatatttcctaaaatgcaacccctctaaattagagccccccccccccctctgaaatatagccacccttttgagggggatttgaaaataaaccccatggggcttaatttttagatatatttttacatataaatattttcacctcaaattaaaacgactttttagcacataaaaaaataaaaatcttattttatctttttaatttaaaaaaattatccactttttagcaaatattttggcatgtattttttggatttttagcatttgtgcactaccgtggcttaaaaatgatagaaaactgtgattagctttctgagtatcagcaattggttaagaattttgcgacgttatagaatacctgccgctgctgttgtcagccaacaagaaattgagcaaggcgaacaaaattcacaaaaaattgcagcaacaaaacaaatttcaagctatgtgtgcggtccgtttaaattaaaaattattttataaataaaaatttaaaaatatatatatataattataattattaaaattattttgagcgaaattaaaataatttcataatattccatgtgtaaaataaactaaaaaaaaatcgcatttattccaataataaatcctgtcaaattaaaacacttttccactgctatccttgaattgtggtgtcctttttcaaggacctcatgaaaaaataattattttttttttgcagaccttgtttcggatgctgtcgagcatggctactgtagtaccagtgaaaattgcttgcaacctgtgtataccgaccgtactgcatttctccaatgcgatccgacgtatagaagttttgacattattttatttatttttgataatagggctaagatttcgcaaaagccccaattttttttaatttacggattttttttgataggcacattttttgtaaatttaaaatt

SEQ ID NO: 3692 - DNA, 2453 bp, Heterodera glycines
  misc_feature (10)..(11): n is a, c, g, or t
  misc_feature (25)..(25): n is a, c, g, or t
atgcctgcannggtcataggcacanttttttgtaaatttaaaatttatttatttccccctcagggtcgtcgatggacgaaaaagcattgccaatccgtcttcaactttgactttgaacgacaggcttgcattgcgcacaccgcaaaaatgtcgcaccattttcggcaatttcccagtgagatttgccaaaatttgcaccaatatatatatatatatatatatatatatatatatatatatatatatatatatatatatttatgaacattgcacaccaatgttgtttgttttaaatatgaagaagcactttgcacacttcaaaatgcaaaaatgcacgtgtttttaatgggtgttgtttggagtgccaccggttaaatgcgagtgccaaaaagagtgaatgccaaaacctggactgggaagtttcgtaaaaaaagccttcttggcggctatcgttttataaacgccgcctaggctggcttttgttacgaaacaaaaaagcacaaaaaaaatctttctttttttaaatttaaatgaatgagtggcactcatcaaattaactttttaacctttatgaatgataagagtgataaaaaatgtttaaaaatgtttaaaaaaatcctataaaatgtgagagagaactgcaactgcagcacaagtgctgccacattcacagcgcggcggcggcatcgtctgtacctttgcccaatgttcggttgctgacccatgcaatgtgggcagctgcaacaacggcaagttttttaagaggaaattctgattttatactgagaataaattttctggagtcgagactgagaaaaattaaagtaggggttgttgctccctgaccctcgggcagagaaaagtcacgaatcggcggggaggaaattccccgacaaaagtttgtcggggatgggtggagaaatgaaaattttaaaaaaatgttagggcgagcgacaccttcgttggggaggaaattttcatgaaaagttgagaaaaatattaccaggaatttttctaaaagaaaaatgaagaaacttatttaaaacatgtcagacaaattaaaatttcttagaaaataaaaatttaagttttaagcgtgaatgatataaggaacaaacttagaaaatccaacatacagtatgttcgtttttacaggttttggaaatatttcgtaattaattaatgggaaaaagtcatgaattaaaaatattttgaatattttataatgaaatttataggatgaatattccaaaataatcgaatcctcttcctattagtgtccctgcaaaaatttggttcgtttttgacaaattttagaaaaagtatgggggatatggggaattaaaattttcaaaaaacaaattaattgatggaaaaatgtccaaaattcatatttcaggattagctaatcctctccctaatgtttcactggtacattttccgggagccattatatttagagccccaatctatataagttatccataaataattatatttaaattcattttattttttctgtaggatattgttgtactgccgctgttggttcaatgcctaaaggtaaataaaatttgaaaaaaaaaattaaattattttttttaaatagcggttttaccaatttcaaccaacaaaacaatctcaagcggcaacagtaataacattgccaagttggttgtttatcaaaaaaatacatttactttttattattgttttttatataatagcgtagaattttagcgtttttataatttttataattgtaaagtttttagaattaaaaaaatagtgtttagaccgttatctccaccatcatcaacaattgctgtctcagcttctgaaacagttccaccaatcccttctattctcgtgattgaactgaacaacaacaacaatcacaacgatgatgtcattgaatatgaccaattacgcctaaacgacattccatccactttaattgggcacatttcatcacattcgcaaccaatgccaacaatttttggtgattttttttgaaatttggctttttctacctcattaacagttgaaaatcggtaaaaccaaaattttcagattttggttatctttttttttgaatctactatctctaagcaaatttattttttacttaaaatttttatttgtacttcaaaattaatttggaatgtccaattttatggtgtccaaatttccaatgtccaattttccggcacccatttcactgtgatcacagcctatcacaccattattttttgcgcagatcactgctcctccggcttccactcgcccatccgttgtggcggcacaagcggcggcgagtgccccgtcggactgatctgtgaatttgccacccgcttctgttgtccatttccgcccaaaaaacagaaacgcaaaagcaccagcactaatagtggtggaattggtggtgttgttggcaccaccgccacaggcaa

SEQ ID NO: 3693 - DNA, 5430 bp, Heterodera glycines
aaatcagaaattcacaaaatccattccaattgccaaacgcgaaccaaatcccataccaaaacgaacaaattcgttattttggtaaaaggaatttccaaaattcgtgttctcttttcaaacccattccaaattttgcaccaaaatcccagggtttcgtctttcctatcttaatttgggttgatcattgtgccattgcttttcaatcccttaaaaaatcaaggatgaaaaacaccaaattccaagtcgcaaagacaaacggcctctaccggttcggagagctgataaacgaggctatggaagaagtgaaagccaaaaatattttgggttttcaacaattggaaaaattaaaaatggaaatttttgcaatttttttttgcggtgtgtaaaattttatttgtgggccataactctttcctcaaccgattaatatttcttaaatttaccatatataaaattttttggaattccataattgtttttcaagggtttactatacggaaacggaaatttacatgtaaatgaaattattttttaatcaattatttacgattaaaaacaagataaattgcaattaatttgataatttctactttatgaaaattttttttataaattacataatatatatatatatctatctataataaatataagctgaaaacaaaaatcatttgatttttttgactcaaaaaaatggaaattaattttgtgattattttcatcttatttctaatcgtactaattgacggaattgatgaagatttgtttaatgatttgtggaaaaatcttaagccatcgacctcaaaaaacatcaaaaaaccgatatttggagaaattaatgcgataaaggaagaaaaagttgttaaaaatgaaaatgatgaacaaggaaatgccaatcaaattgaaatggaagacataaagccaaaattattacaaaatattaaaaaggaaaaaacattggaagaacaaaataataatttaaaaataaaaattaaaatgccaaaaattgaaatggacaaattaggcgaagaatcatttgaaaatgagtttaatgaggaagctgatcagaatgtttcgtctgctgatcacaacgattctgttgatcaagcgtattataatattatggtaattcaacaatcctgtaaaaaataatttaaaaattcaatggttctaagttttgcatttctaaaaattttaatgatttaattaggagtctgaaacaagaaatgaaatgaaaattttgaataaatttaatttaatgaaaacggaattgcgaaaagaaagtgtttataaaaatttgacaaatactcaatttgaaggcgaaattgcgaaaaggttgggcacaaatcgaaacaaaatttataaattgaagaaaaaattgggacaattaagagagagaatggaagaaagtgaagaaacaaaaatggaactgaccagaaaatttgataaaatgagaaaagaaaaaatttgtgggtttaaatatgacgagaagaaaatatcagtaattgaatgtgaaattgccaaaaagttgggcacaaatcgaaacaaaatttaccaatggaagaggaaatttggtaaaaaaaacaataacaaattcactttatacttactgtctcattaaggtataataacgaaatttttatttacaaacgaagaaaaaatagaaaaacttgagcaatttgaaaaagtgaaaaaagaatttataaaaaaattcaatttgaaaacaacaaataaaattgaaacaaaaattgcaataaaattgggcgttttgtggcaaacaatttttaaatggaagagaaaattcggtttaaccactcgtaatattttaattatttatatttaaaaaaaattaaattgcttttattttaaggaaagtccaaaatttattcggatgctgaaaaattggaatatgtgaaaagaagtaaagaaatcgcagaaagaaactcaatgttaagtgagagaaaaattgccgaaaaattgggcatttcaaatgacaatttaagacgatggaaaatgaaattcggcactaaatcgatccgttagcattggacaaaaataattttattcagtgacaattgggtcaatttgacaatgtagagaaaatcagagtactacagtatttccttgtttctttttttttgtaatttctctcactttcgcgtactatctcttcatttttagctgatcaaacgcaactgcgtttacctcgctttataaaattcgttttttttaaatttttataaaaaaatacatctattggcttttaaaaaagattatatttattttaactttttctactaattttgaaaagtaaaaaatttcgtccattcttgagccttgagccagccgcctatcttaaggtgtgcaaattttttaacagaagcccaacaaaaagcattcttcggatcggttttccgttagaaaaacaaaaaaaacgaattgttaattcgttaaattttgcggtctttagggattgtttttatattttaataaacattcagtctgagagaaaatagtctggaaactgatccccgggatcaactgtgccccaagggccagtcatatttttagttttcaatttgtcaaacattatttttagcgcgcgtacccaaacccagacaattcgttcccaaaattttctgaaaatgggcgccgcaaaactaaaataaaatggcgtaccgatcgatttcaaccccttggaaagaatcccgtcccgtaaatttcattttttttaaatgtgcgatccgcaattcgattttgcgcaatttggacttgggttcaatttaaaaaatttttagagggataagattttttgattcttcaatcatcttatctaattacttcgtttttatagaattccataaaaaattgaatcatacttttaaatataaatttatcgattttaagaaaatttaaaattttttaatattctcgggaaatttagcgaaaaaaagattttttgggaaaatttccggtttttgggatcaaaaaggtcaattcatatgttgggggccgttctaataaaggttttttgaaaaatgccaaaatatggacataaaatatgggtgaaaatgccaaaatatggacaaacatggaaatatggacataaatcgcgaaatatggaaaaatatggatatataaatccatcctagaagcttcaaaccaagctagaaacatgttttccgtgcgtttcaggcctcccacagtccaagaaaagaatatggatttccatataattccgagccctacttattataaaaggcgtaatgatggtaaattcatgtacaaaatggtattaatgctgcggttgtagaatgaacgacaagaaatgaaaatggtgtcaaaaatactaaactatgacgaagcggcaaataccttgaaggaaggtactgtagttaatagaattttattatttaaattaaaattctctaataaattaatttttttatttagtttcatttattaataaatcgagttttgtttattcatttcgattttgatggttataatatttttatcccatcccttagcaattttcttttcaattcaaaaagttctgagaatatacatacatacatatctctaatattttcggcattttttgggtttatgtgaaatctttttactcaaattaatgtttaattaattgaaaaagagcgaaattaatattatgttgataaattaccaaattatgttaaatataaacatacaaattactaaaaattgaccctaaattatattaaccacattatcttaatctgcacattgtctatttcaggatttattctgtaaaagaggacttaggtgtccaaaattccgacggtgccattatcaaattttctgatgcccaatttaatttaattttttatttaatataaatcgaggatcaataaacttttccttggccgattatatttcatttaatttcaatatatttatttttttggaattccataaattattttttaacatttacaaacacggaaagggaaattaaaaatttttaaaatcaactatttaccattaaatataatagattgcaattgattgagatttttcaaaaataaatagagattttgcatatattccacttataatataacaaatataagcagaaaaaacaaaatttattattttttttttgcatcaaaaaatgccgcaaattaattttgtgattattttattcatatttttattcgtgctaattgatggaattgatgaagatttatttgatgatttatggaaaaaccaaaagccatcgacctcaaaaaacttcaaaaaacaaaaattcggagaaataaatgcaataaaggaagaaataattgttaaagatgaaaagtatgaacaacaaaatgccaataaaatagaaatagaagacacaaagccaaaagaattgcaaaagattaaaaaggaaaaaacattggtggaacaaaataataatttaaatagaaaaataaaaatgccaaaaattgaaatggaacaattggaagaagaatcatatgaaaatgagtttgatgagcaagctgatcagaatgtttcgtctactgatcagagcaactctggaaatgatgaggattacaataatatggtaatataatagacaaaacaatatcattccttgaaaaaaatgttgaaaattcgctgaattctaaaaaatttttctcttaaaaaggatttctttagaatacagaagaaataaatgaaatgcaaattgtgaacgagtttaatttgaggaataataaattgagaaaagaaaatgtttataataaaaggacaaatactcaatttgaatgtgaaattgccaaaaagtttgacacaaatccggacacaatttataaattgaagaaggaattgggacaaaaaagagtgaaaacggaggaaagtgaagaaacaaaaatggaattgatcagaaaatttgataaaatgagaaaagaaaaaatttgtgggtttaaatatgacgagaagaaaagatcagtaattgaacgtgaaattgctaatgaattgggaattaagcggaataaaatttacaatttgaagaaggaatttggtaaaaaaaacaataacaaattcactttatacttactgtctcattaaggtataataaagaaatttttatttacaaacgaagaaaaaatggaaaaacttgagcaatttgaaagaataaaagaagaatttaaaaaaaaattcaatttgaaaacaacaaagaaaattgaaataaaaatcgcaataaaattggatgttgtgtgggaaacaatttttaaatggaagagaaaattcggtttcagcattcgtaaatttttaatttataaaatttaaaaaattgctttttaggagaaaaaaaacgttactcggatgctgaaaaattggaatatgtgaaaagaagtgagaaaatgaaaataagaaatccaatgataagtgagagaaaaattg

SEQ ID NO: 3694 - DNA, 3975 bp, Heterodera glycines
acagaagaaataaatgaaatgcaaattgtgaacgagtttaatttgaggaataatgaattaagaaaagaaaatgtttataataaaaggacaaatactcaatttgaacgtgaaattgcaaaaaagcttgacacaaatcgaaacaaaatttataaattgaagaaaaaattgggacaaaaaagagtgaaaacggaggaaagtgaagaaacaaaaatggaattgatcagaaaatttgataaaatgagaaaagaaaaaatttgtgggtttaattatgacaataataaaagatcagtaattgaacgtgaaattgctaatgaattgggaactaatcggaagaaactttacaaatggaagagagaatttggtaatagattaatgccataattggatttaatcattgtctcatttaaggcataaaaaagaaattttcattttcaaaagaactaaaaatagaaaaaataaaactaattgaaaaattgaaagaagaatttactaaaaaattcaatttaaaaatgactaataaaattgaaacaaaaattgcaataaaattgggcgttgtgttggaaacaattcgtagatggaagagaaaatttggtttcagcattcgtaaatttttaatttataaaattttaaaaattgcttttttaggagaaaaaaaacgttactcggatgctgaaaaattggaatatgtgaaaagaagtgagaaaatgaaaacaagaaacccaataataagtgagagaaaaattgccgaaaaatttggtatcgacagactgagcttaagacgatggacgaagaaattgggcaccaaatcgattcattagctttagctgtaatttggaaaattaatgggcttatgtagaaaaacatgtacaagaaattttaaggagtttgccaatgtcaaaaaaaatatgaaaattttctcaaaaaatgggtgtcactcaagccgcctagggatttgttccaaaatatccccggttttaagccatttttctggttctcagaccactctgaaggagtgttctgattatcgcagcgcaactgacttttctgtttagcataaaaagctactcttacatgaattttttcagattttttgtggtttctaggaaatttgtgagttatcaaaaaagagtaattggaacacccatttttttttggaaaaattcataatttttttttggcatttccaatctccgtaaattttcgtgttcacaacagccttgttttatcgatacaagtgtcgctacagatttactgttgttataatcttcttcatacaagtgaaatttatgcggttatgctttgcgattcaactgctgatattccccctgcgagaattattgtttatccgaaaaccgaataaaaaaattaacagatttatacccactagataaatgtgtagagccaatgacatatcattactgtgttatgtggtagaataccaaaaaagatgattatcacatttacaattgttattaacattagaagaacatttcaaatggcatactacaaaaaaatagaaaaatttttatccaagcttttattcccgaacaaaatgatgatccagatttgcatgaaattgttccaatgtatgatgatgtgcacggtccatgtaatgaaatataaaatcgcaaaatatggaccaaaaatcgcgaaatatggacaaaaaatggccaaaatatggacataaattttccaaattgagggtgtaagttttcaaaatttcttcgtattctctattgtaaagaataactttcaaaactgtctaaatatggtattaaaaattattttggaacaaaaaatacgataaagctaaaatttattaattccgccccccctgggcagagagatgcgcattcacataggagagaggagagaattagagaaaaagagtaaaaaaatatgcacgaaaaaacaaagaaaagcgacacccgtgctcagttggaacacgagggcttggcgaatgggcatgcgtggcacccgtgagcagttcgaatgtccctgaaaaattccgccacaaatttggccccaaatccccacacccctcgtcccctctcctcccccttccgcatccgttatttcagatttttcatattcaatttcaattcccctacgctaccacttttcatcctttcttctatgcagttgaaaacggcgttagttgctgccccctcccccaaattccgctcagtaattggccactaaattttccggtaatttgattccgaatgtattttttcaggtaattcgtgtccaaccgatgcctcaaccgttgccgctgagagacatgccgcaaattcaccatccaccgcgaaatgtgacatcaatttggatcaaattatggttgctttttctcagtctctgggtgtttcttcaaggaattcatgttcggcaaattcaacgtgaatacgccgtaccacaatttgccgatccgccgccaaacgtgccgtatcatccaccagaaaacgttccggtaatgttgggtcttgtttttcttgcgtttctcatatttccggatgctttttcaggcaattcaaccaatgcaacgaccgcggcagctgagagacgtgccactatacgaccacccgccgccaaacgtgccgtatcatccaccagaaaacgttccggtaatgttgggtcttgtttttttcgtgcgtttctcatatttccggatgctttttcaggcaattcaaccagtgcaacgaccgcggcagctgagagacgtgccactattcggccacccgctgccaaacggaccggtaatttcataccctgtcttacacctaacaccgaaacatcttttcttaagcaaatgcatgccaaccccccgagagtgatggaagcgatccgacggctgggcgagtggagaggaagaccaacggacccaagacgtccgcctcaatgaatgaatggaattccaatttgataaaatttgttgtttgttaattttttgaattgataagggttaaatcccattacctaaattgtttaaaaattattaaaattttaagaaattagatgctaaaccttaccatagacaaagattatgaaaaaacgaaaagaaatgacgaaattttcggaatgtttcttctttttgttatttatggactttactttttgtgttttattttcgcattaataaggtgttgttgaaacggttaattcttcatttattataccccattttgttgaaaattcgccaccattatgccctgcccactccccgccgaactgatcaaggaaataattgatgctcttccccctccaaaaacacatcggcttctgctcgtaaattttgtttaggcatcctttgttaaatgtcggttctattccatgatgagaagattgtttcgctcagatcatttattactaccaatggcccaaagaacaggaatttatttatttttcgatatttttattccccacacaactcaccaaagatataaaatttaaataaatttataaattttattttttaatttgataatttttaattgatatttctgataattaaacaaaattgtatttttcccaagaaattggcctgcaaagagtatgaaaaatgtgaaaactgtggggataacttgtaacatttgtgcgggagaagagagggaatgcgagatttgtgaagggccaaggatgatcacctggtccgtagcggatggttttgagccaatgagtgagtttatcgtttggataatgggttttcaacgatttgaaacggtcgcttttgcgcattatgctgggaggttcgattctcacattgtcttgtccgagctaacaaagaaggaaattgcgacggagttgatgatggctgatttgaaatttatcaaataaaggcgagaagagtgtactttcgggatttttggatgcttcgtcagaataggttggctgaccttccaaaaacgttggggttaaacattacggaaaaattgcatattgcccaccaaatacaataagaatgagaactttgggagg

SEQ ID NO: 3695 - DNA, 4037 bp, Heterodera glycines
tggaagtctcctctctggactttccattaatttttcaaggttatgtgaacgacaattgcagttcactaaacctgatgaatggtcaggtatgcaatcagtgcatgcctgaacaccaagactgcaattgaaatcaattgcttcttgccgacttttacagttaaagtcaattgttaatggctctctggttagagccatgttgttcccgtcgaaaacaaaatctgagtttaagacgggagcgggcggaaaagttactccgatcggagtaaggctgatgttgttccatttcagtgttcttcctggatagaggaacacctgagttgacttgggtttttcgcccaaggtttccaggcgaattattgcataaacaataaattcccaggaattgcagcccatgatttcatagactgtcttggacttttcctgagcataccaacgataaaaaaggcatgcactgccgcctaagaggcatttattgccccaaaaggctgtgctgtccaggcaaaatgaattgcctggaaaatcgttggcatcttttagctcaggaatggaagtattgtggcgaacttcgctacaatacttcccttcacaggagcccatcttagggcaccttttaccggctaatacattaattgcgtatgaacgttgccaggctttagtgaagctttggcattccaaagctaaagccttaagcacaacgtttattgagccaaggagaacaccttcctctgttttcagaagaagtgtgtttgtttggccaactggcagtaacgtcagcattgctgagttttcgacaatgcatctcatgcttgtcgcatttttaatgcatttttccgatttggccatgactgctatggtctctgctccagtcaaatcctgaagagagttagccataaggacaacaaacgccattgttctgtaaacacggcgtgatgtccaattttgagaagctgttgcccttggcctcctctctttcggaagccgatttgggccaactaagtaaattattggcctgataaattgaattatcagccaaatgaccatataaaatcctgaaaacaggacctttaatatggaaaaagccataaagctaatgcttatgagtgataagcaaagtccccctgctaacattgatgaaatcaatgggtaacaggttggattcgctaactgttcaatgcaaaaatagcattcgatgagttcgcactcatcaactgctggacataaaatgtcctttttgaacatgtgtttcgaatccatccaaaaatgaccttcacattggaagtcatttaggaggatttcctttggtagctcgtaagtgagcttctttacattcgcatgaatgtaacagttctctgcacagcagagctcaactttattgatttcttttggaatctttgctttaacgcccttgttaaagcaaagaagtttgcattcattgcagtgattggttggataggctccaaccaacgcaaacatagcaaaaaggatggaaagacagttcagaactgtccccatcttcgatggtttaatgtggcttcgacataagctggtcataactgagaatttttcttcccaaagtccttttgaagcaatttttgcacaattggacaaggcgttcataaacgccaccggcccaaggacttatttgtgggatgaatcgccacttaattttattaagtgcgaaaaattcctgcgtgttttgatctgccctttctggagtggtcaaatgctcaatagttttttgagccaatttaaatgaagtggcattgtcactccaaattaaatcaggcttccctctccgacttatgaaacgtcggagaacattgaggaatgattcggccgttgtgtcaagcatggcctccagatgaaccgctcgtgttacgaggcaagtcataaggagtatccatgccttgactttctctccggccaaccgcgtttcggttggaccgagaaagtcaatgccgactgctttgaaaggagcctgacggcatacacgctcgttaggcaaaggaggcatttttggcaaggcaaactggtatgcttgcatccttttgcaccgaaggcatcccttcagtgcttttttcaccttagttcttgctcgaggtgtccaatactcgagtaaaaactcagtcagggtgccttccaccccaaaatgatgccttctctggtggcattttaaaataattaagtctcggatggaggattgtcctccgagaatgattgggtggctaaaaccaaaaggttggtcacaccttcccaacctggttttaagccttaaatcccctcgctatccttaagagaaggatagcttaggaagtcttcagcacttttaatatgatccatgcggatcagaaggttctctgctaggagaacatcttctgctgaaaatagtcccttttcggacacttttgcgatttcttttcgacggatctcgaaaagcttggaaggatattccttctgaatcaatttcagacggagaaatcttaacacaaagagagtcacttggacaatctttgtccaagagctgaattttttggggtcaatcagaggactgtcaatcagttcctctgttctggtattaacgaagaacactttctcttcgttatccagagacccttcctccagattttctggaggatcttttattttaaattacatttctttaggccattggtcatggtcttccttaagccaggaagggccattccaccagagagacttatccttaagttctcctggttttgcgcctcgggttgctatgtccgccggattttcggctgttcggacaaaatgaaaagcacattcattgagagtacgaatttccttaactcgtctctcaatgaatttcggttgtgcttcttttgaagcaacccaacttagagcgatttgtgaatcgccccaaagatggagattagaaattggtcgccgaatttgatcggcgataaatttaagaccccttatccctattagaatggccatgagttccattctaggaattgttaatgcttttgaggcatttataggtttgagtctatttttggagaaaataagccaaactgaaatttggttaccttctgccgctcttagataaattgcggctgcaaatgtgtggatcgaagcatccacaaaagcatgtaattgaagggatgggttcccttgtagcattgatctccgtgggattctaatggtctgatccttccaattttcttggaaggattcccattgagtttgttctttctcagaaagaacatcatcccagcccttcttttcttcccaaagagtttggaagaaaagcttcaggggctgaatgcacggccccattagaccgagagggtcaaataatgaggcaaggaagcttagaacaagacggcgtgttgccaccttttctaagccattagttgggaactcaaagacaatttcgtctttgtctgtgtccaaatgagccctaggacttttaccttaggcttgttcaggcgatcctcctcaggaatcgccttcattacctccggggaatttgtaacaaattcccttaaattaaaaagtccttctttaaggattgctttggactctgcatatttatgcaaagcctcttctgcggattcacactcaaggagtgtgttatccacatataaggattgggccaattctttggccactggagattcatactcctcaaatggtgctgcaaagtcgcagccaaaatgaagggggaactgatcactccgaatgccacacggcaaaatcggtaagtgatcaaatttgttggtgccagtggtttactggcgtccttcacccagaggaatttggtgacttctctgtcctccggttccaaagcaatttgcaaaaatgcagcttggatgtcggagaggagagggaattttgggcatcggaaacgcataagcattccgacaaggtccggtaggattaccgggcctctatacaaacaggcattgagactgtttgttcctctggtgtgagcactggcgtcgtaaacgacgcgcaatttcttgccattggccaagaactccatgaatgaggga

SEQ ID NO: 3696 - DNA, 4090 bp, Heterodera glycines
ggtctctaatggtagcatcatatgcctccattaaatctggagaattacgaagcttaccaaaagtagacattagtcttgttaaggccatgcgataattggaagggaggtcgggaacctcctccttccatggccatttaacagagtaccgtccgtccttttctcgacgaatggacttgttaaatagacccattgctgtttggtcatcattttcatttggatcgtctttgattcccaaagactccaaattaaagaaatattcaatttctttaacggtaggcatttgcccttgattggactcatcaatgaccatcattgatagttccgggttcggaatttccggcccaaagtcggactctccgtttaccaaagggcccaaggttgttgaattacaaacaacccgggagaaacttccttcgcttggaagaattgccagaaatgtctggcacctataagtatttcgggctcttcccgagaaaagctcaaagcgtgtgccgcgtccttgcctaccaatgggaattcttcagaattccactctgccattttaaatgatgtggaaattctttccgtcctattgagaaggatatcttcccactttccatccgtccttttgatttggatggagtatacgggagaatggaaccttattggtccagttctctctccaccaaagccataaacttccaattcttcagaagacactttgggtggcttaagcctctcgatgagagggtcggaaatataggtagcttgactcgctgggtcaaagagaaatggaactttcatccaaactcttctattgtttttggttctgaccagtatttttctggtcattagatatgcgtgaggctttttcgccactacgcttgccatcacattagtagtgatggataagccttccatatctggaaaaacttctgaatctggcacattttcatgtgtttgctcacacatagtcaaatgactttgagaggattttgtcacctctttttttatctgattatttgatgggccccgagaggttccctctcgagacctctccccgtaacacaccataaagtggtgtctttccccacatttaccgcacctacttaaggacgtacaattttgggaattatgacccgtaatgagacagtttatacaccggtcttggtccgtaaggcgcttccttcgagcccccggagtggtgtatttcgtgcaccgactcggtgcatgcccctttgcttcacaaagggagcataagcgatttgaccccctatctgaaataggggtttgatatttgttaatggccgagaaggaacgattcggttgaggagacatcctcctcaccggttcgtttcgttccattggcctccactgccgttcttgccggaacggctgggagaaacggaacggtgttcctctcccttggttagctcttcccccatttgaatgtgggggaaaattccggggtttttcctcacctcgaaaaacctgagtacatctctgtacttcttctttcacttcaacgattgaagtgatagctcttcggagctctgtgcaattaaaggcacctcctgccctcatttccttctccaccacttgggtgagaaggtgataaggcagtttggacttaatagtggaggccatgaacttattttgttcattttctccatagtccaacaactgatggcaaatccgttcaatggactctgagaattgtctcagagactgaacggattctgctggtttgggaaggtggagtaactccgcttggagggactccaccattcgttttttcatccccaaaccgctttttcagaatttcaactacccttggataattttcatctgatggcggatacaagtcaattgctctccgagcaattgacttctctgggaggcatcccagcaaataaatatgctttttaaagtcttcaatctgaagactttcaacggaagtctcaaagagcttccaaaataaaggccaatctcggggttcccccgagaacttgggcaatgttattggcggaagcgtcacatcatgacgctgatgcacaagttgttgctgctgcacaacttgtgctggctggtttggctggggaattgcatctcccagctctgagaggcctaaggccccttcaatggtgtcgacaagccctcgggcttggtcgacccaatgcatgaaggctttgccttctggcttaaagtccctataattttgctcttcctcctgaagagctggtccctttattctcaggaaaatggcttcccattttccattgtatttctccaaaagagaaatgattttgcagagattttgtctctctgcaattaagtctgcacggacactttggtccgccagctctttgcccaagttttcttgggctgtctcaatgtacatcttgagacgcaccaccattggtgcaatggagatgcgcaagagctcactcattgctcttacgcttgatgaaaacacaataaacccctttgggttgtgtgtttgatccaagcgctcaggccgcgctttggattggtttggttggagggtaggcttacgactggaagccgacccctacggggctccaatttgtgggcaaaaagccacaaaaatttgcacttcccggcagaaggggaagcagactctcccggcagaagggcggagttttttaagcaaagcgaatttctgtccaaaagacagaaactcacagagtccaaagggacaaattaaaggaggaaattcctctcctttactgaagggacaatttgaaaggaggaaaatgcttctcctttccttttgaaagccttttctttgacccaacgtgggtcaatggcttagtgatctgtatgaaagggctcctgagcgtcccttttacagatagagaaaagactaagactctttcttaatctttattcaaatattcacaattacaatttaatgcaaatgcttggacagaaaactgtccggctgacttaatcaaaaattgatcagtgaagaaaatggagaatgggccgggcttttataccctcacaatcgatgggggcggggccaggcccgtgaagaaatgtgcacaagcaaagggaaaaaattccctcaaaaatgatgactcataacaaaaattaagagaggaaaagagatgagtcataaaaaagaggagcgagcgaagggagaaattgatcaacgaaaaggatcaaaaaataaatgaaaatttccaagaaatttgtgtcgcttttggcgacattcggcttgtaaagtacgaaagcacattcgcgaaaattttcggtttaacgcctttatccgtccccctactttggatgtttgacactaaaaatccctattcttgaattttcgtccctaaaataagtttggcccctgggcatttcgccccctatttcggcattttttggaaaaatttcttaccaaaaacgcaggggtacataccctcccccacacccacgcacacacaagacccctctgcacccgaaattttatggaaaattagtatttttgcgaaatttcggttttccttgttcgtaccccctcctaggtttaccccaacaaaatttcccagaaaatttgcgaaattttcgaatatctacaaaaagtacccattttttggtgaaattctgttcaaaaatcgagtgaaaatgcacaaaacattttcttagcccaaattgctcagcacatctgaggtcgaggcggagaagtttctgcaacagtatttggagagttggggaaagattggtgcactttttgccccgccgggcaattccgacggatgggagacaagcggggagcagcagcgcaaagctgtcaaagcagtgtttacggtaggaaatggaatggagttgaagggctattgaatttaaagggctctaggaaaatccgacacaggaaaatccgacacaagcggaaaatccgacaccggcggaagagccgacactggaaaatccgacactaacattaaattttaaaaataatttttgattctatgagttaatatttaaaatacatataataaagttacagtactgaagttatttaaaataaatattcttattgccataatctattctatctaggtgggctatatgaatattttttgtatgccct

SEQ ID NO: 3697 - DNA, 6394 bp, Heterodera glycines
agtcaaattttcccaattttacccacagattttcactgagattttttatttttaggttaaatttaacaaaaatttaataattgttttgatcaaatgccaaaaattgaattttttcataaaatagcaaaaaaaggtaattattaatcatgcagcccaaaataataataaacggaagcattcgtttaaaaatttaaagttacaaaaatattcattcttaggggtggaactttcgcattttgcgccaaaaagcgaaatgcgaaataacgaaaaacgccatgcgaataatgcaaaatgcgaaaagcgaaacctcggcccatccctgcttcacaagtgtatatctttaaagattgattaacaaatttaatcggataaaattaccaacaattttacggtagttcgacactaccgtattttaacatgtgttcgtgccaaaaattttagaccctgcaaaaattctgaccatattacgaagtacaaaactcaaaaactggctccttttttgaattctggactcaaattcgaacaataatgaaaaatttaatttcagaaattcacatatttcagatctgtataaagccatttaaatgtgattgattctgcttgttttaatcaagtttagtacgaaagtgtggaaattgggaaaagttgaattttcgactaattttggcagttcgacttcgggattcgaaattggtcgaatgaatgaaaatttctaaaatattctaaattagaagaatcaggccttcccattaaagtcaaatcaccgggcccaataaagttgaaaaattgccttatctacttacaaaagagaaaaaacagttaataattccgcgcgataaattagggttttgaaatcaaattgacactcaaaaattttcaaaatttaaaaaagtttgcatttctgttggtttgaaaagtgtaaatcttctgaagaacctgaaataagaaatgcgaaaatgttcaaaaattaatcgcatttttttcaatctttctctgatatttagagttgagctggaccgggaccgggaccggggcgggaaatcccggttttttcaggtcccggtcccggtttttggaaaaacagaaatcccggtcccggttttgccagtcccggtcccggcgggactaaataagcactggtaagaatggggtctgggtgagaaaagagaagggaattggtgagggatcagaaatttttgataaaaataaattaaattatttattttcatttatagtatgtgttcatatgcataagtggtcaagaggctaaacctttttactttcattatttgaatcttcggttcaattccctgagggacagaaaattttttttatattttctttaccattattttaattgaatttaattaataaaaaatattttaatttaaaattattatgtttttcatttttaatagcctaaaaacccataaattaaccaaatatttggtcattttttgacaaattctgttaacaaatctcactcaaaatttcaaaatttttccggcggcgcctatcggcaccgccggaccccgcccctcccaatgttccaaaaaagttttttgaaaaaacattgccacaaaaacagcgatctaaaagcaaaaatatttaaaagattgttaatttatttaaaaaaatacagaattttgggactcagaaaattccaagaacccccccccccctctgaaaacaaaatttttaaaattttcctcgaactcgtcccccaaaacgtaaatacaaattgaaggtgtcaaaaggtgtcagaaccttagaaaattgtttacaagcataatttcgatcatttcttacatttgaaagattctttagcatttcaaaatcgggcattttcaaatccggaaagtcaatatgagccaaactcagtggacgttgttgttcagtaattcgattaatcatgaaaaggctgctgttccaccgggttgtaacatcctgaaccgacgattaaaattaagtataacaatctaattaataagacctgtatcagcccatttttgggagctccgattaattcctgttgtctttgaaaaacgttttgaaagtttttggatcggttgaaaaatgccaccaaatccctgcaaaggtgtagctgttctttgacttctccaactcttttagtccgatgttcaagggcgtccgtcagtgcctttaaattaaaagaaaaattatacaatttaatcatcttttgttaccaattgaattttgtgacaaaaacagtcaaaatgttcgtagccaagttcttcaacggcacaaatcatagacgaggctgcatcgcgaagaaaaatgtgaatttggtttggttcaattccaaaatttgtaagaatgtcattgagtcgtaaactaatgttgtgaccggtgtgggactctggcatcggctgagtggttaaaatacgccattttcggttaaaatccgagtcaatgaaatgaacggtcaaacttaaattaggttaaaataatgtttagatgggttcttttacctcaaaaaacttttctttttgcgcacattttgccaattgtcagtagtgaatgacaaaaattttgctgtgcaaatttcttcctttacaatgctgaatttgtttcggtattcttcttctaataattgtgtcataaattcgcgagatttcaaccggtaactaataatggtttattagttcattaaaagagaaaaaatttaccttggacacgctcttcaaaaatctgtcattccatttttttccggaaacaaaattggctcacacgaaaggcaaatgaaacgcaaaattaatgagtcaattttttgggatttagggtgtgaattggaccatttttccttcgaacggaaatgttcaatgttcatttgttttaatggttgctgggaagaagattcctcattgaatactgaagcacttcttttttggctaattttttgctcttttgcggaagcatacattttgtgatacctgaaaataacttagaaataaaagaaaatttaaagactttttgtgttgtttcaaatgcttgtccattcctgtagtgtttcccattttgcgtgagatttgaactccacaaattcggcattttgcggttttgtcgcccttattgaattggtaataacgcaaaaatgaagcggagggttcagtcagttgaagctttgaaaggttgttttcattttcatcaataaacacttcttcgctttgctcattttcagccggaaaattatcagaaatttccggatccattactctaaaaaagttcaaaattaaggactacaaatataatatgtatatgaaacgaataaaatatttcatctttattttaaaattggcataatgtcaatattaaattcatattcataagctcatttttttattatgaaaagcccaatcattaggggtgtaaaaaagtctcggtctcgagtctcgaaaatcgagaccgagactttaaaacccgagaccgagaccaaaaaaccccgagacttttctcgagtcgagactcgagaccgagactctcgagcatcactagtgaacagcacgtcccaccattcgtcggatcttttgtggcggatggcgacagcagttgcgttgcgtggcaatgaacgaattgtccaggatgggattattcccagtcaaaaccatttaccatgttgcattggcaacatttgtttggcaacatttgttccatggccattgttcggggcagtggcattctcttttaacacgtcttctcggcgtaagcttaattagtttttttatgtaaaggattttatttaaaattttagcgacattgtctttgtcggggcattgatgagcgtctttgaggccaaggaagtaagtattccttcaacccatttcttccgcagaagaattcgctctaaatgattttcaatttattgaaaatataatataaaacctacgcagcccgacactcatggaaagcatttcattaagctttcctaaatttattaaattatgagatttcgaattgagtttgatatggatataaatttgggatttacactgtccgggtgtccttgcatcgcgcaatcccacaattgagccttaacgtataatttacgttaaaaaatcatttgatttaatacgatattaaaaataaaaattttcttcttatgtgtatattcatttgttatattctagcacttaaaattgtttaaagttaataatctaaattaactccaaatcaggaattaaggataagcattaaaaattttagtattcgcggaggcggactataaaatttcagaacaaggaacttaggaatgaatttcaaaaaatcatttaaataaatattttttcaaaattagtctaattaacagaaagtgttattggcaatattccaataaataattgcatctcaaattgttcagaaatttagaaccggaataaaggccctaaaatgcttcagaatacggttagccaaattttggattttatttttaaaattttcaatgatctcctcattagaatgcctatgatttcaatcagtttttattatcccaatttacatagagcggataagcggcggtcttttcatcgtgtgtcatcttaatgaaattcattaatcaaatttcctaattaaaaaaaaattacttcctgggcccacagaaactcatggtctgcagcgtaacatttgtggactttagttccattggcggaaacaggtgaaaacaggtgaaaataggtgaaatttcacctaaaaatatataggggcgtgtatttaatggggcatattagagaatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatcctgacactatattgattgaaatcgaagaggacataaaatatcataatttttctgcgggggcaaaatgttttttgggtgacaacaagaattagttgatgatgctaagaaaaatgcgagactccaaactgaatttggagatgaatttattgtttgtaaactataaataggatcaagaaaaaaaataccaattaaataaaaatgaattctgaaaaatcagaaaaagctaattccatattattggaagctgcaaaaaaagagacagaaagagcatgacgggatgtagctgcgctaacggatgaagtaagcgattttgccaaatcttctcgcgaaacacttaatcgtgcaataaaatctagagaaaaggctccttacgctaatagtattcgagaattatatcttaaaatgtccgattcaatttgggaaatcttcacaatcctggacaaaatcaatttggagtcagaaaaggcctacgtggcgtgagttcgagagatgtaaaacttttgaccaggcaacaaagctcgaggaacaatcgcaaaattcattaatggaagcccgaagattacatttcgagtcccggagggtgcagagccaaatgttaaattatgaaaataggctccaaacaattgtttgggagcatatgggtatataagaacaaaaaataatgatataacaaaatggaaaattgtgccataattgagacatattgtcataaagacttaaaatttggctttaaaaaacacaaaaccaagttttattttgtcaatccattttttgttaatgctgagcaaaattttaaactaatactcgcatcaatagtcgaaaaaatttataaaaatgaacaaggaaaattcaaaagcattctgaagctttcctttggttttgaatcattttattgccctcttagatgccctagcgaaaacacagccgaggctttgttccaacatgtcctattaaaagaagaattatattcgtttttctatcctttggatgatgtcataacactagaagtaactataatcccagatgtcgacaatagaccaagaaattaattttataaaaaacaaaattacaagaaattggaaaatcacaggaaagattgttaaacgttcacatttgttagcaatttttgcaaataaactttttaaacgggtgaaaaatttctacatagcggcatttagcgcgccagacattgaaaatttatatttttcattcttagaaatgcttgaaaaaattcaaaaattaccagggcttattatgcatgaatatataaaccaagccttagctatgcaaaaattagaaattggcctcaaagaaataaatatatttaaatgtcaagaagcagagaatatgtcagataccaattttaagaagatagatgaattccaaaaacaagtgaaaaattatcgatttgacataaaaatgaggtcggaaaaatacgattgacagctattaagcatttgtt

SEQ ID NO: 3698 - DNA, 3142 bp, Heterodera glycines
tcagaattacaatgcaaaaaagtgactatttaagaaactcaaaattttcattaccgatatataattttgccttcaaacattagtttatgctatttatttttgatttaacattttttcccattaagaaatgtcaatgcaacaaaatcaagggtccgatgttgttttgccaatgtgggcggtaccggattttgatgaaacggaccaaatgccgcagcggcaaaaacaaaaaaaatcccaacgttgaaggagtttcggcaccaatggaaggaacgaagacttctgtgggagagggaggaagcagaaaaaaacgaccccatcagttggaacgagcggacaaaggaatcgaagaaaatgttcgaggagagatgggcgaaatcggcagctgcgggtggcagcagcaacaacaaacaacaaacaatcgaacgatgcccaatatacttgggactgggaccaattgaaaaaacaagaaagagaaaaattggaaggcggggggttgtggtaaaataaaatgggcccctctccacctttctcaacatcccgtaccattgtgccaatttttgatgtgttaaataaaaataaataaatttaaattttttttgacttgtttgtgtttattgagttttggcgatttcggattttttggctatttttttttggatttttatgattttttgcgatttctgattttttttggttattttaggaatttttgcgaattctatttttggcattttttaccaatttatcattaatttttatgataagcagaatatgtatagtccttaacttaataataccatgatgggtggaattactaattagcaaattttgatcattatggaaattctgaacgatccttcaaatatatttaatatttttttcttaatgattttaaaattgaaattaagagtattttacctttataaattttttataggcataaggaatgtgtaattatgctcgtaaaaattttttggcaaagttctaatcatattttttcgaagaaatgaccaataaattttcctcaaattatttttattcaatgccgatattttttcaaaaaatttgaacaaatatcacaattatcgtcacatttggctcttaattttctcacaacttcctttttcattttgtctgactttgttgtggctcctctttcccgagattgagtcacacgtcgatgctgtgagggcttggcgagcattttcgcgttcctcaggtctttcgattcctagtcgtttatatgcccgtcgtacatgttcctgagtttgcttttgtattgcccacgtgcttttttgagaaggggcagaacgttccgatttgtcactatcgagttgctaaatgggagaagagtgttaccctgaaaattttatttgtatttatttatattacatccaaaagactcctcatcggggttgcttcgaccggaaattgctcctcttccgtgatttgaagcaacggactttcggaaatgtctgagaaagcactttgatggtatggcggttctttaaagaaaataagattacctattttgataatttaataagcaaagaacgaatttgtctaaaaaacagggtaataaccggaaaaattttggggtaataggattaataaaaagtttttcagttttttatttgggggtctggtgtattttatatgctccgccaaaaatttttttgagaattttaagcaaattttgaacttcaaaaacagaccatttttcctagaaaattatttaaaattatttttaaatgtcatgggaacttaaaatgaaacgagaaaattgaattcccctaggtccctcccccacatatgtaccaatgtgtgttgctgtaccacttgtaccgggcaacagatcgtcgtttacaggttgaaattgaaacatattcaatggcactggacgcaaaatctgttgttgttgttgagcttgtggagattgtgtttgttgtcgttcttgttgttgctgttgttgttgttgttgtgtttgttgatggtgttgtcgttgttgttgtggtggtggtgtttgtgtttgtcgttgttgatgatgttgttgttgttgttgttgtggtggtggtggtgtttgtgtttgtcgttgttgatgatgttgttgtggtggtggtgtttgtgtttgtcgttgttgatgagttgttgttgttgttgttgtggtggtggtgttgctgcgttcccagtgtcaacaatctcgaaaccttggcgcgtattgttcaacacaattgttctaaatataaattttatcttacggaacttataaaaaatagtaattaattacatttgccgggctcgagaaatgtccaacatgttatgaaccagcgccagagcataaattgttgccaggaggtttcccaacaaaaagcccgactaaattaagattaaaaatcaattgtttcttgcccattatttacatgttcccaaacgtcttcatcaaggaggaagacatttgccccacgcgttgtgatcacatttcttccaacttgcttgaaggtaattatataccatttgcgctcttccctacagacggcacattatttgatgtcgtacaaagaagcagacaacacttcgaaatttttttcggccgaatccgccttatcgaattctgtctgctcttcgtgctcatggcagcactaaatataaaataataagaatacaaaaccgcggataagcggtgtgataactccgcctttcggcaatgtaaagcggagaccgcctttcggcggtgaaatgcggggaccgcctgatcggcggtgtggagggggaccgcttatcagcggtgaaggaggtgaccgcctgatcggcggtgtggagggtgaccgcttatcagcggtgaaggaggtgaccgcctgatcggcggtgtggagggggaccgcttatcagcggtgaaggaggtgaccgcctgatcggcggtgtggagggtgaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaagaaggtgaccgcctgatcggcggtgtggaggggg

SEQ ID NO: 3699 - DNA, 2932 bp, Heterodera glycines
gcagctgtctgataggccgctaataaattttatggataagccatatttttgtttgttgtattttaggctttaatggaatgcaacggaaaatgagcacaatggaatgttttgaggatgaggaccaagaagtgcatttaatgttgggcgacgaatgtgcgaatgaaacaccgaaattagccaacggcacatacaattacccaagagtttgtccaaaatgataattatccttataatgaattaatagccgtgaaaaattggggtgggaagagaagtggtcgaaccgctggggtcactttggtggttaattgtccaaggctcttaaacgatgagtcattccatgccattgttagcgggtgctttgttgggtcaactaattacatccatactctcggccgtaatggaaaacaaattattgttaatttttaaaaattaatcataattttaaagagacgaccaaagccaccacggctgaccaaagatcagacattcaaagtgccaccacaaatgactttggatatgccatggtaagaaagaatgtttaatgaatggattgtttaaattattatctttttgactaaattttatgttaaccgaatcagaaatagaatattgaaacactgaaattttttatccttttaatgaatatttaatgaagaatattgaaaatttttttggtttcgaagttatgattaaaaacttagcaatttcgaataaatttaattttgccatcatttttaagtaaggatgaagtgcttcaactgtacgaagaactacaatcgtccggcgtgccacaaataatgagccgctttgaagaagttgtaggcaatctgtgccggtgggcaaacattttgcgaagaaaaaataaataaatttcattttagtgaaattgatcaaaaacgtgacgaaaatgaacggttacaacaccagcaaaaagcgtgagtttgttctctttttgtaattatgtgggtactgcaataatacaggaacaaattacggtattcctactgttttagtgaacgtgaaagctacaataagcggatggcagcattggaaaatgaaattgatcaacaattattgatagctgagaagaaagcacgggatgaagtcggtgatacccggcgatttggtctcgagcttttagagatactgagtctgactaattaacatgactaattgacgacctgttctcgaaaaaacattaaacttaaatgaaaatttccaaatttaaaggaacgtgaaaaattggccaaggaaaaagaggagctgaaagagcgattggagcgcgaaatgggcgacctgcaaacgaacattgaacacttgcaaaaaatggaaaaagtgctgaagaaagaggcacaaaagaacggcaatcaggaaaagttgaaggagaagctggaggcaagaaaaaatttagaggaaaaattaaaattaacaaagattgatagcgattttaggcacaaaaaatcgcaaaatatacactaaaaaggcagaaaaaatagcaaaataggcattaaataggtacaaaaatcctggatatgcactaaaataggcaaataaaaatttttattacagcttttaggtaccaaaacacataaaaacttaatcaaaaaaataataatttggttatatttaaattgtaaatgaaattattaaatattttaaaggttttttcgaataatgacaaatttttaaaccaaaaattttttatcatgaaaaaaaatattttagggaatcaatttttgggaaaatttcttcatttcttaggggtgtattttggtttttattgtatttttgttaaggacttttccgaaaatcctgaaaattggcacattgagcataaaaaaccgaaataggcaaaaataggcattataaaagtcatcgtagatgctcaaagccgagcggaaaacgcgcttttcatgcttatctgtgcgtatcaagtgcgcaaaattttaggcatttgcctaacatcgcatccctagtgataaattttaatttgtttgtttttgcgcaggaaattgcgcgagagaatcgcacactgaagaacaatttggcggagaatcacttggagatgacgctgatcaaagccgagttggcggagatcaaaagcgagtacgaaaatcggacactgctcatgcagttggagcagcagcaggagcagccgagcgcggccgaagcacaacaaatccaacggcagctgcaactgctttagtgagtcgcgcgacttggggccattttgcctgttgttacgctcgcgggggggggggggggggaagtgtataggcgatgccaggatgttaattcaaaaaacaatgaaaatgaaaattatgacaaaaaaggaaataattgttctactgagtaaccaaatcaaacaatttctttgtaacattcggtatccagggagttctcaattaattctgcaaaaatttcaatccgttaattccaaaattattatggccaaaacccttggaaattatttaggtgctaattttttaaaaaactaaatttttttctgacattttatccatataaagaaaaattaaagatatcgaatgatacaaagattatttattctgcactaattattaaattgtttgtgttctcatgtcgctccgccggcgccgagtgccttttttattcttatgtcttctgcttattttattcaattttttttcaatcagatgctaacttttcaatgctttttttaattaaatttcaaatttgagcgatgcaaacaaacgccttcatgacaccaatgacaaccttcgcggggcattggatcagcgcacaacggccatcaaacagatgaatatggtaaaaaaaagaagaatggtataatcagttgaattaaaattatttaatttttagggtaattttgtcaatttggcattaaaagtgattttgaatttcgatttcactttttccattaagctccacc

SEQ ID NO: 3700 - DNA, 4068 bp, Heterodera glycines
  misc_feature (55)..(55): n is a, c, g, or t
  misc_feature (3036)..(3036): n is a, c, g, or t
  misc_feature (3070)..(3070): n is a, c, g, or t
taaaaaaacgaaaatgcaccctcaaaagaataataatttcgaaaaccgttaaatntaatgtttttttgccaaattaaaactattttaaatgttatttgaaacgccggtatattttttgaattaatcacttaagaattttttaaatttttataccaaattttttcaattcttttccgtattttgttaatttgtccatattttttgggttttccttctatatttttaaatttttgtcagttaaatcagaatctcctttattgaaatggcattttgtcaatttgtttcaatttcacagactcaggctatccaccccggacgtacggcgcagggtcccgtgccgcgtcgtccgtttcggacaacgatttgttccggtgcgcgtccgcttccgtggacaccgcgtcgccgatgccaatgtctcttgagcaacaactgatgatggcaagacactttccgacggctgttgccagcaatggcatggtactaaatatgtcttttcacgacgaaaattacccaagaccgagacttaatgaccgagactaaaagattaaaactttcgcgaagtcttgattcgacaccgagacactcttgagccgaactcgtctttttttcaattattttatcgattctggtgcaattgtgcaattcttagaacattttggcattggctagtaccaatattcagtcttaatttggactgagactaaataagacaaacaaatagcaaactttttgcgagttttggcattaaattttgataaaataatatagaaaaagcttggctatcgaacaataccaagaatgtcaaattttgttgcttttaagcaaaattatgccatattttgtcaaaaaatagcttagatttttggacatttggattgttttatcgctaatgttttagactgcaattaacccttaatgaggtcattttttccaggtccttcaagagtattcgggaccgcccgaccgcacattccgtgtggtgatgtgcggggatgcagcagttggcaaatcgtcaatcattatgcgaattgtgaagggcattttccaatcaaacattgccagcacattgggtgataaaaaattaaatattttttcctaaatttaaatgtgaaaaaattcaggcgtcgattttcatgtcaaaagtgtacgggtgggagaacaaaacattgctgttcagctttggtcaattttttttcgtatttttttgaaaattaaaattaaattttagggacaccgcaggccaagagaggttgggaaaagaaaatcttttcaaatttgcaaaattttttaaacagatttcgcagtctgtgcaattcatatttccgtcgtgcggacggtgcaattttggtttatgactgttcaatcgaccgttcatttttgaggatacgtgattggattgagacagtgaaggtcctattggaggaatattttgactcgttcaataaatattaaagctatttaaaattatgaaattaaaaactatctttaataggggaatggtggtaattaatttggtgtatcttatttttcccgaaagtcacttgggctgaaacctacgaaaagcaaattgtgaaatgctgttgtcaactactactcgttttgaattcatattttacgaatttaagttctagaaaaatatgaacacaaatctagtcaaaaagaataaattaagcggaccaaataagttttaattttctttacaaatcaaatattttattagtcaaattaaaattgtttttaatgtcaggaatcgaccatgaaagaagtgccaattctgttggttggcaacaaagttgacttgcgcaactcgggcggtgatggcacgacgaaagatgagtcatcatcaacttttgtgtcaagaaaagagggcgaaaatctgtcggaggttaaattaaatttatattaaatttaaaacataattatttcaatattatattttttagacgctacgggagaataaaaatttttttaaagaattttattgcagctgttgggcactgatttcatcgagacaagcgcgttggatggcacaaatgtggagacggcacttctgttgcttgtcgggtgagcactccaaaaaaaggcctttggggatcaattaaaatggaatattatttttaaagctaaaaatcaaactgctgcttctgcttaaatataactaatcagttagttatttatttgtcttagaaaaggtaattttgagaattttaaacaccagcagtaataggcaaccggaatttgggtgcccaaaaattttcgtaaattcaaaaaagtatgttaaaatacgcattttgttgaatcttgataatcagtgatacgaatatttaagttctgtagcattagtattgtagtataaaagtaaaattctataaggagatcgttctgaattacgaaccccggaccagaattcgaacaaaaggtcgaaagtccaaaatttgaaattaacatttttggttaaaaatcactttaaatacatggaaacaaactgaaagccatcaatttttcaataagagataatttacgccgtttttgaactaaaaatgctaaattagaaaatttggactttctactttttgttcgaattcgggtccatgtttcgaaattggcaaaaatgataccgaattcgtgattagtgacctcgaaaacccaaggaacttatttttatgacattaaaattttcactgacgcatttctactgacgtattttccgggagccgaatgattccatattaattataggcacagtttgaaaatttgaatgtttggatgattgttttttaaggattaaattttcgggactgcgatttccctgattcttaggaccatttttaatggtactgatttgatcttaaggtcaattattttcagcgaaatgctcaaaacagaggatgatcagttgaaacagactgcaatgatgctgcaaaatggtggcaaatccaagaagagcaaatgcctgagttgtggcaactcatagatcagaagattatcaaccacagtgatcagcggcatcgatcggaaaatgaaactttgacttgngtcacttgaaaagattcagagatttctcccactnttttggtactaatttaaataatgctttataaatttaaattaccaattttccctgaatttcgtgattttaacttgtgttagacaggtccgggtacccgaccggctccagacccggaaaccggacccgaccttttgaaaatccaatactcgacccggtaggtccgggtccaaaaatacactgctaagaatgagggtctgggccagggctggacataactgattttcaattacggaaatccgtaattacggcgatttttaattacggaaacctaatccatcattagggagttccaaaaaggcgccgtatttcgcgtaatccttactcgtagcgattttagctaatatttatgaaaaaaattaggagtttttgggccgggcagtgcctcaaagtttagcatgatttgaaattttgctgtgcgcttttaatgactaaaattaggagatgggagtgattaagttcgtatttgaattaaatttgtgacttgtaaaaacttcgagaaaaagccatttggaaaaacgaacaatcaagtaatggaaatcatatgatatcagcaatcaagagattaataaattaatttcgaattatttaacttcgtctttagcagccgaccgttttgttccttcttttcccaatcactttgtttgcctttaagacattattgtttaagagtctcaattaaagttttttttaattgaatcgatgaaatcttttgaaattttgcaggctaattaatagccattatatcaaagtattttcatgtaaaatttcaagtcattttgacaactacgtaatgaacaaggaaataagaaattgaagcttcgtgaacttatgtgcctatttctgggaaccctacttatcacgaactgtcagccttattggctaacatggatttttcttattttatccacgtaatccattctatttccggcccctaatttaataaaacaaaataattaatggtaattttttttagtgctaatcttgccaaaaattattct

SEQ ID NO: 3701 - DNA, 1657 bp, Heterodera glycines
agcagggctgcaaaaaatatgcaaatgcatatttttttcctggcttctccatgctctaaatagcaggaaaaacacattcttttttgtgtttgcgtataaaaatcgggacttttatttacatatttttgcatatttcgaggtttttgtgcatattttgccattttcggtgtattttttcccgataattccgagaaatttattttaagttttccattgaaaaattgtttccggcggtgccgatgtgcgccgccggggaaagttttgaatttttagtgcaatgttttaacttatttagttcaaaaatgacaatattttacgcttttaattgttaaagttgcgattaaattctcatcggaaaaaggaataattttgaaaaattagaagaaaaatgaaccacttcaaggggaactgatccaacgaaaaaaagaagaacgtaacaaaaagcacaacccactagaccacgcatatgttaacgaaatgaacgaaaaatggcctaaatttataaaaatataagtttagcaaaatccaatcattaggggtgtaaaaaagtctcggtctcgagtctcgaaaaccgagaccgagactgaaaacccgagaccgagactcgagaccgagaccaaaaaaaccgagacttttctcgagtcgagactcgagaccgagagtctcgagcatcactagtcaacggtgagctcctgccgaaaatctcgagaaatttttgattgcaatagcaaaaacaaccgataaaatttatgaggaataaaattttttaattaatttgcacccctaagtttaaattttttgtgcatatttggtgcatatttcacgactttatttgcatatttatgcgcatatttttgccacttttcgtgcatattttttgcagccctgttaatcagcttttggcttttcggcaaaaaaaaatgccaattttcggagtatcataaaaatttttattaagaaaaaaatattaaatagcatttgcctaataataataataataataataatatgactaaaaggcctggaaaatttgttttatgaaaattttttggtgtcaattgtttttcggaacgatatattttattttacaaaaataatttcattaaaaaaataaataaatttttgacattttttaaaacaacgaaaaagctcaaacaaaagtgtacaatttgttaattgatttatttatttttaagcaaataaaatgcccatttcccactttatttgagtgtgaaatttgttcatttttgacggaaaatcgccaaatttaatggcaaaaaaaaaacgaaataaaattcattttaattttaatgcccatccccgagagtcgaagttttgccgagactccagactgagactcaaaaaaaaccccgagaaatttctcgactcggaagtttcgacagagaatcaatctcgagcagccctccccgccccagtgattacgtgtcgcgttcgcatgtcgccctcgccgtcccgcaacaagttgtaccagaacagcgcgtcatggatggtcggcgccacgcccgtctccaagtcggtgtacaccgtcagaccgcccttcttcggctgtgacatctgtgagagaggagagggcagagcaaattttgccaaaaaaaaacaatcagggttggtattagagaccggcgcgggacgggat

SEQ ID NO: 3702 - DNA, 1694 bp, Heterodera glycines
  misc_feature (22)..(23): n is a, c, g, or t
gaaaataatgaattgttatcannatatttatcatttatattaataacatatgtaatatttgtctacaatcacttaaggccaattaaaactttattggcttgaacaatgaaacctaattgcacattaattagagttcaataactaagtattactgtaatatttaaaaaaaaaattacttttcttttttgaacagattaaaacatttatttaaattgtccattgatttctttgagattcattcaaattaattattcaattattttttttttttttgccattttattgtaattacgttttgccctattcacgtgaaattttgatgttaaaattcatttaaattaattattcaattaattacaactaattctaattgcctattaattcgcgtccaattattaattatatattgtaatattgaaaatttatttttttaaactttaattatcctttatttcattgaaattcattcaaacaaatgattactcattaattaattattaatttattttttaattattttttgcccatttattaattattacattttgtgccactcacgtgaattcgtcgattaatgcgctcaattatcggatgctcatctcccttaagccatgccgatttgctgatgcgatacgaagcgaattccaatccgccggtgcgcgaattttgcactgtcgcgcgacggagctgaaaatttatttaaaaaaattttttttttggcaaaatgtcccaatttttcaatattttcctgaatctttgacaatattttgattgaatattcagttcttgcatttcgattcagggaacctttgcttaattgctcccctaattattaaattgtcgtcgatttgctgtgacggcattatctcaatggtacattttctgattatttggttgatctggctgatcggtattttatgtgcctatgtttaattgtttgatcagtccgtttgttgtctaatcattttttcaatgtttttttggcccaattaattaggttaattttataactgtccgttactccaattcttttttcaatcttttaagttttttctgtcccaattgatttgataaattgtctgatcagtccgtttgttatctgattctgatcagatcccgtcttacccgtggggtggccaattgtttgacaaccgcaatttcctcgtcactgatcacattgcggaacacaaccaccagcggttcataatgaacaatttcgactttgtgcggtgccaactttaggtagggctgtaaaagcaataattattttcattttttaagcggtagggattgatcagaagcccaggactgatcagtatccgcccgactgatcgcatagcattgtcctgatattcttccgatatctctttttgattatggtgctttttgcgtgtccaaatgagataaatgctcggtctgatcacttttctcttggcatcattgatcagttactgtgatattctcgactgctgtaatcagttttactcttttgccacaattcatagttgtccaatctcagaaattttcaaaattcgagtctcgaccatttcaactgatcagggcgggagtatttttcgctgatccatacgcccaccttgtcccgcttgaaataacagtagagtttggaagcatttgcaggcgaaatgtcgaactcacaggggcacaaacttcaaaaaaatgatcgaaaacgaaat

SEQ ID NO: 3703 - DNA, 2635 bp, Heterodera glycines
ccccccaccctactaattgccagggcattgtgttttgacgtcccaattttggcaccaccgcgccgcacccaccggcggcacgcggatggccgggcgccagccggaccagccacttggtcatggtcagtgcccgcttctggttgccctgctggtagagcgcgtaggccaagaactcgagaatgtccgcctcgagcgcggcggacgggtcgcggcggagcgcctcctgcatccactccaacgtgtagtagtagtccttgaaaaatagcagattatcattggaaaatcgcggggttcgagattctcgacccgggtaggacctaactgggtgagtcctaattaggcgcaattaatccgccgtaatgcgtgtaattaggggcgaaaaccagtactgaacatggatgatttcaattacggaaatctataatccatatgatccattgtagcgtgaaaacagataattgggtggtgggttttcgagactcttgacccggacaggacgtaactgagtgggccctgattaccttttggttgtaagcggctcgtccaatctcgaaacagtcgttggcattcagctccttggccacactttcaccatccacaaatccgttggccaggtcagtcgtcttcaacttgtaggtgtcctgtggaaattttaggctttctgatcagttaatcagtccatgaatgatcagtatatggaaagtccacttaattgttgatttgttgatcagtttgatcgtctaaaatcagatggtcgtaccaaaaccgatcacatgctttttcaaccgatttgaagcctttgatcaacaatgaactgatcagaaattcgaccgaccgacccgtttgtttaagtgttcggctggtccacaaaaaaactgattaaatcctccgatcagcactgatcagaaatgtcgatgcaccgttactattatttaaatgatcggccgacacccgtcccggcaaaaaaaagttttggtagataattagcgcgtcaatcaaattaacaaattaatttacctgtaagcggagcagtccctgtgccgctccgtccaggtcctcgtcatccgggtattttacctggaaaaaaatttgattttcaaatttttaaatctcggtttttcgatttctctaaccgcgttcgcctctctgacgccggtgatgtttttgatgaactgatcgcccgggttggcattcatcagctgcctgatccgttgccagtcgcgcgtcagccgcttgatcagcaaatacgcgttcaccgggttcatcaccgagtcctcctgtgtttatggtgggggaaatcgggatcagagtgatcaggatttggctaattaaaaaaaaattatgaaaatttggtgatgaattagggtccagcggttccaatatacttggtgtagcctgaaatttgatcaaccaaagtcagtgatccagatcaattttagggccaagaattttaggaaaaacccgaattttgcctgggccgattctttagcgttcgagagtcccttgatttagggtcgagatcagtgatcgaaaagggaaacgagtagaagagagcaaagatcgaaaatttgtgccaaaatctgtgtgatctagaaatggaataggccgtgagaaaccaatagttcagaatcccaagaccaatattagggacgatcgaaatgacttttggcacaatgccatgcctgccatacatctgcttcgccgggctccagctgcacactgtgctgttgcccgctggcgttgtgcctcgactccgtcaacgacttggcgtactgctcggcgaacctgcaattggccatgcttaggcttagactttagcggaaacaaaaatccaaaagacagagaaattttaaaacagagaccgagaattattgactaaaaaaaactgaaaaccaaaaagaaaaattctcaatttggaccgagaaaaaaccttgagaaccaaggtacaaaaaacccgagaaatttcgtgaatcgagaattgacaccgaaaattgacctaaaaccgagaaattttctcaatttagaatcgggaattagattgagaaattgtctcgagaatcgagacccaaaaaacccgagaaatttcttaatttgcccccctagaatttgtgggtctccaaatgttggcactcaaatttttgtcctggtttgaacccaagcttaatccttgcgtaaaattttaaaaatttcaaaatatatatatccccccactcgctgagctggacaagccgtgcccgctccgcctcaatgtactgctcgatgatgtcggaagtcgaggccgactcggaggccaacagattctccaagtcaaccatggcggtgaacacgtccgcaaccgccacacggagcaccgaagcggaagcaaaaagcagtagcatcatcagcagagaggacgggagaagcagtgatggcggcgccgccaactgcttgttgttattgacggaaaattgcattttttttttgaatttgcgcgtgcctctggcgttgtgcccacagtaattaatgttttttgtattgattttttgaattagcgcgcctttggcgttgtaccgcacaggcacttggcgttttatttttttctaaaaaattcacacaaattttataggctcaggataaatcttcgcactacataagt

SEQ ID NO: 3704 - DNA, 2394 bp, Heterodera glycines
ccccccccccccccaaccccccaaaaatatgaaaatccaatttttaattggatttttccgggaatttcccatcaaattttcggaatccctttgtccgagattagcataatcgcaattgacgatgcatttgtgtggcgttctctttctctctccggacaaattccaagcaaaaaaaaaacaaaaaataattccgcttttccccgacacaaattggtcgatcggttggttggactgattgattgcgtctattttactacaaataaatgttttatataattgaataagcgaatgattaatacgttttggcaaaaatttgcgggaaaatgtcatgctaataaatatttgaacaaaattttgctattcaacttaacagatgaggcattataaaatgattaaagaaaaattggatgtttgaaagaaaaattttaaattaacagtaaatgatgaaagaattaatgggtaagaaaattgcgccagaaattccgacgaacttttctgatcgaaaacataattatttgaacaattaattcagctgattaaatgtgctcagacatgaaaagattatccatctgatcagcttaacaacagttttaggaaattttaatggattattaattaatttaaaatttcaaaaaaaatgatcagtgcgagaaataaatcagatcagcagcagaattgtcctataacaattctattttgatcattgcagtttcctctgctaatgataattgaagctgatccattgtgatcagcaacagcagcagcataattgttgcacaattctctgatcagagaacaattagggaacccaaaaattgtttccgatcaatcgatcgcgctgatcaaatgataaggaagagaaaattgttaggtcgtgtaaatgttgttttatatgtgtgctgtgctctgcgctcactcatttcaccacgccttttcgacagagaaaatgagtgtgaataatgtgatcaatcacattcaattttctttttttgcccctgccgccgattggtggtggtggtgggtgacgttcgttgcgcaacgtgcatgtttataaggccccaaacgggaaaatttttctgataaatgatacctattaacacagattatcggcatgattagcaaaggaatgtgctgcaatttttaggcgcccataaaaatggtgatttgcgccgccaaagaatcggctgtgatcaccagcagcagttttgtctagggttttttcctgattttgtgattttggaaggagacagtcaatgtggcatttttaaaaaaagattaaggatttttgggtgttttttgaatttttgagaaaaacccataaaaattaactacagttttatattattagtaaatgtcatttcgaaattaaggaaaaagccactataattagccaaaataatgatcgaatgcaatcaattaggtaattgattccctgtgctctagcgatgttggcgaatctcggtgcctggtcatggcaaatttcggcgattcataactatatgccattgtcagaagttgtgggaatgttgtgggattgggcatcatttcataaaaatgccgaaaatgtcagggattcaagccacatattagggggcctcgggatgcgtgccccttcccaattaaaaacaaaacaaaccaaaattaatggctgccgaaaagcaaaatattttcattgcgaccaattaggcaattccttcggcaggggatagcacctagcgatgtgcaggaatatggatgccgagtctcggtaaatttttgtcaggcatttaatatattcggggtcgggatggcacaaaaaccaaaaattaatggcactgattgagaagcaaaatgtttttcgtgggtttgcgcaagcatcaaaagggccggcccgccgccacattattagcacaaacaatcaaattgaaccatttcttcttctacatacataacataataaaataatgatgatgatcggctcggttcggctcggcgtgtacacacaaagaagcgcagcaaacgcgaagcaatttaatgaggcatttttaaagaattgaggattttgcatgttaaatgaatgccgaatctcggcaaatgttcggcggtccgggcattgggcatttggtgaaatgccaaaaatatcagaggatttaagattcggggccaggatgccggccttcccaattaaaaagtttataaaataaaaattaatggcgctgattgagaagcaaaatgttttcgtgggtttgcgcaagcatcaaaagggcccgccgtcatatgcacatgaagcagcacaaacaatcaaattgaaccttttcttcttctacatacataacataataatgataatgatgatgatcggctcagcgtgtacacacaaagaagcgcagcaaacgcgaagaaatttgcattatt

SEQ ID NO: 3705 - DNA, 8492 bp, Heterodera glycines
agctttttgttaagaattgttaatatattttacactcccacatagtttttcgtttcgacattgggtgaaatacaattctttgtaaaattatttaatttatttatttacaaatttatttttcaatttctttctagtgctcatgccgccggtggtctatcgttgagcggagcattgaatgagcaacttcctccgccgccaccactgcgacatcgcgcgtctctcaaccagcaacagcaaccaaagcagcgcaaactttcggcggaccaacgccgacattcagcgttggtggacggcactggcactgacaaacagcagaaaaagcagaggcgccaaactcacgggtgccgggatgagcagcagccgttattgatcagcaacgggcccaaaacgggggcaaataagaaacggaagcacgtggtatgtggtcgaaattaattggtattttcgtgccgtttaaagtgtgtctgttaaagaggaattagtcaaatctgaaaacacggcaagataattagcttttgtcactaaccaaaattttaatttggcttttacatttgggaccaaaatgctattttgtcacgaagctgcccctttttgttaaaactgtacgtgaaactgtccctgtttccctttgccaaaacgttttatacattaacaacaatcgcaaatttgttccaggaaaaggcatcgcgcacgggaagcaacgcgtcgacgacaagtggcggtggtggcggaagcggtgccggtctttacaacggtgtacgaaaatcggcagcggctgttagttcggacgaggcggggaattgtgtgtcggaggacgatgacgtcgacagccatgaagatgagaacgaatgtgttgtaaatggcagcgacgacggaggctggatgaataatcacgtcgaagatggtcagcagcagcagcagcaacaacatgaggaagatgacggagaggcgtcgcagagccaaattcaatcgaagggtccgtcgtccgattacctgcccttctcctccgttcttcatcactgacaggaccgttcagcggtgtgcagcacctgtctataagaaaaacaacagcaaaacacagcatcatcaacgctccaatgtcgaagagtctcaccattttcaattgttttgttttcctttgttgtgcccttttgtgctccacttaaatttaaattattatataaatttttgttttacataaatagcattttgccataattactgtaggttgggtcacaaaattgcacattgtcagagctatttttgccatctccgcgaatacaaacaaaccatttatatacaaatgttttttgtgtgtcgtatctcacggtcggttggccgatatgtgtgcttttcggtgctattttctttttgttcccctccccccagaaaagtcatcgatttcttcattttgtttgtttttttgtcccgtcccaacgcccgtgctcacaaaatacaaatgtttattcaaatgctataatcctttatattttgtcttaaccatcgaaacctttgtgcaactaaatatccacctcacccatcaatcagaacaaattattctgcaaatttattttcacttttcccctttgtttgttacttttctgagtacgtataatgcacagtttgacgcattttaccggttgagataataatctggtaacgatcgagtgattgggccgattgcccctaattgtaagtcagtgtttagaaaaaagagcttactgcaccaatttgtatatttccttttttacagttcgcatccagaaatgcattttattacgaaaataaatgtgaaaaacaaaattttgattcgggccaaagataattagtataactgatgagggggagaggaagcaggaaaatgggagcaacccatgtgatgagatccattactcccccaataaaagagccccatgaattccgttttaattggccctgggctaataaatgatgtccatgacgacgcattttgtggattttaaaagtttaacataacataaaatggaacgatggtaaaatcatacaaaaaatattgagacaacaacagtgcggacgacaaaaaagaggaggacacaatttgtgtgaaaaaagaaaaacaaatcgaaaaatagaagagaacagatcgtttcgttgcaggtatccgtccgcgttgctgctttggttgagtccatcccgctgctcagaattgaggtgcaggccttaaaaacaatttcatatttggcaatcagcaacccaaccactaaactaaccagttgtaatccgttttcggctgtgcgccagccccaacgtcgccgcctccgtacgcaccataataagcggtcgaatagtcgcccgggtactgtccatattggtggtgttgtccggcggcggccatcgcaccaacgccgcccgacattccgcctgcagacgcaccactcggcggatagttgccactcgcgaatgctgccacctgttgttggacggcctacaaacggagggaaggggggacacaagcgtgagtgtgcatgataagtgggcctgaccagaaataaacaaaaagatggtatggggaatggccaaacgaagttgatcgaaatgggataaggacatcggtatccgagtcaaaaacataacacaaatgactccttttttgtatcttcctaattcgtggtagaacttctcccaacccatcaacaaacaaaaaaaggaaaggaggcggttggacgttcattttacgccttcccttcctccatctctcatctttcttcccaatgtccaaagcttgcctggtggtaggggctatagtcagttgaatagtcagagtgctgtgaaaagagaaaaaatggagcagataaataaacgaatgagcatggaataatgatggcaaatgtaaaaacaaagaacagacaaagaattaagtgactaatttattgtcggaatggattttcaatatgagagaaaacaaaattggatattagtccaaaaagaaaaaaatgaaatatgcgagttatttattgaacaaaaaatatttgacacggcaaacgtaacagacctgcgcgtattgttgcgctgcggatggcatcaccggcccaactgcggcaccgccacgccctccgccaccgccgcccttaccaccgatgctttcgtaagtgacatggggtggaatcttcgctgacagtgacgggaaaagctccacgtaactgaattgaacgaatccaaggtgaaagacatataatataggtaaaaaatgaaatcatataaaagaacgttgaagtcataattttataaaaatcgaaatgtgactcaatttcatcaaatttttaacgaattgacgaaatttttatcaataaactggacgaagacttgcctattcactaaattaattttttgaaaaatctcgtcttgcgaactgtagggtcgacccccactctctttttaacatttaattggtgggcgtaaatgcacatgtctctttaccggtttccgatgcattcccggtctttgctcattgcctggcgcgcatctgccggtgtttggaattcgacaattccgtctccgcttgaacgaccgtccggcattgtgccgacctataaattgaaattaaagcaaaaattcgacattcacacaatcactacctgaatatccacgcaaacgagcggagaaaagaaacgttcaatgtcattggctgtcagacggaaaggaattccgcgcatgtaaagctaaaattaatatttgaaattaaaatatatagacgcagcactagaatgaattaaaaaccggtaaatagttccttttttactttggtcggtccagcgttgggatttgcattgtatccacctccatagccgccgtatccgtcatcgtaaccaccgccacccatggctgcagcagcagcagcagcaccaccgccacgtccagcaccgtaaccgcctcctcccgcaccaccggcgccgccgggctgtcgcggagtgccgtacccgtagttgggatagctcgggtaaggcgagtatcggtgagaggccggaccaccacccccagctgaatggattaatgagatgatgctgtttggtgagttgattcaacacaaacctccataaccgcctcgtcccatcggacgcccgccagcggcacgctgttcataaccagtcctgacaaatagtagaaaatttgtagtttaatggaattgtgttaaaataaatggaaacttgcccatatgcagccggaccatatccataagaggcgtacgggtcgccggtcgcctgggctaacgccttcagcggaacaatgttgttggtggcacgcgctttgaacgcttcaaaggcggcaccgtcgctcttgaacaactccaaatatctgtagaaaaagggaaagcattaattcaaatagcatccttttaaagatgaattcgtataaaattttatttgtggaatttgtaaatttgttgggggttttcagttgtcgtttttttccaccgcccaaccctccgccatttcctcctgtccatcctctctttccatcccgaccctcccgcattccgtttgtccaatgcgtccaccaccaattttgcaccatttgcaaccccccatccattctttgccaccaccaccacctcctattccaacctcctcgtcatgtgcgagtgagtggggtggtcaaccaaagagacacacacactcctccatcaatggacatctcatctcatcaattgggatgggtcgcgtttggggggttcacgtcacatcatcaacaacagagaatgaatggttggcggaattttcgggttaataaatttttatatattttttgaaaattttaaattttgtgaacgatgaaatcaccgacaaacagtcggcaaacaccgtacctgttccccatgtgttggttgttttgttgcaaagcgcgttctgcctcgtcggcagtgctgaatctgacaaacccctcgcccgtaggtcgcccctctagccccggttccttcccgaacaccacctcttccacggtcagccctgacagtacaacaatggtcatttttcattgtcatgggaaggtttaacaattgtattactacaccaaacacattatgaataaatatataaatttaattctcatgtcgagttttttggaaatggtaataaaacgccatacaatttttgttgaatttgtatcgatatttcgaagttttccaagactaacaaaagccatgcgcgttactaccatccattaagtgaaaatcaacactaattaaattaacaagaaatatttaatgcattaaacaactccctcccggccatttgtccaccaaaaccattggcccgcccgcccgttgcgcgtgccattcattcatccacattgataaacggtttgtgaacagacctcggaaaaactgctgcacctggtccttgttacagttgtagggcaagccacgaatgcgcacaaagcctttgctggacagcgttttcttcatctgagttgtaaagtttcaatttttataagcaaatataccaaacttttctgggaattttcaaaatgtaaatccctaaatcccccagttctcaattccaacctgcatgcgtctcattaactggtccatctcaacgtcgcccacttggaaaactgaattgttttttgattattgtttcgtttattcattaagaaccccgaaatgttggcatgttttgagtatggctcaacaaaccttcgatgtaccgactgcccatcgtctgtcggtctttttgttgtgccacagccgtcgattctctgtctccaaactgcacatagcattccccggtcggcttcccgtccacgctgctggtgaaatgcacgtcgtaaaccgtgaattctgaatcaaatgaattacttcctacatctgaagaaaaccacaaagtgacaaacctccaaaaaatttgcgcacgtcattttcgttggccgaatatggcaacccgcggcatcgcaaaaagcaacttgcatcggtctgcggactttgcggctgttgcgtagaaacgggcattggcgcgttgacctgaaaattgtttgcattctcatgataaatttgtaaattctaaaaagtccgaagggaaaacctgtgtttgtttttgaaaagaattattatacaggttcaagaaattttatttgatggggcgatataatttagaaatgccaatttaaacaaaagaaggtcaaggcgtaaaactggcacaattgattgtgaaaaaatcgttaaacgatgatagagttcaacctgtggttgaactggcgtgaaattctgctgctgctcgccagggtccccgctgtcgtcggcaccgataaccacgggctttgcctcgacgacctcaccgccgtcggcagcttcagcgccattggcattgcccccgttcaccgccgaagtggcgccaacagtcgatgacgccaaaaagctaccatcagttccattcatcattgttttgtcttacaataagtcttgttggaataaaacttcaaaatttgagctgaaatagcaaaaaataatgaggaaaattaagcgcgagtctcgacgtctttctgtgataaagtaattctaaaaacacgaaaagaaggaaaagaatcgacagaatgtgagcatggccgaccagcgaaaggaaaaagcgaaagcttgagagaaaagagaacggaggaggcagaggcaaaggcaatgtccaaatttttaatcgattagcgatgtgcagaaatgtgctcgtggcgcttttcttttttgtttgatggcactgtctaactctttaaagtttttctctgattctcattaaaattaaacaaaatgaaagaaatttgctttaagaagggaatcgttgtaaaaaaaatatattagagtaaattttgttttttcacaaaaataaatttttaaaaatataatttttctgtgttttgcacgctaataacaaacccatagggctgttgaataataggggtcaatggcaacttgacaaaaggcaactcgtattttacaaagtagagtaaaagcttaagcctaggcccaagcaagcctaagcggcctagcttaaagcttaggcctaagcctaggcctaacctaagcaatttgcctttgttcaacattgtacgagttgtcatgacacagaataataacaaattaatttgatcacttctgacaatgagaaaggctatgaaattacgtcgcattcaaagtctctttttttgttgccctttctttcattttcggcttttcccttcccaaatttgcgcttccttttctttttaatctcttcctttccccggaagtctgtgaaacaaaaaagttcatcatcaccaccaccataactcgcgtcattttcttttttgttttatgcatggcgcgggacgcagtcgcagcacaaagcgcggcagatcgaatcgattgtgcggatgagtgaatgaattgaatggatgaatgaaagctgccaccagcagagaatccctcttccaattccatcctttcttttctgccactgtcaaataaattttcttaattttttttattaccctttgccatttcatccattttttttttttgccttttgtatcataatctctgctgattcttctcattgtctgaagaacaattcgttttttcaaccatcacccaaatttggcattttgatccaaaaaaatatatctaataattgctttgcatacaattttatgaggatatacctaataggagaaaaaggggatatcgatgatttgatgaatttgtcgaggaggcaaggtcggatttgtgttggcctttccggaacgcctatttgcttagcttatccccattagctcgattgttggaacagttgtaacatacaatatttttggcaacataaaatgccaaaaccaaatgatgaatcgtttgatttgcatttgtgccaaaatttactccatttcaaataatttctgcaaagcgagtgatcagtgtgatcaaagcgagaacacagaaatggtaaataaatggatacaatgaggaaaagagcagcgagaaaagtcagagacgggcagacaaagtcacgtcgggaatgggtgggcagagattgtcgagaatgacttgggccgtcgagatcaatcggagcagagaaacagcaaaggaatccgatcaaaaagcgttgtctaaacacatccatcactaatcactcaccggggcttttcgaccggagaacggcggcgggggacgacgaggcaaactgcggccggacggacggtgttgagccaacaaaacctcgctcccgcccccgtacgccatcagcagcaattaaaaagccttccttccatcgccgcgaggtttgtccgtcccatggggacaaatgaatgaatgaataaatgtgcgacgaccgcggcggggggcgggggaattcaatcgccacacatattctatggactccgccaaatcgcttgctgcgagcagcgagactcccgtcgcgcccgcttcatcccccacccctcatttgatccccccctttcatcccaattaatcccgccgattttttgctcccccccttttttttttg

SEQ ID NO: 3706 - DNA, 7344 bp, Heterodera glycines
catcttttctaagcaaatgcatcccaaccccccgagagtgcttgaagtgatccgacggctgggcgagtggagaggaagaccatgggacccaagacgtccgcctcaatgaatgaatggaatttggattttgataaaatttgttgttttaattttttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatggattttttttcatgtgcattattttggtgctagtaagatattgccgaatgaattaattggtttttctcttcattttaaaacatttcacgtccccatgccctgcccacttcccgcggaattgatcaaggaaataattgacgctctcccccctccaaaaacacatcggcttttgcgcgtaaattttgttttggcatactttgttaaatgtcggttttattccatgatgagaagattgtttcgcccagagcatatttcaataccaatggcccgaagaaccggaatttatttctttttcgatgtttgtactccccctatttattttccactctaccaataataacatttaaataaaattataattttttatttcttatttgattaatttcgatcaatattttttgataattaaacaaattgtatttttcaaaaaagacctttctcgcagtagcaactcatcggcttttttttactcccttcataaaatgtctcgcttttgccctatcgcccaaatcaaggaatcgggccggcttaacacaccaaaggggaaatttagtgagttccaaacctaccaaattaaataaaaaattttgataatcgttttaggtcttttttacgctctggaaaatgctcgaaactaccaatgcctgaggaagggtacgagaaagctgagaatcagagcaaaatcgcagtgaggtattttgaatggttggcgcaacgcaaaggggtgaaagttcgacatgcctgcaacggcggggaggttgaatttggcgggctgaaggtggactgtgtgattggggcagagaaaaaaataattgagtttcaggtaaaagaaaaaatattttctttttaaacaatacttaaggggtgtgcatttcacgggtgtccgagatgttttttaccttggacgatagcgccaaacggacggacaatggaagagaatcaaagtagaaccgaaattcgcatggaaattttgagggaaaagtgcaaaaatttttcaatcggagaagtttgggtagaataaaacatttagaaatatttattaattgttagttttaggagtgtgatgtcagagcggaattgaagaagaataaggagatgaaaaagttctttgaaagtgtgccggacaagggaccaatcaatccgagggatgcttatgccgggggaagaacgatgccattttgtttgtacgcaaaggctaccgaagaaattgagatatcaatgtttgatatcattagtttgtatccctttgttaattatggtaaaaatctgcttaatttttgttaaagtttcctttcgcttaagacactccataccccgttggagtcccgaaaattgtagtgagcaggaattttaatgtgaattggacagtgcccgacgatattccttatgatggactgctgaaagtgaaggtcgtccccccgaaaaatcttttgtaccccctcctccccgtgcacatcgatgatatgctcctcttccccaattgttgggcttgtgcaaaaagggccaagaatgagtttgtgatgacaaaagatgtaaagaaatgtaaccaccgtccagcgcagagagcatttttgggaacgttcacttcgattgaactacggaaggctttagagctgggatatcgggtcataggcttctatcgggcctatcattttgagcagtttgacagtcaactgttcaaaggatatgtgcggatgtttttgaagataaaggttgaggcgtcggggtggccggcggaggtgaagagtgaggaggaaaagagagcattcatcgcaatgtataaggcaaagtataacatcagtttggattatgataagattggactcaatcccgggttaagaatgattgcgaaattggtgagaaattattttaaaaaatcgaaaaattgtttaatttaagggattaaacagtttatggggcaaattttcgatgcgcaataccctttcaaatacggaaattgtgggcagcatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaaataaacaccaaaaatttagattctctagcttttgctcatcggaaggggcgctgtccgttggtggaggggaaatttttggggtaaaacataatttttgaaaaattttctataaacatttgtttagtgagatgactcgagagtatgctgacagcgaaattttggagtttgtgtccgcgggtccgaagcagtacgccttgaaacttagaagaaagaaggatggtgtgatttggcacaaaaccaaaatcagagggatgacattggatagacgaaacgaatttaaatatgatttgttcaaagagatggtgctggattacaagaaaggggtcaaaaaagtttttcactacccggagaagattgggccgacaaacgacttccgggttctctcaaaagatgtacaaaaagaatatacgccggtgcagaaaaaaggaattattgacgatcactttaatgttttgccctttggatattattaataatttttgttttgataattttgtctcatgtttataacatttaatattttaaattaatcaaatttgtttcttttttttagaatgtcaaagaaaaacttccaagaaacttcaaaagaaatccgccgctcgaaaaatacaaaaaattatttcaaaaacaatcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagatgagccgggctggaaaattgagaagatttcagtggacctttattgcagtgccctgtcagaccccgtgatcatccctgcccgccccttccaacaatcgaacccagacattgttttcaacgagttcatgcacaggcagcaatcatttggggaagtgaatttgttagaccagagaatttcaataattattgccacttattctttccctgttaaataaaattttttcatttttccctttcattattttttgttcattccattattatttattcgagtttttttctttattaatttttcagttaaaatgtactcgtttcaaaaatattttgaggaggctctcgaaaaagaagattttttctggcagaaaaacagagcagaagtggaggcattgttaattgaggcttcaaattataaaattataatacacagggactacgaaagccgctattctgattatattgccacctatcgccgcaccccactcttctgtttctgcatgattgagagaaatttaagatttttttacgacacaggaaccgggacgcccataggaagggttacaaccgtgctacatgttaccgttgaggcgagctatacaggagaggggttcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgtatagataggttgggacatagaaaaaacaatttaaaaaaatattttagagatttggtcggatcgtggtcattgttctatagactcccaccctcactttttgacacttcccgccgggtggttgcggagaataaactggaagaatttttaaaattaccatcattttttcgcatgcttttttataataaatattaaatgttcatgttgtttttaaagtgaaggttttgacccaagtatttaatcaattttaatttattatttttggtagaattccagaaaatgcaaacaatcgctgaaattaaaaatttcgagattattgaaggtggaagagtttttgttgtgagagcgagaattgagaatgtgatggaggcggagtacagggtttgtaataaaaatgaaaaaatatattagtttgtttaggcatgcactttatgccgtaaaggggcttgttcttgcggggttgagaaaaagatgacatcttatttgaaggtgtctgtggcagatgatacagggcttttggaaaatgtgggatttttcggtgtgcgtgggaagaaaaacggaatggtaatgttttaaagaaaaaataccattctaatttaaattcaggaggagttgagaggattgtctggggccgtgtgcactatgaaaatcggcgcgagggtgaaagaattcggagggaagaaggggatttattactctttgattgatattgtcagcctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggcgtatttagagacataattaggttagataacgaagcaaaagaattttctttttctgcacataataccatgattgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaaaacaatgcgcgaaaaccaaatacggtttgaaaggcaaagacctcttgaagaatttagggatgaatttattgcttataaaatttaagaaaaaaataaaaattcgagaaaaggaaactgcatgagaatcaaaggttgtgggacataaaccaaaaacaggtgaaaagggaaacaggtgaaaatagatgaaaaggaaacaggtaaaaacaggtgaaaataggtgaaatttcacctaaaaatatataggggcgtgcatttaatggggcatattagagaatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttctttacaatgacgcgccgacacaatcatcatcctgacactatattgattgaaatcgaagaggacataaaatatcataatttttctgcgggggcaaaatgctttttgggtggcaacaagaaatagttgatgatgctaagaaaaatccgagactccaaactgaatttagagatgaatttattgtttgtaaactataaataggatcaagaaaaaaataccaattaaataaaaatgaattctgaaaaatcagaaaaagctaattccatattattggaagctgcaaaaaaagagacagaaagagcatggcgggatgtagctgcgctaacggatgaagtaagcgattttgccaaatcttctcgcgaaacacttaatcgtggaataaaatctagagaaaaggctccttacgctaatggtattcgagaattatatcttaaaatgtccgattcaatttgggaaatcttcacaatcctggacaaaatcaatttggagtcagaaaaagccgaatctacgtggcgtgatttcgagagatacaaaacttttgaccaggcaacaaagctcgaggaacaatcgcaaaattcattaacggaagcccgaagattacatttcgagtcccggagggtgcagagccaaatgttaaattatgaaaataggctccaaacaattgtttgggagcatatgggtatataagaacaaaaaataatgatataccaaaatggaaaattgtgccataattgagacatatttccataaggacttaaaatttggctttaaaaaacacaaaaccaagttttattttgttaatccattttttgttaatgttgagcaaaaatttaaactaatactcacatcgttaatcgatgaaatttataaagaggaacagggaaaattcagaagcattttgaagctttcttttgggtttgaatcgttttattgccctcttagatgcctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagagagggcggtgcgcaatcgccatttaatttcacagagaattttaaatttatcttatatccaagaaaaatgactatctctt

SEQ ID NO: 3707 - DNA, 2368 bp, Heterodera glycines
  misc_feature (87)..(87): n is a, c, g, or t
  misc_feature (94)..(94): n is a, c, g, or t
  misc_feature (102)..(102): n is a, c, g, or t
  misc_feature (105)..(105): n is a, c, g, or t
  misc_feature (128)..(128): n is a, c, g, or t
  misc_feature (131)..(132): n is a, c, g, or t
  misc_feature (137)..(137): n is a, c, g, or t
  misc_feature (142)..(142): n is a, c, g, or t
  misc_feature (145)..(145): n is a, c, g, or t
  misc_feature (158)..(158): n is a, c, g, or t
  misc_feature (161)..(161): n is a, c, g, or t
  misc_feature (164)..(164): n is a, c, g, or t
  misc_feature (168)..(168): n is a, c, g, or t
  misc_feature (183)..(183): n is a, c, g, or t
ttgtggcatccggcgatttgggtcttcgccgacctacataagacaaaaagaaataaaattattttaaaaaaattccttttaaagggntttcttngatttgtnggnataaaattttttaaagatttttntgnnattgnaaatngtngatgtcacagagnatnagnagantctgatgaattgggncgtggcgagcgcattccgagaaggaaaaagtcagttttttgggaggaccaaaatgggatttaatcgggtgttcaatttatctgtttcgacagttcggcacttttttaaatgccgggcactgaatttgtaaaaaaattgatttttttttggcttttccgaaattgaggggccttctgtcccatatgaaatcaaaaatggattggtttttagaaattccgatacccgaaaaataagaatgtctttttttttaaaatgagtatcatttttttaataaattgcatttcaatttccaaaattttcacagcggcaaaatttcggcaaaactgaggttggaggacacatttccgagttttcaattttttttttttgaaattttttgcttaaattggcacagctaatgcgccaaaatcaatcaagtttttgtcatttttaaggcttatgctcggcttcgtcacgctcagttttttcttattcttcacctcctatgtgatgttggttgtgttttttacgttcgaaatgatcaatttcaaaagcaatttattataaaaaaaatgatttaattaacaaaaaaaaatgattgaatccaatatttgaagcatttttaggtttaaattttaatttttgtaaatttttccacttcaatctctctgcaagatgccatttttatgttttgcaaatattaattccatcggcttaaaaaattcataaaccgtgaaaaattttggcttcgaatttactaattttttggatttcagcactttctatgcctagatcaaagctaggtttattttgtaaaatctcgagttttgtttaataaaaatttattttctgcaatttcacaacatttttaaaaattttgtgcaaatttcacaaaaattttttaaaaacataaaaatgacatggttttcttcgttttatgtattattgtcaattttcgagcatctttattgtattattacaattattgcacaaatatgtatgtatcaaatttttgatttaaaaaataatttttttttttaaatttcttagtgattaaaaaggcacggtgaaatttaaaaaaataaaaatttcggatttatttttgatcacacattgctgggctttcgactgttcacctcaacaatgttcacatcatttgtgtttaatggagttgccaacttaaaacataaataattaggtacaataaaatgtaaaaataaatgtaaaatatcatatatttaattccggaaaatatttcaaagttaattagggtaacgaaattcatataatctatacatttttaatagtcatgaggaaattttaaaaaaacttttaaataaaaaaagaaaaaatgaatttgaaatttaaaattttaaaaggtttctttatttaaataaaaacagaaaaatatttttcaactcgctaatttcaggtctaaattttttttataaaatctaaaaatggtattttcaaaaaaatggaatttaaaataatttttgaaagaatttttcaaatttttggtgtgtccaacctcaaattgaattcgaatttttcaaaaaaaaagcccgcctgtgcatcagcatcattctcgtcgttgttcactaccaacaccgttgtgcttgtgctggttgtcatgggcgtcttctcctcgtcatgagcaggtcgtccatttggcggtggttcatcagcagcaagttcaacaactgcttgcggttgttgttgttgtccatgttgtacggcaggtgttgcagcagcgtcagtttgaacaacattttgcacaacatccgcaacaatttggccaactgaacacggtaatgaccattattaaattaattcacaaaatctgattttaaaaaatttatgcgatttttaattaagcaaattataattattaattaattaatttacactcatgaccgaattaattgttttaaaaaatgcgttgaaccctagtgattggaaatgttgcgggcttaatgctgttctaggggtcaacaagttggtagaatggaattttgtactattcttaaatttaaatttaaattttttctcaaaaaatcagaaaaaaaattattatttttttcaattagacataaacttgaaattgttttatgtttttcttaaaaaaacattcttattttttgagaaaaaattctaacataaatttgaatttaaattatacgagagtccatttgtacgaactgtc

SEQ ID NO: 3708 - DNA, 1794 bp, Heterodera glycines
catttgacagatttctcggctttccctgactgatcagtccttcctttttcgagtcgctctgattttccccactgatctgacattgactgatcaccatctcctcttccggaacatctgctgaagcacccgttttgtcttccaaaacttgatcaatgctttcccatctctcctctctggcagcttttcccgtttgctccgttttgccattttcttccccaccactttttggcacttctccgccatcagtttggctttgtgccgaatgttcctcattctcatggatcagcaaaccaacggcttgaacttcaagcagtacatcctttgtgccagcaacacattcttccaccagctgattaattgttggaacttcttgtacagcttcaacttccgctttccccgtttcttgaacatcgatggcactttcttcgcttttcaatgcatcattagcaaattcaggtacagcttcaacttcgtgtacatttgcttgagggctcggaatggtatcagcaaatggttcagttactgattcgcttcgattttccagggcatttttttggcattttggcacttcgtcttcaccggtttggctttccatggcattttcttcgcattttagcacaacgacattgcattttggcacatcttcttcaactggttcagctacagtttgacttccttctacggcatttgctttgctttccagcggcacttcctccccctttccttggccactcgtcccattttcttggcattttgccaatttttcttgttgttcctgtcgttctacttcccgtcgcacatagtcacttccatccaaactggtgcgcacaccgagtggcacaggctcagacggatgtgttggctcagcagtggaagcaatctggcacaaaaaaaacatatatgtaaagccaaataattaggagagaagagattatagagatgtgccaattttaaaattcttaaagaaaatgaccgacttttcaaggacgtccttgagaaggagtaccatgaaataaggaaggtttattttagaacgaggaaagtttgttttcagggacacccttgataaataagcctttttctgagccaaatacgaagataagacattatggggggatgtgccggtttcaaaatccttatagaatgaatgactattttctcaagtacgtccttgagaatgacccaaaatgaggaaatttttgtttttcaaggattccttgataaaataaggcactaatttccattaaatttcgaaggattttccacctgtcaaatttggtcgaacccacctcgtcctggataatctgcgtcgattgtcgggtggctttggcacgattcaaattatatgagtgcttttgacccatttttatgaaaaattgagcaaaaatctaaaaataaaattaaaaagcaaattttgagggaattttttaaaaagattcaataaaaatagaaattcctcccacaaatcaaaaaatatattggtgagcaccattcattcatttggtgaattgacaaaagaacagccaaaattgaagctaatttttcggcggacaaaccttccacccgccgccggatttatgagcttagcaatggaaaattaattgaacacatttacattgttattacaggtcactctgatcactgatcgctggtcaccgatcatatatattaccgtatatcgtggaataaaatcctccccccccaaaaaattggaacttcccctcccccctaattttgaaagaaagccctccaccatttgagtggggagggggggggggggggtgaaaaacaaaa

SEQ ID NO: 3709 - DNA, 2365 bp, Heterodera glycines
ttcgaaatattgggttttcgggtttcaattgtaataaccaaaattaaagcgttgtttggtgtgtaaacatcgtataaaaattaaaatattatttaccttttttagtgcttgtccgaggctttttgtgcctatttaatgcctatttgctattcttttctgctttttaggtgcctgtttttattgaaattctttgttttttaattgagaatttgtgttttttttaaagttttcctcaatttttaatgcaattttcattttttataaaaaatattcactgaataattaataagtaatttttattacggcattttatttatttattttgtaaatatttttgcaagtgaatttgctatattcaaactgccagcaaaaaattgcaaaaacaataaaaccatcacactgatcatttctcccaatatattttccatcaactgttgaatccttcattgatcatagctgtttttttcatgttttccgctgtccgtcggctcctatttaccgtagcctgaatggtaggtgatccgctgcatcggcatacatactgtggcatcagagcaggtcaccgtgaacacggttggtccttccctcccaatcttgttggttcatttccccgtccgtggcccaatttgttgccctgcctcagcctccttgccattaatcgggccatgtcggcatcggcacacgcactccctccgcctccccccgcgcccacgggctcgaccatagccatttttcgttgattattcgcaacggacccggcccttttggcaatggacccgaggtccctaggatgtggagatggcactggcacatctgctgttgactgaccacctaccatgcccgtcgcgacagaaacccggaaggggacatggcggaagcggtggtcgaccacgctgctgctcattgtcattgtcgtcgtcgtcctgcgcctgttgctgctgcctttgtttgccagaaggaagtgcatagattggcactgagtatgaccgcctaatgtgccatattttatacgtataagcaaatgccatttttgggggaaatgccatgccaaatgttagcagggggggggggctcaatttagggaatatggtatcataaactttgatcagttctgtattttgatagtccttgtaagcgttgggatcagtctgccattcttagtcaaaaaaaaaataatagtttcccacttacagataattaagtgtttggttcaagttaatcagtgaaggatcagatttggtctccgctaatcagtgctgttttcggtctgataatttctttgatttttccgctgatgaatgacagagataaatttggtcccggccactgcttgatttgtaatgccaaatcattctcaaagtttggtaatttccattttaaaacttgtgattttttgatcattcatctttctgatcactgatcagaaagcattaatggtaccaaaaaacaaagctaaccaaaaaaaaaacaaaatggcaaacaaaaagttttttagagcaaaacaattataatcattttgttaaaacggaattttgtcagcacaggcagcacaagcagcagcatctcgtgaatgctaaaatattaataattcccaaaattggggcccctcaaaaattccgaagaatttattggcgaggggcaaaaaaatgaaagaaataaatgaatgttcgttcgttcgtccaatttgtgtgtgtatgcaatttcattttcaaatttttctgggcggggcgataagaaagaattaatgcggcggcggcgggtaaaaatatttgtgtgtacacacaaacacataaaaatataaattctaaaacaaaacagccccggaggggcagaaaaattgatggaatgaatgaatggcctggccaacgacgaccgacgaccgaacacatcatcatcatcatcattaacacatccatccatcgctaaaaaggggggcgacgacaaatcgtcggtcggtgggtcgcttcagggagaataatcatcggccgtggatgatggaattattaattatttatttttgtcccatttttttttgggtgaataattgggccctccggcggccccattcgatgtgaagaaacaaaaaaaaggacaggacaggacagaaaaaatgatgatgcttaatgctaataatgatgcttattgaaattgcattgttcttttgttttttgtgtgaatttttgtgcaaagccaaatctaatccaagcggcatttttgatttagtgatcagaaaggataaacaatcaacaagaatgaatgtgatcagagcaatcagtctatgcacatacatacttactgatcgagagtgttagaaatatctctgaagacttttaggtatgggttagattaggagtttaaggtagag

SEQ ID NO: 3710 - DNA, 1381 bp, Heterodera glycines
gtcccggtcccggttaagcccaaaattcccggtcccgctgcactctagttttaggaccaaccgatatctcatcagggtttcaattttcggccaacagatctcgaaaactaagaccaaatttttcaaattcccgaaacactatgaattgcatggatatgagttggtgttcccctctcaagagatccgtatctcaagaactattcgtcattcttgaccccaatgagtgtatgtctatgtctcggtctcaaatctcgagaaaaatcgttgccaaattccccgctttggcggcatccccgattccccgcttttttttctatttaaagtgtggcggggtatggaaaacagacagcacagatgagaagcgattacataaattttgttgtggggggggggggggggtgttttttgtgaaaaattcttttcaaccaacatctgctgctttctgcgtttgggggcgggcggtggtcgtcgccgccggcggccgacgacggacgttttcccccgcggcgctcttccgtcttttcatcgtccgtctgtcgccccgccccgtccgtccgtcgtccaatctgtcgtcgtcgtcgttcgctgagaaaatggaaattgcgcttttttggcgccccaacaaaaaaaaaagtgtcggcgacaaaattcgcccccccccaaccctccggcgatgaataatggggaggtgatgatgaaatatatgtgtgaatggtatttgatttttgtgtgtgtgtatgtgtacacattgtacaacacatatataaagtgtttacgggccattgacacgaccgacaaaatgttccgttccgttgccgcggggcgaaggttaaaagttgaacgatgggttggggggggggggacggcaaattgtgagcaaattttgaattttgaaattgcagagcaaattttaaattttttaaaaattagattggatttaaagttatgtttgcaatcttgacttttaaatttgcattttgaattttaacttttaatgaaattttatttttattttttaattacgaacaaattttaattataaagttgaattttgaaattgtgagcaaatttcaaattttcaaaatgcagagttttggatttaaaatttttttcataaaaatgttgaaatttgataaatttgtgaattttttaagttatatattgttcgagggttgtggagtttttcgatacgctcggataattgagccccccccccccccgacgagagtctagaatgagcccaaaaatcacaaattgagctcaaagattttcaagtttcattaaaaaaaaaaacttttaatataataaaatgtttatttgactttattctttcaaaaacgtattaattttaattaaaaaaaatatatttgcgtttcgaaat

SEQ ID NO: 3711 - DNA, 1354 bp, Heterodera glycines
  misc_feature (31)..(31): n is a, c, g, or t
  misc_feature (39)..(39): n is a, c, g, or t
  misc_feature (141)..(141): n is a, c, g, or t
cattttcgggatcggcatcgccgaaaacacncctagganagtggttttacgacttttataaactataaaaatttatttaaaaaaggtgtggcaccatctaaactattacataggcaaggaatagggcagaaaaaaaatccntaaacatgtaactaaattggtaaaaaaagttcatccgtataagataatcattactaggcttataaattatatggaccaaaaaagcccgaaatatggactaaaaagctcaaaaatggccaaatatggactaaaaactgccaacatgtatcttttaaacttcaaaaaattcagaaaaatgttttatactcaatatttgcttaaacaacttaaaaatacgctaaaaattgccaaaaaatggatttaaacttaaaaaatgccaatttttattaaactctagcttcacaattgcaaatcaaataggtacatctcaaaatttttgtaagaatttcattctgttgtcagcgaatcatttcggaagtggacaaaaaatttaaaaaaaattccgaactttcgaaaaaattctctttttaggggtgtattttttaaaaatttccagaaaagtcgacttagaggtgtatttttcgctttttttttgcatttttcttgcgaaactttgccaaaaatggccgaaatatggactaaaaatgcaaaaatggcgaaatatggatttatttccgaaaacccccaaaatatggatttatttggactaaaaactttcactaaatcaaaaaattttaacgtagaaatgctatttttgagcccctttcttcatagcatatgcgcagaaaaaatttgttaacccatataatttataaccctaatcattcattactgacgcatttggcggtttgaaaaattttgagtattttttcctaatttaccattctaaaattttaacatttcactgaaaacaaaaattcaaattctaacatggttgcaataaaaatttgtacaatttatgaaaatttgttttcattataaaatgattttcaaaatggtcggcctaggttccctgggcggctctaattgaaagaaaaattttaaaagttacaactaaattggtcatgttaagacatttgcagccaaaggaacgctaaaaattatcattttttaaaatttaattacactaaataattaattaatttaaccaaacccgtaatgacggactagggatttccgtagttgagaaaatcgtcataattacggatttcggcgctacttgcaaagcgtggcgttttgaaaatttttttacttttttttgtctatttttttttttgtttattttgacgaaaaatgtgtttttttaaaacaaaatgtccacttagaaaagaca

SEQ ID NO: 3712 - DNA, 1383 bp, Heterodera glycines
ttttgagcttagaaagtcggaaatttactcctgaaatttttcccagcgctacattaccttttggaaagtcggaaattttttcatttgtccacgatgtcaaaatggtatcaatttaatgatatgtctgctctccttatttttcttttgatgacttttgagcttaggaaagtcggaaatttactcctgaaaattttcccagcgctacattaacctttgcctccacgatgtcaaaatggtatcaatttaatgatatgtctgctctccttatttttcttttgatgacttttgagcttaggaaagtcggaaatttactcctgaaaattttcccagcgctacattaacctttgcctccacgatgtcaaaatggtatcaatttaatgatatgtctgctctccttatttttcttttgatgacttttgagcttaggaaagtcggaaatttactcctgaaaattttcccagcgctacattaacctttgcctccacgatgtcaaaatggtatcaatttaatgatatgtctgctctccttatttttcttttgatgacttttgagcttaggaaagtcggaaatttactcctgaaaattttcccagcgctacattaacctttgcctccacgatgtcaaaatggtatcaatttaatgatatgtctgctctccttatttttcttttgatgacttttgagcttaggaaagtcggaaatttactcctgaaaattttcccagcgctacattaacctttgcctccacgatgtcaaaatggtatcaatttaatgatatgtctgctctccttatttttcttttgatgacttttgagcttaggaaagtcggaaatttactcctgaaaattttcccagcgctacattaacctttgcctccacgatgtcaaaatggtatcaatttaatgatatgtctgctctccttatttttcttttgatgacttttgagcttaggaaagtcggaaatttactcctgaaaattttcccagcgctacattaacctttgcctccacgatgtcaaaatggtatcaatttaatgatatgtctgctctccttatttttcttttgatgacttttgagcttaggaaagtcggaaatttactcctgaaaattttcccagcgctacattaacctttgcctccacgatgtcaaaatggtatcaatttaatgatatgtctgctctccttatttttcttttgatgacttttgagcttaggaaagtcggaaatttactcctggaaattttcccagcgctacattaacctttgccctcacgatgtcaaaatggtatcaatttaatgatatgtctgctctccttattttcttttgatgacttttgagcttaggaagtcgggaatttactcccctgaaatttcccagcgctaca

SEQ ID NO: 3713 - DNA, 1494 bp, Heterodera glycines
cggggacctctagagtcctcagcggagcggagagtcggcctttgtttatgtgtctcaacggcgaaaacatagtgcaacaagacgtaagtatataatttatttacaagagaatcaacatttgttcaattaggtgggcaatgatcggagttttgtggcgaatgatggccaatttatgacggatcgaaggtatccgatcagagacggcgcccaatggacaattatctcgaccgatacaatccaataccgtttctttgaggcactaaggccagttcagaatgaggtgcattgtcacggttgaatgtgggccaaccaaatgccgttaaggttgctcctgtgccaattgtcagttcgctggacatgcactcgactgacccgacttcgtcttccggcgcttacgttgagcttaatgggcacgacttctaccccaatttgcaggcttggctcggctccactcccatgcccacgacatttgtgtttgttttgaacactaagagtcatcactttgttaaattctcggttccctttgctttgcagcaacaaagagatgctccgtttcactctcctccctctcagtcagctgaatttgcaggagggcgtcgattatgtgttgggtgcccgctgctctcttctgtccgtcccctgcccgctcagttcgccctcccattctccgacaacggcctcgtctcccccattccttcacttcctcaatggcacaacaacagtttcttatgacagtgatcaggaattggagtttccgttgtcattggttcgcgatgacggagtcatttacgccactcagctgagtgtgtcttacacgagaccacgggaacaacagttcaggacgggaattcaaggaacacaaccgaacagctagccggggaggacctttatttggttggatgttccgttctgttttctatccattgttattctcaatccatttgtcttaagttttcttccttatttattacagcatttacacttgcatagtttcataaatgtcattctaaatctattcaataattattttcaactaatgataatatatggtgtcgattacttctgtgtctgtcattgtttatccgttatcttgtctgaaaacacgaataaatctcgttgtcgcatttcccatttttttaattatcgcgttcaaatcagttttatgattactttatttatcgaatttacactaaataaaataattcgtttttttttgctgttaaagacaatgttggagaatgggcccgacgaggattggggctgtgtaggcccggacgaattgttcgtaaattcggggccgactccgtcactcctttctttggcagcgcgagtcgaaagtcggcatcgtctgctcaacataagcaaattgaacttagagttgggacaaatcgtggacaaaaaggaagaacggacaaatgaggaggaaaggacgataagaaacgaatgggagggagcaaatggaaagaattgcgccacaacggacgacggacacaa

SEQ ID NO: 3714 - DNA, 1763 bp, Heterodera glycines
  misc_feature (1711)..(1711): n is a, c, g, or t
ataagaaacgaatggggagggagcaaatgggaaagaattcgtgccacaacggacgacggacacaaaatgccaaaggaggggccgaaaatggcaacagcacggggagcgaagaatttgaagcaattagcctttgaggttgttattgaaaatgagaaatgagggaaggaaggctgttctgttcaggttgaaagatttgttgcggccaatttgactgatgcgaatgagcggcagtcggcggagcagcgaatggttgttgccttaggcgcgaaacccccacgacggaaggcgatcaattaccggacattaaaggaacagagaacggaagcgaagaggaaaacaatggagggggaagacggacaacagccggaaaaggacttgtggaggatggtcaaagaaggaaaagtgcgaaagagagagggcggaaggaagaggaagaacggaagcggagtgctgaagaaatggaagaaagaaaagcaaaaaatgagtggaagaaaaaaggacaaaaaaatgaatgcgtgttaaacacagttgaattacctatcctttgttttgtatttgtgaaataaagtttcatgaattatttcggttcaccttttcaaatttattttaaaaatctatttgatctttttactataaaataaaaagatttaaacttgaaaaatgacaacaggtccgttacaaattaatgagctagccaattgcgaaggtaaagatcgttttcgaaacccgttccaaatgtatctgctgagttgagaaagaaagtcacgaacaaacacatccttggggttgaggctgaagcgttggagtatttgccgaatgtaatgggaatgggcaaatcggcaaaagtctcggcggagagatgtgcgccgttttgccgaccaaacactggcacatttcctcaacaaattcatacgaccgttaagcgcccttttgatggtgttgcaaatgaagcgaaaatggtcggatgagcgaagggcggaggacggaaaagaaatggacggacgacgctgacgataacgacaatagtcgacggtcaactgaagaaagtgtaacccatcaaaagatcaaagggaaaaacatacactcaaagtccgacgatggatcgccagtccacaccattgcaatttgtcctttgatttcattggtttaattctgtcactttggcattgtaattggaatgatgtgttcactttcccaaagtaaagaccaaattttggcatctcagacatcaaattatcaatcaactaaacccagcaaataatgtaaatttacaacggtatttgaccttttcaactcgttcccttttgttggatatgattagataatcgtccatgtaacgacagcaaaacagggtaatagcgcaatttgtcagccccatttccggcgaatgaaggcaaatttgtcgctcgacccaacccaaatacaaattgcacaaggcaaccgaaagtgagctcccctggccaattcctcttccactgacaaataatcgttgtcgtaagggccggttttgtgcagaggaagttaatgcgcagaatggttctctaaaattaaaagataaaccagtttgcaaaaatggaaattaaattaaaaccaataaattcaaattcacctgattagggtacgcatggcaaattgagtgatcattttgagaaattcgacactgcttatttcgcttttgaatggagaattgaattcctcgcttcctttacanatgatgcgtgaaaatgcgtcgtcatagctaagcccggcttctgtcttcgttt

SEQ ID NO: 3715 - DNA, 3451 bp, Heterodera glycines
ttacaaatgatgcgtgaaaatgcgtcgtcatagctaagcctctatagtgtcttcgtttttcgatatttgtatattttgctgttcacttgaacactgacaactacaaacttgctgaaaattgcggtttatcagaaaaattgatttattaaatggaatgtgaatcaaaataataattgttggggttttacctgtcagagggtgtgattttgtgcaaaatttcgtccaacactttgtgttcaaatgaggtataacaattgttaagatcagctgtacagaaatgcattcgttgtcccttttgtggtccacgtgtattttggagagataaacgacggaaagcgaaggcaaagagtcgcaaatcttatgaaaatttaaatattttattactgaattgaaaattaaatcacttgaaatgccccattcagaaagaagcgagcaccgaccaataagaaaacgcagaacggcatgaatcgcgttgagtttatttttgagccttgcatttctcaaaataacaatcggacgaacgctgcattttttgggcaaaaaactttaaaaaggggaaattgaaaaatacgaaatttaaatgagaaagaacattagcttgtggatttgaccatctaaatcaggaagagcatcagttgccaataaaaatcgcaatttcctttcggcacgaagcagatcaaaactttgtgaacaaatgcgacgccaaacatctcttcgaaaatggacaatttggccagcataattgagagtcgaatagaaaaaggacatgaaattgggaagggattattttattgggttctattaaaaaaagtacgtaaaaatgcgagtaaagagatttaggaaggatttgagaatattaagcacgatggactgcttcagttgaaaatggagtcctttcagccaaagaatctgatcaaatcgaatgccttttaaaatttgggtacgtgacatcaaaaaaccgcgatttctaaattattactataaatcatcagagaaatgtgtatggaaccaacctcaaatcaatgaaagtcgtagcgatgttttcacaaaacatttttacattggaatgatcgagaagttcagcattaaaaaaaagagaaagtttagtgacaaaagcgtgaagttgtcgtctttccaacgggttgcctaaagaaacgtaaatgaatgtcagttattttctaaatattgggaataaaaaacaccgtctaaaaacatttatagcttacaattaacaataagcacacacttatcagataggcacatttttgtcctttatgtgccgggatgtgatcattcaaaacacgacgaaagcgaatgcggccaatttttggcatcaaaaagcgtaatttgacgtgaacatcgtccaaaacccgtgcatccacctggccaagcacatggatacactggggggagaacagctcctcgagcaataaatgggtgtcgttgcgtctcgaaagctaaaaggtggaggctataactgtaaaattaaatacgtttctgaatccccacccattgtgaccctccttctccgtataacattggtcccttgggtctgttaacgatttccgttactttctttacgtcccaaaatttatcatccgtgttaagagtgaacagcaactttaaatggtcttcgttaatagaggttctcttttgcctacgatattttttcctgacaaaagaacataaaacaattttattgaaagtgtacaaataccggtgtctcctccgtttctctccccttcgttctttggtcccttcgctcatcatttttatagaccaaagaaaaacattctttgctagtttaaaaataaattttcaaaatcgaattttctttgagcacacagattaagcagtataatttagttaataggaacaggtcgacaaatatacaaatctgaatgctctttttatacctccaaatatgcgatgcgaaccgaataacaaaacacccctggctaaacaaagttggaaccatgaacaatagtataagaaaagagatgaaggagcaagtcgaccaagggaacaaagaggatgatagggcataatatattggtacgaatatggacgaactcgtatcgaacacttttgaggtacagacatgaagtaagaagtggaaatattcagccgtttgatacgagttaaaaatggaaaaataccaaatgatttgaagagagggaaatgattgatggggacaactcaatcagaaggtatggtcgaaagtgtttcaatggaaatggaaaacttgcggacatacaacttttgtcattccacagggctgactcctctgatgcgccgtctttcattgtctctcggccaaataacggcgccccgcctcagactgacggacacttaaaaacacagtcaaaaattggaccttatgctaccaaaccacctttgttgtagcaaaaactgagccaattggatttgatgtggcgatccggtgattgtgatgatacgctcatccgttccgaagacatccgactgcgtgtcaatttcaatgcgtgcgccggactcgtttcgaattcgattaatacactcgccgcgttttccaatgattgtcccactcaatttgctcggaatggtcaccttaaaatactttattaacacgttttggaaaaaactctggattgaaaaacatacctgtgttgtggtcatttgctctccacctggccctggataacccatcggtggcggtcccccatgatggtgaggaggcggtccgcccggtccgaaaccggcatacccaacaccaggttgatgaggcgcatttggtggtccgtggtgcggtgggtagtcgaaatgaggaggaggcattggtggaggtggtccaccttccattggcaataataaagcatcaatgaaggcactcacccatcgattgtccttcaaaaccaccataagcgtggcacatgtgtgggttgtaattgtgtgggtcgtaaggctggtgcggtcctttgaagggaatttctttgacaaaatcgacgagttgtttgacggcgcagggcaattttgacggatcgccagtgatcactgaggaaaaaattaaacgaagaaaaaacacgaaaaaactaacggcaaactcggtcgctagaaactggacaacattcttggaaaaccttaaagcggcattgcgtttgctcgcgaaactctttgattttgcttccatttcggccaataatagcaccagcgtgagactgatggacaagcactttgatgtcaatctcacctcgactggctttctcacccttaaaaatttaatattttaataatattaaataggtattttggcaatagtaccgatggtggcccccttttacgaaaaacaaaatttttaaaatttttttcgataaaaattatataaggggttttaaggattgaagaatccgaatctgacattaatttcgacctaagtcgaaaccggaacccgaattcgagcaaaaagtcgaaa

SEQ ID NO: 3716 - DNA, 2180 bp, Heterodera glycines
  misc_feature (57)..(57): n is a, c, g, or t
  misc_feature (2165)..(2165): n is a, c, g, or t
ttctcgaaaaaaaatcaaaaattttgttttcgaaaaaggggggctaccatcgggtantataccggtattttcaatgatccttttgctgtacctctgataatttgccgagaatatcggtgaagcattcttctattgattcaagagagcaaacgatggtcaggacacttaaaataacagggaattaggattatttgtaaagagcctttccacaaaatttaaattgtatccaagccaagagaaatgatttcgccattagccgaccaacccggggccaaatgaacgaaaaataattttgcctacataataaaatgcgtccgatttattcaaaataaggagggaaggattaccgctcgggagtgctcctatcgggaacattgatgttggcatcgtactgaaaacggaagggtcagtcaatgaagaagagccatttggtagtggagggtgctgattgaccagccgttggttcgaattctttgttttttctcttccattttaccaagaaacttaatgtctctcgacagaagagtaaaggaacgtgatttaaaagtgatgggaccaccctagccaaaaggatgggcgggtcaacaggatggaacaacactttgctttatctcatttttaagatatttcaaacctaaaaaggcattgaaaatcgtcaattatgatcatttaatagaataatattttttcctttatattttcaaaagcattgtcaagcaaaccttagatcgcaatgatttgatgaattctccaccacgtccgatcacagcaccagctgatcgactcggaataaacagacggagttcgaattttcccgctgccaatgcatcttggtaagcttcaccagcatcatgcggaccgcgaaagcgtttccccgcaccattcatatggccaccgcctccatgcatttgcatgccgttgttttcttggttaaactgtcgtttcatagcatcaaactggctaaaattcatgtcacgtagttgaagcgcttgtcaataaaatactgcccaatatcgatgatcaatacaaatctaaaaacatcgctccaaagaaatgaaaatatataacgcttattgtattcttttccacaattagagagagtatttacttagtggggggattaaattttttctgtgcccatatcgccaagttgggcatcgcccagttggctcctagttgactcccatttcctatttaggatctgtatgggtacgctccaatgtgcatgagaaagcccggtactatctctccgtttttttttttgtatttttctctctttggcgtactatctgtaacgttttcatagaaaaaagaatttggaaaataaaaataggaaaaataaaaacccaaatataaaaagtttacaaaagttgacccaaaagccacacaagattgggctaggatttgcattggtccggatagatttgatcagtgatccagaaaacgagtaaatataatttcataacctttaacacagaaaacctgatatgctgcccactaattccgatttattcaaaataactattgactcttctcttgaccttcatttcttcaagggtaaacgacagaaaatatgttcaactttcggcaaccaattcgaagtcattgagccggctacgggtacagtcgtgacacaatgtccaagtgcggatgattctttagttgatatgtcagttgcaattaatataaaagttccgagaagattgtttatttaaatgatatttttagagttgtgaatcaagcggacaaagcacagctccaatggtcgtcattgagcccattggaaaggtcgaaggtcctcttgagaactgcagatttaatcagagtaatattaacatacaatggtattttacatcaattcatggttaaatagttaaggccaatttggagacactcgcctcttgcgagacgcgcaccaacggcaaaccaattgttgaagcccgcgtcgacattgagtccagtgcagacacatttgcattttatggtgggattttgccagcagaatttaaaggtgtgtacaaattactgtagtggaaaatttactgggttgaataattcaaattacaggcgatttttacgatattccatcagatgggaaagggaatcgctttgcctacacacggtaagggcatattctttttaccccctatttttgggtaatattncacaaaatgcatagt

SEQ ID NO: 3717 - DNA, 3562 bp, Heterodera glycines
  misc_feature (3551)..(3552): n is a, c, g, or t
  misc_feature (3554)..(3554): n is a, c, g, or t
gtcaatggattggactcataaaagtcgattggactcataaagtgcattagagccaaacgggttgtgtatacaattttttttctttgcgccatttaaattcgttgtcgagtagggctctatatttggatgattcttataattgaagtaaaattttttcaaaaatggggtaaacaaactcaactagttccatttatttaacccaaatccatgtctagacgcgaaccgttcggtgtcgtcggttgtatcggtgcttggaactatcccttccaagtgatttcttcggtttctgtaacatctactataaaactcgttcagacttgctgttggaaagtcgcgccggcgttagcttccggcaacgccgttgtgtacaagccgagtccattcgcgcctggcagtcccgttttacttggcgaattacttaaagcggctgggcttcctgatggagtttacaatgtcttacaggtcattattttatttttaaaggcactttaaataaatattggcaatatttagggagaagccgagaccgggcagcttatctgtttgcatgagaaagttgctcgagtttcattcactggctcagtgtctaccgggcgaaaaatccaacaaatgtgctcccaacgcggcatcaaacctgttggtcattttgccaaaacaaagaaaaatttacattatgtcaggtcacccttgaactcggtggaaaatcagcatttattgtctttgaagacgcggatttgaaagatgcagtagcttcagccattttggcgaatttctgtaaccaaggcatgttcccttactcatcatctatcagtgaaattgaatttttatatatttttaaaaccgaatattttatattctcaaataatatttcgtccaattaaggcgaagtttgtacaaatgctactcgtgtgtttgtccaggaatccgttcttaatttgttcaaaacaaatttgctggctgaattgaaatcaaaaatccgaattggaaacccattggatgacacaacaaatgttggagcgacaattaacgagcaccatttggagaaagtgattcaatttgtagaacgtgccaaagaccaggtaatttaaactgtttaaagggtttaatcactaacttttcctataatttcatggtgcaactgtgctgtttggtggtcggcaagtgtttccatccggcgttgaaaaaggcttctatttcgagcccgctgtgctcaccgatttggacgatgagatggaaattgtgaaagaagaaatattcggggctgtgatgttgattttgccgttcaaaactgaacaagaagcgattgcacgagcaaatgccacacaattcggattggcgtcgggattatgcaccacgtgagaggggtttaataataaatattgatgagattaggtcgtaaacaattaaaggacatcgtttgatttttagctattatgaatagtaagtttatgtagattttgtttggattggagatgcataattatttaaaatgttttcattgtacccttccttaggcacaaattaaaaatcgtcactctgatgtcctaattaccacttattttttaaatattatccgatttattctcttgttggtcaaatcactaaaaaaatctttggtttacttttagtttaattgggccttattgcaaaacgacaaataagcttttgctaacaaaaaataaaagtttctaaaaatatttatttacaagtaatgaaaatttaaattttggttttattgcattttaattccaattttttaaggaatttagcacgagctcatcgcgttgctgctcaattgaaagttggcactgtttttgtcaacacttacaatgatgctgaggtaacaattttgaataattaattgcgaacgattgggtttactgttttgttgtaagatggtcgtttaaggtgcacatcccattcggcggcttcaaaaattctggtcacggacgcgaaaactgtgttgaatgtttacacgaatattcacaagtgaaatcggtgtacgtgaacatcgacgaaggattgcaacacaatttgggatgaaggaagcggagagagaaaaatgcaatagaaagagctcaaatacaaatagaatatttttaaaattttttcacatgccttattttactaactaataaagagattaactaactttctagaaaaaattaattgaaaagcaaaaaaggttgtttacatggctggaggacctcgtaaatttcggtccccaccacttactattttataacctaatcagtgcttggaaatttcgatgctttatgtaaaatgttttaggtattttgtttgagttgcgtcgcagtgtgtgcttgtgatgactgcctttgaggagttgggcgttttgtccgaattggcaacggcactcaatgatttggaatggacgtccgtctctcccttttctttcctacttaattttcatagctttcagcttgcctactgacattcaatccgaagcgatccccgccattctcgggggtggcgacgcttgcatggtccgtccgtccgtttctttctctcttttgttttgattgaatcggtgtatttaaggcggcggagacgggcagtgggaagacgggcgccttttgcattccggtggctccgtccactaattcctttttcgttaattttgcttttcgttgaatcattttcagattttgcaaattgtcttcgagacaatgcttccgtcaaaccccaaacggagtggtgctgtcgaaggtcaatcgacgggcggtgaccatgtcgataatgatgagcaacgtttgctttaagacaacggttggcgcatgaacatctttgaccgtgaccacaatttgggcatcgacgccagcggatttgtttgtgagagtaaccatcccaaattgtggagcggctcgcgttcagtgcgtggagttaagggatcgggtcagtattcttgttcatttatatgagggataggattttaagtcacgaaaaatccaaaaagtcaactaaaaaataataaaaatgcaaaaaaaaaatgaaaaattgacccaaagttaaaaaaataccatttttaaacaattgttgaatagcccacattcttttttctcaggcaaatattattacgaggcgaccattgaaagtgacggactttgtcggatgggttggtcaacagcgcgggcaaatctcaatttgggtttctataataacaaagttcgtgaaaacgaagatcattttcaaggaacggatgaccagggctggggatttggaggcaccggcaaaaaaagtcacgcgggtcaattcgaagactacggacaaagtttcacgttgggcgacaccatcggctgctttttggacctcgaaatgggcagaattcactttgctaaaaatggcattgacttcccagtggcttttgccctaaagcaacaacagattcagcaagggcttttccctgccgttgtgataaaggtgaacagacggacggcaactagccccccccccccgactaattttttcagtaaattccggtggggaacttttacataattaacgttttgtaagtgtactttcagacctgnncnaggcatgc

SEQ ID NO: 3718 - DNA, 1969 bp, Heterodera glycines
  misc_feature (1955)..(1955): n is a, c, g, or t
agataaagcctgttcattcaaaaaaaataataagaagcttctgcaaatctgaaaatgtttgtttgaaatttggcattttaaattaattacgcattgccaaatttggcaataaaaatttacactcgggcgcattggtgatcaattcagtgtccccgctcttaacaatatgtgcccgaatttctgcgagatgcgtgcgaaatttgccaatgccataattttcggaagcctcttcagtgaggttgtgccacgccatgcgcaataagaactcgttgggaacacggaaattgagtgagagcactaaatggtatgataatatgccattaggatgaggaaaatttgtccccaggtcctacggcatttggcctttgaataacatgggctgtgaagtgaaaaagccgggaatctgagaccaatcccggacggtatcccaaccacatataccgtatgttctcgaattatcgacctggggggattatttttcaactttttcattttcaaaaggggggggggagtaattggatacgaggcgttaattagagaatatacggtaagcaaattatgatgtgaatcgaaatgtaagtgaaacttacgtgtcatgagacagtacaaaataagcctacggtgatgtgccactttcgccaaaaaagtgcccaatttgccatccaacgcttcgacctaaatttatttcattaaataattattattttttatattttaatcaccaaattgcaaaacattttcagccatttgccctgtttttccaggacaaatccatcaaaaatggcagaaacccttttattagcccaatggcatttgaaaggcaaaaaatgaattaactcaaaaagtaattcgggtggaaaatattttcgtttaattagtttcattttaaaaataaaaaaagtaatatttggttatttattaatgtgaggaaggcgggcatttttatcaccaaataaataaaagtgccaaatttatccgttgataaacttttttagtgataaatgttgatcaaaggacgtaccgcacattcaaattttgtcaaacatggagtaaagacaaatgcacaaattaaataataaattgccaaaaataatattctggcaaactttaattagaaaaatgcttatatttttaatttttaatgtcctttttatttacaaagttcaaaaaatgtgctgatcaattaattgtcttttagtcgtttgagaatatttcagtggtgtgatacggcggtagttaattaataattttgcattcgactaattacattttccattgcgcgagctgtttgctgatcattttttaattacttgttttacacaaatcaagttttggtcactttgaatttgctataaattgaaagaaaatggcgccgacaaactcattaaacttattatttttattaattaacaatggtcacgttttcccgtattcaaaatggccaattttgggtaaaactctgagaataaatgtttcaaactgtacaaataatggaataaaaacctcaattaggaaaatacacacttctttttacgcaaaaaattatatttttaatcagcaatttgtctttgttattttttttagaaattttcaataaacgagcaattaaaataattaattaatttttataaaatgcgaattttccttttgctttgcttattgtcgcctctttgtcttattattttgctgtgaagatggagaaacgagctgtggtgatggtgaggcaatttaatggtaaaatatttttttattatttaaatttaaattcgattttagacactttttttgcttatttgttttttgaacagaaattcgattttcggcattttttagagtccttatttttaaggacggccttattcaaattagactataaaacaagggcttctgttttttttagtgtgtctttatcagagtgaatcggttgcccattgaatttaataattaattaattntgacagcctcttga

SEQ ID NO: 3719 - DNA, 1766 bp, Heterodera glycines
aaacaaatatgattttttaattttctggttaatattattttttgttctttttgaaacgaaaaatattttttatttaacgcaattttttttaaattcaaaccaattatttttctccaaaaattttcactgtttacattcatttttttttctgctgatcacttcactttctacatattattcctacccattcattctctcaacacacttttgcaatgttttcccccgatttggatcacaattatccgatcggattaccctcccctcctcctgatcagtcggtgttaatgaggtcgtattgtcactcggatcgccactcattcattcatcgggaatgaacaaataaataattggaggtggccccaaaatgagtgatcacaagtgtcgatcgacacagaccggaatttataccggaacaattattgcgggatcgctataaaaagagcagttgatgaatgggtaatgcaacagaataaaacccaaacattcagatgaacctgagtaagctgatcaaaaattgatcaatcaaactgatcattttgaaataatactgttgatggccaagtgattagactgtataacacactgattaatgcaaattatcagtcaaagtgatcagcttgaaacattacataaaatggccaagtgatgtgatcaacttgatcatttcaaacaatactagctcactgatcagactcagactcgtttaatgatattaggcaataaaattgcatttattctttttataagttacaaaaactttttcattttttgaaaaaaatcataaatattaacagatcattcattgtccgtttaaagtaattcctgctttcattgatcactcgtaaattcagatcagcccaaatcactgaataatcctcactttcgatctccaaaatggcagcatctttttcatcatcaaccttatcttactcaattataaactgtttgttgctcgctttatccatttttctattcctttcaatgactcatccgatcagcgctcagccggccgcggttaattggccacgaatttttttaaaataaaattttcccatttctttagtggccttccaccagttactcgccctatttccaaagcttgttcagtgttgcaaattcgccggtggcagcgttgccatccggtgccggagcgcaaggttatttttttatgacaaatttgaatttgttggcattttgtctttgtgcccatttcagcgccggccatcccaatcactggcggcgccgcggccggtcccatggcctacggtggaggcattgtgtgaacagtgaagacgacaaacaattgcagaaaaataaaaacattgatcagagtgatcggaattttagtttttcttgtaaattgatgcatcgataaaatttatcagagtgataaaaaattatccaatcattaaaacggcatcttggctctatttaaggtggaccgcccatttgctaataacttttttcattattaaccaattaaatattgggctctagtgcactttatgagtccaatcgattgacaatcccgagtttttttacaataactttgtttatgttcgagctaaacctatctttttggtatcattcgaaagcacaaagtctaattaatgtaataatacgagaaaacaagagaattctaacatttcaagaaagtttatttatttatttcgtaaaaataaaaaagtcatcagaagaagggccaggggcgtatctagagaaaattttcggggggggggggggacccgacctgaagaccttttttt

SEQ ID NO: 3720 - DNA, 4457 bp, Heterodera glycines
aatcagatcatttttcgtaattgcctaaacgttgagattttatatattttagcttcgttagacttcgtactttcgaatgctaccaaaaagataggagttgttcaaacatgaacaaagttattgtataaagtcaattgattggactcataaagtgcactagagccattaatattttgaaaatatctttataggtagctcacaacattctctattagcatgcaaaattacaaaaaaattttgtggtgtttataaaaaaaaagttatgaccaaaaacctcaaaaattgactttttcatggctttttcgtcgcggttgacataacttcttttaccttgtgcatgatttatttctttttcacatattagagctttcaaatgatgccagatttgctaactttaactgacaaagaaaaaagtcagaataatacaaagttggcggcgccaaaacagttccacgccgccgaactaatcccgaccttacttaagtggaagaatgatgaatagggcgaggattcttaggtttttacttattttttctgcggctttaactcgacgagaaatgcacgaaaaacaccttttttgttcggaaaaccttcgttttaacgcccctatccgaccctagaaatccctattttggatgttcgcccctaaaaatccctattttgagtgttcgcccctaaaataagtttttacccctattttggcgttttctccaaaatttattaacaaaaatgcaataaaaacgaaaaatacaccccaaagaatcgaccaaaaaattttcagaaaaatataccccaaagaatcgatccaaaaaatttcgaaaaatataccctaagaatcaatccaaaaaatttcgaaaaaatatacccctaagaatcgacactaaaatgaaaaaactttctaaaatatatcttatttgtaactgcaatcagtgaataaaattgtttgccttaattttaacttatttacatagagaaaacagcaatttaaaaaattgcacccctaaatttgaaactttttcgcccctatttttgcccctatttcgcgaattttttgcccctatttaggtccctaaattggaatttttcgcccctaaaaatcctcgccctaatgatgaagaagagcaaaattggcataattttcagggcgcccggaaaatgcgtcagtggaaattttattgccataaaactaagttccttaggtttttgaggtaggtcactgaccacgaaacagatatccatttcggcctattccggacccgaattcaaacaaaaagtcaaaagtccaaattctcgaattttggttcaaaaatagcatataggctctctttcttatcaaaggattgatgggtttcagtttatttccgtacactaatttcgaaaattttgactttcgactttttgttcgaattcgggtttggggttataatcagggctgccagattaaaattttctaaagcctcattcggcaagcaaaaaagcctcattttgggtcaaaaagcctcatttttacaaaatttattcaaaacacgcttaaaattttatatttttgactgtccatgatcaatttgagcaattttttgttagaaataagcatttgggaaattttgagcacgaaaaaccgaagttgattttttgcggcacttttttcaaaaaatttcggggaataaggggccggtggtgccgataggggccgccgggggagaaatttagaattttgaccatatctttagcagtttttcattaaaaaaattctttattttgcgatttttctcaaaaaaccacaaaaagcctcaaaatttctcaaaaaaccacaaaaagcctcaaagcctcattttgaaaatttagcctcattgacctaccaaaaaaccacaaaatgaggctaaagcctcacatctggcagccctggttataatgaatgaaagaaaatgggggaggagggagagcttttgtagtcgcgaaaaatttggaaaatgcaaaagcgtacaaatgaaccaataaaaattagtataaaagtggttgctcctcctcctccacctttcattattattttccattcgccatttatttttttttcgactttttctcctgacaattccttcaaaaatgattctgtacttttttgtattttttctctacatcaaaatttttgctaagtaaaaattccaattttaatttgaattttgtttcctttttttcagttttatctccggcgactgttggctttgtgtgttcaatttgctctctccgcgtcagcttggctttggaattgcgatgatcagtcaccgatttgacttttacgtcgatgaacacttcaaaactcgcaaatggacattgggacttattcgaatttggagcaaaattggagagaatggcacgaagaaaatgaaaattgtcaatggctatggaaaacgaatgccaattccgcaaattcaaatgccacggaaagtcatcggattcaattacatttccatctagtaaaattggcgattatacaaatttcagcaaatttcccattcatttttagttacatcgaccaaaatgccatcgcttttctccgccattttcaccaacttttcgccacctgtccaattaatttggccatcgaaactgaaaatgaccgcattttggtgttcattttgcgcaacatttggccaatgatcggaaaaaacattcatttcatggaattgtccgccggaatttttcatcgttttcgacaatttgtcccgtcaattctcaacgattgtccatcacttcgctttgtctgtttcaattttcacaatctcttcgccgaatttccatgcgatgacaatgccatggcatccgatggacaagcggtggcaaaatggctgttcactccgcttcaaaacgatgtgccgaagatgtacaaatgctggttgaaaaatgatgattcgagttggtcgtcgaagattgaagcattcaaagcggtgatttttatttgattgatttaaaatggtcttctcctaagcaacaagtgtcacagctatcatttcttaatctaatttttccatgttttaggcttttgccaatgcttcatctcccgtcaatttcattgtcaccatttggttttcttttgcttcctccgttgtgccctttgatctgaccaacgaattaactcgagaacaattgacgttgaaaagaactgactacagcaatcgttttctgctaatccgttgtccaatttcgcgagacgcgagcaaatgggcaaaatgggaaaaggaagcgattgactggagaatttgcggtcaatgtaacagaattgagattcaaatttatgttgagcgtcaaattggcgacgggtaagcgaatgctttttcaaaaaattcaaatttaattcgtttaaattcttttaggcttctcgacgcaactcctggcacaagtgatcggcagcagaagtgaatgaatgaattgttgagaaatgatcgatcaatttgaattatatagttattgtcgtgatcataaaattgttcttttttgttggaatgttcaattttgtttttcttctttaatccttagagctttaaaaaatgccaaattcgtaacaaaattcgtttttgaaaaataaaatgatcatttttgggaagcagctgaacgacggcgctttccttcaaatactaagaataccaaacccattcaggaatacctgatatacatcgtaattgtcctattttgtctgttaggccaattgtccaattttttctggatagaacagtcgcgcaatttatgtgtaggcaaatcgtccaattttttctgggtatgccaaatggtccagttttgcggattcttcctggcctgctcattcatttttcgatgaatacgtcttcgttttctctgctgatcatcattatttttcgattccttgaccaattgtccctttttgttttggtcaatccaaacaccttacccattctgatcatttccatttttctccttctgatcagtggttattttcctgttatcattgacccttttttgttgttcactgtgaccctttttcttctgatcgttggcgattacagtatttttccaaattcacttcaaaagatgtgccgtgaaagtctggtaaatttattggattaaattaaaaaaatatattaagttccccagaatgttttatatctttttgcacttggcaaaaatttttttcttttatttgtgccgatgaaatttgcctaaacccaactcattaaaagccccagagattagataagagcctatagaactccttctttttttgtagacagtcattcgttacaataattttcacatccaaaaatgtttttggcccccaaaaaagtgcccattgaattggtctttgatctgagcagtttcattaaatttgatcgaaaatggtcgagaaaatgccgagtttgctttttatttgaccaatatttgttggcacaaaaccgatattggctgaagctgatcaaaaaattggt

SEQ ID NO: 3721 - DNA, 730 bp, Heterodera glycines
taaatccctaatttttttcttaaatagttggctcaaaaccgcaaaatttactcattttttggacattgtcggtttgcattgccccggaccccttcacaagaatttggttgacccccccccccccccccgctttttcatgtatgaccccgagagtcttgaatagcattattattcaatagaatttatccatataatcaaagtatttatttttgattttttgtttgaccacagttttgatgactacataccgtaacgtggttggacttactgaatgagaagcacagaaaatggcgaagagtggtggatggaaagaagcttttttgagagttttaatcattgcaaaatttttactttaaattcaaaaaagtccaaaatttgtgattttaggaaactttaaaaaaaaataattttaaggattgacacaatttgaattttcgaccttttgttcgaattcgggtccgggattcggcattggtcaaaatagatgccggatccatgatcagcgacccaaaaaacccttggaaacacattttcatgacttataaatgcaaaaaatattttttttcaaaaatggggggggggggacaaactagagtattaccgaaaattgtgccaattttcattaattttttttattccctcttctgattttgttggtccacaacaaaggttggtatatgaccagcagaggacttacaaacatatttggattaattttggtttggttgct

SEQ ID NO: 3722 - DNA, 3059 bp, Heterodera glycines
aaaaaaggataggagccgaccggagttgaaccggtgacctattgatctgcagtcaattgctctgccactgagctacgactccgttgaattagagattctcattttcctccttctttctttaaaaagctcctctaaagaaaaactggattttatggttaaagtggacgaagaaagcagaaaagggaacgatttccttctaatatgcaacttatttgttagctgagaaaaataatgaattatttattatattaaaaagacataaaataaataaaattaacgataaaaaaagaaaaatcaaatgggtggaataaaacaataaaatattttttatttatattttatttaattaatattaatatttatgtagttatttccgaatatgtaaataaataaatttatttattttttcttttatgcaaattaccagcataatttttgcgttttctttgcaatatctacagaaatcttttatgaaaataaaattttctcccattttttttatcaaaaaatattgtataatttaattatttttttgccatataattttaattatcctttccctcctcccccaaggcacgccaatcggctttcatcgaagtgcttagtcatgtgccgtcccagccctcgtccgatcaaacggtgccggatcgtccccgggctgttttggcaccgggcaaagatcgccccaactttcacattgaattgcgctcccaagagctgtttgtggggcagccgcttcgtctggagacaaaactgacgccgatcagcgacccgtcaatgaaagtcgctttctttctgaacggaacacccgtccaatcgagtgggtgtcgactgatcagtgatttagtacagatcaaccaagaaagatctttttcaggtgaccgtgtgcaagtcttataccaaaacggatttgcattgctttcaatcgccgaagtcactgaacaggatgccggctactacgtttgtcaagccgaaaacgaaattggcagtgccgaaacatccgccactgtggtggtcgtgccacggacgggcgacggcaagtttttggccgaaagcgaagtgtacgagcacgacgtggaagacatgcgcgagttgcaggtaaagaattgcaattgtgaaattaaaacaaatttaaatcgagcaattaaattagcattaaattcctttaaaagagcatcaaagaggccgagggcaaaatgtacgcgccgcaatttgtgcaagcgccacgcgactttaactgcgaggacgagctgggccagtcgtacttcgatgcgcgcataaagccaaccaacgacccgtcgctgcgtgttacttggcttaaggacggacaaccgttgccaaatgccaaccgtattcagctggtaattaataattaaaaatataattagcaattacttgcttctgcccttgcccaggtgaacaacttcggcttcgtctccttgaccatccatccgacttaccccgaggacgcgggcgtgtacagctgcatgctgaccaactcgctgggccaggcacaagcggacgccaatctgtcaaccatttcctccggggacattatgtccgacccattgcatgccggcgcactgccgacaatccaagcgcacgaggaataccaggtaaagtagaggaagcaaaacaaccgagactgggcttgacttggctaggacctttgaagagactcaattgcattacgtcgagattctcgtttgaacgagataaaaaataaatattaaaaaaaaattacgtttgaatataatttagacatctatcgatgataattttatattttaacttttcaggtgcacatgggccccatgtttcagcccgaacgacccgaggaattccaaagcgtagagcaggtagaggaatgtttaattacattaaattgcaaatttgctttttttttattacacttacataagtgcaatttgtcccacttttagcctcggttcgcgcgccctttggatggccaagttgaggtcgaacaggaacagccggtgcacttcgagtgccgagttcagcctgccaacgacgtggtgagaagggaaatgaaataagcattaaatcttaaaaattattttgccagaaaatggccgtccattggctgttcaatggccaaccgttgttcgccgcccaccgcttccggccaatgttcgacttcggctacgtcgcgttggacattttgtacgcttatcccgaggacagcggcacgtacacttgcgtggcacagaacgaacttggcgaagtgaggaattggaaaaaaaaggaattgattgctatattaatccattattcgccattccaggcccagacttcggtggaattgtcggtgaagccgaaggacacgctttaccaagacccattgcatccggaaggcctggaccggatccaggagttggaacagccgaaggacttcagtttgcccgaagtgccggacagggaatgcgacaatccgccaaagtttctcggcaatttgcaagacattgaatatgcggtgaacaaagaattggcaaaatgattttatttgatttttaaattgttcaggaaggcgatgacctgatcttcgagattaagctggtgccggtgaatgacccgactatgaaagtataaaaatgagaatatttaccaaaaactgagttaccgtaatcattcaggtggaatggttcatcaacggccaaccgttgttcaacagttcccgcatccatgcacagaacgatttcggattcatcactctgttcatcaaaggagtgattccggaggatgcgggccaatacgttttgagggccaccaacgaaaagggacaggtaccgtactctaaacggaggacaaaactcaagggcatactgtaattgcaaaccatcacaaaataccgtagcattcattgttttcttttttctgtgctttcattcctatgggacactttgccaatgttcaggcggaaagtgccagcactgtgagcattgtcggcaaagatgcaattctgtcggcaccccaacacgaacagtcgctgtccaaaaattgaatatctcgagggcttggaacaatacccgcgccaggaa

SEQ ID NO: 3723 - DNA, 3882 bp, Heterodera glycines
  misc_feature (1617)..(1617): n is a, c, g, or t
tgcaggtcgaaaaaacgcaccagcagaacattccaattaccgaatgcatttgcttacaattagtccccacccttttttagcatttttcaaaatccacctcccccctaatgcttaataaacgaaaacaaattgagcatttaaaaagttcagtttaattatattttgtgattttaattaaaaaataaaacaatttcagaaaaaagtcgcattttctctgaccctcagcatccgagcagttacgcgcgcattcaggagatggaggcgccgaagccgctgccggaggaggtgcccgaaccggacaaacagtcaccccaattcaccaaagcattgagtgccagcgccggacatgtggccgaagcggaaagtgtttatttggaggcacagtacggcccattggacgacaacagcattgtggtgggcaaaacgagggggacataaaaaaaacattctcttgcagtgattaaaatcaaaatgagtcattaattgggctaattagagtcgaaatggcgattttataatttacagttgaaattatttgattaaaatgttaacaattccatttcgagcaaatattatgagttacattcagtgtgaatggcttttcaacggacagccgctgatgaaagcacatcgctttgtgctaagccaagactttggatttgcagcactgaccattttgtacatgtacccagaagacaggcaagtgcaaaaaggagaagtgagcccgcattagttctgctgtgaaactctcttgtttcggctcgagaaaatcgtatttttggagtctcggggttttggtctcaagcatcactagccctcatcttaattatgtataatttaaaggggtgataaatttggtcattagtgtccggaaggccgtaattgactgcaattttgttttcggtactactgatcagtgataggatagtctgctgatactgattctctgcaaataattgatatttataaagactgactgggaaggtattcattttcttgccactaattgatccaattaccaattaattactcgtcaaaataattactaaaataaatacccattaatgtgggccacttcagcggcacttacacgctgttgatccgaaacgcggccggcgagtcctcctcgtccgtcgagttgagctgcgagggcaaagcggcgctgctcagcgacccaatccatccacagtctgtggcgcgcatcgccgagttggaagcgccgcgtccgctgccggaagagccggcggagccggagaagcaggcgccgcagattgtcaagcagctgacggtggccacgcaaggcgaaggcggtccggccgagacgcaggcgctgcattttgacgcacaatacacgccgacggatgacaacagtgttaaggtgggggaagggacggagaaaactgtttttacagtgatcactgatcggttcaaaccttttttaataaagatcaagattttgaaaatgccggaacaaaatcaggaacaggaccagaaatcctgccaaaaattttgcgcggtcgctggggcgctctactttttaactcttggtgtcaaaatgaagataattagaacggaacaaataagataatttctgctttcataatactaatatccacncacggggcacattccctaattaaagttaatataaaaaaataaaatattgcattggttgggccattcatttgtcagattgaatggttcctgaacggtcagccgttgttcaatagcaatcgccatcatttgaccaacgatttcggctttgctgctttggacatcaatttcctcttggctgaagatgctggcgattattcgctggtggttacaaacgcagtcggtaggaatgttttggtttaattagttaattaattaattattacttttttactaatcaaaaatatattgccacgaggaattctcacaaaaccatttgcttaaaatgtgaaattaattcccaactatatgttaaggccaagcccaaacatcggcatcagtgcaaattgaaggtggcgctttaatcctggaggacacgcaacatccggaaagcttccgacgaatccaagagttggaagcaattcgtccggcagagccggaggagccggaaattgtgcccgaggcaccccaattcacgcaagagttgaccggacttgtggacgatttggccgacggcatgccgctacatttggacggcacagtgatgccgataacggatccgaagctgcgcatcgaatggtaggcttttgaaacaccaatcaatggtttgggggaccataatgaattagtgaaatgattatccatttggctaccagttattcaatcaatttatatacctattaattatattattttaaatagttattaattaattattgtaattactcaaatcacttctctccctcctactttaaggttcttcaacggacagcctctgcagtttagctcgcgcattcgcaccatccacgactttggctacgttgcgctggaatttgcccatcttttgcccagcgactcgggcacgtacacatgccgtgccaccaacgaagttggccaggccgagtcgtccattaccatcgaatgcgagacgaagcgtaacctgtacttggactcacaacatgaacagtcgtggcaaaagattcaagtctgatcaattactgatctaagaggcttgaaatatattcaaaaattattttttaaggaaatcgaaggccgacaaccgacgaaagagccgagccccgagttgcacttcctgccgccaactttcattgtgccgttgtccaactttgaggacctcgtcgagggcgacgtcgtccgctttgagtgccgacttcagccggtcaacgacccgacgcttaaggcaatttaaatttattttaaataaaaagtaaatattctcgaattctccgttttaaggtttattggacgtgcaatgaacagcctttgccggaagggaaccgttttatgtaaatgtccgatttttgaaaattaaatacaaaaatggaattcaggcctgcccggaaccttgacctcgtcacgttggacattctcacagtgtacggcgaggactccggcttgtacacgtgccgcgcagtcagcgactttggtgaggcacaaacgagtgccacggtgaagtgccagccgaccgacgcgcttctcctggacactcagcacgagcaaagctggcagcaaattcaggagatggagaacagagaactgcccgaattcattgtgccggaaccggagattgtggcgccgcattttgttgtgccattggcgagcggacagaacgaatttcaagtcgtttttggagctgatccaacaaataaacaaagaatcgattgatcgctcatttaggagggtgacccaatccatttggaaggccaaattgagccgaccaacgacaacaaattggtcgtcgaatggtttttcgacggccaaccgttgccgaatgggcatcggttccgcaaggtgcacgactttggctatgtatcgctggatattctgtacgcattcgacgcagactcgggcgagtataaatgcgtggccagcaacgagttaggccaggccgagtcgaatgtacagctccaaattgcgcccaaagggtcgctgttcaccgacccacagcacgagcagagttggcaacgtattcaggtgggaaacggcacttatagcccacaagtgaatgaacggtggcatttgcgtaggaattggaagcaccgaaagaagcggtgccggaggaggagccgcccgcgcccgaggcgcccgccttcgccggccaattgccctcactcgaacgcgttgagggccaaccagcgcactttgagacgcgtgtcacgccgatcaatgacaacaaattgcaagtgcaatggttcaaggacggagctc

SEQ ID NO: 3724 - DNA, 1542 bp, Heterodera glycines
cgaactggacaaggacattcgaaaatgttgagctggagcatttagggaggcattgtgcaattggttggccatgtggaaccggaaggagacccgaacatgacgattgcgtggttcctcaacggcatgccgttgcaaaacgcaaaccgattcagacaggtgacagagaaatggcagggaaataaccattttcaatttcccattttttcatctactcaattacaggagaaaaacttcggcgaggtggtcctgcacattttgcacgttctcccgcacgactcgggcgtgtacacgtgcaccgcatcgaacgcgcaaggcgaggcgaccacgtcggccaccgtcaaagtggcgggctatgagaagattttgaaggatgtgcagcacccggacagttggaaccaaattcaagtgcaaaacagaatttaaatttaaatttaaatgttttaacgtgcacagattttggaagcgccaaaaattcgagaggaaatcgaaattgaggaagtgaaggaaaagccgcgctttctcactcagttggaatccgtcgcggacgcgcccgagggcacgcccgtgcggctcgaggcgaccttccaaccggcacgggacaacgacctgatttggtacgaaatgacagaaccatctcgttatctaatcagctaaaagatcggattatccgatcaccgcgatcaatcaatgcaacttttgaatctttgatattttacacaccctaattagctgttgaaaatgttcagcacgtgggagttcaacggaagtccgcttggcgcttcgcaactcatacggacgcgcaacgacttgggatgggccgctttggacatcaggtggagcataaatcaacggccaatttggcacttcttaatgtgaatcggtataatagtcgtcattcagtgccgtcaacatggaccacgagggcgtgtacacgctgaaaattgtgaacagtgagggcgaagcggccacctcagcttcgattaaggtcgatggagcattgcatttggaaaatgatattaattaatatttttttagtcaaataactcttgagtttactagatttgcaagtgttgttttaggtcgccggagttggcaacattcttggcgatacgcaacatgaggagtcatggcgccaaatccaaatcctggaagcgcccttggaagtgattgagaatttatttgccaagcaataataattaattttttttgaagcgtccgccgtcgcctccggcgctcgaatatcccccgcccactttccaacaacaaattagcgacatcgaatgcgacgagggcgatgtggtcgaaattcgaatgccgttttcgatgcccgacgacgacccgaacgtcgaaaatccgaatgggtgcgcgaacggaagtgcccattggtccactggctcgaaagtacgcgaatcgcgatacgacattcggactagtgcgcatttgatcgtcggctacacgatccccgaggacgaaaggccggtgaatcttctgctactggggaaaaccagaaaagaatgggacctcgaagaaggattccccccc

SEQ ID NO: 3725 - DNA, 1905 bp, Heterodera glycines
  misc_feature (1899)..(1899): n is a, c, g, or t
attttaaatatatttatttaaatcatttattaaaataactttaaataattttcccttccgttagtgtcatgcaaaagcgcccattatcgacgatgtccaacacgagcagagttggcagcgcattcaagagattgaggcgcccaaagagccgttgccggagcccgagccggcaccaaaagtggcgcccaaattcacttcgccagtgcttacgccgggcgaagtgaacgagggacagccgacacattttgagacgacggtggagccaattgacgacaacgaactgaaaatccaatggtgggagagcaaatatgaaatttaaagaaaatttattattcaaatttaaataaatttatttgccagattaatttaaaaaaattagatttatttctcgggtaattagggcctatccctccgccgatttctttcaaatgatcaaacgattttcttactgaattgctcccatgttttgaccaggttcgtgaatggagcacctgtgccggactcgtctcgtctgaagcaaattgccgactttggctgggtgattctgaacatcaacgacaccgaactgcgcgacgcgggcgactgggagtgcgtggcgaccaattcggtgggcgaagcgcgtgccagcgccaaactgaacgtgctgccacgggaccgactgctgttggagccgatcaaccagtcaagtctggcacaaattgaacagttggaggcaccgcgagcgggcccggcagagccggaggcaccggtgtacgaagcgccgacattcaccgcgcagctacaggcaccggacggactcgcggagggtgacagcgcgcacttggaggcgcactacacaccggtggccgacccgaagacgcgcgttgaatggtaaacgaagcggagaatttgaattaagggcaattaaatacaattaaaattaattaattattttttaaatttaaattctataagcaaaattcattttcccatggacaggtacaaagatgggcagcccatttaccactcgaacagacaacgaatggtcaacgactttggttttggcattttggacattctctatctgctggcacatgactcaggcgaataccaaattaaggtgctttatccgttttagaaatgcttatctcaaaaacggatttaattaaagggcaattaagcagaatttaatttttcaaatttacaattattttaattggtgctcatttgtcaggtgatcaacgaccaaggcgaggcttcgtcctccgtccaacttgaagtggcgcccaccgagtcgctgctgcttcagccgcaatcggagcagaaggcgaaggcggtcggcgacttggaggagcggttggccttccgtccgaccaaagaagaggtggcacgtgagggacgaatgccggtgttcgtcgcgccgttgagcgcgcccagcgaaagtgagcagggcgaccgggcgcatttcaccgctcgctacgaaccgatggacgacaatcagctgaagatacaatggttattaagctgtgccatgccatggcctttgttgactgatcggcatttccccgcaaattgcaggttcctcaacaacaaaccgttgctgaccgggtcccgcgtgaaaactatcgacgagttcggcgtggtcgtgttggagatttacccggtatacccggaggattccggcgactacgtgtgcaaggcgaccaacgcgcagggagaggcggtgacgagcacttcactgaaagtgagcaacggggggacaattgtatggtttttttgtccgatcacttgatcaatctgagaggatcttctgttaaagggaataatttcttcccgtcaactgatcaaaaaacgaaacccactccccttttaacaattatgctaatgttatgcaaatttggcacttttaggtgacaccanaaggag

SEQ ID NO: 3726 - DNA, 1854 bp, Heterodera glycines
  misc_feature (1006)..(1006): n is a, c, g, or t
  misc_feature (1691)..(1691): n is a, c, g, or t
tccgtaccgtactccaaccgtatccatctgagcaacgatttcggcgtcatcactctgatgatcaaacacttaattgcgcaggtcattcacaactttgagaaagcattttaatcatattctattgctccttgctgttcaggatgccggtgagtacaaatgcatcgcgcggaatgccaaaggcgaggcgagcaccgcggcgaccatcgaagtgcagacactggtcgcgcaggaggagccgacggtgcagcaaccgctggtggaaacactggacgccgcggagggcgaatccgtgcacttggagtgccgcgtgacgcccatcaacgacccgcaactgcaggtgcactggctgaagaacggacaaccgctgccggacgccaatcgctatgtgtaagcggaacataaagcaaaaaaaataagaaaaggagaaagggcgaactgattggaagcgaagtgatcggaaatgcaatgggacaaggcgaatgccatcatttttcaggcaaagcttcgagttcggcttcatcactttggacattttgtacgcaattgcggaggacgggggcgactatgaattggtggcagtgaacggaaagggcgaagcgcgcaccaaaacacacataaatgtgatgccgaagccgggccttctgttccaaccgcaagcgccaggcagtcaggtggcgaaattgggctcaaattagtcaattttatttaaaaattccctatcgacggcgccgtagctaaagctttacgaatgatctgacggcgccgtcgtcggatatattttttaataaagttacccaatgtttctcttttcgcaggtggtggacaacttggagcaccatttgcgtcaattcaccaaggcacaattggctttgacagccgaagacgcttggcaaccaggcaaaatgatttaatcataggggggtcttccgacttttttcacttttgcgttttgggacggtgccgccagcggtgccaatattcaatctcattaaattcttaagaaaanagctcaaatttcaaaaaatcagagagagaggaagagaaagagagaaaaaagaccccattctgctgaagtataaatatttcataatttaataatttaggagctcaacaggcgcccgctttcaagtccgaactgaacaacatcggtgtgcaggagggcgacttctgccgcttcgagacccaattagcaccgatcaacgacccgtacatgaaagtggagtggtacaagaatgccaagccggtggacattggtcagaaagaaagagcctattaaaaccgattttggttggaaattcacctgtaattaaggcgcccgtttccgcaacacgctcgactcgggttactgttgcctggacttactgtacgcgttgccggatgacactggcgaatacgcgtgtgtggccaccaaccaattcggacaggtacacacagacaaacagtggacctctccaagatttaatagttccaatttccacattaggcaatgcttacggccaagttggcctgctcgggcatacagcacgtgctgacaacgccgcagattccgcaaggtgaaaagaaaaaattaaaaatgtttcaataaataaattattatttactaaattattaattaatttattattaattctttaatttaatttttcactatttaaaaaagggatactaaaacaattttataaaaaaacacnatcccttaaaccatttttgaagcattttatgactgtttcacgctttttatagtatcccattattacaaattaaattaaaattaactaataggccttcgcgtgaaggacgtgcgcaaaaatgtgtaccatgcgggagcgggtccgccgccggagcgccaaaagc

SEQ ID NO: 3727 - DNA, 10725 bp, Heterodera glycines
  misc_feature (31)..(31): n is a, c, g, or t
gcgctgaggatagaaaatggcggcactgccngggttcagatctctttggactcgagcggggaaaagaattgtgcctttttgtcgctccccaggaaatgaatgccatttttggtcagaatgagcagtgtgtccggtaaagagcagttgaatagccaggtctaaacaaggtttcaaaaccgtatgaatttagtcgattttagaattcaataacctgaagcgactgcgatttggagtatgggttttcatccgtatttgtgccgacgcaaaagactagcgaatccaccgcacgaaggtcgtcgtcactttccttaatagacaaaagaataacaccttttttccacttttttaaactttaaaacaaacccaagcattgtagattcgagttgcgcgttctataaaaaagtttttgttcaccgataagccagccatagttgaaagaatcgctgctaaatgatttattaattataagaaacagtacaaaagttcatataacttatgaacgaatattcagagacttagacaacagtaaaagagtacaaaaaaactgaattgcaatggaaaaagctcgctaacaagtaaaaaaacaggttcaggatcaagcaaacagaaagaaatttgaattgttgttttcttttaaaaatatgtggcgttttgttaatattcaatccatttttcaaaaaaaaaatctttaaaattctgtcatggcatggtcattgcatgccatggaatataaggctcgtgaatggcgtatatttgttttgttggtcttacgagcgcgagctaattctttttttactaatgatacttagtttgactagattctgcaaatttgcttttctctttttaagctctgagtcagctttagttagcaacactaataattgagcacttcttagaaatattacatttacaactcacaatttccatatatatatgatttttaattttagaaattcagcagtccaaaaacaaatttcaccagcaacaccagcaatgatttaccaccgatttgttgagattggccgtgtcgtttacattgccaaggggaaggaccaaggcaaattggcagtcattgtgaatgtcatcgacggtaacaaggttttagtttttttttgctttctgaccaaatttattgttaggaataacaaagccgtttgtataaaaccaaaatttgttaataggacatgcggatttatttgattagaaacaatcgctattcaatctttttttacaaaatatataatctttcaggttttattggacggcccctcctcgggtgtgcctcgcggtgtttggaatttcaaagacttgcagttgacaaaattcaccctcccactgcgtatcggccaacgtacgaaaggagtgcgcgaggcttatgaaactgccaaaatcaacgagttatggcaaggcactgagtgggcaaagcgcattgatcggaaacagaaggtccgtttggaattctacagatagtttattgggtggatatggtagaatttctaattaactactcgacaaatttgtggcaaaggttttcctttattttgtgcccagtcaattttatcatcctcccgcagatttttttgcttctaacacttggctattttagtttacacgtccaatcagtgaccatccttagtttcttaggccatgacttttttttagcttggtcaaatcttaaatctggtatcaaacgaaagcttaaaatctatgcaacttatagatacaagaaaagagcaaatgttgaattaggaaaaaaaagttgcaatgaaaaacccgaaattcagcatttttcaaatatattcaagcatatttttgtctttagcccaatatttaaaataattaaaaattattttgctttttttaaatctttgctataaacttggtactatatttaaattccatttaatgataaatattgcatttatttacaatgcctgcatggctcagtggcaaatcctttgttctttccttgggttcaatttcctttacgtgccgtttttcccaatgctttcacaaaagcaccgtatgcgcccttaataatttggcgtttttcggtcgtcgcgaaagcgaaattggcgcgaattcaattgggtgagacagaagtcgcctaaattgggcttcacgtctcaatatgaattcgtacaatcttttttaaaattacatttaaattattctctcgttttaagcgtgccgggctcaacgacttcgagcgcttcaaagtgttcaaagccaaacagcacccgaaacccgtttggtccgcgttgagatggctaaactgaaaaagatttcgaagccgacagcgaagtaaatgactgaatttggcctgatcatattttgaacacacaaatgccgtcttttttgttgatgaaattatttgttggagttaaattgttttttaattcaatcgtgagttgataatgcgaaaaagagggtgttgtaatttcaagacttgtatgcaaaacaggtcttaaattaactgacaatatggttcggattgaatgtcggacagacagaaatgagtttaagcttcgacgcttcattgaaatgattacattgggggtagtcagtcagcggccaattttgcaaaagggtaacggctatgtgaatcggcgacctttttgcttttaaggacctccgaaactattttttactaaaaaaaaatagcccaaaaaattaaaaaatttggtcaatttttggacaaactcttaacaaatccgacggtaaaaagttgatcggaaatcaaattattaacggttcataaatttgactatttttttcttttcaaaaccacttttgcggtggaatttttcaaaaaaactaggaacagggggtccggcggtccttatcagggatggcattccgaggcccaaaaaatgtcggaaaccggaagtctttccgtgccatacccatacctggtgcctatcgacatctgcgagaaattttatgaaatttaatgcgatttgttaacagattttgtctaaaattgatcaaatgacgcatttttgactcaatttctacaggattattaagtagggttgcacccccgaacgtcggggttagaaaagtcggggttcggggttgtcggggccagcaagttcggggtcggggtcgaccaaattgttcgggtcggggttcggggtttttaaatttttaccttgtgccatatagtcaaattataatttccataataaagttttatttgtttatatttatttatttttttttatcataaatatttttgtatgctttaatatcttgaaaattttaaaattttttattttgtcggcaacattatgtctttttggcggcgacatttctggtgcatcgaatttctatattaataaatgaaattttgccggtttttacaaatataaacatgtgaaaatttaaatttttcccaatccggaaaacggtttcggatccggcaatttgaaaaaagtgaatcttattcaaaaaatgatcaaaaatttaataagtaacttttcgcatttgcaaatcaatgtttcatattgttaaattttcttctttcatacggcctgccaaatgtgactttcttctccaactttgagctgatcacggctcagaatttccaggaataacttttgatcaattggtaaaaaatcatccgatttgatcaatttttccatgttattgtcaatgtaagccaagcaacgaccagcaaagtcccaaaataaaagtgattgaaattattatttataattcaaaaattaatttttgtacattttcttgcagaagacgagcttcggctaaggcaaggaaaacatttggcaatttcgaaatgggaaagtcggcgaatgcttcgatcagaccgatgatggcatattttttggctaaataataaataaataataattaatccattggtgaaataaattttaatttttgacccgcataaaacacagccattgcattttgtccgtccaaaacactcaaattgtttgtgtaaataaagcgtaacatcgccttaaatggcacggcacaaatgtcagtgaccaccacagggttagaaggagcttaaaatgaaaaacgaaagtttaatttaattaaatttgatttaattgtccaattttcgtacaattccccgccattgtcccattttgagagtcataagcgaacatcgcttcgcacacatccgaggcggccatcagaagggttttatgtgccgcaatttgcttaaaaataaaaaaccattttttatttggccattgcaccctttgtataaaacatgaatatgtatgtatacagtaccaaatacaaatcattttcaattgtacagtagacactgaaaaactttgtaccgtactaaagacaattcctgtcccgattaattattattttaattgatatattttttaaatcgccctcactcgcctccttttcttcgtcttctgcaaccaaaaagtaaacatccgcgccattgcccgtgttcaacaaaagttccaactgatcaaccaacaattttggttttggcattgtgtaaaaacaatttcggccaaatttggaattaaaagctgaaaaactttaaaaaggtaagaaacaaaattattagagatcggtattttgaaaaaagcctggacctggattccatgttggacctggacaaaaatccaggaaaaatccaggcctggacctggattttttgaaactcattttaaaaatcaaaaaatgtttgaaaaaattaattatttgcttagaaaacatttaaaaatatctgatttataataataatgtgtttttaaatttatttaatctttttttgaaaacttgaaaaaacttcggtcacttgaaataataaattctaaaattttgtccaggaaaatccagttttttcctgtttgcctggacctggatttttttcacatttgacctggatttcctggacgaaaatccaggtccaggaaaaatccaggttgccgaaaaatggcctggacctggatccaggtccaggccgatctctaaaaattatcaagtggcgaaaagttgatgagaatctgaattaattgaaggattgggagacaaagtttggcgggaagagagtcccgcgcagaaatttcgcaaattttctaccagaacccgtctgttctggatgaattgttaatacctggacacagcaaattcaatttgtaaatttaaaataattataaatggaaaatgttttttttaatttgcccaatgatttgaggaaaggttttttgagactaaaagtttggtgttttttttaactttcgtatcgacgaaaaaactgcagaaaataaatgtttgagaaaaagtaaaagaaaaactcagtcaatgcaaaggatgagagaaaagaaacggaagagacaaaagggaaaagaaaaaaaggaatatttgtctgactaaggcattttatgggcagaaaagcgggtcaaccaaacaaaccgcgaccgaacgtgggtcagccgcggcggcgttgcgagccaaaatcggccagcaaaaaaccaacgccatttgagtcattaggacgctattaatgagtaaataaaaatacgctaaataaaataggataatatcaaaaactttaataacgaaaagatgggtgaaaagtccgtagaagtgaaaacaataaaaaaaacacttataactttgtcaaagatcttaagaaataatattggaaattctcaatgtcaatgttttcccgtttccgctcttcgtcgcttttcccttaagccttgtatgcttctgaaataccgatttcggcacgaattttcagtgcctttccaatcgcccagccgatcccgaccaaatccttaaattttgatacatttcaaaagcatttcatttcttggcacctccacgggtttttcgataggcgagaagggataaagcatccgatctccaatggactggccaaaaaaggtcctcttttgctcatttcaaccatttaatatacccaattaaattatggaaaaatatgaaccaaatcttgcaattgacaaaaaaggcggtaagccatttactggtaaagctaaaataaaatttgtcagtaagttcattagcaaaatgctcacttaaaaataaacaaaaattaagcattcattgacaaagtaaactcatctcaaatttgccgaaatcagaagagcataaggaaaaagatttataaaaaaagacaaaaaggctgtcaataattaaccacaattaaataatgtcagaattttgtttactctccaaataatcatttgataactttgaccatcgatcagggattgatcaatcagatgaagctgccacattcttccggcttcgtgtcacaacattttcgcgcattgcaatggcatttagtcgtcgctttgtggcagtagcaaatgtcgtccaaatgcattttcttcccgcactttttgcagacgaatttcgactccaacgcctaaaatggaaatattttattgtacaaatttcaatttgaaaattcaaaaaacaaaacatcttattcatcagtgtcagcccaaatatcctttaacaaaaataggcccattaaaaaaagtagcgggtcataaaaagagaaaaatggacaaaaaagaagccaatttgggtttttgaacataatttaaaaaaattagtggaagcttaagtctcttggtaaattttttgctagaaaatgttgaatatttggtgcctttttccattttttcgtgccttttttgccatttttgtatttttttatgccttttttcatatttttggtgccttttttaggtgcctatttgagaaattttcgtgcctaaaagtccggtctctaattatcacccaagtttttgaatgttgttaaaagtagttttttaattttagtgataaatgtttgggtgataatattatacaataatggtggaaaaattactgtcccttggggcccagttggcggggcccagttggttggggcccagttggcggggcccagtcgacccccaccgctgattcccaatccctggtcccggatttttcaaaattccgggctgaatttttaaaacttttttcccactttagttccacaaggtgcccccaccttcacacgcaagccacagattttgcaaaaaacatcagactctggcgacccggccattgtgttcgacatcggatttcaggttaaccatttgtaagagaatacaaaaaataactttgatcctaaaaactcggccaaccaaacgaacaattgtcaatttttatgatgaaatttcatgttgcgctacgttatttttaagaaaattctagaagatatttttggaaaaatcgctagtttcattttttttttaaatttttaaacaaaaaattttaaatttttttttcgagtttaaaagatatgtgggcgagtgaaaacgaacgctttccaaatttcttgattcattcttaaattaatcatctcattttttatgcaggctgaccaaaacccggaagtgatttggctgaacccgaagggcaagaaaatgaaggagtccagcagaatcaagtttgggttgacgccggacggcggcgctaacacttacaccgctcaattggagttgaaggtgaccgaaaataaattttaaaaaaacttgggatataatccgaataatatgcaaatttttattctaaaatttcaatttcttttttttttgcagaattataaggcaaaagacagcgggacgtacacgtgcaacatcaaaaatgacgcgggagaggcgaatgtggagctgacactgaacatcgagggtcagtttaaccacaatttttttaaatgactaatgacacaacatttaattatcggtgtgtttgggagtgaagtgagtgaaaatgctttatctaataccaaaacaacaccccgaagggttaaccccccccagactcaaaaaatttcaacaaaaaaaagttaccacgtttttcttaaaattttcgtttctgacaactcactaatccgtgcgcggtttgaagcttaaaacccgattaaaccgttcttccaacaatctcgcaaagtgttgatcaatcccctactggaaaatcaaaccctgctaattaattgatcatttctcgcaatcgcttccagccccttttttgttttattaaatttttgccaattgcccatttaaaaacagcatttttttttgttcgttatttttactaaaaccggaatatgtatcaaattgactttattttcgataatttttcaaatttaattttggtgaaatttcactgcaattctcttctagcagtactttacttttttgtaattttgggcaaaaaaaaagtcttgcatcctaaaaccaattttttttttaaatttcttcccctgaaataaaaaaacggttttcccgcaattttagacgacgaggtcaagcaataagccagagaacagaagagcgcgcaaactctatgcagtgtttaaaatggtgctgtgtgaatgctgttgttttacaatattattcatcacattattattattttatgtgtatgccgtgtgagtgtgtgttggttgctctctcattcttttatcatcatatctcttctattagatttgaatttcaaaatgataattaatttattttattgtgcaaatttgctgatcgaataattattgcataatacatacatacaataactcaacatattgttttattttaaattataatgaacccgattcaattaaaataatacgattaatgcaattggcacatttctagaatttttagtgggcccaatgaaaaaccataggtgaattcttattagttggtagttttacaatcgaaaattacatttagtataaataacaatctatgatcagcagtgaccctgaaacattaaaaatcaaatggtcgcttttatggtttttcttcgggtccattaaaccagggtgccttaattatgactaatttgatgcaccgaaattctaaccgtttgtgtttaacaatttgacaaaaaaacattatttattttttccttgttaggaccattggacgatgctggcgacgacgaaagtcaagcctaaggagtaaattgggaaaatggagaatttgttgaacgatgccgagaaaaaatttcttgaaaaaaatctgtttttatcatgaatccaacctaaggcatttacacatacatttaatattttgtgcccaagataaatttttctttctcatccatcggtgtaatctcatcaatcaatcaattcacttttttttttgctgtcgctgatcactgatcaccactcggcccgggcaatccgtcgaaaacactgaaaaaaataaaaatgagaaaattagcaaatttttaaaattgttcacccattgttgactccgtcgtctccgatgcaaatccaaattttactgttcttttgccctcgaatcacttcatcaatttccatcatccatttttcatcgtctgctgctgcaattgaacaacggatcagcttaaaaacattcacaaatttttttgacagtctcaatttctcttgagtgaattcgtttgtgtgttcaaatggcaaaacaacaggaaacggaaaggaatacggaaatacaacgcaaatgctgaaagcaacaggagaagaagcgatggaaaatgcctaaaaaaaaaaaaagggaaaaaacgggcaatcgtaaagaatgggggtccctaatttaacttttttttattttcgctcaaaatgagtattgagggttttcgagggcgctgatcacggatctgaactcggaattgcccaattccgaaccccggacccgaattcgaacaaaaaagtcgaaatttttttccaaacgtacatttttcctgggtaaaagctttggattcgtttaacaactatttatacccggaaattcccggttttcccagccaaaaagtcccggtttttcaacccgaaaagtcccggtcccgacttaccctaattaaaataatggataattaccgctttgatttgttccactgttgtcaaccattggtcaaccgacgcactcacaatggtgacaagcagcagtttcggcaaattgtcgtggcgtggcgagaacagccatttggccaccgcttggccatccgacgacgcattggcagcaatgtcgtcgtcgtcggcgggcggaaattcgggcaaaatgtcgccaatgaaaccgacaaaacgaagggatggaaagttgaagagaatggacgcgtccaattggcgcatttgacgaaaagtgtttgtgttgaaatacatcacacgaatggtgtcattgagcagtgtccaaatgttgagcacaacgcattccggaatgtgaatgcttgcagtggaaaggtcaaattttgtttcacatttgctgaaaaaacgggcaaaacggcgaaggaaagtgagcacattgtggtcgaagaagctgaaaaacagaggagggcacgtgtttgatggcacaaatcaatttacaaattcggcaatcctaaagaatgtgggggtttctaatttaacttatttattttgtgctcatacataattagtttctgcaggttatcgagggtgctgattatgaatctgaacttggatttccccaatttcgaactccggacccgaattcgaacaaaaaaaaaaattttttttttcaaaaatacacgttaaaatcgaccaaatttacaagaaaattgcgtattttctattcaattaaataattggagcattgttttgcatcaaaataaatagtggtcaaattaactcgaagcttttccccagaaaactgcattttgaaaaaatttcaattttttgttcgaattcgg

SEQ ID NO: 3728 - DNA, 1652 bp, Heterodera glycines
  misc_feature (1643)..(1643): n is a, c, g, or t
tgatgcaaaataacggaaagaattgaaaggggtcaatttttatccactcaaaacattttaaaaaaagttagggccaaaaattcccaatttttcccctttttgaaaaattgccaaaaaaagctttagggaagttgtttaaaatttaaaaaaggatttaaacaaggatttcctacgggataaactatgctggaataattttgcatgtgttcaaaaaatataagaaaatcttttgtccaaagacaagttttttctccttggccttgtttttcagaaattggaatattcgcccataacacaattttggaaacttgtgcgattctgtaatttttttatattatttaagggcataaaaagcctcaaaaccccgatggaattattttggattttgtttttgactttcggtttggccaatagatttgaaaacttggccaaaataaacatggccaaaaaattttgttttttctttttcagaaaaatttctttcaggctttttcttgttaagctcatcaaatttcataatctgaccaagttttaagtcgttttgacaattttaactcaagttatggacgttggtgtaaaatggtagccaaattttgttgaccttacccaattttttggactgtaactttagatataaaaggacaaaatcaaaatttttggcaaaaacatgacgagaacattcagataaaagaattacacacaaaaaagacataacaaacgttaatcaagtcttaaaaaaagtcattttgaaaaagcgcccttttttatgcaacgacctagtaattacatcgcttttttcatttctttctccgcttcctttggattgtgcgacatttttttggataaaaaacaaaatttaaaaataagtgaactgaaaaaaagttatcatatgtacataatacatatgttatgtgcagggatgcgatttttaggctctaaaactgctgccaaaaatatgtatattcaggttgaccaagttttttttttcttcgaaattcaggaatgacctttttttttttttgctttcagaaccgctcttttcgcggcgcgttttttccaaaacttttggtgaaaaatttttgtgatttttagtgcggtttgttaaaagattttatgactatgttttgcgcttttaagccaatattttatggaagaatggatcgatcccaataaaatatgacgaaataaaaaaagatttttataaaatgctaaaattggtgaaattataatttacaaaaattttccctttcaataaatttacattaaagcccggtaaaaacatttccggttatttatatgattttccaaacatttccggttattgtataaaatgatcccttttcgaacctttccggttatttatataaaaacgatcttttaaagcattttccggttatttacatgattatccgaacatttacggttatttgtaaaaaaaaatatgatttttcctaacactttccggttattgtataaaaatgatcccttttcgaacctttccggttatctatgtaaaatgatctttttgagcatttccggttatttacatgaatttcctaacatttacggttattggtaaaaaaattatgatttcagaatttacggttatttaaaaattatgattttttacgaacatttccggntatttatat

SEQ ID NO: 3729 - DNA, 1077 bp, Heterodera glycines
  misc_feature (177)..(177): n is a, c, g, or t
  misc_feature (1030)..(1030): n is a, c, g, or t
  misc_feature (1050)..(1050): n is a, c, g, or t
aaaaaaaataatggttttcggaccatttccggttatggtataaaaattatgattttttccaacatttccggttatttttataaaaatgatcctttttgagcatttccggttatttacatgattttacaaccattatggtatttgtaaaaaaaataatgtttttccgaacatttccgnttattgtataaaattatgatttttccaacatttccggttatttttataaaaatgatccttttttgagcatttccggttatttacatgattttacaaacattatggttatttgtaaaaaaaataatggttttccgaacatttccggttattgtataaaaattatgattttttccaacatttccggttatttttataaaaatgatccttttttgagcatttccggttatttacatgattttacaaacattatggttatttgtaaaaaaaataatggttttccgaacatttccggttattgtataaaaattatgattttttccaacatttccggttatttttataaaaatgatccttttttgagcatttccggttatttacatgattttacaaacattatggttatttgtaaaaaaaataatggttttccgaacatttccggttatttatatgaaaatgatccttttttcgactaagggctatcagaagatcttaaaatgtttgcactttaatagccctcttcttctcctcctcttcacccaaacgtcgtgctaggcggtgcggtgcatctatttgctcttcgcattggtcagttgaattgtgttgcgagaggagggattataaaattggggcagctgtcaccacagcctccattagtagctccatttgcattcctaccataattatttgctcttttcattcaactaatttgagatcttgcgattatatttatctgctggttgagcttggtcgcctactatttaaggtcattccttgagtcattgctttccatgacaaacattttcctcttaaaaagactaccagttttttaaataaatccaaatcttaactcaanaagctgataagcccaaaaantattaaacaattaattattaaagaaat

SEQ ID NO: 3730 - DNA, 5390 bp, Heterodera glycines
  misc_feature (32)..(32): n is a, c, g, or t
  misc_feature (5366)..(5366): n is a, c, g, or t
acggaccctccaaaagatgttttattttttgngtttttcccttggctttttgtcaatatttggaatttttctttgtcacgtgaataatctaatttagttagtttaaaatgtaatatgtattaacaccattttctttattttttttatttgattcacttttcaaattaatcaaacactttcgggaatatttccgcaatttcctctttcaattggcaagaattaattaattgcaaattaattattcttttctctccaaattccaattatttttccttttaggcgtctttagcgtatgagaaagaaaaacattttgttaaaagtttttcaaagaatgtatcattcgcccgtccatccatcatttttgtttcctcgttatattccgaattcccccaattgctgctggtgaaatcgaataccgtcaattaactaattaattagccactgatcagcaggtggtggcggtggagttcatctcccgtcgttatatttcgaaaagcgatttttgactgaatgaatttgaaaaaagaaatattgccaatccaaaaaagaatggggagcagaaaatccaaatttaatgggtcgctgtttttgacgcaaaaatgggaggaaccaaaaatcgaaaagtgaaatctgtcataatctttttggtcgcctccgccagttaaattgaacgaataaaggcaataattctgtcatattaactttcacattcgcacccattgaagaataaatacattaacatttgttctttctgctgcggtgtcatttgtaattttggaaaacgaaacattccaataaaaaagggtggcgggtgattagcaaatttggggagaacggggggagggtagagaaaatggcaaataacaaaaaaaaaaattttggcaaattcattttgcatagcaaagtaaactgatcagacaatcattggcatatggtttgccgccgccgtaagtccggttcacattcattgccaaaagtgctgagaatcagtcagaatttgcgacttttcccctacaacagacagataaacagtgatcgccaattttgtttactctctccgcctctgtcgcccccctgcccacttttgttggcttttgcgtgtttttcagctgtgtattgtcagcgcgcctttaaatcctaattttcgaccgccaattcattttcattccatcgctcaaaatgtccgttcgtccaatatttttgtcccaatgattgcattatcacgataaaactggtggcttggtgtcaaaatttgcaatcaaactcaaattcagcccatttctctgttcgcgttgccgccgcgcctttcctttcgtctgtcatttttttggagcccgcctgggcatacccccaaaaaccctcgtgcgctgttttttctccgttcccgcattttaaaatgtcactgccatgcgcccccccccccctcccattttcgcagccaaaaattctttccgctcgtccaaaactctcctccaaatgataccctcttttcccgccctttccctccacgtctctctgtttctctcgtcgctctctccgtcactctctctctctctttccgttatttctgttcacttttattattattaatatttattttattatgatcgctgttactataaacatatgcgttgctttgtttttgtttttgttgatatttcaaccgtagtaatataaccataaaatagtaataattacatgattttcgcgttccctccccctcccctccccccgcctcatttgtcgaatcctttcccacttttgtttttgctcctcgtggttttcgtcgttgcgcaagcgatcgtttggccctcctcgtccaatcctctttccccttttttcaaatttcaccaattatgtgcattatttatccacacattcattattattcatccattacaaacaaaatcattcaatttaatctccaaatggcttaaatccgaaaaaaggaaattattccaatttaaattacaacttaatgacagttgaaccattattttcaacaactattattaaacgggttaatcagcaattcgttgttatctctccggcaattaatataaaagcaaaaacttttgacggtatttttctctcgccgcccctccctttattttgaaggtgtcactttttttacgttggtccaattgactttacaaacttattaaatagtaaacgattacctgaaccgtcccccccccccccccccccccttcagcggagtccaatgtccgtcgacccgcccacccaatcaaatcactttaaaaaatcgcggcagtgttcccccgcacttttcacttccttttccaagcgctcttctccgtgttgtgacgtgtgtggttggttggctctgctttccttctgtcctcccctccagcggcccatcccctgcctttttttcgtcgagagtttgtttgcccccttccaattccgctctctagttggttggttggcctctccggaagaggagggacacggactcaattaaaaagggaaaagggggggggcgaagggtcggtcggtcttttattcatcaaagccattactataaatcccgtgatcccgcgcgaaaggttaggttttgtgttataatcacaagggaccaacaatcactgctttttccgctccttccctctccaattcatccatcggaatcactcgtgaaatgacattttcatcagaaaaagcattattagtcattacaaaagaaatgttaaattttaattttgatgaaggcaataataaaacggagatgaatcattgaggtggagattttgagtgtttataaagagaacaaaggcactcacttcgaacattttcattgggtctgcttgagggttgaaatttccgagactcgagaccgagaaagaaatgattctatgatagtcgagaacaagaaaccgaaccgaactaatcctcttattgttacaccaatccaagccaaaaaaggctattgttagagaacacttttttataaagttcttgtgatttttaaaatttgatatattgtgtttttttgcgtattaataggataacgatgatggggcggagggacggggataaataaagggggggggggattttgcgccctaagcctacccacaaaaactgctctatgaaatactatcataaaaaagaaaacacccattcttatgtatgttttactgttgaattatttccatcaaaaaagtatttcgttgttactaaatatagtccattcggaagcaatttttctcatggtgcctgtaatgacctaaatccttagagcacttcagcaatgccaaaagcctttatctcaaatggatggcctataatttgagtgttttttagcggtgttttcatccgtcctttcccatttgttccatgcgtttattccatgcattcaccggtgattctccggttaacaagcagtttttgctattcgtcatttttctgtgttttgtcgcaacggcagcggtgggaccgacgaggagaagtgcaattcgaaatgcgccaagggaagcgaaggcggacgaagcgacgccaaagtgcgacttgggagacatcgagctgaactcggaggaatttgtgcacacgtgcgacgaggacaaattcgaaaatgctaacatttactgcaaggggaaactgctggaggcaaggaaaagcggattaagtgtcattcaggaatcttgaaacatttttaaaatgcgaattgagaactgaaaatcaaaccattgaggggttgatttatgttataatataaagcgtttttttgaggcagttaattaccaccaattgttggatgacaatgactcgaaggactttgtggacagaccgttaagaaggaacgccagcgaagtgctacgtcaattcgagcagaaattcggaggacaaaacgaatcggcgagcagcatcgacgtggaagaattgagggattttctcgatgaaaactttgatcgcgcaggaggcgaactcaaaaagtgggaaaacggacgaatcattgggaggggggcaagcaaagaaaatgagaaaggggaggaaaagcctaattgataaaatgaaaatgaaagttaatgagtgtgttttttgaaaggtgtgatccaaaggattgggtgcagagtccgccagagttggaacggattcgagacgacacgctcagggggtggcgatgggagctgaatacagggtggaaggaactgtgccgagtgattccatcgaaggtagaaaaacaatttaaaatatggacatggaacaccttaaattacaaaacaaaaattcacagataaaagagcatcgggaccggcactcattgatctatgtgccgaagcctttcattatcccaggtggatttaactaattttgcaaattattagcataattaaggcgggagatttcgagagttttattactgggatgcctattggattgtgaaggtgagtgagtgttaattgttaatcaatccacgggtggttaaaagaacaagcgaattgttcaagggactgattgcttcgggaatgacagactcagttaaatcaatgatcgaaaattttgttgtgatggtcgaggaattcggttttgtgcccaacggaggacgcatttattacagcaaacgatctcagccaccctttctaacaatgttcgttcggatattgagtgcattgcttagtaattagagtgttgttcaggatggtttacgagtactttgaagccactcacgactacgaatttttaaaacaaactgttcccagtttggaaaaggtggttgatcagcggggaatttaaaacagaattgcgcaaatgccatttgaggaattggcattttggcaaaaccaacggactgtggacgtcaacatggacagtcgcacttataaaatgttccaatatcgtactgttgtgaatgtgccacggtctgagtcgttctgtgccgatgttatcgttgcaaaacaaaagacgaagctgaaagacaaacgccgtttgtggaaggacatcgcgtcggcagccgagtccggctgggacttcagcagtcggtggatgagcgacccggacaggccgagcatgcttgacattgagacgacgaacattgtgccggtggatttgaatgcgtacatttgtggcaactacgaaatactctcgcatctgttcctccaactcggcaagacttgaatttggaaatgaaaccatatcaacgaaggaaaccgacggacaaaaagaacatttaggcaatgattcgaaggcattggaatatcacaacaaacattatctgttccgggaggcttttcaacgagtgttttaccgtaacaacgacatggagacggcgggatggtacgactacaacatcaggtcgaacagtcacaacactcacttctacgccacatttgccatttccgtgntcacgcgctgttaccactcatcga

SEQ ID NO: 3731 - DNA, 1393 bp, Heterodera glycines
tctttctgtccaattccgatctcttcggtacatttcgcaattaaaacaaaagttcaccaatctctcatttggttgtggacaatgaaaataaaataaattgtaaaattaaagaaaaattgagttaagtgttacaaatcgaaacttgagcgtcaaaatgacttgcctttttgagtttggactgtttgtgttcaaataatcttagcaatgtcaattaagatttcatatgggagtgccagcaaggtcacactttactaagtgtccgatatttgttgtcgtaaccaaccggcacaaagatgggctaggaatcctgggacacttgaacttgagaagaggaccaaatttatgaattattaagttcttcttggcatttttccaaaaattgcccaaaatgttgttgccaaaaggtcctagcccatcgcagtgtccaatttttggccccttttaacggtcactcttttcagtatggtcaacagtgcgcaacaatgggactatcccaacggatggccggtcaaatcttgcttttttattctcacaaataaaattgaccatttcgttttgctttagccattgaatcatatgatcatcgaaggattgcgccgttcagacaacaaactgtagctgttcttttttatgtaaatcaaaattaatattgacgcccctttaaccgacagaatgcagaaaaaggcgttttggttggccaccaaatgggtgctcagcaattaccgggtgtaccgttcggaagtgcccaggggcaacatgtgggagaaatacgcggtgaacaaattcaagccgaacaaaggcgttggcggtgaatacgaagttcaggtaatttgagggggaggggagggatttggtcgtcgcaattggacttttcctttgtcagtccgggttcggctggtccaacggagttatcctggacctgctgaccacctttggggatcggatggagttcaagaacgacttggaggaggaccccagcgcagtggccaaggaggtgatcaaggcggagccgcccaatttgcccacgcccaacccgaacattacacccgtactcaacggacccttcgtggcggttgggccgcagggcgaaggcattggaattccgaggccaagcggcgcccttcgaacagcgatggcacctcggcacacattgtgccgatggttgtggtggtggacaagcgtactcatggcactgctcgtcactcgcacaattcattgagtagcaacaacaaaggggacgggacaaaatttcgccgccgaaattacgccgccgaaatttcgccgccgaaatttcgccggacggaatttcgccgagggggaaatttcgccgccgtaatttcgccggccaggggggtgtggagacaaaatttcgccgcaaaaaaataaaatcaaa

SEQ ID NO: 3732 - DNA, 3956 bp, Heterodera glycines
gccgccgaaattacacactccgaaatttcacttacaaattttttaagaaaaaatcatagaatttcttataagaaaatttaaaaaaaaaattagaaaaaattttaaggatttttttttgaaatttatgataaattagtaagttttttcgaaaaattttccaaaaaatcactaaaaaattttttcaaaaatttttcattggaatttccatataaaaaaattctaagaatttttttcttgaaaatttccaaattttttaaaaaaaatttaaaaattttccaaaaaatcactaaaaaattttttcaaaaatttttcattggaatttccatataaaaaaattctaagaattttttcttgaaaatttccaaattttttaaaaaaaatttttggcgaaattatgtcccggcgaaatttcggcggcgaaattatgtcccggcgaaatttcggccggcgaaattccgtccggcgaaatttcggcggcgtaatttcggcggcgaaatttcggcggcgaaattttggggtgcacccacaacaaagcaataccaataaatcaaacccacacatttcgaaatgcacttaatttacactcacattcaccaaatattcatgcatatcatccttttcattttgttttttcttccattttgttcccttttttgtttcccatttccaaattacggaattttaatatttaattaatttcccttaaatttgtttgtacgtatttttgtatttcatagtaacaatttagtgaataaaaatgtaattattatcagttttgaaatggaattccccaccttttccgtgctttcccaacactccgaaagagaaggactcgtcgatgaaaatgcgcactttgtgtcgccatttcagctcgatcagtttgggcagtgggcaaatgtcgcccgaatttgtgtaaattccttcgacaacgatcaaacggcgaatggacgctttccttttcggattctgcgaaaatggctttttgctgaattctacagaacaaattcttacaagtataaaaaatttaaatgggtttgctaaacaatctaatccgatataataatccgaattttggtgcggctcaattggggagggccgtcgcgcggaatgcattccctcggcaattcttttgtttcccctttcccgttctccccaccattttgtctttctcctccaactcgaccattttgcgctccaagtccgccatgtcattgtgttcaaaccataaaatgtcacttctcgacgccatcagtccggattgtatggcgaaattaacacctaaaaacatggcttttattttccatggccaacaaatgattgggcgactcccggggacctttgtccgcaaaaatgacatcgcccctccttgaataagctgggatggcacttgcgatggtggggaatccgtagctgtacagaatggcctcttcacagcccatgaactgtcaatttgaatgacaattacggtatgacaatacagtgtgaaagtgccgccaaaacgaactatctgcaaatttttgctttgtccctacctcagccaattccctttccaagtccaaatgtacgtccaccgttccgtagaaattcctgggcccgcatgagcccacgccgtatttgaaaatggcatttttggctacttcctatgaaatggaaagcaaaacaaaaatatttttaaataagccatgtatgaacaacaaacttcaattttctggtttccgataaagccgaaaaaatcagtcgacgccaaattgacgcatcgtttgtcatcgatgacaacaaatttgcccattcgcctgtatttggtttgtatccgtgataccggtccaaacaattcaaatgaaaatcgaacccttcaattgaacggggccgataattcgggtcgttttgttccctttccgagtaaagcggcaccaacggactcggctcccaattcgcaataaccgcttccttttcctgcacacaaaaaccaatctttgccagcagagaatggccgtttttaatcgaattcaaatggcacttgggtaatcgcttttttttttgttttgttgaatttatgggttttttcgacgccaaaatttctgtcgccgtcccatcgttctttccctcacctcttcgctcagttccgcttttttcccctttttctttcgcttccctcccatcattttaaagcgccaacacatgcaaatggtcaaaacagttgcgaccagtaaaggccagctgcgaattgtcaaggcgaaaacgcagagcaaaacggaggatgccatgccaaaggaacgcaccgtttgggtgagagggggcgccatcggagaggcgaaatcggacagaatgcaaaccaaaaatatattaacattatcaaacattgcttattgttagtgtacaaaataacaaatacaattcgcagtcgacgaattaaataaaatccttggaaaatatttattagtctgtttaatgagcaaatcgttctgtccaaatccttgccgctttgttgaattcttccggctgttgctggtactgttcgccaattaacggaaccaacgaattgtatgggtcgcaattgcataggagagaaattatagactaaattaaaaaaatgatagcaaattattttataaaagggaaaacctgaagaacggtggccacgccaaaggagggtcgccacgattgtcgactgatcacctgcagacgcatctttccttgactgaatggaattaggttagaaattcccactttaaaaattggattttcccagcgtcggtcccttcaattcaaactatcaaaaatccatctctctatcatcaaaccgcactaattaaaatttgaattctttggcaattataattttctcactttgaaatattgcagtggtaaacccgcgtcaaaaagaccacttccggcgcatcgaatggataatttttgttgaagttcagctcaacaaaaaaggtccctccctcataaaccgtttcttttggcccttcgatcactgcgatccattggaaaatgttctcactgtttggggacgcctgacaacttatacctaacattacacagaacagtatagtaattcattcatgatattttagaataatttattgtatagaacttacccctgtaatggcaattgactcaattgtttgaattcggcgtgcagtctttgggcagcaattgagtaatcgtcaacaaaagaggggaataaacgtgcaatgtcaacaagcgaagatgaagccattttaaattcaaccaacaaaactgaaaaataagacatatatattttttagagctcggcctggacctggatccaggcctggatttttcctggatccaggtccaggtccaggtcatttttcggcaacctggattttcctggatttttgtccaggaaatccaggtccaggtccaatgtgaaaaaaatccaggtccaggtccaggcaaaacacgaaaaacctggattttcctggacaaaattttagaatttattatttcaagtgaccgatgtttttttttaattttcaaaaaaagattaaattaatttaaaaatacattattattattaagtagatatttttagatgtttctaggcaattaattaattttttcaaacctttttttgatttttaagatgagtttcaaaaaatccaggtccaggcctggatccaggtctcgaagagcctggatttttcctggacctggattttcctggatttttgtccaggaaatccaggtccaggttcaacatggaatccaggtccaggtccaggtccaggcttttttcaaaataccgagctctaatatttttattaggattgtgcccgggcatgatccttgatcagaccgaggatgactaaagtggggaacccaggaaacggagattcgtaaatttgcttcgaaaaagattcttttcaaaaacttttttttagatatcaatttgttcggctttgttgggatgaatcgagttatga

SEQ ID NO: 3733 - DNA, 2113 bp, Heterodera glycines
aaattttaataattttatatatgtgttaatactaaatattaatcttgagttattttgttgaaagaaaaggtttgggacgatagcacccggccggtctgctttccgagcacgatataaatctaaaattatttaatttttaaaatatacaatactcagttttaacaataaatttttttgtcgagtgataagacactcataaaaatatttgagttcgaaaaagtttaggatctcgaataattttgttgttgtaataaaaacaaaatatttcgaaatttaataaaccaaaatattatggctaaaagaaatttaattcatacaaaaataaaattattttaaaacaaaatggaaataaaatacgaatatgttaaaactcagcttgaatttataaaaatgaaaaaaataataacgtgcttaacataaaatatatcaaaaactataaaattaaataaattttggagataatttgaatctttgattccacccaaaattacaaaaagttgaagcaacaataatgaattaaatttaaaaacatcatttatttgaagatattcaaaatgataagtggcgcaacatgatattagatgtaaaaaattgtgtaatcgcattaaaaacactacaagacaaataatacaaactaatagaaactaaacgatgtttttaaaataaatttttttatatattttcttaataaagaattttaaaagctttaagctttatgaaagacattcgacaacaccgatattttgaaagaaatataaactgggtactaattacattaattagttttatttcagatctgtagtgaaaattataagcttaaaataactcacctactatagattttaatattataatttttaaaatgtcttttcattaattctaggttttctataaatctagaaaatggaacaatcgcagataaatactgctgaaaaatcgcccatagacgaataaaacaattaaaatttatgcaagtttgggacggggaatttagctgaggtttaaaatttaaaatttctgagaagaaaaatcagcatgaattgtggtcttttccattgtttcagattcagccaaaggagtggccaaaggtgtaaaaaatcgattcaaaattttgtaactgcaatttgtttataattgtgaaaaaagggtgcgaattgaactaaatgtccattagtaaaagtttaaatagctttttatcatatattgttttgaaaatttgtatatttttaaaggtttgataaaattaatgacgaatttcaaaagagccttttttctataattttggtctagtagaatggtaaatgcaattttttcagttgataatattttcattttttttgtgttacactgtgttgcattagaatagggacaccctattttttgggagtttgaccgcttcccatgaaccaatttcacagtgacatcaatagccaatttcagtttatcctcattttggttatacaatcctttgcttgggtccaacaattccttaattatgaacatttaaatttaaaaggcaaattaattgttttgaattgacacccaccgcaaatgaaacgaaattagggaatctcatgctgatctctttattgttaaaagtttcttcgttagcaatttgtctcttataatcttccatgcagcttttttgagacataatttgaaatgttgctgaacatttgcaactccaatttttgtctaaaaataaattagacaattttacttactaggttataccatgaaaatttatcagttttttatgatcaactattaaatgattcagcgaaattgcgaggttaattaaccggccgccaaaaagcttttaaatcatatgacccgggaattgcgggcttccggcgggttacgagaagagacgaccgagctgctaaattaaagtggtgctatctaatcgattaatgcctatagatgcaatgtttcagatcaaaaaaatgctcatagattagaaaggaggaaatggcccaaaaatggctattaataaaaaataatttcccattttatttccaccagctaaattttgttttttattaataaaataacttcctttcgaaaattattaattgttggacatacatctaataacaccttaatctatttt

SEQ ID NO: 3734 - DNA, 2967 bp, Heterodera glycines
aaaatttatgcataaaaattcaaaataaaattataagactattaatatcgtgataaaaattaaacatttgatgtgattttgcaaacaagaataatattataaaaatattaatacaaatttttatattcaataacatttattttaacaaaataatctcaaaaatatgactatatattttaaataaatcaattgaatatttttcttcaaaaaatgaatgaaattataaaattcacataactgaataagtataaataaaaggcaagaaaaatcaagagattaaataataataaattaacttaaaactcgaactaaattattttaagataaaactttgaacctaagattgctttatttattgttttataaataaaattatcttatctaaataatatcacaaagcctgactataaaaacaaaaagaaaaaaatatacatcaatcagaaaataatcatattataaattgagagaacatataaaagtaaggaaaaagaaaattgtgatcattctcacaattcagaagatatccattccgattgccttttttccatctctgaatattttttattcacaaccgttctctctcctttgaaggacaaataaacagctctttgtcaacggcacaattgcatttgaagtctgtaaagtggtcaaaattatacaataacaaagggtataataagggttggatcacaatgacccggcctaaatatacttttgttatatcaaaatactttaaaataaaaatataattaaatatccgtttttgaaaagtataacgaatacaaattaatacttattgttagtttaaataattatcacaaattaaaaaattaaaaagaaaaattaagaatttttcatttggtttactgaatgaaaaatgcctgaaaagagaaatgaaattatatctatactaataatagtattaagaaaatttaaaaattaaataaattaggctacacttaaataaaaatattccaaaaattgcagaaaaataaccggctaataaccgatttattatttacaaattttttcagccaaattcaaaaattcaataactccgtaatttatgcaatttttaatagtcctttttttatttgtcatgtcttctctttcatttaatacaccgtttcactttttctttgcttgtttgattttttttcagccgtttttcctgaccattccaaaattggaaattggcccgctaatttttctcgaattttttatggtctcatataacaaaaacgaatgtcttatatataatttagaccgttcgaatacaaacatggctatctttgctacttaaacttgtgcttatcaactctaactccttaaatactttcacacttggattgatctgtttcctgataattattaaaattaaataatatgaaaccatgagtattataaataaatattgatctagctacagatgaattcatggacagtcaatcaaaacacagattttaataagattaacacgcaaattagaaattacatgagtcatgagaaattgcttatgaggtaccaattttttttatagattatctcacaagattttcaattaacaattgttttattgtggaatgcatttaaggaataataaggtaaatattttatattatgctttttaacttttacataaaatttgtgatcctatgacttaaaaaatgacattaaatgatctaattgttcttcaattgcaaattaatattattcgaataaaataagaccctctggtccaaagtcagcttataaaataagactgccgcgcaagcgctcaccaatagatgtctaaattccatgattaattaaaaaattaaaaaatatattattacaaaatgcataaatttcgaaaatgcttgttatatttaataaataaaattcacatagatttaaacatttcaaaaattagatataagataaaaccaaaaaattcataaaatgtaatctagaaatatcaaataattcatagattaaatattttttaataaaatgttatgtcaactaaatatatcattaacaaaatttcgaagaacaatgataaatcataaattaagaatttcttagattatatgctaaacatacacgccttcaaaagtccaaatcctgatacttcgcgaaaaccaaatgaactaggtcatatgaaagcaatagaaattaaacataagtaagaaagttttatgttattataggctaatacctttataaatagtaaaataaaaaaaattcatttattttgaaaaaaattaaaaaattcaccgagaaaaaaaacacacttaaaattgaagaaaaacaatttgatttttttaaatcaatagttaaactttttttatttatattacttttttggagttaattgttttttttatttttataattttgattctaatttttaagctttttagttttttttctttctcttagggtttgttcacaattttttttttaattttttttaaaacaaaaaaaactataaaataaaaattaaaaaaaatatatcattttttatataaaaaaaactaaaaaataaaacaaatattctttatctattgatttcgagaaaaaataaagttttatatcaaaacaatgaataaatggttttttgtttttaactaaatttatataaccgatcttataaatgcttaactttggtgaaaattctatttgaataagaatgaaagacaatagggcattgttctaaaatactaaataaagcaagttttttaatctcctattaattccatttttcaaatatgaataaatattttaaagaattaatctttgtaaaatataaaataattactataaattttaatttaaatcgattctattaataatgaaaaaagggaatgaaaataatcttcgtgaattaaacaaatttaatatttcaatatatagacaaaacaaataaaatgaattaacttttatatgttacatgaaaaatttacaattataaaatttataaaa

SEQ ID NO: 3735 - DNA, 4563 bp, Heterodera glycines
tgagcagaagggcaccgatcgggaagtatgcgtccttttttgctggacttgagccaccgcggaaagctaagaaataccaagcggctgatgagcgcctcttcaatttggttctcaattacatcccggtgaacccgaacaatgaaaatgatcacaattaccacataaatccaaattttcatattattttagaatttctccgtggaatttcgcgcaattatcatatgaacccgtaaattgtttccatttcttcattttgttaagtttattatatttaacgaaaaatttcattttttgtttccatttcttcattttgttaaatttattatatttaacgaaaaatttcattttttgtttccatttcttcattttgttaattattatatttaacgaaaaatttcattttttataatttttacaatttcttcctgccttttttttcatttttggcttggcgccaaaacgtcggcgccaaaacgaccctggcgccaaaacgtcggcgccaaaacgtcggcgccaaatcgtcggcgccaaaacatcggcgccaaaacgacctggtcccgaatacagacccccaggcagtcacagtcggggatttgaatccaggagagattagaaggagcaatcattttattattgttgttaattgtacaaatgaagaatgagcccccaaacttacaaaaaagcataatccgataacatctgaaccattggccgacaaacaaccattgttccggaaatctaataatagaaaaggtcattttatttgggagtacagctacgtgagagagggagagaagttagagatagtcagtgggaggatgagagttcagggacagaagagaacagttagagatgaaatgagatagtgaaggatgtaagaagagagcagtcagtgggcgcgtgagagagtacagatgtgtaagagagcagtcaaagatgaaatgagagagtgcaagatggaagagtgcagtcagtgatgagatgagagagtgcagaatgggagagagcagtctgtgggcgggtgagagagtacagatgtgcaagagagcagtcagagatgagatgagagagtgcaggatgggagagagcagtctgtgggcgggtgagagagtacagatgcgtaagagaataattagagacagtgagttgactgaaagacattagggcatttgtttttttaatataaatggtcttatataattgttataattatattcattatgttttgaatttacctaagcaatgactctaatgtaatttatgtattttattaataaggaattatcatttcagaaattatatataaaaaagcgaaaagcgtaaatttgccaacaaattatttttgttttgttcagatcgttaatattcacacccaatccttttaatattttaataacaaaagaaaattgttctaaaatactaaataaagcaagttttttaatctcctattaattccatttttcaaatatgaataaatattttaaagaattaatctttgtaaaatataaataattactataaattttaaattaaaatctattctattaataatgaaaaaagtggaatgaaaataatcttcgtgaattaaaacaaatttaaatatttaaaatataatagacaaaacagaataaattgaattaacttttatatgttacatgaaaaatttacaattataaaatttataaaataatgaaaaagtcttgaaatattaataaaaatatatattttttggaataaatataaaaataaactttaacctatactctcatgaactattatttactcataaaaaataatattatttaatgaatgaaaaaacaaatacacatcgatggggttgggaattatatgtgatataaaatcgcaaaatatggacaaaaaatcgcgaaatatggacataaaatgggaaaataccaatttttcgaaaatctaattaatcaaacattttcgacataattttactaaaatgactttttcggaaaattttccagtttttaaaggtcaaaaaggccaatttatctgatgggggccattctaatagaggttttttggaaaaatgccataatatggacataaaatatgggcttaaatgccaaaatattacaaatatggaaatatggacataaatcgcgaaatttggaaaaatatggatatagaaatccatcctggaagcttcaacccaagttaaaaacgtttttcatgcgtttcaggcctcccacagtccagaaaaaatatggatttccatataattctcaaccctactcatcgagcgatgtttataattttttttcatttaattgcttttttgtaaagtctctatacatttctatcaacattgtaaaattaaaagcaaattttatcagcagcaaataattgataaaatatgcattacatttatatctgtaaatttaattaaaaactcactttacgtatgggtaaagagatgtgaagtcgtagtaagagatcttctctcccggcccagccctgcgcagcaatttcattggcccagtccgtcctcccataaacgcatcccgtatcaccaacggaccgtcgtccacgtaattggcaaagcatttccgcattgcttttcttctggccagcatttccgtaattcagcattcccagtacacatccacgcgattgcaatatcttctgatgtactccatcctcttgccgtctcgctcccgcacttgtcccgccgtttttccattgggaagcaccatgttgtcatttgggcaacatttcttacatccgtgccacgttgtcgaagcgaccaccaaattgtgaataggcataagtttcgtatttctttggcagtttgtagacgagccaatccacaaatgcctccattgggttttcgcccactatttgtttgtcaacaacagtgcccgtaaaacggagctggcagaaagcgaccacgcgatgcggaccacagatttgacagcctgcagtccctcttctccaattgccgttttcaatacagccggggcaagcaattcgagcagcgatgaagtttggctgatgttcttttttccggctggagcgggtccaatgcctggtgttgcattgtctccaagtcgaacaccacaatacgataagggtcaatttccctgggctcaattagttgaatataaaagatctgcattttttaaattcttcattttctccgagattttcatgtggttttaattcattttgcatttattaatttaaattttaatcggagaataaaaaaataaaacttgagaagctatttaaattatctcaaagaaaaagataatatatattcttgtaataactctaatttattgactttcttaaattttattttaaatgtttaaataatcaagttatatttgaatttttcacaatttattactgtgcgcatttaaactgtatatttttattttaaagataaataaatacctttggaactttacattttaatattaaaatataactacaatcaatttcataaaaaaacgttttatttttaatacctttggaactaaattttattaaattcttcttgcaattttccaaaaagaaaaatcgccgaattgcagcaaaaaagattttaaagaaaagaaactaataaataccattaaaaaatattttatagtataaaattggacttaaaatattgtgtaaaaattataattatttaaaaaataataattataagtatccttattttaataatagaaaatttaaagaattttgactatttaatttaaataaattacagtaataatctaattgaaaatctttaccatacaaaaaatgcggcaaaatgttaaaacctaaatggataaaataataaaaacagtttaattaaaaaggaatttgacgcgaacttttgacggaaaaactagtatttaagggattgtgttttgcggaaattttcagattcaacaaccacgcgctaagtaatatacatattccaaattataaaaaattgatgataactaataaaatgtaaatttagttgacaatacattttattattttgataattataaattcttcataaaattaaatacccgaaaaaatattatataatcaaaaaatcattataataatagatggatattagtagattaaatcgactaccaaggaatcatttagaatataaaactattatataagaactaattttactcttgcgaataagatgtttgctaatcaaaaaaaaactttttgaactatatatttaattaaaaaactaagagatataccgtgcaaaataagagtaaaatactgcagagtttatgaccaaatttaaaaaacatatacatttcagagtaaaagacaattttaatctggaatcaatctgaaaaactaaaaatttaaattacaaaaaatcaccaaattccaaaacaaatattagttaaaatttaaatttttaaaatagcatatatagaattttaaaacgaatgattattaaaaagtattttaaaaaatcacataaagtatatattattacaatcttaaacgattgagattagcaataaatttttaaagtttcttaaattttaatatgaatttataaataatattgtt

SEQ ID NO: 3736 - DNA, 4812 bp, Heterodera glycines
ttactgaacattttaagacagggttcttcttgcccagttcaaaggattcaagacagattggacattcttcagcttccttattgttattttgaaccgataatttatcgagggctcttgatacttaaattttaattttggcactttaatttctaatttgtatcatggcatttgacataatttcgccatctatgtattgcattggaacattctaacccaaattatatttgatcagaaatatggaatttcgtaaccttcttcacgaatttctcatctcttttgacttacttttcgaatcctcgtccaatttgagtgtcgtaacaattgcatttgacaaattggtaatgggcattatcacgaaaacaaagaagcaaaggataaaaccgttaaagcatttgccaaggtcgcgtttcttccgtcttttcggcttcatctgctgctggtcttaaaattaatttaattttttataaattaattcatttgaccatttttgttgtcaatcgctgtacgcaaaagttgcaacatttgctccattcttttggcggatttgtccggattttctttaccaaaattgcccccttttttgtcatttgccatcttttcctctctgtacaatttgattaagcttgccaaaatttgcaaattgctcatattttgcagcggcataattttttccgatggaattccttttcgcagtgccaaaacatcaatgacaaattgcaaatattccttcatattgtcagaatattggcctaaaagatgcaaatttaaaaatgcaaaaaataccttttcaattgcctcctttcatttccttgatgattaattgcagttttcgcattattcggcccaataaagggtctttttcttttattgccttaatcttcaggtatttctcttcgttcgcttctgttttttcttcctttcgatcagacatttttttgttcttcttaatggaattttggcaatcattaaaaagggctctctaattatttttattaatcattttaccaaatctaagcgctttggatctataataattgttttccctcatcccttttcagatattcaagtggtgttttgtatttattttattgttttttaaattttaccatatataatatatatatatatatatatatatatatatatattttaattttgcctgaatttggtgtgcattttgctgttgcggttcgaacacttcttcaatcagatgctgattttctctcatttttttgaagtgttgctaataccttgacttttattgctgctgcccgctccattgaccaaaatgaatgaacaattggctaagaaaaaccgcagaagagatggtgcgaaaaataattccataaatcagacagaatttctaagagaaaattaaaagctaaataaaatttagctcttaagaaaagcgaaaaattactttattaacttggataattatatataaaagaattttttaaagaaaaatcatgcaataaatctatatccattcaatttataatgagaaatgtagcgttgtcctatgggcattttgcaacgtacgcttggatgctatattggattctaaaaatataatttatattaaatatttaaatttaattattagtattcactcatatttgtagaataaataaatccataacctttgctcgaagtttatcaatttaaacaatcttaatatcgaaagatagctctagttcctcattaccatgtaaagttataaaaaaaaatgtattaaaaatttaacaaattactaaaaagattcttaaaacttaaatccccattttgccttttggcattttgtgccggaaagatttttggatttcttagcggaatacaataaaatgtaaaattggcatttctctgccgatttgctgttgggaaatttattaaaaaaagatttcaaaaaacccgaattttttgctctctttgattttgaaaaaaactatcgaattttccttattatttttaccttatttaagtgaattctaaaattatcaatccttattttgattaagttaaccaaagagaaaaaatgcattaaaaattgactatttaattgctttcaaatggacccctttcgcttacgaccataccacgttgaaaacacgccatcccgtccgatctggcaagttaagcaacgttgggccttcttagtacttggaacggagacgtcctgggaatcgaaggtgttgtaagcttttttcttttttcttcttttttcatttttattttttgttttgtaagaaaatgaattattttttgtttgtttttgttaaattattcatttgcttgaaattacttcttcctataactttgtggcttaaaaatctcttcttatttttaataatatttatttgttgcctatggaagtcgaaaatttaataaaaatttaaatcgctttgagaaagaaaaatagaatttgctgaacaaaaaatgtgaaatgaaaagtgaacaaattttaaaagaattttcttttaccctaagggccaaaagaatctttttaaattcgaaagaacagctataaaagtcaggctaaacatttgaatttaacttttttttaattcattaaattttccaatttaggcccatcatttttaaatgtcattcgctttatgttttttatcgtcataagcttgaaaaaacatttttagtttggttttgaactattaggatgaatttttcgtcccaattttgcctatttgtgcattttgtgccgaaattgtttttttttttggttttttatcggaataaaaaaaatggcaccttaaaaaagagtgacttaaaccactaagaacggaggatacttgtcttaaaaattgacaattaaaattaattttcttaacctattttctgattctctagcttttttagtcatttgaaaattcaaattttcgaaaaattacgtataggaaaaggcttatgtataggttttaaagagaatttgtgaagaaagtcaaaaaatgttatcaatttttctaaagacttgcgaatttggaaataattttgttaaaaaaaattccaaatttttcgctgattcattgaaaactaataaatttttctctttcaattctaaataccttatcaattattgttctgggttaaattaatcaaaaaagaaaaatggattataaaaaagactatttaattgctttcaaatggagcactttcgcttacgaccataccacgttgaaagcacgccatcccgtccgatctggcaagttaagcaacgttgggccttcttagtacttggaacggagacgtcctgggaatcgaaggtgttgtaagcttttttcttttttcttcttttttcatttttattttttgttttgtaagaaaatgaattattttttgtttgtttttgttaaattattcatttgcttgaaattacttcttcctataactttgtggcttgttaaaaatctcttcttatttttaataatatttatttgttgcctatggaagtcgaaaatttaataaaaatttaaatcgctttgagaaagaaaaatagaatttgctgaacaaaaaatgtgaaatgaaaagtgaacaaattttaaaagaattttcttttaccctaagggccaaaagaatctttttaaattcgaaagaacagctataaaaagtcaggctaaacatttgaatttaactttttttaaattcattaaattttccaatttaggcccatcatttttaaatgtcattcgctttatgttttttatcgtcataagcttgaaaaaacatttttagtttggttctgaactattaggatgaatttttcgtcccaattttgcctatatgtgcattttgtgccgaaattgtttttttttttggttttttatcggaataaaaaaaatggcaccttaaaaaagagtgacttaaaccactaagaacggaggatacttgtcttaaaaattgacaattaaaattaatttttcttaacctattttctgattctctagcttttctagtcatttgaaaattcaaattttcgaaaaattacgtattaattttcaaaatcaaatttttctgaaatgtttaatgtgaattaaaaaatttaatggaaaattttatctataataaaaaaagttattttttttaaattagtgaaatatttataacaatcaaagaacgaactccacaattaggttattccattccgtcactcatcattcagttcaatgtttgtgtgagccggtcaatccgggcatggaaatcacactgtccgtactaggcacatttcgttgggagtggtctccttgaattgtacgggataattaattaatgagatcttctctaattgtttttacccttggggccatcgatgggcacttttccaatgctaatgccaaactctgcacatttcgagtcaatttcagtgactttctgaccaaactgtgtactcaatgcctgccattcgctgttgttgctggcatgggaagaagcggaggcggcaatggcgaacatggcacggacgaagccgaggctgtgggcacactcatcaaaaaggggaaaaacataaaaatatttaaaataaataataattattggtaaatgatccattaatttgatccattccccacttattaccagcagaatgactggcaagagatgcttcgatgtcggccaaaagagttcgatcgccgccattcgagcagccgatcagttggcctttcaacgcgtccgcaacattttgggcatccgaacaaagcgatgacttggaaatggaattggcaaaagtgccaacgtaattggacataagtgaaaccactttttgactgccgggacagcacggatctgtcctaaaacaacaaa

SEQ ID NO: 3737 - DNA, 2604 bp, Heterodera glycines
caattaatgggacaattggcctaataattatttatttatttttatatcattttaaatatctcttccccctttttgatgagtgtgcccacagcctcggcttcgtccgtgccatgttcgccattgccgcttccgcttcttcccatgccagcaacaacagcgaatggcaggcattgagtacacagtttggtcagaaagtcactgagattgactcgaaatgtgcagagtttggcattagcattggaaaagtgcccatcgatggccccaagggtaaaaacaattagagaagatctcattaattaattatcccgtacaattcaaggagaccactcccaacgaaatgtgcctagtacggacagtgtgatttccatgcccggattgaccggctcacacaaacattgaactgaatgatgagtgacggaatggaataaactaattgtggagttcgttctttgattgttatccagcaattaattagctgttgtatttttaaattagtaacaaaataaatatttaattttacttttcaaaattatcttatcttaattcttctttaatacaataaaactcacctttgccctttcggtcgcccacattttaacatttgtcgcctcattctctttccctctcttagggaaatgaatcatttaaaatgggacaacgcattgaaatgagagctaaagcattttgaaatgcatttacctgttaatgtgtgcaaatacatgacattttttaatgttaattttgtatttagtgcagctgagacggaattttgtaaatttgtaaaagttttttttaaaaaactgaaattatagcagaaatcttatgaataaatctgattgtttgttaaatgttttgttcatcaaaatgctcgtttttcattttttattacaaaattttatatttttccattaatattttgggtgtaataattaattttgaattttataattcgagccttactttactattatattatccaccatcacatagcaaatgctacaatttgcacttctgctgctctttatggtgctaattattttttaaaaatatagtagggtaatttaatcaaataattgtccgatttaataggtgtcatcatttgatccctccgctgaatttatggccaatgaccaaattagtgcggtgcaacagcagcaagtgaattcaaaagattcaacttttgagtttaattatgctttttttcccattttaaggctgtaaaaccaattgttggctggcatttttggtgggacggacgaaatcgaaattggatagcaaaaaatgcggaaaatgttgaaaaataaaagaaagcaaaggaacaatcgaaaatggacagaaaataaatggcgaaacattttataaaaatggcagagataagtgaatttttgtggctttcttggaaaacgacgaaagattggataaatacatatatttgttgctttttaatgattagtgcacggagttgtagacaaacttaaaaatgaaccatttttaatacaattatttagagaccggacgggcccgggggcccggcgggcttttgccgggcccccgggcccggtcccgtttttttttggaaaaaaacgggcccgggacgcccggtaaaacgggctttttttgaacgggcggcccgccccggtcaattttcgaagcccggtcccgggcccggtcaatttgaccgggctaaaacgggcttaaatttcaccagcgaaactgcccaaaacttgaaaaaattaattatttatttatggcgaaatgtctttaattcaaaatttcaagataaaactttggatttttgaaaaattaatgattatcgacgttcgagattaaagccgaaaaccgcagaaatgttgatatttttgaacaaggccatcccaatgttggactacaaatactgatttaattttgttggatgataaaaagttcataaaattttccataaaattttggtttagaacaaagaaaaggaattacgcaatttttttatatttataaatgcatttttaaaatttgaaaaaagcccggtcccgtacgggcgcccggtcaaaattttggaccgggcccgggacgcccggtaaaacgggctttttttgaacgggcggcccgccccggtcaattttcgaagcccggtcccgggcccggtcccggtactttcaaaattccggtctctagtaattatacgtggataattgaatatgaatgagagaaacgacagatggaggggaggggtgaaaaagagggagagaacaaaagtgagacgagagagagagagagaaacaaaaatgaggcgagagagacaaagtgaagtagagtaggtggagaagcgtaatggagaaaaatttaaatttcattcggcaggcgaaatgtaaaaaccctccgagagcagtccagaaaaaacaacaacaacaacaacagttgcaattgatgcagaacggtgggccggatgcttatgagctgaaagaagtttttggctattataacaatggatgccatgaagcgtactatgtgtcgtggctcagtgagtccaatttgaaaatgattaaaatggagcggtggaggggggggggggggttggaggaaggggtagttgaaattttaaaattt

SEQ ID NO: 3738 - DNA, 878 bp, Heterodera glycines
gtccatcccgacccgaatcgagcaaaagttgaaaatcaattttccattttttattttggtctagaaatggtgaaatgattttttattggtgaattgtccaattttagttgctttctcgatattaagccatttttaaaccaaaaataaaaaattagaaagtttaattttcgactttttgctcgaattcttgtttggggttatatatatagatcaaaattaatgccatattcggattctccgacccttaaaacccttaatatgatcttttctcgaaaaaaattttcaaaaattttgtttttcgaaaaaggggcgggggtaccatccgtacttattacctttgaatgttgccaccgttggaatggcaaagaatttcgcgcccgctactctgttgaagcttggccaattgccagttaaagttaattacaattagtaattttattataattttttttatttattctttagttgattgcgtcaaaaaatgcggactccgaaaattacagaaaatggttcaaaagcactcaaaaattttaattgcttacaacttctttaaacttaatttgccgatgatgttaaattatattatgcccatgaaaatgatgaccattcgaatcagttggataaagcaattgaggctttggaaaaatggtcaaaaataaatgggttagaaatttcaactgaaaaatgttttgttttatatttagggaaaaataatatgaaaaaagaatattttattaactcacaaagaatttcagaatcggataatgttcgtgacttgggaattataattgactcgaaactgaatttttcagaacatattagaaaaattgtacgaaatgcatatcttagaattttccgaaatttcgagcagtgttgaa

SEQ ID NO: 3739 - DNA, 1603 bp, Heterodera glycines
ggaagggccgcgactaaccgggaccaaataagcactggtaagaatggggggtctgagtgaaaaatttttatttggcactttaaattcttggcaaaatgactataaattttcaaaattttcctgacagcgcctaatggcaccgcctgaccttacaaaaaaaaaattcttttttcaagtaaaagtcccggttggtccggtcccgatcgtaaatccagatcgcggtcccgacatgtcccggtcccggtttttccaagaattcccgaccccgctctactttaataaattataaaatactaattaatttatttggataactaattaacatcgatttattaaaaaaaacattttcaataattaccccctttatgtttcttattgctgtggcaacatctcttacagcaactttgtcctcgccatataaaataaattttttctttttaattttcattaaaacttctcgtatttgtttgtattcatgtgattcttttggcattgcttcaacaaatttttcaaattgtttaaaataatgatccgcctaaattttcaaacaaatttattattattttttcatttttttttggctgagtgatagataatatctaaaatttcaaaaatgttttccaatttctatgggatattaaaaaaaaattcatgacaatataggggaaggcagcccatagccagaaaaagatttcgtcggatgtgggaatccgaagcgctattttgttttttgattttcagaccaaatttttttttctttatatataaaaatttcagcaccggcccgaaaaacaggaggattttttgcggttttgcgccaaaaatgacaattttttgggaagggccgcgactaaccgggaccaaataagcactggtaagaatggggggtctgagtgaaaaatttttatttggcactttaaattcttggcaaaatgactataaattttcaaaattttcctgacagcgcctaatggcaccgcctgaccttacaaaaaaaaaattcttttttcaagtaaaagtcccggttggtccggtcccgatcgtaaatccagatcgcggtcccgacatgtcccggtcccggtttttccaagaattcccgaccccgctctactttaataaattataaaatactaattaatttatttggataactaattaacttcgatttattaaaaaaaacattttcaataattaccccctttatgtttcttattgctgtggcaacatctcttacagcaactttgtcctcgccatataaaataaattttttctttttaattttcattaaaacttctcgtatttgtttgtattcatgtgattcttttggcattgcttcaacaaatttttcaaattgtttaaaataatgatccgcctaaattttcaaacaaatttattattattttttcatttttttttggctgagtgatagataatatctaaaatttcaaaaatgttttccaatttctatgggatattaaaaaaaaattcatgacaatataggggaaggcagcccatagccagaaaaagatttcgtcggatgtgggaatccgaagcgctattttgttttttgattttcagaccaaattttttttttcttatatat

SEQ ID NO: 3740 - DNA, 3664 bp, Heterodera glycines
  misc_feature (46)..(46): n is a, c, g, or t
  misc_feature (3629)..(3629): n is a, c, g, or t
  misc_feature (3646)..(3646): n is a, c, g, or t
tccgccggtgccgatagcgggcgccgggaatattttttggaaactntaatggcatatgacaagaaaaagaagaaaattttcaaaaaatttgcccatttttgggcctgagtccaaatacaccaattattcccataatttacccacccaatcgtgatcaaatgtggcatcgccagttacccaaaggtcaatcaaaattttgcttttggcgcttagcaaaacataggcccaaaatgccataaatgtcatcttgtcctccatttctctgtaatgactgtactcttttgagttgaatgttcgtggactcatcatcagtgataagcgacgtggtgaagaagacttaattaattaatatttaaaaaaaataataatttttatttaaataattttataatatttgctttatcagtcttttaaaatctggtattaatttgttaaaaattgatttcttaagtgcataaatcgcattattaatattttcaaaaaaaaaatataattacaacaatacattttataaaatacgaatttttcgtaaaacttattaattttaaaaaagaaaaaggaaaaaagatttcacaatttttaaatctcattttgtaaaaattaataaaagatctttttcttcattaataaaaattaatttaatttaactagaaaaaatttaacttttattgaataagtgcttcctctcaacatttttgattaattggaataaaagaatttggcaatcaattaaaaaataccgcattgccagaattggttttcacatgatatggtgatagtttggcagctggtgattttaattgtggactttgttgtgccgatggcgtttgaaacgtctccgactaattatcaattttttaaatatttactttaattaagagtcattgaattaaaaatttatttatttcatttaaattattaataattttgttttaaacaaaccgaggatgcttcagaggatccgtcaacctaataaatttagtttactgtgtattataagtatttttgcaaacccaatgtttattgggtgatgatggcgccgagaacgaagcttggcgctaaattcaattttatttattaaaattaataatcaattaaaactttttaaaaaaaaaaaataatttactacgaattaaaatactaattgtttgttctacgtttatacattaatacaaaaatgaacctgaaatttctttttgtttcgcgccttcgactgaacatatttttaaaatgtaattaaacgatcaccacttttgaattgaatttgaaattatcaccttgctgccagcagatgttgcaggtaattcttgatttttctaaaattaaaatgaaaaaaaaacactcaataattcgtctaatcttaatacaatccccccccccccctttaggttgtttttccgcatcggatgggtcccccgtacaaaagggcgctcaaaacattggcagcagaactcacgcaaatgattatccaagacgatggtatgtttgaatatacaaataatttaaattcaattccattcgtctggaccaaaaaattattgaaaaatgaaatttttttaaaaattgcgctagggctgggaatatttgttttttttttaatatcctaaaatgataaaaaaaattaaatggcccttgatctcaaaataaaatcatttgaaaaattgtttaacaattactttttttaaaaattcataaataattttctggccagtttataccctagagaatttttcggtctttcttatttcccacttcggtaatatgttagttttttttaaagtccacatttaccgattttggcagtttgaggtagggttaagccccgactctcggggagcaaaatgtcggggaacggggaggaaattttcataaaaagtctaaaaaaacaaaaagaaaaagtccagaacaaaaaagtcttaaaaactcatttaaagatacttccatcttatttcaagtgcactttacgactttcgtaattccccgaaacctgtcggggcttaaccctagtttgaggttccaaaaaacacacagtaatggaatcctacattttttatttaaaaaatttaaaaaacgcatttttatttatttcttttttgctgtttagagtccggccacgacagcaaggaggacgcgttggcatgcatgcgcataatgttgcgcaagtgccggggtggtgccggtgcgccatgagcaaagaacggcggaaaaacaaattaatccaattctacgagaattggaaatctctgtgaattctgttggacccaaaaaataataatttgccaaatttattgtccgtttcatcatcgtctccctcccctcactcccgtctcatcaattctgcaaatttggcaataaaattctgtgtcctttgatcatcaccgcttctacccccttttttcatgcgttcactattttcacatcaccattttttttacaatttcacaaatatataattggttttgttctctcttacattttaatctttattgttgtcattcatgttcatcggggatggaattctgacgctccaaaaaatttaggaaatcggaattccgagcccttctccacaaaaaaaatataatcgagaattcattattccatcccagatttctctatcgtcaacagtaaataaactcgacaaaagtttaaacgtaaatgtcgtgcaaaatgattaatgtacagttattaggtgtcagtcaaaaatttgggttctcatctccaggcacatttttatttctgctctgttttttgctaaaatgaaaaggtaatgaaatgatttggtttttttgagagttaataaaacggcggcgcgcgtgtgcgtcataatgtcaagacaaattaaaacaaaataaaataaaaatttgaaaacgaacaaataaacaaacaaatggatggatggatggacatagaaatggagagagaggatgatgattaattaattatagcaattaattaattaattgctttttgcatcatcggctcttccttctcttcctcctccttcagcagcggcggcgggcggtggtgttttgatggtggtggcactgctaatgccgctgccgttgttgctgttgttcctggtcaacaatgcccaatgcaaactgtacacaaccagctcatacgtgccgatggtaaacgccgtgttgggcaccgatcggatcaacttgggggaacaaattgaataaatttcgtaaaaattgcactcccaattaaatttttgatttgtggttttgcgacgagtgcatttggcttattatttttttgcactctcgcactgaaattttttggagatttcttcaaaaatgcaataattgtttttttttgaaagaaacaatgtttccagcgatcgcactcccaagccccaaaatcctaaatccccgaggggccgcatgggcgtagtcagaccagctcccccagaaatgaaaaattaaaaaattgtcaagaaatgggcaaattttccccgacaaacgcctaacggcacggccggactttattgtagaattattttatgaaaaattgacgccccaaaatggaaaaattgatcatttttggcatagaatcactgcaaaattttttttatgtttttttagcagcgggttcgagtcagacctcctatatatcaattatantgggggtaaacgaattncaaaagtgttttttactg

SEQ ID NO: 3741 - DNA, 815 bp, Heterodera glycines
acctctaaaaaataaaaagtcaaaaaatataaaatgaaaaaatgagggaaggggggaaattcggggctgttcaagatttcgtaacaagaaaagaaaattttttgttaaaaaaacgaagttcgaaaaatgaaattccatcaaaccgtcctcgattttctacccccccccccaaaaaaaaaagaattcgcgaaatccgaattgggtttttaccatggggaatggcgcgggaagatactgctaccctcggtcgcaagaccaaaaaaatttcaaacaaaattttttaaacatttttagagaattgggcggcgaaattttgtcctattccgacttttccgcctaccatgtgggtagcacgtgaagccggccaccagcttggccgtcccgccggccaccatgaattgccaaatgttctgcccgtcctgtttgccgatgaatgtcactgatgggtcttggattttgctggaaaaatggggggagggggggggggggggggtggggatgattaatttataaaataattttttaaattagcattcgttaatgtccaagggtagaggaaaatgaaaatcaatgaggactgaatttttttttttattataataatcttgacctttggggaaaaatgagtggaattttgcacgtctatggggaaatttctgcaatataataaattttttttttcattttcgcaatttccaaacccttgttaaacttatgaagacactttgcggaattatgctcggaacagaagaaaatttgactctaaaatgttttttttcgattttaattatgtgtatataaaaaatggactctag

SEQ ID NO: 3742 - DNA, 2886 bp, Heterodera glycines
  misc_feature (2815)..(2815): n is a, c, g, or t
ccaaattgggttgattgcggtggcggtgaccagcgcttaaacaaaccatttggattttgggcacccaaaataggcaatcaaattttaaatttttttttcgaaacaagcggaatgaatataaaatcgaaaaaatgtttaaaaaaaacaaattcctagaccgcattgaggttcgaggcgaattcacaaatttttggcattgctaattttttttattattatttaatttttaaattttaccataaaatggcaaaattgtcaatttttggcgaaaaacggctaaatgtcctgcttttttttttgctgtcggcgctagatttttaaaataacaccgtaagaccgaattttttttcttttagaattttcgatctggagcaaaaaaagttttaggcatacctgcacaaaaaaagggggggggggtcgactaatcccgatctttgcccattttttcttgaaaatttgtaatttttcgtttcaaacacacaacagcaacacccacctgcactgccggctgacaacatgtgcacggaatgggagttggactgaatccattcagggtggtcgttcaggaaacgcttcatgcacgagtagcagccaaaatagacagccctggagggagagggggggggggggtttgaaaaattaaaacaataattttggaatgtcacacagaaattgtgtcaatatcacccaccaccatttgaataaacaaaaatgcacacagtagggagagaatgagggggtgggacccttgtattttttgtaagagaatttgatgaaaatttttttttatttccatcacaagaaaaatgtttgcctatgagccatatactcggattttttttaaatattcaaaaaataataaactttataagaacttcaaagaaaaaaaaattgaaaaaatttcagatttttcaaaattttatgatttttgaaaaaaattcttccaatcaaatatcgcaaaaaattttttctgttttttggaattttcaattaataaaattttttatgggggtaagggggaggaagtttaatgcacccaaaaaaaccagtttttttttgttggctcactttgacggcgccacaccgaccaaatttgggccaagccctttgtacagcgcgcgcaggcgcccctcccgccacacggagtgaaaggagcggaaaatgaccgattggtggagaagacgacggcacagcgcaaaacgggctaaaaaagagggcattttggggaaaaaaaaatttttttaggaataattttctcgaaaatgtaaaaaaaaccctagaaattgtcaaaaaataaaaaaatttaaaaaatcgcttgattttattttgcttatattaagtttaaaagaaatatctcaatttagttttttttccctgaaaaatcagaaaacattttttgtgccatttaaacaaatagaatttgaaaccgattttaaagtacacacaggtggcataaatccccggggcggatatatctaacaataagcacgcaaatttcataaaattttctaaaaaaacaaaaaatttcaatttgtccaaaccatgccaacaaaaagcatttcatttttgaaaaaaatgcactaaaaatctggagaaatttgtcatttacccttcaaatttagccaaacaaaaatttaaaaaaattctccgaaaacctgttgctgtgctgctcgacgctgccgtggttgctgtactggtcgaacttgttgtcgatgatgtccaccgctgcattcgttccagttgcacttgacgtcgcatttcgtgcccatgcgaactttgcagacgcgttttaaccacctaaaaaagcgaaattgaaaaaaaaaattgtttcaagaggcattgtggtcagaatttttcggccatgccccccaaaaaaaacggttccaaattttcaatggatcaattgtttttgttttttgagaaacccgtctctttattagcctttaaaatttgaaaaaatggtttcattaacagctagcattttgctcttatctttttctgttgaaattattttttttttcaaatttggtacggaaatacggactgggtcggttgggccccgccgattggccccggtacgattgggccccgccgattgggccccatagagcagtcactacatggacaagggggggggggtcagaataaaagttatattgtcacatgttattgtttgcgtgtttcattgcatatttgtaaatatatttggtttcatatttgttttctaatttttttatattttccaattcttgattgcctaactaaaataccattaattcagcttattatttaatatattaatatcacgatggaaaataatatcttatcgaagatgaaccacaaaaaacttgaacatgaaggtcatctttatgttttcttatcaaattttggaggtatgagaacaaaaacaataaggacatgaagtgccgagggcgaacattatggaatttttgattggtgtttctcgaaattaccagatggatgcttagaattttatgaataaatttttgggatgttaattaaatttttgacagtatgaaatggaaaatgtgacaggcccttggggcccaatcgacccccaccgcggaaataaacctattgttagcgttaccgattacgaccgaatttgtcattcggagactatgaacggatttaggtcccaaaaaagggatttgccctcccccccttccccacgcttttgataatactcgtcacccaaggcgaaatcctgggacatctctgccattttaattttcccctgacagccagcgcctattggcatgggcggaaccaattttttttttaatttgactcnaaaaatccacataaagatggataaaccctcagtgggacagtgattgctgtgcccgcagtgcccccgagagc

SEQ ID NO: 3743 - DNA, 4432 bp, Heterodera glycines
aggaaatgcgcgatttgcgtgcacctttggatctgctctttaagaaggacactccttggttttggggtcctgatcagcagaaggcttttgatcaggccaaacaggttcttcaatcggatttgttgctgacgcagtatgatccgagtttgccgatcattgtcgctgcggatgccagccaatgtggaatcggagccacgatcagccatgtgtttccaaacggagtggagcgcgtcatcgagcacgccagtcgaacgctcactcccgctgaacgaaattacgcccaaattgaacgtgaagctttgtctctgattttcgcggttcaaaaatttcacaggatgatttacggtcgtaattttactctgttaacggatcataagcctctcttggctatattcggtaataaaaatgggatcccgatctacacggcttcccgattgcagcgttgggccctaattttgtccaattatgattttacaataaaatatgttaaatccgctaattttggacaggccgacgttttgtctcgactgatttctgagcaccggacagacgaagaagtcattgtcgcccacacatcggacaacgacgtggacagcactgaagaagtcgaatatgctcttcttgtcaacttggagcagctgccagtcgatgcaaaagaagtgagcgaactgacgacttcggacgatttgttgcagcaggtggcacaattcgtacgttccgggtggccaaacaaatgcccagctaatgaattaatgcctttctattcgagacgtgatacgctcaccctcgtgggcggttcaattttgacaggaaaccgagtcattgttcctgcgccgcttcgtcaacgtgtactcaagacgttgcactttgctcatcctggcattgtgcgaatgaaggcgctggctcgcaaccatgtctttggcccggtcttgacagtgacattgaggcaatggtaaagcattgtgcggaatgtcaattcgccgccaaaatgccgccgaaagcgccacttcgaccatggccaattcctggtgaagtttttggacgtgtccatattgattttgcaggcccatgtgccgatggaaacatttatctcatcctcgtggatgcactttccaaatggcctgaagtgatgcagatgcgcacgacaacagccaagggcacaatcgaagctttaaatttggtatttcaccggtatggtgctccaaaagaaatagtgtctgacaacggaccaccatttacttcccatgaatttaaagacttttgcaggcttaaaggcattaagcacaagttctccccgccgtatcagccgcactgtaatggtcaagccgagcggatggtggacacattcaaacggcaggcaaagaaaaacgcaaaatccaaaaatcaacaatggatttcggaatttttgtttgcgtaccggtcctcgccgagtccaattttgaatggtttttcccccgcagaattatttttgggaagaacactccgcacgcccttgtcaatgcttgaaccgagacagcacacgccgaacgagaacaacaaccaacgtggacagtaccaatcgaggatgtcacagcagtacaaccgacatcatggcacaaaaagccgttcattcaattcaggagactcagtcttagtcttgaattatggtaggagtggtaagccatcatggttggaaggtaaaattgtgagaggtagtggtttgatttggaaaatcgaaattccaatccttggaattacagtaacgcgtcacgtcaatcaaatgcgttcattttccccttacatttcaagtaagattgtgtccgatcagattcaagccgctccgcaacaaccaattcctccaatggcgccaattcaaattgatcagacacctgtccgtgatcaaactcctgtccgtgaccgcacacccgaaccagtcaaatctcctcgtccgcagcgacagcgcaagaagccaattcgctattcgcccggctaattgccacggacggtctttccaaaagagggagatgttggatgtgttgatatttaatattattaagtttcgacacgaatacttttattgattagttatttgttgatgggtcctctcccatcgactcattcttcgcatttgtgttattttacatttcggtgtttatttttcggactttctaatttgactccgtcgttattttattattattttgtgattctaattttattgtttattcatttaataaatttatcttgtttgtgtgttagcaaaacacaacaacactgatgttgggattcagttggcgacaaaggcagcagctgaagaacattctcgtgaacatgctcgacgccgaaacagctgaaggaatggattttttgtcttcaacacatgaagtcaatgccctgcgccgacgtctgacaagtcacgctcgttttgaagtgcggcacagcgaaggaggaacaacactgatatgtacgaacatccgtcaggtgttggtgcaaagagtggaggcgttgcttggccaaggtgggagaactgattggaaccgtgcagagtaaagatttaaggacgaatgaaagaatttgagcaaaaattgtttgtgtcaattgttggagatcgaggatgtggaacaggcgacacgactagggcctgtactggaacagctctagcaaatcgctgatttgccatttggccgaaatttgacgattgaatggtcttataattttttgcattttttgcacattttttcttaaggtttttgcccggcgacatggctttcatctgcgcttggatgggacacatgggaccagcctccgttttcccttgtgcactgtgccgaattccatacaaagctttgggcaacaccatcatcgggcgaaggacagcaaagtcgatcgtcggtggcgccgcaatttttagtcaccgaacagcagacacgggcaagcacacaactcgggactcaatttcgtgtggaagtcagaaagacttgcctctctttttcgtgccgccaacaaatgtgatcccttcaccatttcacacgcttcacagtgccggacggaaatgcattgacttttttcaaaaaaatgggtgccccgcagaaaaacgccaattagaagaaattatggcaaaatcgggagcaattcggcatgccaagacgcaagagtatactggtcctgacattcccctctttctttttttcgaatcgattttaggcgaccacattaagcgcctacttctcgcctcaaccgaaatccgatcgattggaacacccttttcgatggatattgccgccctccttgacgaaattcgggagctccacgtttttggacgtgcggacctattgacaacagaacaaatcacagatttctcaaacaaatatctcggcattcatggctatttcaaggcaaaaaatttttttgcatttttctcacattccccttttaagaattgggagacctatccaactgcatttgacacaaacaatgccgctggattcacccccaaattgcattggcttctcgcccatggtccagactttgcaaagcgctgggggtggttcgcatggatcagtgaacagggcatcgaacaccttcaccacgttttgaacaagcaggttggacagactcaatttcacagttcaaaaacctattttttgttttagtctgagcgcttcatgcggtacaagggcgacgaactgctgctgaagatcggagaacatcagacattgctcaattctattttcgacagacaaaccggtttcctctgatcaacaattgttaggaatcattaattttattatccggttttgttaaaatattgttccttttaatatttttgataaaataaacctttcaaacacgaattatcaactaaaaattatgtttgattagatttgatcagttgggaataaaagatttttgaatttggcgccttcgtttcaatactcatttttttttataatgatacgcatttttattcaaaatgatgatatatgctgggctaaatttaaaaaggcattgaaaatgtttacatagtacaataaaattaaaatttgtcatttaaaaatgggaatgaaaattcaaagtccattagccattccggtaacttttttgaaaatcgcttcattcttcaacgccaaaatgaagcgtacccattccaatttgccactgaactggttcaaatgctcataattgacgttcaaaatgtgtatgatttgcatataggtgttgaaaagtttcttcaaacaaaaaaaaaatcggggaaaatcatgaaaattgggctgtttttttactaccgaaaaaacagttggttcgatgccgttgatcaactgttccgcattcatttcggggttctgtgccaacaattgtgtgacctgtaataagatgaatagaaagccaactatttttattttatttttttgctaactgcatgggcctgaaaaatttcggtctggcttggccc

SEQ ID NO: 3744 - DNA, 848 bp, Heterodera glycines
agtcggtagaagcaatcgaagaagcgaaagtgaaaagagctaagcaaaaattgttgtggctaaaaaacgggggggggggggggagaaaggctttttttaaaaaataattggaaatataaattatagcaatgtttgtgaaaaatggaccaatttttggctttttaaacccaaaaatggatttctcaaagtgccgttttctctcaataaatttgttaaaaattcaaaaaaaagtaaaatttccaaaatattcgttgaagaaatcatgcaaaaaacaaaaacacacacacacacacaaatcggcccttggaaatttgattttcacaaaattttttaattgagtaattttttttttaaatactattttctctcaacaaaatttgatgaaaattcaaaaaaaaagagaaataaatgtcccagtccaaaatatttgttaaagaaatcatcacgcaaaaaataaaatcatcccaaaaattggtgcccttgaaaatttgattattttttcataaaattttcaattaacacgatacaaataaataaataatttgcactgcacttcattgttggtgttgttgtcgaatggactgtccgttgcgaattggaaattgcttctcaaatagcgttgtccgctaattgtgaccaaaacggcagaaaatgagtgtttgttgaccatcactgttgcacgtcgttgcaattgttgcccgaattggtcacattcggtgcacagctaaaaaatttaatgcaaaatttttttacggttgtttctgatgtggccagccagccacaggcatagcctttggaaaatttttgttgagaattttttgggcgccataatatttcgaaaattcttt

SEQ ID NO: 3745 - DNA, 2805 bp, Heterodera glycines
ggccataaattttcggtttttttttgagtggagggcgggggggtgtttagtttttgaaaattaaaaaaaaatttttttcgggcgccgagattttgtcgcccccattagacagacaaatgacgaccaccaacttcgcatgagcggccaacaatttgttgcatttcccatttggtgcgcagctttgtgcggaaaatgaacgggcgaagtgccgccgtttgcagcggaattggcacgttgaaacaggcgacaatgttcgtggtcagcacgcgtttcaagtcccggaactgggtgtacgcgctgaagtagggatgttgtgctgcaaaaaatgtgttgtgtggaaaaatttttaggaaaattcaatcatttttttaaacacattagattgcatttaattgacaaatttcgtcgttttttttaatggtatcatcgcatcgagaaattttcgtgaaaaaataaccaaattttttggacatatttaatcaattttcttaactgaaacccaccaaatcgttgccccgattttgtctttttttttttttgaaaatatgactccaaaaaaatgacacaaaaatctgagaaatttttagggaaaagcataattttttttttgaattttcggttcttatcctttttttcacccccccccttaaatttttttttaaaataatttttctagggtaaatttatgcgttgaacacgtatatgacatttatttttagctcttatgttttttaggtgtgttacgtggaattttttaccagtcaactacagtatatcgtggtaataatgtactttgtcccctccaccccatttttcgaaaaaataaaaatttaaaaaagtcgtataaaacgccttccctggggctttgtgaggtcgctgatcacgaatctgacattcatttatattaattccgaatcctgaacccgaattcgaacaaaaattaaaatttaaaaaatttttcacattgccctaaaactgattaaaactagataaattagtcacaaatctggtcattctatacaggttctaacataaatgtaattctaaaaaaattcgaatttcgactttttgttcgagttcgggtccgggatgcggaattggccaaagctaatgttagattcgtgttcagcgccaaaattaccctagaaaaaaatatttttaaaacattttcagggggggggggtgacaaaaaggataaaaaccgaattttcctcgacggcgtcactaattcccttgtttgtttgattttttgttttcgaaaaccgctctcaaaatttgtctattcgtctccgttatacgaataaataaaaataaatccgtgaattttacgtcgattcttggcatagtgttggtcggcgttcgcgtcaaacactttaagcgcatggaaatagaggtaattgagcagcgtggtttccagctcctccttgtcatataccaagatgagctggacaaaaaaaaaaaaaaaattcccgaacccgccggagttctgacaaaatttgagaattttaaaggaattggtgtgccagggtgacgtgttatagcccaaattttcataaaaattttttgaaaactcacaatttttcgatggtaaaaacttaaattaaaaattttctttgaaaatgaagaaaaaattacccaaaataaaatttttttttttttatattatttttttccataaaggaccaaaaaatgtttggagaagggcgaacttttccccggatggacagacagcatcggcctaaagttttgcaattttgaccaaaaaatacgcaatttaaaatttttttttaaaattttgtcccatcaaataccaatttgttgttgttgttacctcattttgtaacaactttctgactattttgcaccgtctgcacgtgtgttgccggctgtacattaagaatttgcgcaacggatcgcaccgatatttgagacaggcgttgaagcacaacgtggactgtttccacttggccaaggcgtccaacgtgtgcaacattgtggcatttgaagtggactgaataaacacgcatgtgattttgaattttttttccaaaaaattttcgaaatctcactggaaaaaaattttttttttatttctatgtttgaatttttttaaaattttttcgggggggaaacgacatgggagaggggaataaacccacccaaatgaactccgaatttaaaattacatgaattgctttttctgaatggaaattcccaaaaaaaaaaattgcggtaaatttttataaattgacgcaaattcattcaaaaagtggctaattttttggccaaactttaagtaagaaatctgctaaaaactcctttctcattccatgacgatacgaagaatttagaaacaaattttaaaaaataattggacagtgggaaagaaatttttagatttcccccccccccccccccctcaaaaaatctgaattttttaaaaatgccagtaaaagtaattgaatatttgaaaactctagggggtttgaattaaaaaaaaaaaaaaactcctcctgcctgtatttggcattgctttttgacttgcctgaatcggtgaacattcgcaggcggccgcactcaatctcttgccacttcgagtctcaattccaccgacctcatcttcctggaaatgaaaatccaaaaatgaaaaaacaataaaatttccgtcacttcatctttttcatcggggaaaaccatggcacttcaaatgcgttgtataaaaacagaagaggaaaagcgttttttatgaattaaaggcaatggagagagcaaaaaaaaaatttatacaaaatttaaattttgctt

SEQ ID NO: 3746 - DNA, 1720 bp, Heterodera glycines
gcttttatatcgtctcttttgcgtcccttaattttcactctgatccgagttactgcggtctaaacacgtttttggtagaattgcggccagaattaaaaaatacagtttgctatggcttcgcatcacccacttcaacgggtgctcagtgtaaatatagactgtccattcaaattctgcctttccagccttatggaaagatattatggaacttttggttccatctcagttgtcaacaccgcgactgcatccttattatatcattcgatagaatattcgactcccttttgtatcatataaataccgtcccgtactattcactatgataataaattttccggtccacccacttttcatatagcgccaatatttggcagttattcatttttagattaaaagaattgatttgtgaaaaatgacccgcgtgaagacccatgaacttcgggccaagaagaaggaggagttgatgaaaatgttggaagaacagaaaacggagctggccagtctgcaggtttacggattttgaaattttcacttgcgattcctagtggatcaggattaggattaccaagtgctaatgtgctaaaaccatattttgttagggttttttgtcgtaggctagaatgggtggacgacttggcaaatacgggtgttctaggttttcatttacggtccaaaactgactggaaaagacgaatttttttttttttgcgaatggcgactgactaaactagagctcggcctggacctggatccaggtccgggtcattttttgacagcctgggtttttcctggagtccaggaaatccaggtccaccttttttcaaaataccgagctcatgggtaaacaaacatttctttaacaatactgcacaacatccgtttgttcattttcatgtttcaatttcccgctgtgttttcaggtgtccaaggtgacgaacggggcggtgtccaaactgtccaacatccacgtggtgcgcaagaacattgcccgcattctcaccgtgatcaaccaggcgcagaagatgaacttgctcaagttctacaaggtttttctaatttatgtttgactgactgtcgtcaattgttccgacccctcggggattggggtccgtaaatccgggatcgccgtatattgtgttgccagcttaaatctctgaattcattcacgcgaactggttcggttggcatacactctaaattggcttgatagatcttgttcatccgttccgtacaagggatggttggtactcagtttcaattttttttttttgaccggaatgccgttttaaatttttgaggctctcgaaacactagcttttgtgcgagtttgaatttaaacgtactttagcaaatcatttgttttaatttcaaatggtatgccaaccataacaaaaataggacaacatatgagacggcctaaaacatctatcctcaattttttttttttttcaaaatttccaatcaatcattttttaattctttttttacagggcaagaagtatcgtccgattgaccttcgcttcaagaaaacgcgtgccatgcgcagagagttgaccaagcatgagctttcattgaagacacacaaacaggtgggccgccaaaaccaatggtttttcatttttgggaaagaaaattatttggctgaattattggagtttttgagtgcggaattttggaaaaaaaccttaccccgggttcagatttctgagatggagatccc

SEQ ID NO: 3747 - DNA, 3264 bp, Heterodera glycines
ttcgtataattaaaaaaaacaaaaatttataatttaaaaattctaatatgcaatttaaaattgaattaatgtttttaattaaaattatatgccatatcggttcacatgaatggtgtaattagtagctaaacgaaaaaagtgttggttgatcggccccgtgtctcggccagatgtgttgccaattttggaccaaaacaaaaacagcacaaaatgggctgttttcgcgaaaatgaatgactaattggacaaggaaattttgtcattggaagaacacgatatttttttgcattattttattcaatttaattaaaataaatgaaatttaaaaattcggttctccaaaatgtggtcataaagcggtcagaaaagtttttgggtaattattaaaaaaatgatcatattttaatttagaaaattttttgagcattttggttttgaactctcaatttataaaaaaaaatggagcttaattaatttattaatttttatttttcaattttaaaagaaacttcttcgaaaaatgatacattttcgatgggtatttgaggaagtttttccgttaaaactggccttttaatgagttttgaaaaactaattatatattgtttctccgtgaaaaacaatctaacttagttttatggtgaattttgttgtcaaaatttcgtttcttaataagttaaattcaaaaaatgttttgctttaatgagttgccggcgccttttctgctggaaaatgtgccaatttaaatacagctgtgtcacgtgcttggttggcagtttttattaaatttttttaaaaatcattcttagaaatatacttcttcaattatagaaattcaaaaaaaaacaaacaaataataatgagaagtaattaacgaaataattcatcaaaatgaatcccaccctcacaaataatggaaaattttcattcattggggacacaaattaagcttaatttgtatttgaaattttcaaattttctgatttgctctgagtttaaaaagaaaatatgtataaaaaatgtttatagaaaaaacaaaataataaaaaaatgatttaatttaaattaaaaaatatataaaaaataataaattaaaaaaacagcaaacaaaaagataaattcttcttaaaaaatatttttttttctcatgctcaaataaaattaatgaactttaatcaaaaacatcttttctacatatttatctggtttcaatgttaatgaatgaataaataaaaataaccaaagaataataatttttactatcataataaattgaaaaaaaattcattttttcttcaattttcttttttcttcgtaatccttccatcccctcttcaaatttaatcaattacttaataaaaaataacttataatgttagatatcaacaaaaaaaagtcgtatattatcattttattatttttttgttttaataggttttgcgcgtcccaaaaaaaaaagtttgtttttcgaaaaggaaactggtacaaataaaaaaattcaaaataaacctacgcttatttcacgaattcgcaaaattgtaaaaatgactaataaattgcacagcaaaactattttaaaataagaaattttacttaactcaccaacaaaattaagttccgctcgccatttttggacatcatctaaatcaatagccaaaaaatccgctattttagcatcagagttaaagggatatttttgcctgagtcggtcgaaatcattcatcaatttctgccattcatctgtcctcactaaacgaataggccaattgttgaaattaaattttttttttttttattagaattttcaaaaaatttttatgccaaaaagctggcggattgaaacaaaccaaaacaaaacgaaacttgagactagacaactgattcgaccgatatttttcaataaaacattcaaaaaaatcgcaatcgaaaaataatggaaaacaagaaatttctcgatcaattttttctggaatatcgcaaaatttatatcgaaaatttcgtacgataaatcgatatcgtaacggtctctgaactaaacatgcagagaaattgaggtccaattaattcagagttaaaaccgattgggctaggttttcaaaaatttcaagaaaccgccaactcttacgcatttatatagatttttaaaattgtcgaaataaaatggaaatacttttcttttctttatcatgttgttgtggttcaatcttttgtgcttttgaagacccagcagaagtgccaattttcaatttttttgccatggaagtgccgccgccaattttcactttattggctcttcttttatccatcattggcgctttgccagttatggtggtgctcaatttttccattttgctcacattgtgttcattttgaaatggggcaagttgcttttgcgcaactgcaattaggtggttagcagtacagaagattttttggcttatttttcgacaaatttgagaggtttttttggcatatttttcaacatttcacaaaatattcgggaactgcttaaggcagtctgaaaagaaatgccacaaatgtctaaatcctaataaaagtcgaagaaaaatgccaaaaatataaaaaaaggttccaaaaaaataaagcaccataccacattctgcttcatgcttcttcttccacgtgcacagtgtttttctggtgatgccaaactgttcagcaatttttttgtcggtaatattttgtgcatttttaattaaataatattcattaattaattgtctccaattctttaatggatgatgctttcccccatcaatgcttcgtctttttttatttgtcagtgattttttgttggaaaattcctgatcagaatcactttccgattcttcttcttcaaacaaagaagaagcactttcatcagatgattctgatttaaattgatcctcttctgctgttgctgctactggttcttccatgaatggtggcgccgccgcgtcaattagcatctttttttctgaaaaaaaaacaaaaattcttccgatcagtcatgaacggcacaaccaaaagggcacgggtttttatatgtctaaaaattcagaaatataactaaaacactcccaaaaaaatgctaaaatcaaaaaatgtaattctgtaaaagatatgcaaaaaactgttgatacttgtttaaatgcaataattttaatcaaaattttgtaaaaaagaaaatatttaaattcttttaaatgttcgtaatttcggcaaaaaaaatttagaagaaaatcaatgccaagaggaacggca

SEQ ID NO: 3748 - DNA, 3533 bp, Heterodera glycines
  misc_feature (3504)..(3504): n is a, c, g, or t
aattttccaatttttttatttggcatttggtgaccatgcattcagacaaaatttaattttactcaatttatttcctattttttccaaaaatgaggctttaaaaagttacgttttttgtttttctcgaattccttcttccaggaaagaattgtgctccgttttaagcccatttctccagcaattctctcctccatttcaatgaatgggaggtcataattttcatcagttaaatgtaaatatttcttttttaattcaatgaattggtggacaatttgtcgtttttcttcgtcagtttctaaaaatattttaaaatttaattaaataataatttatttattattttgtccaacttggctcttcttctgcgctttgtggttgctcatttttgattacttttgacaattctttgtattttgattttgtaaaaattattttaattttcggatatgctcctaatagtgaataatatgcaattattattttaatttttctttaatttaatacagcaaggtgcctttaatataaatcttaaatccttaaaattcaattcaaatttccttggccgtttcggcatcaccgggccaacaaataattttcgaatttaatgaattttaaatttgtaaaatccgaacaattcattttattcgaagttaattcaatttttttttacttttcgctggctccgaatttgatctggacatctgtttttcggtttgcttatcgtttcctagcaaatctgatttagttcggttgaattttggctgatcattcagttgccttttcgtttgtttttggcccatcggttccgtttttgatctgcttaggttcgacgactgaatgggatcagtttgcttttccttcaatttacgattgtccatcatcggctggggttcaatttcgctaatttttgactgatcagagcctttcgtgctgatcgttgactgatcagagatttgtctttccatttgtttacgttcatttgcgctgatcattgactgatcagacgtttgttttcccattacaatgcccttcgtcgtgatagttgactgatcagaggccattgaccgatcagaaacttgtctttccattacaatgcccttcgccctgaacaatggctgatcagttctcgttggctgatcaatccgtcgagtttgcgtttgtttattgcgctttggttctgtattatttctgctgctggttggcttttcaaagatttgcctttccgtttgtttattatccttcatggcgattgttgatagatcagaaacttgccctcccattacaatgcccttccctctgatcattgactgatcagttcggtgggtcgttagctgatcagtcggtcgattttgcgtaatttgcgtcagtttggtttgcttcggttctgtattaattctgctggttgttggctgatcagaaatttgtcttcctatttcaatgcccttccctctgatcattgactgatcagtttggtgagtcgttggctgatcaatccttcgagtctgcgtctgtttggcgcgattgggtactgtattaattctgctggttgttgactgatcagaaatttgtcttcctatttcaatgcccttccctttaatcattgactgatcagtttggtgagtcgttggctgatcaatccttcgagtctgcgtctgtttggcgcgattaggtactgtattaaatctgctggttgttgactgatcagaaatttgtcttcctatttcaatgcccttccctttaatcattgagtgatcagtttggtgagtcgttggctgatcaatccttcgagtctgcgtctgtttggcgcgattaggtactgtattaaatctgctggttgttggctgatcattgcgttgctttccagccgagggtttaatcgggatttgtggttttgcatgcgcataatttgtttgaaataaatcctccacaaaatcatcaaatggcatattttcgacatgcttttgtggcaatgtaaataaatcatccacaaaatcatcaaatggcatattttcgatatcattttgtggcaatgtttgttccttaatgcccataaattattggtattaaaaaatattaaagccatttccccagagtttcggtatttttcaacatttttttaaattttttttacaattttcaacatttttaaatgttttccattgtttgtcgggatttgactcacacttgaccccggctcaacacgatctcggcggttcttgtccctatcaacactttccaattcaattgtcaaaaataataagccgaaaatgattggccataacattttaactaaatagtgtaataataaaattgagaaaaaataaaattaagaaaataatagtttataatagtaataataaaataaattttctttataaaaatgatttggcaataaaaaaatgtcaataaatttataatactttttaaataaaatgccattataaagcttcgtttaatagttaatgcaaatgcaaatatatatttattgattgccaacattaaaatttattagagtgccacgggaccgggaatttttgcaaaaaccgggaccgggacttgccgggacatgagaagccgggaccgggacctcgattttttttcgggaccgggaccaaccgggaccaaccgggaatttttaaaaattcaaaaattttttaaaaaattcaaattttaattttttttttcaactgaaaataatacaaaattaaatttttattttgttttttatttaataaaatccaaaggttaaagctaaattaaattaatgaaaattttcaaacaaatttctttaattatttcaaacaattaatcatttttggactaaatgatcgaatattatagaaattcagatttacgtttcacataatttttttcggcgcgctttttccaaaaaacttttggggaagaagggggtccggcggtgccgataggcgccgccaggggaaattttgaaaatttgagtgtaatttattaacagattttcctcaaaaaatgataaaaatgtgttaattaaaataaaattatgagtaatcatattttgtcgataggaaagccatgaatatacaaaaagaaaattcaaaatatgttagtttctgtagagggattgaaccaggggaaagaagggaaagcaaggagactagccactaggccatccgcacaatttacagagttacttttaaagaatatattaatatatttttaaaattttttctttttaactccaattttcttcactaatttttcactcagacccccattcttaccagtgcttgtttttcccggttcccggttgccctaccgggaccgggaccgggacctgagcttttcaaattccgggaaccgggaccgacaagcactggtaagaacggattcccggcccggtcccggtcccgtggcactctagttaaatgcgatccaaaatgatcaaagattgacaggagcttcccagctggtataatttatatcgtgttcaattgctgttagtctgagcaaattgaatattangatgacttgtaaatcattaagaaagaaaa

SEQ ID NO: 3749 - DNA, 4550 bp, Heterodera glycines
ttcataccggtcagggacggtcccaggattttggcttgggggggcacctccccccgggcgacgaccttttttttttttttgcttttcacacccgttttttatgtggcgcggtttttgcaaaaaatttttggggtacagggggtccggcggtgccgataggcgccgccgggaaaatttttgcggttttaaatgcggtttgttaacagattttgtccaaaaaatgaccaaattttgtgattttgagctatttttagcagattttcattaaaaatttgtggattttttgaaaaatttagcgacatttcttggaaaatttgggtgaggccaggtctgtggggtggggggtaccagcccagcaaggaaaacctaaaattttcagccaaaatattatttttccttaaaaatttttggacccggggaggtcttgggggggtacgtaccccgcgtacctccccccctgggaccgtccctgccgggaaccgggaccaaccgggaaattttaaaaattcaaaaaattaaaaaaaaattcaaattttaatttatttcaagtgaaaataatataaaattaaattttttttgttttttatttaataaaacccaaatgttaaagctaataaattaatgaaaattttcaaatcaaattttcttcatttctttcaaacaattaatcatttttggactaagtgatcgaatattattagaaattcagatttacgattcacataaattttttcggcgcgctttttcaaaaaacttttgggaaagaaggggtccggcggtgccgataggcgcggcgccgccggaggaattttgaaaatttgagtgtaatttgttaacagattttcaacaaaaaaggctggttttcgggattaataggctcaacaatttgtacggattttcattttaaaaaatgataaaatgtgacaattaaaataaaactatgagtaatcatattttgtcgataggaaagccatgagtatacaaaaagaaaattcaaaatatgttagctttgtagagggattgaaccaggggaaagaagaaggcaaaggaaaggagactagcaactaggaaatccgcacaattgcaagagttacttttaaagaatatattaatatatatttaaaattttctttttaactccaattttcttcactaatttttcactcagacccccattcttaccagtgcttgtttttcccggttcccggttgccctaccgggatcgagaccgggacctgagcttttcaaaatccgggaaccgggacctcgggtaaccgggaattcccggtcccgggcccggtcccgtggcactctaaaatttataataaaaaaacataaaaaatatttgttttataatttgtattaaatttcaaatataaaacaaatttaaaatttataaaattccttttcctcctattcttcgaacttccataatgggcagacagctccaaaactttattatttgttctcctcgccctttgtttccatgacagcgccgccgccattctctcgtgccattcactcattttgtccatggccacaaatgttgccccattattgcccgagggctttggattttattgttgtttaaaaatgccgaaaaaagggcattaattaattatttataacaaaaaaaagtggataaataaattattgtttaataataaggcttcagtgtgtccttttttaagaatttttattttttgtaaacattcttaaaaataaaaagataattttaataaaatgaatgatgaaattttagaaaaatttattagatttttagagatttttaacgtttctgttgttaactcatcaatttttatttttgataaaatctgtcaacaaatcttaaattttgaaattttcttttgtcactaagcctcgagtaaattaaacattttacgataaataattgttttttatatttatttaattttaagggatttttttttctccatataaacattttttaaactcaaattcctattttttgacaaaatctgtcaataaatctcacacaaattttcaaaaaaaaaattttttctttcgacagtaagccacgagtaaacacttaagctttaaataattaattttatatttcatttaattttaagtagtgcttgatgatggatggatgattcatcttcttttcttcaattcattcatccgatttattttattttttttcacttcgattttccaccccccccccccccaattctccgctgcgcgacaatccccgaaaacatttttaattgccatttttatgggttctctccccaccagcccctcactttgcttttaagcaccgatgaagaacaagttgagaaattcaacaaaaattggaaaaaatgatgctttacattattccacattcattttggccccgaaaatttcaattctttcgaattttaaattaatctttacaaatttcccaattcattttagccccgaacatttgaattcgttcgtttaatgtaccgatgaatttattaaattattattttctttaattttgtctcatatgattacataaaagttgatataccggccgatacatagtttggttaaaaagtaatttttgttatgaattttcaaattttacagcaaaattttttggcataggcatgtctctctttccttccttgaaaatatcaaatttttccgaaatttcaacccgggaaattatgtattcctgagcctttaaagttttaacgcgaccttcggccattattgtttctctctttacacatacacacctattttggatttttaaaaacggtttttaatctcatttattcaaaaatatttgtttaaaattcggagcagagaaaaaagatacgaattttttctaaaaaaagtctaacaaactcgttaattttttttctgcgtgattcgcccctccgggcacatttccgtctgctgttgtggaagtgaaaaagcacacgacaatttgtggtgcaccacgacacaacagcaacaacaatttctgtgggggttgtgctccaatttcatcgccccatctgtgctgttcgttcgttcgttcgttcgctttgctttgtgttgttgagacggtcggtcccatccttccgcccgaggggcttttatttgtcggacggatgagtcacacacactcaacacacatcagtgagtcatgcgcccctcctccgggcgaggggaaaaacgaacgaaaacaaaaaaaaacctgttttttgagccagctccagcccaccttccgaaaattttgaattttacaagcaacaaacaaagcagcaacatagtttaaaaaattaattggttctttatggaatttttgaggatagacggctgtcaacaatttttaattatatgtcaatggaaaaccattcaaaaaacttagttgttttttaaaactgttggggatagcgcagggacaaacaaatcggcaaggtttatatatatatattgtataaaatccaaaaaaatagaaaacatgcatgacttttgaacaaaatcttattaaaaattgggtagacaaaagctaattgtaagacataaaaaattcatcccttttccgatttttattttttcatgtttcatttctaccttttgaagcttttgttttctcttgagagatgactccattttcaccccccccccccttgggagggggcggcggctttattggaggggggttataatggaggcggctggcggctatattaggggaaatacggtctaaccctcacggcacattttgcttcaggcggttcttctttttttcgctttttatatttttaaataacttataaaatcatttcaataaacaattaataattattttactccgacaattaattccttttttcctctctttctcatgccgtccgtcggctggcacattgtcgctcgtcataattttttttttcttttgtcttttcgctgctgctggtgacaatgtgacaattttcagcccggaagctactgaaaattgtattgcgcccagccgaccgcccccggcggggcaaaattccgtgcaaattgatgacgacggacgaccaccaccaccaccaccacaccatcaaaattcaaaattcccccctcaaattcgtcgccgtcggcgatggattttcatacactctcatcattcatcagtttctcgcataaccaaccattgcacacattcatcccattcgcacattattattgtttttgtacctcacacaaattatgcaaatttgaaatcgattccatgtattgaaaagtttcgtcaaaattttccgggaattattgttttaaaaatgcagcacagaacccggttttttcgcgcattccaaagcgacacataattacttttttcatgaaattaagacaacataatcaattagagattcaaaatttcttgaatcaaattgatccattaattttcttcctctcggggaagctacttctcttctatctcagttcgatagtcgaaatttagattcccgaaacaatttttttcttaaggacaaagtctaaatcccatttgattaaaattaattctcaaattcgaaaactttttattttat

SEQ ID NO: 3750 - DNA, 4859 bp, Heterodera glycines
  misc_feature (4854)..(4854): n is a, c, g, or t
gctcccatcattctcttgtcgaacaaatagcgcaacaacgagttcaggtcggtcggtcgcttggtttgcctgcatttggctgccctttttgcaatggcgccgcctttaatgattaacccaacaacaacaacaaaaacaattactattctataaaagagacacttcatagggcaaaagctttccatattttaacaattggtctttactaaataacatttaaatggcatttgtttgatcagtgatcgggagcggcaagcagctaacaaaccaaaaattaaagaaaacaatccgattttgaatttccccaaatatttaaaatttcgttttccatttttttttcatttgctttccacttatccaggaagagtccgtgcgtctttgtgtgttctcctcttgaacagtgaacgagaatcgggcaccggcacttcgctttgcggcagcaacaaaagtggagggaaagaacaatcgaagaggaaaaataaaatgggagggaggaattggctatgattttcattagagatctgaattttgaaaaaagcctgtacctgtacctgtacctgtatttcccgattggcctgtacctgtattctgtacctgtatttcctgtagaaaagtacaggaaaatacaggttttttcgtgtttagctgtacctgtacctgtactaaattctaaaaatggcctgtacctgtacctggatccaggaaaaatacaggcctggatccaggtacaggccgatctctaattttcattagtagaatgtttatttttttgaactccccccccccccctttatacaacacaccgaatcagtttccttataaccagaagccattcctccaaaaatttgtgcttcaaaattttacggcaaagatgatgctccgattttgaaggctttttaatttagaaaaattttcctaaaagcatgtcatgcctgaaatttcggctctaattttatacatttcatttctattgccttctttaaacaatactaatcttttaattaagaatggatctgacacctgaacaagaacgcgagttgtataacgcctacaatcgtcccaatgtcccggaggacctcaccgaagcagaactgtcgcatgaagttcatttgggggcgtttaatcaagcgatgcaaatgcgtcatgcattgtctacaacagatttgaatgccgcgccaaaggacatcagcattactctaccattcacaccggaagtaatcagaaataaaaccattttttggtttcgggctgtgattttttaagcattttaagccataatttgacaatttgtgccatttaattgggtacttttacacttacgccacataaatttttttaattttgttgttttctggggtattcgggtgcgctgatcacgaatatgacattcatgtccatctatttagaaccccggaccagaattcgaacaaaagccgaaaattaatttttcacatgtattgtccaaaaacgattcaagtgcactaaatggccgtgaatctctattttttattatatgcctgtctatttgaatcggttttggacaataaatgtgaatttggtgaaaaattaatttcgccttttttcgaattcgggtccgggatttgaaatgtgtgaaaatttggtcgttttggggtatttgttttaacaatttcgcgaacttattcatttttttaactagaacattcgtcacatcgagacaaggccatcattgacttgcgtccgctgcccttgcgtacccatgatgtggatgttcatggttcaacaagtgaacatgtgccgccccacttcgaggaggtgccagcgctgtacactgaatattttgcgtggctcaacaccgaaattgcaaaagtgcaaacattttggttgaacgagtgcgtcacttctcgctttttcaggtgaacggaatgtccaacgaattttggggctggggcctggaggacgacgacttttacctcagattgaagtgagcattttaagcattccgcgaaaaaaaaacatttggaaaagccatttttacaaaaattctagagatcggtattttgaaaggagccccgacatttgcggccccgacatttgtggcccgacatttgcggcccaacatttgcggccccaacatttgcggccccagccaataaccgacatttgcggccccagccaataaccgacatttgcggccccagccaataaccgacatttgcggcccgacttttggggcccgacatttgcggccgatttcttaagtgttatttcccgacatttgcggcccgacatttgcggccccaaattactcatttaaaaatttaacaaaaattaaccactttctagtttctctatatatcacagtgaggtcagatatagttatttgaaaattccaatttatttgattttaaccaaatttttcttttcaaaatttaaagaacattattctaatttttcaacaaaattgggcttgctcaaggccccaacaaagcttgaactttccatccattctactaatcctgaatttctacagtatcggccagtcgatactgtagagctctgaggtgccctaataacgtttcgtcattcctattttcatcgttatcataacgcaaaatcaaatttttgatcgctctgtcattttccacatattttttcttccttgtttcagtcaggccccttgtggggtccaattcaaatggccgaattctgtttcgctgatattcctcctcctctttaattccgtttatgaatctttaaaattaaagtctcgagattagagctcttaaaagcgaccgtccaatttgagcaccaatcggtccaacacacttctgcatttgcacacgcggaaccgacggaggaatttcgcagtggatgaatacaggaaaaaggcacggaaaggcaaaaagtgcaccggaaaatcggtcaccaacggatttcccggaacaaaatttttttagctattttttttaaatttcaatattttaaaatttaaaaaaagggggggagactaagtgctcccctggctcacttccctctctctcctgccccccccccctaattgaaaatgaatgagttttgagaaatttgaatcatttaaacttttccattgaaaattattaaaaaatggcagtcctgatgaatgggcgtttctaatttaacttttttattttgtgcttacaattagtttctgggggttatcgagggtaatgattacgaatctgaacttggatttccccaatttcgaaccccggacccgaactcgaaattctgcaaaaaaaaattttcaaaaattgttttcactgatttcgagtcagcaaccgccatagcaagcattttagcgatcatgattctgtctttcgtcattttggtctcacgttgttggactgtacccatgcgtatggcggttgttgactcgaaatcggtgaaaatcaattttggaaattttttttgcagatgttcgaattcgggattagaaatagcacggttctgagttaagattcgcgatcagcgacctcgaaaacctataaaaattggttttaaaaatttataaaaaaacaaaaatttaaggggcgtaaactgcagaagtgcccagatatttcaaatttccattaaaatttacaactcaatctccaacaactgttttgattccccccgccccaccaaaaaagagaacccaggaaaaatccaccgacggaatccgtccgtccattcggactctacaaaatatgctttacatattacaaatttggccatttttaggctttcgtcgcggtgccgagccgttgccgaacggcgaaattgtgccattgtcaatcgcatcactcttttggggctgaacttttggcgtgtgatgtttgacgcggacaaaatatattttcaataaaaaacgagcaaatgttttttgttagtgcttttgataaacaatttttccatgtttcttgcaaagatttcattttttgtcgccaataattgaaaaattctgtgtatattttgacatttttcgtccaattattgcattttgtacgccgaactaagaataaaatggttctcttccatcgtaaagttcggcggaggagctttttggttgttttcgtcgttgtgcttttgctattgctcatcacttttgtacagattgctttttttcgtcaaagttgcatgggtaaaacaaattttagtgttgtttaccccccccccctgattgaaaaattttaaaaaaattccataaaaaagttttcggagtatcatccttcggcaaatttcctgcgagctctactcattattaatgaggctttttgaccacaacaattggtagttttcatctgcatgttatattctagacataaaattgtcaattaatttgattaattagccaaaacacaaaacaataaattaaaaggaaaaaatatgtgtgcgaaattatttaagcatcatcacttttctgttcatcttcagccatttgatgctggaccaaatgccgcgggtgcaattcagcaaaaaagcggacctaagctcagtgtctctgttccattcctggctgaaaaagggaaaatttttgaaaaattatttggcattttgtctcatttctatggcttaacgtaccgcacaattttgagtgccggaaggaattgccctttttgggcaaatgcgagcgcaatgtacaggaagcagcgcgaaatcagcaccgggtcaccaatttcgatggccaaacggagctgacgaatggaaatcacaaaggcatgccgaatctgtgggaagaattgggggagggggggaaggattttggcgattaaacaattaaaaacaattaggggatcgcttgccgtctcgaatttttcgggagagatcgtttccccccaaaaattttttagaaanattta

SEQ ID NO: 3751 - DNA, 783 bp, Heterodera glycines
gggggggagacagatagaggggtaaacgtagccatattttttttatcagtctttaccaccttctcccaccccagctccccttaattggatgatgtaaatgaaaaaagtcgggattttggcaccagtccagccaaatcgcagaatcccgaccaaccccaaattaaaaaaatatatataatttattacaaatttccgactaaaaaagcccattgcggacacagcgccgccaagcgttgaaaggcgccaaagctcttaagaaagggtgaaaagatagataatgtaggtacataaagataggcgatggtcaagaataacaacggaccggtctcgacatgcagaactgtaaatgagggggaaaattgggaaattgtggcaaaatttgtggaaaaattttacaaattcgtcataataaattaaaaaaaaaatcgtttttaaaatttctttttagtaattaaaaaaaaatagggggggggggatgacccagacaaatcaactccaaattccttttctgagcctcgaattccgatcccgagattttagagaagtggaaatgcgaattccattctcttccctgtttttaggcaattaaaaaccccaattaagtaattaaacgcgcctataaaaacagttgggggcacattttcaatatgtttttaaacggtgaataaatgcaattatcaccagtgcttgtcaatgtgaaagtccgtcgctttctttgatgtcggccgccgacggcgaagggaaagtcgcacaaatgatgaggcccaaaagtgaggggggggg

SEQ ID NO: 3752 - DNA, 1618 bp, Heterodera glycines
cggcgcgccgcaaccgcgccttcgaatgccaacagatgagcatttgacctccgcaattgtcattcatttttatgcctttctcttatttggacaattttgtttgattttttgtttgcttgcccttttcttaatgagcataattaatttttttttgttagccccgtcccctccgaattttcttcgccttcgccactcccgcgcttccctatgctggtaattgcagtacggccacaattccgcgacacatccgcactccaattgaaggaccaactccggcacaactgcagaggtcgcacagatcaaagggtatggtctaataaataattgagaaataattaggccgctggatcgaagccgcgaagtgcgcactgatcaaaaaaagtacgagtttgggtctgcgagagttttgggtttcgggggggggcaatgttcggtttttatattcttgattaatgtgtgaacctccaaaatcaattaaaacagtaatattatacaaaatgggtgctactgaagcaataatttttaggggaatggcgcatttcttcgctttcggtcccattgaggaattcggcttcgatttgcatgccgaaaggggcaaaagccacttcatcggtgccgttgacaaaggcggcatcgccgatgagtccgtccgattgaccgtttccattctttgcatttcattcggtttgtttagtgccggcctcgaaacatggcaaagaattgtcggcgataacggttgtttggtctccgtacaaacggcgcaaaaggtgaactcagaaaagaaaacaaaacatacatggaaaatgaggcgagggcagcgacgtcccaggatttgggcttggtttatacttataaaagaagttttttgaaaaaagtgcaccacaaaaaaggtctttaaaaagcaaaaaatcgtcggtaaacttggccccactccttttgtaaaattgctgcctcgaaatttgtggtcaaacttttgctgcaatcagcaataaaagatattagcggcccaattttttcgacaccaatcaaaatataaacctcaaaatttttgtccaattcaatataagcgaattttatgttttttttttgataagcggattcaaattacaatactttctcgaatccattttaactggatctaccaagtataaaaactgaaaaaaggaaagtataattgtggagaaatgtcagatcgatcagatcaaaaatctattgtcttgaacaaactcagtttttgaaaacaatactaagttgaaaaagtccggcgtaatttgaagaaaaaaaagtatttttaatgttctattttgattggggtagaaaaaatcgggccgtcaatgctcaaaaatggccttagaaatggccgcaaatgtgaagcaaaagtcggaccgcaaaattagtgacacgataaaattaagggaaccaaaaggcgcgaacgaatgcaaacgatcatttcggtggatgaaagtcgcgagccggcgacccctcagcagaaaaagcgcaaacaaaagcagcaagcggtagaacattgcttgtggaagtgccggaagagagcatcagcaagcggaagaagccggcgggagggaaggcgaattggcgagaaaacgagggacgggcggaa

SEQ ID NO: 3753 - DNA, 4856 bp, Heterodera glycines
  misc_feature (4838)..(4838): n is a, c, g, or t
  misc_feature (4847)..(4847): n is a, c, g, or t
ccctcccccccccccgagaaatttttttttgaaaatttctgtttggaattttttttttaaattttggagatgggccgaaacggggcaactgattggaactgatacggggagatctaccgtctgtaaaacttttatgtgacgggctttttccgcctttgttgaatttccactttcaaccctccccccccgccagcttatccattcattaaaaatccggtttcaatttacaaacacatccctccttcattccctcccccattcaattaatccgccgtcatccgcctcaatcctggaaaatcaatccgcaaatgatttctctctgtgtctatgccctcttctagcgccggaggcggcacggattagtcatcaccggtcggatcggcgccggacggcgccgctggatttgtccatggtcattgaatcttctccgtctctccttaccgcccccctaacaaattcgtgttgtttttaaataaatatttatgcctcggtgaaaattttcatttctaaaatagggttagaccccaatttcccccgggtttttttttttttggcatttttcggggaattccccgacccgacatgtccccgacagtagcttccccaaaaatttccatccccccgatttcgggatgtgtaaatttttaaattactcataatttagggaggcccatgggtttaaattctctcccaccattaaaaaaaatcaaattttcaaaaattaaataaaaattttcttcgtctcttctaattggctcattcagcctgtattttgtacaagaaattttgagaaaaatgcgctgaaaattgactttgattagcatttttttatcccccccccccccccccccgaccgtccctggtattgtctaattgctttttctttactcacaattgaccggttgctttgttttcaggatatcacaccgtttggggtgtcaccccggccctgcacagtccgttgatgagtgtgaccaacgcggtttcgggcatcaccgccgccggcgctcttcatttgatgggagggggttggtggctctgtcttttaacaattgtccacttttgttccttttaggctattgtccgacaaattctgctcaaatgctggcccttggcgcggcctttgtttcctccataaacattggcggcggattcactataacaaagcgaatgcttggcatgttcaaaagaccaagtaagaaagagaaatggctaaaattgataatttacacatttctcacaatcaattgtttatgttcaaattaagctgatccaccggagcacaattggctctttgctttgcccgccggcgctttaattggctcttacgcttttggcgcgttgaatggttttgaacagattcatgccattggcgcgttcacttcatctctctgttgtgtcggagcaatttcgggcctttcttctcaacactctgcccgaattgggaattctttaggttttaacagcaaacattattttaatgacctgttcaattaggaatgattggagtcagtggtgccttactgaccacgctgggcacattgaacccggacccgcagacattgagccaaatgtgtgctgccatcgcttccggttccctcatcggctcaatcgtcgccactcgcataaaagtcaccgatttgccccaattggtggcactttttcacagttttgtcggaattgctgccacggcgacgtgtgtcagcaattacctagccgagttttcgcactttttggccgaccccgcaggcacggttgcggtgaagacttgtctctttttgggtgcttacatcggtggagtcactttcaccgggtctttgatggcctatggaaaattgcagggttattatttttagtttaatcaataacatgtcaaattggtcaattccaggtcttcttggcagcgcgccgactcttcttcccgccagaaatatgcttaattttgcacttctcagtgccaatgttgccgccctcggcttttatctgacaacggacagcatggccatgggcttgtccatgctcggcactacgtctttgctctcctctctgatgggcgtcaccctaacaatggcaatcggaggtgcagtcgattttttttttttttgctaaatttcccaatgcttttgcatttaggtgctgacatgcccgtagtgatcacggtgttaaactcgtacagtggttgggctctctgtgctgagggattaatgctcagcaacaatttgctgaccattgtcggtgcgctcattggcagttctggtgccattttgtcccacattatgtgcaaagttggtgattttttgcgttctgttcattatttcatcgttttaggcaatgaatcggtcgttgttcaatgttattttgggcggcgttggcacaaaatcgcaaaagggtggcaaagcacaggaaatcactggcactgctcaatttgcggaggtggaccaggtttgatgatggatacagtgaatttccatttcaaaaattctccataaatcaggtcgttgacatgatcaaggatgccaaaaacatcattattgtgcccggttatgggctttgcgctgcccaggcccgatacccaatcgccgaacttgtcaaataccttcgcgagaggggtgccaatgttcgctttgccatccatccggtggccggtcgaatgcccggccaattgaatgtgttgctcgccgaagctggtgtaccttacgacatcgtggaggagatggacgaaatcaacgacaacttccccgacactgacctcactttggttatcggagcaaatgacacggtctgtccaattgcgttcactgattgtgtgaaaagttttctcgtgcggtccaatgcttttcacacttcccttaattaaggttaatcgcgcggctgaggaagaccccaactcgtcaatcgcgggaatgcccgttttgaaagtctggcacagcaagcaggtggtggtgatgaagcggactatgggtgttggctatgcggcggtggacaatccgatcttcttcgaccacaacacgcagatgctgctgggggacgcgaagaaagtgtgcgacaaactgttggccggtgtcaaaagcggcacttaacgcattttttggccaaaccaaaaacaaataaaagatgtaaaactgtccattttaagcttaataataataataatagggcatgctgacaatttatattttaccaatttatttttgtcaatgattcgaatttctctgtgactaaatgatatagccaattcccttctctgtaaatttttgacaattatcttgctcaatcccttttctctctgcccataacatcttccacctcaaatccatataattctaattgttaattcgtattttatcacggcatttttatttgtactggtgacttttacaggtttctttaatcccaatggcttgcctttcgattgtacgaattaatagaaaataatttaataaaaatgcaaatgaatttaattctcttattttgtactaaactttagtcatcccagaaaaagaaattgatgttttttgtccgtgctcccaaatttttatggtggtctcttctggcaaataaacgtcagaaaagaaaatgtattattttccctctgcaatttcgggtgccaaatttattatggccgttggctaagcaaatattggccacattccttgtccctccctttctctctcggtcctcctcctcctctctctcgaggatggtttgtccctgcctccctcactcaattgccccccccttcatccatcgatccatcccgactgtctcttcccccccccccctctttttccagactctctctctcctcgttttgttccgccttctccctcctatccattgcttctcccaatgcttttccatggcttcttctttcttcttccactgctccccttcccttccctttgcttccacaattccattgcttttcccccgccgccgttctttcacgtgcacaataataaaaagcggtcacaacaattattatgtattatttgctatttttatttgtcgtctctaaaaccgtgttgacgtcactttcccgaccattcgtccgtcgttcttcccattctctcatttactcatcgtcactcactcactctttcattcgttttcgtccatttgtgccataattagagggattagcattcattccctcttcaattttgtttgttttccctttctttcccttttattctttcttcctttttcgattaaacaatgccttctttttcagcgtttctttcatttccattgtttgaataacttttcttttccttccattttctgttgtccttacgaatggaccgtaatgacttgcagcggacggtggagagtatgtacgccttcaattcggcggcggatcgcgaaattggcactcgctgaaggaaaagcaaaaatgttaagcaaaaaactctaaaaaaatttatttttgcgatcatcgaatttcccagcagggcccaatcaagggccacccaattttacatcaaacttttgtttaaaattgggtacttatacagtttgacccacataaaatttttttttgttttaatgataaaaacgtgtttccaggcgttttcggggccgctgatcatgaatttgaactctatttcacgaatttccgaacccctaacccaaattcgaacatttttttgaaattttttttcaaaaatcggttttaaatgtgccaaaatttcttcaagaaaaaatcatattaggggttttaagggtcggagaatccgaatctgacatttattatgacctaagtcgaacccagaacccgaattcgagcaaaaagtcgaaaaatcaaattatcgaatttttggcgctagtgtaaaaangttaccctnttttgaaaa

SEQ ID NO: 3754 - DNA, 1752 bp, Heterodera glycines
attttcgtgcattatataagaaaactttcttggtactgcagtgtccattttctctgggactcagttgtcccagtgcttagatggcattggttcgagtttataccttgttttttagacttagctcatcaagagctttcgaatgataccaaatttgtccgaatttgagcgttttaaaaggtcaggaacccccccccccttttcactcaaattttcgagtttaaaccggttaaaaaccggttttttggcatttccgcaactcgatacatatttttccgtgcttagctcctcgagacgaatcgattggtatataatttgacccattttttcacggggcgttcactaaagcttatccatggcttacatattgagaaacaaactaaaattcgacaattcactaataaaaaatcatttcaaccatttttagaccaaaaataaaaaattcgataatttgatggcctttctcgcagcagtgatgaagaggcaggaattatctactttgagacggctttcaaagaaatggcaaacactcaaaacaacacctgacagtaacgtcaggaggcggaacttcggacaatttggcgcgccattcaatggaaatagcgcatacattcgccataaatttcctcaaaacaaagggaaacacatcgctagaaaaagcgcatgtgcatatcaacataattagcactagcacggtatgtatttgattaattaacaaatgggtggagattccgcaccacatccgaaatgaaattccttaggaaatgggttatttttaaatttaacttttaaaaaatctcgttaaaatttgcaaaaattttcaaaggtgtcatataggcactgccgtatgacgattgacattcccttaattttttttgggaaatacactgtagaaatttttgggaagagcaaaaaagctaggattttcactccgaacgagaagacctttttgttgttgatcgcaaaaaatggcacgtttttttcttaaacagtagttattagaaatggaatatcttccagattagtctcccttttaaagttgaacagctttttggcaggtcgaaatcgcaaaagtgaacggcaaatcggccattccgtccggttggggtgcagactccgcggggcgtccgtcgactgatccgctgtcggtgctcgagcggactgttgccattgggcgtagtgtcggaggaggacggctcacacaaaggcaccggaattggtcggtggagattagcatcatttgtgccaattagcagaatgaagggccttccgaatttagcgatgatgggcgaacttttttgcggtcttttgggaggcgcaagttttggcaaaaacgtgcgatcgtggcgagaagtgcaaaaggcagccaacctggtaaatgccgactttgcttgaccagtcgcttgtcggacgaattgccaaatccaatggcattattttcaatattttgtcccccagggccaatgcttcgtggccattgaccccgaatgctttgctccaacatttgtggactatttgcagttgttcctggaccaaacacgtgggcttaagccggttatcactgctcttcctccatggcattcgatcgcctcccttccctccttttagcgcgacccctccaaatcggtgttagtgcccggtgaccccgaaagaatgaacagcgaacggagcgcaaaggctggcggagttatttactcagcaggacaaattcgggatttgctcagtcggaggagcacttaacggcaattatcactt

SEQ ID NO: 3755 - DNA, 1597 bp, Heterodera glycines
attttttttcctggattctacgtagtctaattagtaggaaaaacatcttctttttcgtatttacgtctaaaagtcgggttgggttttttaccgattttgcctagactagtaagaggagttttttgccatttttaactcatttactaatgatatgtataccatttttcattaatattttatattatcagccggctttatattttacaaaaaatctatcaaaatgttcatccgtctccaatcctccatattgcctgttcggttttttttcacctcaaatcatccacctctattgcttaatataactaccaaaaatccaaaaacatcccggtcattatgtgtgataaagtctgagtcagttttcgtcaacaaaattcccttcaatgagttggtcgtttctgcactgagagagtcgcatcctggtattaatatgatggaattatctttttttttgtttcgttttcattgcagaagagcacagagtttctctgacgccatccgctgctgcaaatttggtcaaaaagggcatgaaagtgcaggttgagcaaggggctggtgtattggcgtcagtaatggatgaagacttcgctaaagttggtgctaaaattgtgaaccgggaagaggcacttcgtgctgatgttttacttaaggtgaactgacaaagatttaagtctctcacaatttttaaatttccattcgctcagatgcgttgcccagaaacattcgaaatcgactcgtttcgaccaaattcaactttaatttcgttcattgggcctgcccaaaacggaagtgttgtcgagctgcttggcaagaagcaaatgaatgtctttgcgatggattgtatccctcgaatatcaagagctcaggtgacagacaatctcattagcaagtaattatatgaaattatatttcatttggattataggtttttgatgcgctttcttcaatggctaacattgccggctataaagcggtgattgaggcagcaaataattacggtcgttttttgtccggccaaatcacagcggcaggaaaaatcccacccactaaagtgttggtggtcggaggtggagtagccgggctgagcgcaattgcaaccgcaaaaaatttggtttcaaagtttcactgtattactcaacaaactcgtttttaagggtgcgattgtcagaggtttcgacactcgcccggcggtcaaagaccaggtcaaatcattgggagctgagtttttagaagtgagttttaaaactgttatttctcattaaatttttgttaatttgattcaaatacaggtcaaaattcaagaatctggcgagggcgttggaggttatgcaaaagaaatgagcccggctttcattgaggcggagatggaactttttcgtcaacaatgtcgcgaagtggacattatcatcagtacggcagcaatccctggaaaaaaagcgcctgttttgtttacaaaagtgattttgtttaaaatggcagttctttttatgccgatttcaggacatgatcgccctgatgaagcccggctccgttttggtggacttagcggcagaagcaggcggtaattttgaatcaacgaagcctggagagatatacacgg

SEQ ID NO: 3756 - DNA, 2259 bp, Heterodera glycines
  misc_feature (35)..(35): n is a, c, g, or t
  misc_feature (96)..(96): n is a, c, g, or t
taatttttcaaattctgtccaatgcaattcgcaantccatcggaaaatttcctccgattcgtcgtcgatttctgtgccccgcttttcgaattctcncctaatagccattaatttgtcaaattcatccgctgtgttttgtccaatttggcccttcttttgctcaattaattttttcatcccccaaaacatttccctaaaatatccttcaatgtttttcagtttcgtctcgtccatgtcaaaaattttgtcataaatttcttccgcttcttttttgatccgatcaaaaagtgcgttctttttccgctcaacagtgagcttttggccaacccatcgcataaacaccgccaaatcggcgccgattttgtgacttactaccaacattaggtcttcttcctcaatcgcacacagaacattcacataatggtcccaaagaaggtcgtcatttgtgagtgctaaacatttgagatagagaagagaagctttccaagccgggaggaagattaagggactaattgaggtgataatgaccttaatgaccgagcaaatttgattaatagggagtgccggtaattcagccggcggtgggacgacgtccataaggctagagaggccggttctctctgactcaccccgtttttcctcaatagctccttgcttgtttattaattacatatttaatcaattgactttaataatccattgcctgctcaattagttaatgatgataaccctatttaccactatccgtaaattcttctcccgtcagtccgagcttttcccaaaacttttcaaacagttctgccaagccgaccagtcgcaaaaggcgagtttttgctccgggatgcttcagaagttgcttcagggcgttcatttcgctgaaatctataagaagggaagtgagcatgttgccaaagtgctcgcggttgaactcctccaacacttccgtccgtttttccctctcttcgcatttgttcgtctgcaaattcttcagcaccttttccgtcaaagctccacaataatctgcgttgaatgtcaaggaaaacgttgtgattttgatcatcacacaaagctgcacatgggagccaaaatgccgaaaagcgtcgcgtttggccatgttcgctttggcaacgagtgaatcacaagcggacgaacggcgcttctgttgggagagccgcttgacgagcatccgtatctctctgatcataatcgcggtcaacaagacaattttggtccttttgaactgctccgagtcgctccggtttaacaacaattggcaaatgcgttcaaaaagggttgtgctcaccatcgtatctgaaatggacaaaaagcttcccgctgactgttttacaattttttgattagccatttaaaaaaactcgccaattcgtaaaacttccggaaattcattctccaaaatggtctgatagatggcgttggttattttgttgagcgtcgtctttaccttcggaacactttcaatttcatagcacaaaaaatgccgtaagccttcgctttcttccaaaagttccatcaaagtttgtccaatgattggcttaatcctcggcggattggccaacttttgcaattgctcgttaaattcttttccattacaatccaccacgtctaactttaattgaaaatgaattatatctaattaatcattattgtccttatttctatttgccttccgcatttaagcctattgtccttattttgtccttaattctcaaaatcctctttttccacctctataatttccagcactcggtttttgcgcataaattttccaaattcctctgccatgtttttgttttccgaatatgacatcattaacaacagaattgacaccccatggacgtacattaagcacattgacgtttcgatgtcgcttttcgtttttggcactttgccgactgttttatcccatgtgctttttcgcttttcaatttccttcaaaaattcgttgtctccaaatttttcgccaagttcactcacaaaatccaccattttaccaacttttcgtttcaaaagccatttaatagaatttgtcttaagctcccaacatccgtttatttggtcacatttgtgccattggtcattattcagaaaaaaatgcttgaaattgtcctctaattcaactatttctgaagcttaatgtattaaaagaaataaaataattttatttatttttgctttttctgcgtgactggacaatccgacaaaagtggacaatccgacagtgaggacaatccgacaaaa

SEQ ID NO: 3757 - DNA, 421 bp, Heterodera glycines
aatttttaaatctcctaggacgtccatcttttggcgacgaatttacaacttattttggcatttttctgtctttttaggcaccagaaagttttttttttgaagaatttaaggtaattaagttttataaaacttattttaaaccataaaaagaacaaaattaagttttttgattaagttttacgtggttttctcccttaaaatccataataaaaaaaatttaaatgccttttcgggatttttgtgcttttcatgcttttttcaatttttggtgcctattaatgtgcctttttcgggattttcgtgcctttttagcgtgctctatttattaaattaatttttggactgaaacggtccttccctcacaaaggagaggtacccaagtgacggtgggacttccgaaccaaactttcagggtagatag

SEQ ID NO: 3758 - DNA, 2792 bp, Heterodera glycines
  misc_feature (5)..(5): n is a, c, g, or t
  misc_feature (26)..(26): n is a, c, g, or t
  misc_feature (2730)..(2730): n is a, c, g, or t
  misc_feature (2744)..(2744): n is a, c, g, or t
aattntagtgtaattgttaacagatntagtaattaaaatagtaaattaaatgaaaaaaaacggtaaaataaagtgcgggcatatgggatcgaacccatattaaaaaaacaacaaaaatctcaagtgcgcacgactaaactacaacatacaacagttcaatgaaaccacttattttttttactaaatttttgttgaaaatttccatttgatggtttttatataacgccccttttgatggtttttatataacgacatagcacccatagcattacctcgttcgtttggtactgcccagagcagatgggtttactacgacacatttactgaatagtcgtcagagtaagtggttctcacccttctgatgacttttatttttacgaataaataaataactaaaataaataaatatgtttttgtgcccaaaccccaaatgttacagtaccacaccaaaattacagaataatcctctacgatcaattaatttttctctcgtttatatgtacgaacgacggcgatttttttttaccatttcattatttctttttatttaaaatgaataattttattataattattaatttatgtagaatttgtaaatgtttcaaaaaccgaacgcgaaaattaaaccgattcaattttaataaaaacaatttaaaaatgatataaagtgattggatcaaaaagaaaacagcaaatgatcaaacaaaaaagtgatgagaaaatgccgaaaataaggaatgcatatttttgttaaagcacaaaaatttgtaaagaataagcaacagacagttgaagtcacaataaattaatgaactcgtcagtcaattaacgcataaaaagacactaattaatgaactcattaaacacacactaatttccctgcagtttttttttgccaattatcaacattgatcactgcggcgtgtggtaaggaggacggccaggaaagtaattgccaatatgaccttggctataattggttgtgatgccgtaggttggtgccaaaggctgtggcaaagtagaagctgcggaagccaggagacgtgcagcaaaatgattggctttaattgagtaattaggtaagtttactgataagaataatgacaaaagaaccagaagcctggcctaagaggccataattagtgccgtaactgggtgccaaagactgtgccggaacagaagcgacggaggtcggcggacgtgctgcaaaatgattgccttcaatttttaaatcacgtttactgataaaattagtgaaaaaattacctgaaagatggcctaaagggcgttggccataattaatgccgtaattgggtgctaaatgcgattccggagcaaaagtgacggaattcggttgacgtgcgggaaaatgaatgcctgcaatttttaattaggtttactgataaaattagtgataaaaggacctgaagcgtggccgaaagggcgtaggccgtaattaatgccgtaattggctgccaaaggctgtgccaaagctgaagctgcggaagtttgaggacgtgtgacaaaatgagcgcctgaaacttattttgggattatcacagatgagatcaaatgataatgaccaggaagatggcccatgaggtgttggccataattagtgccgtaattaggtgacagcgcagaagaggcggaagttggtggacgagcggcaaaatgaaggcccaagggttgctggcaataattagtgccgtaattaggtgacagcgcagaagaggcggaagttggtggacgagcggcaaaatgaaggcccaagggttgctggcaataattagtggcgtaattgggtgccaaagactgtagcggaacagacgcgacgggattcggttgacgagtggaaaaaggaatggctgaaagttgtgttaatttatcaatggttaaattagtgataaacggaccaggaggatggcccaagggttgctggccataattagtggcgtaattgggtgccaaagattgtaccggaacagacgcgacgggattcggttgacgagtggaaaaaggaatggctgaaagttgtgttaatttatcaatggttaaattagtgataaaaggaccagcagaatggcctgataggccaaaatttgtgccgtgattcggagccaaaggctgcgctggagcagaagcagcggaagccgggggacctgcggcaaaacgaatgtctgtaaattcatttaaatgccatttactgtaattatttggaccttggcgctcaactttggccatttgttcgttgtaacggcgatcaatgacggctttttcttcgttataacggcgactgatttcggctgattcttcgcgataacggcgttcgattacggcggtttcgtcgccataacgacgctcgattggggcacttttttcttcataacggcgatcaatttcggcaacttcttcatcatagagacggtcgatttcggcaattgcttcatcatagcgacggtcgatttcggcactttggtcgtcataacggcgatcaagttgggcaaattcttcatcatatcggccatcaatttcggctatttcttcttcataacgacgctcgaccgtatgcgtggcgacatgcatctcgtctaagcgctatcgacaggtgaaaactgcaaaaaaaaagaatatagcaagtctagtttactgtatttactagagagcgattacggtatgaacccgtaactgtatttattcgaacgataggtgttttttacggactacagngtatttagcccganagtctgtaccccgtatcaatgcacagcccgtaaccctttgtcttatct

SEQ ID NO: 3759 - DNA, 2358 bp, Heterodera glycines
cgttagtagaacatgcgtcaatgaaatttttattgtcataaaacaagttccttgggttttcaagggcactgaccatgattccggtatccattaaggggcaatttcgaaccccggacacgaattttgtatcactgacgcattttccggtcacgccccgcggcagtgccattccctttgaatttcgattttcggctttaaatgtgttttcctaaaatcgctcgtgttcacaaacggtgtggaagcccatgccgtgcagcaaataagtcaagtcttcggtggccaaattgccggtggcgcctttggcaaagggacacccgccgaggccgccgatgctgctgtccgccacgcgaatgccacgctaatcaaattaatgcgcataccgtatttcctcgattataagccccggggcttctattgttcaacccccctccaaagggggcttatattcgagggggggcttccaatcgagggggggcttttattgttcaacccctttccctatataaattcttaaaattttttgctttctgcataatggtacaatttaaatcttaatctaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaatgaagaagttattacataaattttggaaaaattcgttttttgagaaaaaaaaattaatagtgctgttctgaaaaggttttttgaaaaacacgaaattcttcctctataagcttctgtttattctatatttttataagacttttgaaaaaaagtacaaaaataaactgattttggaattcgggatcatagatggaagcaaatggtttttttgggccatgggttcagatccacttgcctgtaaaaatgttttttagggtttttgggaccactaatcaagaacttggcatccattttgcccaattccaaagccttgatccgaactcgaaaccccaaaaataatttttttaaaatgttgcaggcatgtggatttgaacccatggcccaaaaacccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaattcgaaaattcgaaatttttgaagttttttcgtaataaaattttttccaggcttgaaaatcttttcgcttttggtaaggctaatagagcatgttaagagctttcgagtgataccaacaatgttgtatttggatgtcaaagaaaaaagctatcgtagaaaaagagctggcgccgaaacgcgagcgccgaaacgcgtgggtcccgtttgtacatttagtctttctaaaatattttatgaattttaaaaaaatactatttttttcagaaaatttttgtgttttaaaagtatttaaaattaaaaataacagaaaattttttgtttataaacacgaaaatatgtatatttttgcttttcccaccgcttctcccaccactcactttatcgtgaacatcattcggctgtccgtgttggtgacacttggctgtgcagttgctgctgtcgttgcggcgccgtcctgcgactgttgctgcggtgccgtcgttgttgtcgtctccgttgctgttttgtcgtcattggtggcagtggtcgctttcgttaacagtcgctgcattcgtcgcacactgtgtggccattgccatttgctggcgttgagcatcagcacgggctacaaaagtggggaaaaattttaaaatttccagtggcgcctatcggcacccttccgccggtcctcaaaatttttttccaaaaaatcgcatttcacacacctgcacagcatacgcacttccaagggtcatacgacgtacgatcgggctcagggggggtggtcatatgcgattttccttatgacggggtccgaaatttttgacgacctttttttttttttgctttttaaaatctcttttttttgcggcgcggtcttctcaaaaaaatttcgcgaacgcgggagccggcggtgccgataggcgccgccggggaaaattttgtatttttagtgccatttgctagcagattttgactaaaaaatgcccaaattttgagattttgggctaattttgttaagaaaaaataagggtttttgaggccggcggggccgataggcaccgtcggaaaaaaacatgcagaca

SEQ ID NO: 3760 - DNA, 2899 bp, Heterodera glycines
  misc_feature (40)..(40): n is a, c, g, or t
  misc_feature (62)..(62): n is a, c, g, or t
aaaataatttttttaatgtttgcaggcatgtgatttgacnacatggcccaaaaacccatttntaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaatttttgaagttttttagtaataaaattttttccaggcttgaaaatctttttgctttttgtaaggctaatagagcatgttaagagccttcgaatgataccaagattgttgaatttggatgccaaagaaaaaagctatagtggaaaaacgagctggcgccgaaacgcgtgggtccctgatcttacggaacgggccaactccgcctgaaccaactaagtctgaccaactccgtcttagtgtatatggggccaattccgtctcagaaaaaaaccaatttaatttataaaaaatatccttacataaattcaggaattttttaaaaaacctccttttaattcatgaattatagaattgtataattgagatctcctatttattatttattgaaaaataagaacttaataaataattagggctgcggttcttaggtttttactaatactgtgcctcttaatttgcatattggaaggtggccagtctatgtctgatacttcattaaccgctaaaaaggcaaatgaacaacattccatcactttaatcgagaaaaaataaaacttcttgaaaaatatttagcaaaattaaattaaattgaaaattactaatcaaaatattggttttatatacaaaaaatattatagttcatttaaaaataaaaaaatgtcactgaaaaaattgctgactgttcccgttgaaaaaagaaatgaaagaaatgcacaaaaatattaaagaaataatataaatgaaaataattatgtcgaaatattgagaaaaaaagaaaaaaattgtcagattacgggatatatgaaaatatgataaaatctttcttaacgagccaaaaaaatgaaaattgaaaagagacccgaaaatttagaaaaattaacaaagagattgatcgcaatgttcgtacgaaagctcgtgctaaaaagaataataatttgatacgtcgcctttaggaattattcaatttcaaataattttgaatcaagcacacaagattcagcattcggaataaataaataatttttgaaaatgctgtaagaaatgacgagaaagttaatttttaggagtggtatttttcaaattattacattttccttacaaatttttcaattgtaaaatatgtgccaaacatcgaactatgtgcgatatgtttttatgtgccaaaacgttaaaatgtgcttttatgtttttataagtggctttaaatcgaaaattgtttagagaaaatgcaaaaaatgcttgtcttgggcttttctagtaatgtaaaaacataaaaatcccatccgcactaattactaacaaatttttatgaaaattaggcgcaaagatttatagttatttccgttatatccttccccataaatcgaaattttgttttgacgccagactacactagaaaagtttaggtttttgagatatgactttttatgagggtgaggcatgatggaaaattatggattttgaatcgcttggtacttcgctgatcattcattggtcttattgtcctccgctggaatgccctgctccactgctttgcagaatttgttgtttttggcccattctatctcactttgcgccaaattcaccagctgtttgataactaattttctgttctttggtggatccttggactttgcagatttgttgaaaatttgaaggcagtcagtcattttgacttggtcgtcgtcaccgtcgccgatttcggaaataataaagtattcattaggcagttctgtgcggtttttacagtactcgaagatggtagggatttcaatgtatcgaaataagaagctaagactaaatacaaaaatcggttacgggggaaggaagggagtaatggatttaaaatttacaatccacttgcctcttaatttgatgctgctttaaattgatttgctgaatgtcgtaagttgtgtcctcaattgcatgtttaatattggcatttttcttctgcaccgccaaatcattttttatggcattctccatggctttatggttaactgatttaatgttgtccgactcgtccacatacaaatagggccgatcaagcgaagtgccagcaaaagcaaaaatgggtcggaaagactcttcggagaatttgaccaaaatctttttgctaattttcgtagacggagcatggggcaaagagatgttcaattgattgagggatgagttattgcgtaagaccaattcaatgccacggcattcactcaaaagcagcgcaaagagtggaagaagaagaagaagaaaagtggggaacattgtgatggggagggaaggggatgaaaaatttgatagaataataataattattattaatgatattaaatctgtcaaatgccaattcttagaggggggggggaggagggtggcaaatgatgacgaaaagcgaatgatgtaaatgccaatatttaacgaaaagagggggaaaaaattattcttgcttaatctctttgttttccttttaaaaatcagttagcataaatgcatagcaatattgatttatttttgggggaggggggtagataatccagggtcggagttacttcggtgcggcgttttccggtgcggtcagcaggggcctattcaaattgctcgcatcgtatcgatgctaatttgaataggccccagttcggtggcgccgtcattatttattttattt

SEQ ID NO: 3761 - DNA, 4649 bp, Heterodera glycines
attccctcccattttggcattttttagtcgtggaaaacggccaaatgcttgggcttcgaaattggcggaatcggatatccacatttgatcaaaaaaccatgcaccggtaacattaaaccgaccccaattgggaggggtatacattaaaaaatttccgtaattttttttttttgtggaaatgagtcccgttgaaattgggcgttttgccatggctcaaaaagtcatcctatctacctgttcgtcctgtgccgatttgtccaatgccatggccaccaaattgtttttggcgaagaaaatccgcgaattctgcttgaaatgttggcggaccttcaaaagcaaaaattaaaaaaaaaatttttttttcaatttttcgggtttcccaagaaaatgataattgcacaaacactttaagggcttgaataaaaggaggtatatcgaaaaaaaccacggattgtcacccatttgtcccccctccctctccccattgtgacatttatgccgccccttccctaattttgacaaaaaattgcatttttattttttatttttacctccgccagccttgcagagcgtaaattctccgtcgagaagacaaacaaatgtttgtactgatccacgcattctctgacctaaaatttttgttggaattttcaaaaaaaaacaaatttttttcccgcctctttcaaaatgttttctttgccctcgcggctcttcttcttcacttttgtgagagaaactgaaggaaaaaacaaattgaagaaaattatggacaaatttggctgaagaataataaattgctgaccaactaagtcgcgcttcgattttggcatttgctaaagtgcggaaaattggaataaaaagaattgaaattgaaatacaatagctctgaaatgcttacaaattagcgtttgaataaataacgtgttaatttttagagtcaggtactaaaaaaaaacatgggaacggcagagtggaaaactgaaaaagcagacatttgcacacctatgtcttttttggctattcatgttttttaggtctatgaacttcgaacaaatgtctcaacaaaattttggccaaagacttttgcgaattttcacttttggctgcccagagaaagccaatttggttttgcgtgcacagcctcgacaaatggtagagataaataattaataaattggcttctggactaaaaatgtttttgttaggtagttagcaatatgctggcgatgttcaccaacagagaggagacgaggccggcgcaggaaatactcattcaggcaaagcggaaattaaagaagcaattagtgctaattggtttacgaccattgaatttatatgcttgtttgttcagccacgcttatgccgccgtccgactcggaagtgaatttggcacataaaatgaactcggacggatcggaggacccattcgacattagcgccgcgttggagggcacaaagcgcgccacagggggcgagccattcgcaccaatgccaacggtggacgaaaatgattaaatgcctttttaaattggaaattcggcccctttcagctcgaatcgtccccctccttcgacccttttgaggttattcccgtggaggaactgatagcgaaagcgcgagaaaaagccgagttggaaagggccaaacgcgaggccaagcacgagggcgaatttgtggccgagaattgaatagcgttgcctaacgaccgaccacctgtccgcctcgcacctttcgtccccaacgccggaagggggcagtcccttgtcttccgtggcacggccggtcggcttctacgacgacttcaaaggggcacaggtgagcattctgctgatgattaataattgaaattgtttttataagaatttaatgcgttttccctcttttaaaagaccgctgatgacgaaagtccgttgttcgacgcggacgattctcttccacttcccgaatttccgcttccgttcatcggcgatggatgggaattgttcttacggtatcctcccaagaagaagctgatgaccgacagattttggaagccaatttacgtgcggatgagtggcaatatgctggcgatgttcaccaacagagaggagacgaggccggcgcaggaaatactcattcaggcaaatggcaattaaagaagcaattagtgctaattggttaacgaccaatgaatctatttgttgtgtttgttcactgatcacttccgttgtgcccaaattcaggccaattattcgctgtcggacattgtgctgcaaccgtacgacgctttcaccaaaattcacaccgtaaaattgcaacacattctatacaatgagcgcaatggtattcgctccggtcaaatctcgcacctcgtcgaaggctatttgaccaaatatggccttcctcttgagcacgcggctcacaatcagtgcacagtgctggctaagtttgggtcattgaacgaacggaccatcgccagtttcaccgacgcattagaaaatgtgctgttccattacccgaaaaagcgcgagacggcgccgacctacaaatatgacgaagtgcaggtgaaaaaaagagagaggagaacgatgcgagagtgaaagagcaatagtcgagaatgggtatgctggtcaagagtttacgacggaaaaaattggcactttgaaatgggagggacagagaataattagtcggcaatggacatttagtactttgaatattgacacatttgcattcagattaattgttacgatgagtgcgaggcttcggttttgataattttcggaatcataagttgctcgttgctcaaaatatcttttactcacccggatccgaacctaaccatcccctcccccctcagaatgtttctttggggcagtacgatggcatagtatgagttgggtttcgtccgtgcacttctccttttctggtatttcatttttaagtaagaaaaccaaataaaatataaaattatcccaattttcctttattttttaagctttgttacactaagattgtccaaccctgaactgagtatgaatttacaaaaattaccacaaatttcccgggcccaaaaaataaaaattttcaaaatttaaaaaaaaattccaactttctaaaacgtaaaataaggttcatattccgatttcaatattttggggagttttaactggaatttttcgaatttttcatatataattcagaaatttaaaaaatgcaataaaaatgatttttttttgcgcgattacatttttggagacatattcaaaataaattttcaaaaattttccatcgaaataaatcagttgaaattggctttattttgtaattgggcgccattgaatatttaaaaaattaaaagtaatcttgctgatgatttatttaatattaggtaaattttaattattttattcgagatccaaaaaactttaagaataatgtgtatttaagcacaatttaattaaattatgttttaatttaaaaaaataataaaaatcataaaaaaatcaggtttttgatttttcactttttttgtgaggcgcccaaatttgcacttttgtgaagtggccaaccacgattaataaagtattggtgctaatttttattttttcaattaaatattgttttaaaatatttttttggattaaaatgatggcattaatctccaaaagttaacaaaataattgttttcaccaaatattcatgcactttttacattacaaatattttaaaatttaataagtatatatttaaatggaaagttttaaatgaattttttttttttgtattaaaatattgctttttctattcactcattaagttatttttttttgattgttcataatttttacaaaaatattatgaataatttcaaaaattctattaaaaatggttatctgttctgattatatcaaactttgtgaaccagtcataattaagctggttagcgtagtaataaatttaaaataaatcattcttcattaacttaatttttgtttaattgtatttctttcgcataattaataattaaaaataattctttgcacggtttttgatttttaattttcatttacattttttataatgtatttttaaaatattgttattaattattgtttttaagtattttttccgttactttatgaaactttgtgataataatattatatcaaaatactatagaattttatgaaaatgttatttatttcctttgtttaccttttgacgtttacagaagctgatgaccgacagattttggaagccaatttacgtgcggatgagtggcaatatgctggcgatgttcaccaacagagaggagacgaggccggcgcaggaaatactcattcaggcaaagcggaaattaaagaagcaattagtgctaattggtttacgaccattgaatttatatgcttgtttgttcattgatcacttccgttgtcccaaattcaggccaattattcgctgtcggaacaacggacggaagaaaaggcggaggaagcgaagcgcggagcagcggaggaattcgaggcggacttcagcaaaatggacgctgagaacccggcccaacggttgggcggcagccgttgagcaggccccgcttatgccgcccgccgacctccgaaagaattttgcacataaaatgaaatctgaacgaatcgaaggacccattc

SEQ ID NO: 3762 - DNA, 1629 bp, Heterodera glycines
  misc_feature (28)..(28): n is a, c, g, or t
tacgcttcgtaccattgcgcgagtgacncgctctgttctcttttggtctacgacaattttttaaaagcggtaaacaaaggatcatgattgcacgaatattgtttttgtattaatatttttttttcgcaatgatttttttaccatttgaatgggattattttggtgcataaagcatagaattgaagcactcttcggaggcatgcgaaagtattgcctatgggccagtagaagctgaaaaatgattgtggttgagtgagcataataattaggttttcaatgcttttaaaaattaaatcttttttatcaataaatgcatttaaaatctaaatttatcaaagtaaatctaacatgaaaaatttaataaattaatttcattataagtttgtttgggtgagttttgatttaaaaatgtaaattttaatttgttttataatttgaatttaatagatagaaaattgaattaaaagaatttattttttatttcttaagtttaaattaaatatatttaaattaaaatgaaaatattattttattaaataaattctttcttcgacttgccttagcgatggaattttgcgggcttttctcaatattagcatgtgaaatcttaattttttcccaatccggaaaccggttccggcaatttgaaaatatgctttgaccggttttcgggattgaccagttttcaagagaccggatccggaaaccggttgcttttgaaaatatcagtacggtccgacatttcgaaacgtttggtctctattaattataaaacaacatattacattttttgaaaattactgttttatttttttaattataaattaaaaaaattattatataaaatatttggtggcaaaaaagaggcaattttgagaaattacatttcaaaaaataaattatatgcaataaaaaagtgaatttattcaaaaaatgatcataaatttatgattacttttttttcaaaacatctttttttcacggcgcgctttttctaaagacttttagggagaaagaggttagacactttatccgcttcttcttcttctcccgctggtggcgaaaatagcctaaaattaatgaactttattttccgacaaaatcaaatgctattgctgtgttcacccaatggatttatcgaaattccacagattaaatacgttaattaataaaaaatatttcaacttataaattattatttttttcttttttaaacagcataaaattgcaaatttaaccaaacatttggttattttttgacaaaatctgtaaacaaatcgaattatataaattacaaattttttcccccggcggcgcctatcggcaccgccagacctcttgttcgagaaatttacattgaaaaaacgcgacgcggaaaatttcaacgtatttttccctgattctttcttttttaatgtctttccaaagtaattttcgatagtcaattggaacagcgaaagtgggcggagcaaaacaatttagaaataataaaatttataattttattttagcgattttcttggcaatgccaccgcatttctgttcacaccaaaatggacgaaccgtttgggctcggaatgatcgaagcaatggccacggggacgccggtgattgccattcaaccggggg

SEQ ID NO: 3763 - DNA, 2236 bp, Heterodera glycines
gatgattaataattgaaattgtttttataagaatttaatgcgttttcccttttttaaaagaccgctgatgacgaaagtccgttgttcgacgcggacgattcacttccacttcccgaatttccgcttccgttcatcggcgatggatgggaattgttcttacggtatcctcccaagaagaagctgatgaccgacagattttggaagccaatttacgtgcagatgagtggcaatatggtggcgatgttcaccaacagagaggagacgaggccggcgcaggaaatactcattcaggcaaagcggaaattaaagaaccaattagtgctaattggtttacgaccattgaatttatatgcttgtttgttcattgatcacttccgttgtcccaaattcaggccaattattcgctgtcggaacaacggacggaagaaaaggcggaggaagcgaagcgcggagcagcggaggaattcgaggcggacttcagcaaattggacgctgagaacccggccaaacggtgggcggccgcgtttgagcaggccacgcttatgccgccgtccgactcggaagtgaatttggcacataaaatgaactcggacggatcggaggacccattcgacattagcgccgcgttggagggcacaaagcgcgccacagggggcgagccattcgcaccaatgccaacggtggacgaaaatgattaaatgcctttttaaattggaaattcggcccctttcagctcgaatcgtccccctccttcgacccttttgaggttattcccgtggaggaactgatagcgaaagcgcgagaaaaagccgagttggaaagggccaaacgcgaggccgagcacgagggcgaatttgtggccgagaatcgaatagcgcggcctaacgaccacctgtccgcctcgcacctttcgtccccaacgccggaagggggcagtcccgtgtcatccgtggcacggccggtcggcttctacgacgacttcaaaggggcacaggtgagcattctgctgatgattaataattgaaattgtttttataagaatttaatgcgttttccctcttttaaaagaccgctgatgacgaaagtccgttgttcgacgcggacgattctcttccacttcccgaatttccgcttccgttcatcggcgatggatgggaattgttcttacggtatcctcccaagaagaagctgatgaccgacagattttggaagccaatttacgtgcggatgagtggcaatatgctggcgatgttcacgaacagagaggagacgaggccggcgcaggaaatactcattcaggcaaagcggaaattaaagaagcaattagtgctaattggtttacgaccattgaatttatatgcttgtttgttcattgatcacttccgttgtcccaaattcaggccaattattcgctgtcggaacaacggacggaagaaaaggcggaggaagcgaagcgcggagcagcggaggaattcgaggcggacttcagcaaattggacgctgagaacccggccaaacggtgggcggcagcgtttgagcaggccacgcttatgccgccgtccgactcggaagtgaatttggcacataaaatgaactcggacggatcggaggacccattcgacattagcgccgcgttggagggcacaaagcgcacagggggcgagccattcgcaccaatgccaacggtggacgaaaatgattaaatgcctttttaaattggaaattcggcccctttcagctcgaatcgtccccctccttcgacccttttgaggttattcccgtggaggaactgatagcgaaagcgcgagaaaaagccgagttggaaagggccaaacgcgaggccgagcacgagggcgaatttgtggccgaaaatcaaatagcgcggcctaacgaccacctgtccgcctcgcacctttcgtccccaacgccggaagggggcagtcccgtgtcatccgtggcacggccggtcggcttctacgacgacttcaaaggggcacaggtgagcattctgctgatgattaataattgaaattgtttttataagaatttaatgcgttttccctcttttaaaagaccgctgatgacgaaagtccgttgttcgacgcggacgattcacttcccgaatttccgcttcagttcatcggcgatggatgggaattgttcttacggtatcctcccaagaagaagctgatgaccgacagatttggaagccaatttacgtgcggatgagtggcaa

SEQ ID NO: 3764 - DNA, 1226 bp, Heterodera glycines
ctatttgttgtgtttgttcactgatcacttccgttgtccccaaattcaggccaattattcgctgtcggacattgtgctgcaaccgtacgacgctttcaccaaaattcacaccgtaaaattgcaacacattctgtacaatgagcgcaatggtattcgctccggtcaaatctcgcacctcgtcgaaggctatttgaccaaatatggccttcctcttgagcacgcggctcacaatcagtgcacagtgctggctaagtttgggtcattgaacgaacggaccatcgccagtttcaccgacgcattagaaaatgtgctgttccattacccgaaaaagcgctagacggcgccgacctacaaatatgacgaagtgcaggtgaaaaaaagagagaggagaacgatgcgagagtgaaagagcaatagtcgagaatgggtatgctggtcaagagtttacgacggaaaaaattggcactttgaaatgggagggacagagaataattagtcggcaatggacatttagtactttgaatattggcacatttgcattcagattaattgttacgacgagtgcgaggcttcggttttgataattttcggaatcataagttgctcgttgctcaaaatatcttttactcacccggatccgaacctaaccatcccctcccccctcagaatgtttctttggggcagtacgatggcctagtatgagttgggtttcgtccgtgcacttctccttttctggtatttcatttttaagtaagaaaaccaaataaaatataaaattatcccgattttcctttattttttaagctttgttacactaagattgtccaaccctgaactgagtatgaatttacaaaaattagcacaaatttcccgggcccaaaaaataaaaattttcaaaatttaaaaaaaaattccaactttctaaaacgtaaaataaggttcatattccgatttcaatattttggggagttttaactggaatttttcgaatttttcatatataattcagaaatttaaaaaatgcaatgtaccatggcatataattagagaaaatacggtacataattccaagcataaattttgtgtgttgcctttaagtcaaaatttaatatacataattcccgagacttttaaacagggctgccaagtgtccttttttctaagatttgtcctttgttttggcattccctccttattttaggcttatacttggatttgaaataaaa

SEQ ID NO: 3765 - DNA, 3608 bp, Heterodera glycines
tgaaaagttgaaaatttgagaaaggaaaacatttttatacgcttttccacattaaccaaatgcaaaaatattttcaaattcaaaatttacccccccgctaaaaatgttttgcgtataaaaagttgttgcaattttcaattaaataattaaaatatatttttgagggtcaatcagtgatttttctttttccttttacgtctgtgcgtgtcgcgcccgccctcctccagcagcgcactctctctctctctccctcggtcggtcagtcattgcgccaccgctcgtctcacttggaacagcacgtgccgcgccgctgctgtgccgccgcctccgccgcggagatgtccacgccgctgcgtccgtggcccgacggaccgccgccgccctccgtctttggcagttttttggctgaaaggggacaaaattgaaaaaaaataaaaaaatgaatttaaatttgaaaatgctgaaacttttatttttctatatgatcgacagatgatgattaaactaaatcagaacgaactgtcaagttcagaatatttcagtgctaattttgcttattgacaactcgtgatggcaaattatttgtatataaccacattcatgttgtaaaaaatctttattgaaaatgggctttttttattcttttaacaatttctcaaaaattttcccgtcggcgcctagcggttcttgttgccggaacagtattggaaatgatcaatttgaaatggcattcaaacttcaataaataagcatcgaaacggagaaatcgaaatggggtgctgtcgattgaaaaacaaagtctgggattttagtttgacatttaatgataaatttcgggtgggatagggaagacgaaaagcactgaaacaaaaaaaaacaacggaccaatggcaaggaaaatgtcgttgacattcatcgacgacttggcactggtctccatgaacaacagtccgttgtcctccgcatacgcttgtgcctcctcgtactccaccatgcgtttggcggccaagtccgccttgttgccggccaacgcaatcacaatgttcgggctggcctgccgctgcaactcgcgcacccaattcctcgccttcgcaaacgattcctgacgaaggaagggacagagagcgttttatggaagcaaaaaaaaaggaaattaatttataaaaaaatataaacatatttatagagcataatatgaattcaggcctggatcctgtccagaaaatcaaggtccaatatgggataaaatccaggttcagatgcaagtacggcacgaaaaaactggcttttctctacattttgtatgtcggttaaatgacgaataaggtccaagtaattaatagacgtaaccgtaacgaaattcactgagaaaggtcttttttgggtagtagtgaaatatgggccacaaatccatgcctattaatttttatgatcactaaccaactgaaatttgggaccgcaaatgttagatttggacgggtttttgcaagagcccaagtccaccactgggtttaaaacaagcctggttggtgatgtcgtagacgacgatggccgcctgggccccgcggtagtacatcggtgccaacgagtggtagcgctcttggcccgcggtgtcccaaatttcgaatttgaccgtcgcgtcgtccaggcaaattgtttgggtgagaaaggcggcgccgatggtggattcttggtactcgtggaactgacccttgacgaaccgcaacaccagcgacgatttgccaaccgcactttcgcccagcagaaccaacttgagggggaaaacagtcaaaatttgaaaataggcgggggaggggaaatatttacaatttgaaacgaaaatcattatagaaatattatagcgcattacagaattattttatggtcctgaactgcaataaaaccccctgctcttcatcttaatttagtagcgcaaattcaatggaaaatcccaaaattttgggggtgacaaaatatacaattaatgccaatatttataagcattcaaaatgggtcaacaaatggattaaaaatgttttaaaccttgaattgacaagttttcgtgggcgctcctccgttccccgggcgtgtgcgctgcgcagacattttcagtcaaaatgaaaaattgcttagaaaaataagaaataaattatttgctaaacaattttaaatgatgcaaaagaaaaaatggaaaatatgcgcagaggaaacaccaaaaataaataaatagaaaacgctccttaagaccagattttttgtaaaatctgattgtccaaaattcattcagcttcaaatttcttcaacaatattttttctcaatgagaaaaaatggaatttattggccataaaatccgggccctattcataattaggtaattaatttttaatttaatcgaataaaaatgcaaaacttccgactgcagaacagagagcccccaacagaaattgaatacataatgtgataaggggaagaaaggaatctaatcgaacttttcaaataaacaattgaaaaaagagatgagagaaaaaaagggaggaaatgtgcggtgaaatgaattgaatgacaacagcggaagagaagagagggacgcgcgacacaaagggaagaggcgaacggaagacatttctaatacatagcgcagcagaagagattcatcggattgttcgaattgcactccgacagttcgaacacggtgattttgcttcccaagaaaattgaaatggagtgaaaactcgaaacgaaaaaccaacttttaccatcttatttttaatcctcggcttaactttgcacaagttacgcccctctctaacaaagcatttgcttacattaaactcttcgttcaaataagttcgtctttctttgttaaatgataagcatgaagaaaaggataatgataatttcgttctacgaatttttttcggaaacatttccggtttctaaaatttttattttcttttcattttcaaacttatttttatgtatgttttcgcgcaactctactggggatggacggccaaaaatcgctgcttttatacacttttttacattgcatttgcctacatttacagaagagtgactgctgcaaaaaattctgtcttttacagaccgagttgatttgtgtttaaatatgccaaaattcagcaacaccttcattttctcatttttttgtctccaacttctcgactattctctttgcaattgctacgctccaacccaactctccattcatttaaagccttgttttcaagtgacatttgctcctttgacttttgcgtctcgaacatttgcgcccaaaacaattacgcttaattgttttcggctccaatgttcggactcaaatgtccgagttgctaatgtacgcacactcactgttctcgccatcactcatcacggctttttttttcttctcccactctcagttttcccttcccgtgtgccgacaaaagaccaacccgacaaaagaccaactaacacaaaaatgacaaaagaccaactcacccaaaaacgacaaaacaccaaccgacaaaagaccaactcgacaaaagaccaactatgctaaaaaacgacaaaacaccaacgccaataaaaaacgacaaaaaaccaaccc

SEQ ID NO: 3766 - DNA, 2534 bp, Heterodera glycines
  misc_feature (2526)..(2526): n is a, c, g, or t
gataaagaatctatttcttattcttttagagttcgagtccgttgtgcaacatgaatatttttatttatttttgtccaaaatattaaaaattgctatttttggaaattgtttttggaggtttttcccaacaaaattggacaaacttggtatcattcgaaagctcttgatgaggagaagctttttctaagcaaatgttaagtaatttgatgagttcgaaaaaagatatgaacgttcgaaaatttaaattaaagtttgaataattgtggtttttttattgctttttgcccatcacactgtcctattgccaatttttttgcctcacttttttgttgttttattacttatttcaactaccttttttgttacaagtaataaattttaagataaacgttaacaattggtattaatagttgcaattttgtcgttttttggtagagttgttttttgtcgttttttaggttagttggtattatgtcggattggtcttttgtcgggttggttttttgtcgttttttattggcgttggtgttttgtcgtttttgggtgagttggtgttttgtcgggttggtgttttgtcggttggtgttttgtcgggttggtgttttgtccgcgcgccttccttccttctcttcccattcccaacacctccctttcctcccctcccattcgtcgattaacgattaacccactttttgctttctctcctttccacatgtgctagacatcgctgcatctctgccttaacatttattcagcgcttattctcctctgagtttcatttctaattttctcggtctttccaatttcatcactttttctttcccaatgtaactgtaatgtcatcatttttatagtggccttaatacataacatttgaattatcttttagcgatcgaattcaacaccctttcaatttggctatcatgcaaatcttcgtcaaaactctcaccgggaagaccatcacccttgaggtcgaggcgagcgacaccatcgagaacgtgaaagcgaagatccaggacaaggagggcatcccgccggaccagcagcgcctcatcttcgctggtacatcgacttttgatatgccgaaacaatcatttttatacccaacccttattttcagggaaacagctcgaggacggacgcaccttggccgactacaacatccagaaggagtcgacgcttcacctcgtcttgcgtcttcgcggagggatgcagatcttcgtcaagacgctcaccgggaaaaccatcaccctcgaagtcgaggcgagcgacaccatcgagaacgtgaaagcgaagatccaggacaaggagggcatcccgccggaccagcagcgccttatcttcgctggtacaatttgatgtgccgcaacttttaatcataaacccttgttttcagggaaacagctcgaggacggacgcaccttggccgactacaacatccagaaggagtcgacgcttcatctcgtcctgcgccttcgtggtggaaagaactagaacgacgaacggaggagatgattgatccgtatcgatccatattttatgtaacttgagaccgtcctgtattgtgttccgttttattcatcatcatgaaatgtatttcaatgatcacggaacgataaatccatcaaaactctgtcttatcttctcccgtcggaaaattaaggttttgtctatgaaaaatttgggcttagaatttacaaagtaattggtagaagtaaacatacgtaccacaattcgttggtacacacccaacttgtactttgagatgagttccagctttaaagtttacttacactcaaaatggggtggagcaataaatctgtaaggatagcagagctagcttggcactttttagagcccaaatttgaatgtatcagcgcgggtttacattagaattattgtacgaaatgccggaaaattatttttgtacgagttgcctattgcgtgtattgtcatggcacaaaaattctactaaattccctctttttaagctaaaatgatatttacatgtacacaccgtttcaaaaaacgagacatgtgtcaataaatagagagtgcagagaaaaatacatttctctcaatttggcgtactatttctttacagagaaagaaaaaactgaagaaatgacgatattcaagaatcttttttgagattttttgccaaccaaactggacaatgttggtatcattcgaaagctcacgttggggagaagctttttctaagcaaatacaaagcgatttgatgaattagaaaaaatatatgggacttcaaaattttattttttgaataactttttagctgaccctttttttgcttttaaaaacccttaagttttgttcgcaatttttttctctatcgagatgcaaaatttggtgttgatttaacgtgcagaaaaaaagttaaacgtagcgaagtaaattcggtttttctctattaacagagataaagaaatagtacgccaaaaagagagatgtttttttctttgcactctctatttattgacacatgtctcgttttttgaaacnggtgtgta

SEQ ID NO: 3767 - DNA, 931 bp, Heterodera glycines
  misc_feature (765)..(765): n is a, c, g, or t
  misc_feature (851)..(851): n is a, c, g, or t
tttattgttatttttttgttcataattttggttgttatcaacaatttctttctttatggcattaatttctccgaatttttgttttttgatgtgttttgtggtcgattgttttaggtttttccacaaatcatcaaaaaaaatcttcatcaattccatcaattaaaacgattaaataaaagaagaaaaaaataataaaattaatttgcagcattttttatcttaaaatattttcaaaaacaaatttatgaataaaatatttcgaaacgaatttttgaatttctgcgtgtataaattattttatgattaacagaaattatttaaaaatatacattttttaattttcccgcccccaccacaaattgcatcaatattttgctattatcttaaaattaccatgtgattttaatttttttctatatgaattttgtcattatagaaaaaattattaaagataattgatttaatcttaacgtgttgaagaataattttaattttaaattcaaaaatgtttgttaaatttaagaagaataattttttaattttaaattcaaaaatgtttgttaaatttccataagctgaatgaatgtggtgccaagatgaacataaaagagatttaccagactctcaaatatacaaaacctatacgatacggtaagctcactaccgtataatgcttaacataaaattgctcttagtaaatgggagagaaggtgccatatccatatttagtgatcctgaaaaccctgaattggattgattttctgngtttttataagtagttagtatccgtatctcatcgcagggtgtgaaatgataaaatggggttttttttccctttgatctttgcgcgnccgccggggggggggggggggggtaataaataattaaggggagggggggggggggggttaatttatgggggggggggggg

SEQ ID NO: 3768 - DNA, 1248 bp, Heterodera glycines
ggggggcgtcagcggcgaatgatgatgccggccgtgcatatattatgcaggcaaagaacaaaatgagagaagagaataaaagagagggagaggcagacagtggaaaataagagagagtgtgagagggagagagaataaatgaaagagagaggcagagataaatgagagagagagaggcagacagtggaaaataagagagagtgtgagagggagagagatggagagtgcgaaagggaggggaagagatgagacagcagacaggcagagaaaattggggaggagtgggtcggagagagatggagagtgtgaaagagaggggaagagatgagaatagcagacagacagagaaaattgggggagcgaaaatgccgataagcgaatgagggggggggggggggcgtccaccctttgccatagcaaggggaaatgttgcaaataataaccaaaaacatttaggttaaggggaggggggcataaagtcagcaaattatacgaaaaatgggggggggggtatcccaaaaacttgtcaatttgttgatccagcaacattatgatgttgttgatgggcaaagaaaaggacagcaaattatgataaaaagttgaaaatagatcaaaacgggtagagggggggggggggaggagaattggatcacttcacattattttgccattcagtggtttcccttcatctgcagtgaatgtgaaccggggctggtatgctaccatcccggtaactaccgtaaacccatcctctgtttacattccagtattaacaacctaaccgagtttttgagggagggcaagactgaaacgacatgtccaaccgagacaacagcaacggtcagcagccctatcatctgtcctccgcctccactaacgacaactcacagcattctactgttgttcatcacttctctgcttcttttggtctttttcgcgcaggtccaccccccccccccctcccccgtctaatcattaattattttttaaatttttttttcaatttacaggctttcaaaatgggcattgtggcgcggcgtctgctcaaaaaccgggccattcaaaagcagttggaccgtcgacaaaaaagtcggttgaattatgtggaaaaactttaaaagataaaaattttttttttaaagatctgaaaacgcttcgccgtcaacacgcggcagctggccggccgcccattgttgtgcattcggcggtccttggtttgccaggaccgcggccgtacatcaagtaaaa

SEQ ID NO: 3769 - DNA, 4159 bp, Heterodera glycines
  misc_feature (3996)..(3996): n is a, c, g, or t
  misc_feature (4062)..(4063): n is a, c, g, or t
  misc_feature (4081)..(4081): n is a, c, g, or t
  misc_feature (4133)..(4134): n is a, c, g, or t
cccccccaataaaaaaaatcgttttgtgttcgccaatttttgccccctccaaagtactttgctcccccaatttgtagtgatcggcccattttaattgtaaatttaacaatttcacttttggtccccattttttatctctttccctattccatatttaaatggcccccaaatcactcccaaatcattcccaattcacattcacttcgcttttacgggcaatcaatgcctatccctttgccctctctcacacactctctctctctctttctccctttgcccatccttggaccacttttgaccatttcttttcctggtccctttctctctttccactttttgcacttctcctggcccaacatttgtcccccttggattgtcccggtgaatcccgcatttctgtgattgtccccccggtgacggcccctctttctgtgattgtgatcatttgtccccccggtgatggcgcatttcatttttattttttgtattgttcacatttaaatatcggtttaattacccaagtttgagagggaacaataaagcattattttgttgtgtgaattgtgtgttcgaccaattgcccccgacccatcagacgagcccgaccatccctgaccggaccccgttggcactaccttgtgcaaatttttgtggaggtctccacaagtggcgctcctgggtggattcttcgtccgccagcaacagcaacagcaaccggtgacaaaggggagagggaaagcatcggaaagtggataagttcgtgctcttcgtggccggacttagacacataggaagggaaggggggaagcaaaatttgggctttgttgggcactgttcggtctccgtgccaacagtgactcgactaattacagttcggtctccgtgccaactgtaatttgactttgggggttgtaagcgcaggtctaggaataactgcctggtctccgtgccggtagttgttcagttactgggcgacctccgtgacccctgtgacaaagtactgaggaagggaagggggaagcaaaatttgggctttgttgggcactgttcggtctccgtgccaacagtgactcgactaattacagttcggtctccgtgccaactgtaatttgactttgggggttgtaagcgcaggtctaggaataactgcctggtctccgtgccggtagttgttcagttactgggcgacctccgtgtccccagtgacaaagtactgcttgctctccgtggcggcagtacttcgtcggcgcagacaagtcaaacggccgacaacaacaaactgctcgaacaaaaagcagtggtcaacaaagcgcagtgaaacgcacattgaaaagcagcagcagaacaacttaacagagcaaagcccacggcaaacaactcacaatggcaagcctaatccagaagggcatcacattcatactcaaggcgctggataatgccagaacaaccacggcactttcactacatccagacgccgacctctcaaactgggaaaacgcagtcaaattggagactcaatgcactcgcgtgaacagataagtccaaacaatcgaagcacaactggacaatctacgcgacctctccaacaattggattgacctgctaaaccgcctcgaaggagcagaaaaagacaaaggcgagaaagaatacgtcaaattcgacacgtatgagaaaattgccgaacgccatgatgcagccacaaccaaactccgggatctgcgggatctcgaagcaacgctcagtgccgatgccaaactttaccgaggcagagcagaaagacaagcaagagcggatcagcaagcaaatccgccaccacaaacggcaatgccaccaatggaagcacctacattcacggcaccgctctatcaattcagccaatccagctggacaaaattcttcggtcaaaatctaaaatggccagaattctacgagtccttcaaatcggccatcggcagccaattaatcagcaaagcacagaagctgaacttgctccgcaatcttctgggcggagaagcacgggaactcatcgctgggttccgcctggaggaccaaaactacgagacggtccttcagttgctgaaggacacttacggcgcacccgaagagcacatcagggcgctacactttgagctggccaatctcaagacgtgccgaagtctccgagacacaaaagacttcctgcttcagctcgaacgactgacaagagagctgaacaatgccggagaggacatcgagggaccgcaggtgttcctcatgttggagaaaaagctgactccagcattcctacgcaacatcctcaacaaaaagggagaggatccggcaaattggacaacaacaaaattccgggacgtgcttaacgaagcagtccgcaaggaagtccaaattcaagaggtgatgggtgagtacggacaccaccatcagcaactcaatcgaccagcaaggccgcaaacacaagcacatcaaactcagcgagcacgcatgccgacagcaaatttccggaacagaaatgcatctcccgccaatcaggaacgcactttcatgtcctcaacaattgaggaggttcagcaacgaatgaaccacaggccgcaactgcggaagtcccaacagaggggaccaaggccaactcaagcgccttacaacgtgccaatccggaatggcacagcacaagcagggtcaaggaatccgccttcaccctgcatcttctgctatggcactcactggaatgagaaatgccagaaactcagtaccgttcagcaacggtcagcctttgttcgagaaaaaggcttgtgcttcaagtgcatgaaaacaaatcatcgggcaaacgaatgcccccgaccagcaaaatgcatgctacaaatgcaaacggtcacacccaccagcactttgtcatgaagccgagcgctgttaatgacagcgagggccacaatttacaatccggcacagccatgcctcagcatgatggcaacagtgttcatagacccgggaagccaccggtcattcgtctcatgcaacacagccaagcagttggaactgaccaaccttggaacggaggaatgcttcttcacaagctttggcgagcgagagccaaagagatacgtaagcgaccgcgtcgctattggctttttgtgtcccgacggggaccgattcatcttcaacctgaacgcactgaagttcttgttgaacaatttgccagtcttgcagctcaatgcaatggacaacatgcagcttcaacagaagaagctttacataccacatgagtcaagacagcctgacgtcatgctgggtatggacgtgtgacacgaactgcaagtgcaacccgtcgaacgactgccaagcggcttcacgatttgtcaatcgaaaattggccaaatcatcagcggatccggacgcattgaactcagtcaaccgtccaacgtcacattcgtcgtcacagtgacggacgaaaatgtcttcaccacagaggaagacttgaaagccgacgatgactcaacaagttctacggcttgaaatcatcggcacggacgattcatcaccaccgattgaccacgacgaagtcatgaaaaacttcaaacggaatttgtcgttcgtcaacgaccggtaccaaatcgcattgccgtggaatgacaaagtgacacagttgccaacgaattatcatcaggcgaaagcaaggctaataagcctcgtccgaaaactgcggacaatcaacttggtcgacgagtaccaagtcattttggatgaacaactgcagaatggcatcatttaaagggctaacccagaccattcttgtggaccagtgcattatctgccacacagggcggtaatccgcacggacagagccacaacgaagattcggatcgtgatggatgactcagcaaagcccaaatccactccatcggcaccatcactcaacgaatgcctgcacacgggtccgttactgctcaaggacttgacgggaattctgttccgcttccgtcaaatggaaaaagtcgtactggncgacattgaaaaagcattcctgcaatttgggagtacgagagcaagacagagacgctacacgatttnncctttggtggcaaatccnaagggaggcaacctcgaccaactcagaaaagaggacatcaacattctccggnntctgcgagtcagcttcggcttgacc

SEQ ID NO: 3770 - DNA, 3926 bp, Heterodera glycines
  misc_feature (3456)..(3457): n is a, c, g, or t
  misc_feature (3471)..(3471): n is a, c, g, or t
  misc_feature (3478)..(3478): n is a, c, g, or t
  misc_feature (3480)..(3480): n is a, c, g, or t
  misc_feature (3487)..(3487): n is a, c, g, or t
  misc_feature (3491)..(3491): n is a, c, g, or t
  misc_feature (3497)..(3497): n is a, c, g, or t
  misc_feature (3500)..(3500): n is a, c, g, or t
  misc_feature (3511)..(3511): n is a, c, g, or t
  misc_feature (3516)..(3517): n is a, c, g, or t
  misc_feature (3526)..(3526): n is a, c, g, or t
  misc_feature (3528)..(3528): n is a, c, g, or t
  misc_feature (3534)..(3534): n is a, c, g, or t
  misc_feature (3540)..(3540): n is a, c, g, or t
  misc_feature (3542)..(3542): n is a, c, g, or t
  misc_feature (3546)..(3546): n is a, c, g, or t
  misc_feature (3550)..(3550): n is a, c, g, or t
  misc_feature (3555)..(3556): n is a, c, g, or t
  misc_feature (3564)..(3564): n is a, c, g, or t
  misc_feature (3570)..(3570): n is a, c, g, or t
  misc_feature (3583)..(3583): n is a, c, g, or t
  misc_feature (3588)..(3588): n is a, c, g, or t
  misc_feature (3597)..(3598): n is a, c, g, or t
  misc_feature (3600)..(3600): n is a, c, g, or t
  misc_feature (3602)..(3602): n is a, c, g, or t
  misc_feature (3604)..(3604): n is a, c, g, or t
  misc_feature (3609)..(3612): n is a, c, g, or t
  misc_feature (3624)..(3624): n is a, c, g, or t
  misc_feature (3627)..(3627): n is a, c, g, or t
  misc_feature (3636)..(3636): n is a, c, g, or t
  misc_feature (3648)..(3649): n is a, c, g, or t
  misc_feature (3655)..(3655): n is a, c, g, or t
  misc_feature (3658)..(3658): n is a, c, g, or t
  misc_feature (3681)..(3681): n is a, c, g, or t
  misc_feature (3683)..(3683): n is a, c, g, or t
  misc_feature (3709)..(3709): n is a, c, g, or t
  misc_feature (3718)..(3718): n is a, c, g, or t
  misc_feature (3734)..(3734): n is a, c, g, or t
  misc_feature (3747)..(3747): n is a, c, g, or t
  misc_feature (3761)..(3761): n is a, c, g, or t
  misc_feature (3782)..(3782): n is a, c, g, or t
  misc_feature (3790)..(3790): n is a, c, g, or t
  misc_feature (3802)..(3802): n is a, c, g, or t
  misc_feature (3809)..(3809): n is a, c, g, or t
  misc_feature (3811)..(3812): n is a, c, g, or t
  misc_feature (3816)..(3817): n is a, c, g, or t
  misc_feature (3819)..(3819): n is a, c, g, or t
  misc_feature (3823)..(3823): n is a, c, g, or t
  misc_feature (3825)..(3825): n is a, c, g, or t
  misc_feature (3830)..(3830): n is a, c, g, or t
  misc_feature (3832)..(3834): n is a, c, g, or t
  misc_feature (3852)..(3852): n is a, c, g, or t
  misc_feature (3862)..(3862): n is a, c, g, or t
  misc_feature (3866)..(3867): n is a, c, g, or t
aaaaatggaagacactaaggtgttgggcatcaagtggacgccaagatacgaccaactcgttttctccatgccacacttcgacagcccaatcaccaagcgaaacattctttcgcacattgccaaagtatatgacccactggggctcatttcaccggcacttctgccagcaaaacacttccttcaaatcgtccaaaacgcaaactacaaatgggacgacccgttggaagaggatttgaaattgatgtggataaaactgatgcatgcgtgggacggatttggattcaactcactcgtcgaattcccacgccacatcatcgctgggataagcgaagagttccattgctattgtgatgcgagcaaatctggtctgggtaacgcgttgtaccaggtcgcagaaacgcattacaacaaaagggaaagcaatttgatcttcggcaaaagccacgtcaagccactcaaggtcgcgtaccacaattcgaccatacccaaattgaaactccaggcactcactttgggagtcatggctaccaagttcgtccaaacacagctcaactttgccgacagccaagtcactttgtggacggacagccaatgctcgattgagcggttgaaggaaaaccgcacccacgacagattcgtagtcaatcggctaaagaagataagagaagcaaacttcaaagtccgacacatccgaacagctgagaatccagcagacatcgcctcacgccgcacagacccgcaaagcctccaagcctcattgctttggcgatatgggccagcctggctcaccaaaacacacaaatggccagaaacgaacgtcacttacactcccggagaagagacacgggaagagctgagccaccgatcgtcgagtggagtgcagcactccaagaagagcagaaattcagcccgtcaatccaatttgaaaggttttcgaattggaaccggctcaaggcggcagccgcctatgccattcgtttcgctttggcacttcttcaaaaaagaaatgtcgttccggcgatcgattcacttctgtatcagcaagaaagacaagcggggctgcttacggcaaaggaattggaaaatgccgaaacatggattttgttggaaacccaacggcttcactcgcccacagaaacagccacaaacaatttaaaattgtccagctcgagctccatcgagccactgagatgccaggggcgattggaaaacgccgatctgcccaacgaaagcaagcacccgacctttttaccggcagaagcctggaccaccaagctcatcgttatccactacgatcgggcgctgaagcactgcggcccacggacgcttctctcaaaacttcgagaaaattattggataacaaaagggcgacagacagtccagcacatcctcaactccaacaaattcggatgtttgaagtgcagactggtgagactcaagccatacgcttatccggacgctcctgacctgcctgaggactactcagctgaagcatttctgagagccttccggcgatttgctgcacggcgcggcattcctagtttgatgatgtccgaccaagggacaaatttcaccgccggcgccaaaacgatccaagaaaattggacagtgcaattgttcccaaacgaaatcagtggacaattggcccaccaaggagtcacatggctcttcaacacggcacacgcaccttggcgaggtggtgcctgggaacgacttgttggcataacaaaaaatgccttacgacgaagcatcggtcgaaatctcctcacgtgggaggaattctgcacactcaccgttgagattgaaacgatcgtcaattatcggccattgatattcgagtcggaccgtgaaccgagccccgtcattcgaccaatcgattttctgattccgtactggcctgcggaaacgaatttccaagtgatcgccgtggatccagaggatcctgagtacacggagcacacatgtcgccgctggcgactgaacgcgtggaaattgggggacagccctgaggatcgctcggaggacagcccggaggaccgctcggaggaccgtttggaggaccgcccggaggaaagaaatgaggaagtcctgtggaggacggaagaagattctcgaatgttcccttgtgatctttgtgattaatattcccgaagtttccccatttttcatttcctttcaggtgtgttttagaattttccctccctgtccaaatcccatatataaacccgaatatttttccctttagaatatctctcgaaaaatcattattccatcctttgattgtgcgctattccgacaaataaactacttcttgtctaagaagttttttgttccgaaggtgttcctttttctctacggtttcgacattccctgaactcagagttccgtgtttgcatttgtctaagctcgattgtcccgaagtccaccaggacagtccaactaagtctaaaggggctgtccatcccacaagtccattccaagagtgaaaaccccgtcccattcgctaagttcaataacattgtcgcggagcgtgtgcaaaccgacagccgaagcgcaaccgaccagtccagcaaacccgcacctcacccgcctcctcgacaagtggcgctcctgggaacgcgataactggcgctcctgtaaaacgaccacacaacaagtggacctcccgaaaagaccatcatgagcaacctaatccggatggtactgggcccacaagtggcaattcttcgtcaacgagtaaacacggcacggacacatgtcgaccgtgaggaagatgaagaagtcaacaacgctgcgctgatggaagcaaaagtattgctgttaaaagtattgcagcgtgtggaagctgaactagcgaaatgggaaaacgtgatttctggacttcaaggacaagaaaaacagacagagcaagaacgactcgagacattcatcaacgaaagagaagtagcgaatttgctagccgacgcacatgctacgatggatgaaatactagtggcacttgcaggagagtcagaatacgatggttccgaaaacggggacaatgccgtgcgagaaaatgcccaaaggcaacggcaatcacctgctcgagaggaaaggcaactcccttctcgagtacaaaggcaatcacccgtcagagaagtcctgcatcaaccaaggatcagacttcctgaattacggatgccgatattctccggcgatccgttagagtggccgacattttggcaatccttcgagaatgcggtccacaatcaggctcacctgcagccaatcgacaaaatgaattatttgatgggatgccttaaagggaaagcctctcgtgcagtgataggctacagaggtggccaaaattacgaaaatatggtggaaacactccgccgattgtttggcaatccgcaagttatcgtcgaagccttgcaagccgaacttttcaatcttccaaatgtagaagataacccnnactccctccacatnttctccnanaacttcnaacnaatatntcnccaattaaatnctttnncacatcccnanaattcnctcatntncatnccantcaanncaaaactncccaancaaattctcaccnaattnattaaaatnnancnanaatannnnttccattatcanatntcacatctnatacttcactanncataantcntatcacttctataaattctcatncnttcctctctatcactaataacatatnttaatccanttcctacacaaaacanacacctattccanctctaccaactaanccaatcatctaaaataaccanaccctttntatccacacaanataaacnannaatnnantcancncctcntnnnaacccactcttaagattnttcttctccntctnnccccattgggtcaccctagtaggaaaagaggccagcgttcagcaacgaacgaaaatgct

SEQ ID NO: 3771 - DNA, 1381 bp, Heterodera glycines
  misc_feature (1155)..(1155): n is a, c, g, or t
cgaatatgttctcaaagtgcgaggaatgacgctcaacccccctgagattcagaaccaagggcttcgatatgagacattccctgaaaaagttctgcgatatggtgagaccggagagccccaaccgatcaatattacttatccaaactttctccgtcccagcattaaaaatgggagggtcacgtcttatccccttcacaaaatttataaaccctttgtcggtaaaggtattgtcggagccgaccttagtgttttagattttggccacacattgtaatcatattgcgcatttcctttgtattttttcattatattgtatacatattatgaatggaaaataaaatttgaaaataattaagtgaggggaggtgttagttttaggtgaaaaaatgcataattaagtgttataagacacaattttaaaaactactaaaatcgtatttttgctataaacataattagggaatgggagttgtcaattttaggtagaaaagtgcataattattgatttgaagatgaaattacaaaaaaatacacagaaatgcggtaaaatatcgaatttaacacccaaatatgcacatggcgcgtgtaagtatgcgtatgtgtgtgtgtgtggtgtggttgtgtgtgtcaccaaaataaatctggcgattgtgtgcactgattgcggccaacatcttttaacgtttcatcatcatccacatcattttcaaaccggcccgaagtgcgtggtggggtcgggtccctctctgcgaataagggtcctgaccattgctgccaaatagggttgtcctcagtaagctcaagcaattccatgggatagagtcgatcctcttttccttttgagaatcgttcaattatgcagactatataaggatgatgaagcttaatgcgatgtcgagcatagaaatgagctgcgatgttgatgttgaaagggcgagagagacaaccgtaggccattgtaagtgcagcacccttttccgataaacctccaatgaagaaagtcttggtcattccgtttctgtccttgtatgttgtcgtgaccttgcgaccctttagtgaatttaatatgtaagtgcggtcttcaggatggttcagtcggtcgcaaagctgtgaaactcggcaattgagaagctcagcacagaacacactgagaanaaccatttttgacaagaatgagcttatctgctgaaggagtaaagcttttatactcatcacccccctcataatcccaagccatactttaattttcaattattttatttagcatcacagttacaaataaatcggggtggtgaatttgaagtcaagaatttcgtaaataatttggaaaatgaatgttccaataaaaattgtggtaaataaataccaatgcaaatgatgt

SEQ ID NO: 3772 - DNA, 5194 bp, Heterodera glycines
  misc_feature (63)..(63): n is a, c, g, or t
  misc_feature (126)..(126): n is a, c, g, or t
  misc_feature (2363)..(2363): n is a, c, g, or t
cccctagcgtaaaagcacaccaatgagatcctttcttgtgtgagggtctcgatttacattacngccgctgatactccaaagtgtctgtgaaggtattgatcgctggcatacattcccgaaaagatntggccgatcgacgattttgcatcaaaattgacgttaattctattgcatccatttcaatgccttgtctttatccaaagaaatgagcaaaattgttgtaacagtaagctaacaatcagcattaaatagagaacgagaagaccccaacagattgcttgttgataaaaattatcaccttccgcacggtctttgcaaagctgaatcagaggaggtagaagagaggagactggcgtgttttcgctcaacaatttttcattctttggaaaaatcgtcaaaattgtggttgattttgtagcagaaggcgttgaagtagtaatggaaaaagatttcctttttagaaattctgggaggcgagtagtgatgatagatgattttgtagtcctactcattgtcagtcttcttatgtattcagagtattcagggatttgttcctcggaaacaacaggtaaataaatccgaataaagaataaaattatagaaagctgtttgtaattcatatttattcaataagaatttttataaaaatggctccttaaatagtgatatcggtgcttattgatcggttcttgtccaacatcaccagagagtcgcattcacccatcaccaccagcattatccctccggcgggcactgcctggttgaatttgatgctcaccgctgttgtcccattttttataagatcaaacagcgcagcttgatcatcgccgctgttggtcaaattgaacacataaatgcagtgggtttttccgaactgttcatagctaattccattgctttccaatgagttggcgaaccccactgcttcgttcatgtcattgaaagggcgaacatatttccagttagggaagtctaagtcgtatggcgcttggggaaaggagcgtccattagcaataattgagatctcgcgcacattaaacggttgaaaattgaacggactgcgcgaaattgttccaatataatcagcattagccaccaatcccattgtgatacggcgggggatttggtccatgaacaaattggctgtaaactcgaaacgtccatgactgatgaacattgatttcatcagcgttttcctcacagcatatcgtgccggtttcacttcaagttttcgcgcaacgtccaacgccagtccatccatcaatgagacttttttcacatacattttcaaactgacaacctcgaagcggtaacgaggagcggctgcaacaccctgggcaacactgggcgtagtgattaggacaaagtcgttatcatttggtaaaatttcaatgtctagctcacagaagttgatcaagtaaagaggttggttgaacaaatcggcgtcaattttggccatgaattgcgctgttctacttcccgcaaacaggttgcgtcgcgcaatgcatccatcccctgtctcaagcgtgccgccggtgtcacggtaatagcccgctgcattcaaatgcgagtcctttgctgtattggaataggatagttcgtgtgaaaagtaagttttgtaggccattagagaattggaattgaaaacttcgcgtccatttatgctcattttgatgtttcgaatgaaagtctgaccaatcatctggatcggtgcaacctcgtcagctgcgaggtcaatcagctgaccatgctcattttctttgcgaattcggaattcactttgtaagtagcatttggataaatcaataaagttttggctggaatgaagcttgaagtggtagggagtgtccgtcagtggattactaggcagcagctcaaacacttttgctgaagagacgctcacattggtgggtggaattcgaaaaaagtctaaggcattagttattgagttagcactatcgttgtcaattttatggaatgccatttatttagtaaagtccaaatgcgtctgaacgaatacgtttgtttcctgtttttttgattgtccttccaattatggtctgatgtgttggggcttgcgttctctttctttttatacccattcttgcaccattcccaaactgttttggtaggccgcccttctccaataccgtgtcaattcctttctttccctcgttcataaacgcctctttaaacggcactccttcgtttcccactctctccaacactcgctgtcccgtactcagagcctctgaccctactgtagtgccaacacgacgaagaatgggaagaaaaaatctccaaagtccacgaaacacatcccccaccccagcacctctttgcccataacctcgttggaaggngctagtccctctgaagtaatcctcgctttctataccgctaccatattgcatgtattcatcatatccgataatgcttgggtcgaacataatatgaaccattttatttaagtaaaaaagttaatgaatacaaaaatgagtgaatttaaaaatttatcactttcttaaatattaataccaccatggtcgtgccataggcgaatgggaccagtcgacccttgtccatcgtgcgtagctcaatgtcaatttcgttgatctcgcgcgacagcactctagcgtatattggcgaatcataaatcttctcattgtagtcaccgggtgtggcaccgctcaccgacacaacgcgaagcagcgagctcagtgagttgccaatgatcatgttctcagtcagtccttttgagtagacagcaaaacttgagaagccaccccgtaagtcacagccgtattttgccatttcttgaggcccaacgtgttgaggattttcaaacccaagcacatagcccagctgaggtgaaaatgataagtggctgatcacaggatttttgagcaccaccttgaatcgctcaaagtcatcaagatattgtatttctacatcatcgagaatgtttttaaaaggctcatatggccactcggactctttgtcatcgtcgtcaggaaactcatctccggcggctaaaccgccaaaaaaccgatcatccacatccaaaattctcttagattcctttttgttttcgtttggagcttcgactgagcgttttatgtcctttgctatactctttgggggcggtgatggtgttgacgttgaagacggaataggcttaataggaggcggtgatggtttagttgttgttggtgatgattcgatctgagaagttaatttatcaatagatgttgtagatactaccgttggtacagtgggtttttttgctgcgctaggtgtagttgatttagttacctgaagtgatgataatttagcaattttctgcaggttggtcgatgaagcaggcattggaatagctgatttggatgctggagtcggtgttggagttggcttcggtacagcctctgttttggacggagaaggtttcgggagcgatggagtttgtttaatggttgtaatgggagcgggagcaggtgttgttttggttgtagttatagtagatgttacttgttttgggggcggagctgtagcagattttgaagctgtctgtttcggtgctgtgactacctttggcgcttcagagggtggatgagaatgagaagaaactgctgccgctttagtttgcttctcgtctggcttctctgtttcattgtagacaggctgagactgaggcttctgctgcccaggctcttcatacctcggtggcgattgcagtgaagacatgtcttctatcgttgctctcttaaggcgcttggcgtgtggagtgagccgatcactaacaatttatcgaaatagccttcttcatgtgcaaggggcttaagtcttactttttcttgactcttcaaggttgcttgtaaaaaatccctgagctgctcaacctttttatgtgacgcctgcggtacaggtactctgatgacacgctgtcggtcctcatcaacggaatggagattggtgaaatgaatgtctatccattgctcatccaatgtaccaattgttgagtgccatgaatacggataactgatgctatgcagcccacaaacccatgagccactaaaatgcagaggttttggaaggcgtactctgaacttattcggctgattgtctgggtaatccgtaacattgctaggtaaaaacacaaagaaactatttgatgtcatctattaaatttattcaatgtctaaaaatgaacaaagtgaatgcttttatacaagctgagattcattaatccactccctttctgggtatcctatgaattttacgagcatctcagttgatccatccggtttccttctcttcctaatcactttctctattcggtagcttgtctcatcattcttgcgtacgcgagccaactcctgctcataaaaagtgcccctaaacttttctccgtgatcatcgcgaagtctgtatcgaatgggacgaacggtcttcatcacttcatcaacctcaagaatttcatcgccgtaattgggtaggtaccccttctcgaactgccccttctctctgctcatgcgcacaaattcatttttgcggaatcgtggtgcaagcttttgtgtaatgttgactatttgtggaccgtaaattcgctcccacaccttttgagcgttttgaaaattgatatctattggcctcatccgatgaacacgagatggggcagtgttaattccagctacaatttgctgtacaatgtccacccagttgagagtctttttccgcaaaatatctgtataatcgttgcttcacatttctgatggctcgctcagcaactgacgctttccctgacgaatgtaactctcatgctctacaacctcatgtctcctctcaaactactctgacaacctacaccaatccctccgctcaaaatgctcatcggttggtccattaattcactaatttgattcctcttggattgacaatcatatgaataaacgaattctattccttcttaaaatgtataacaaattatagctatgaccttatttaaactctgcgaacgacgaaccaaacccttacaaaaaccgattttattaatcctctcgctatgaaatacaaaagttgaaatgtccagagaactcctttggaaaaagcgatctaccaccagaataccccgtttattcactttgatctttttcaaattccactttgccttttgcaaaaccgcttaaaaatgaaa

SEQ ID NO: 3773 - DNA, 2423 bp, Heterodera glycines
  misc_feature (2300)..(2300): n is a, c, g, or t
  misc_feature (2336)..(2337): n is a, c, g, or t
  misc_feature (2345)..(2345): n is a, c, g, or t
  misc_feature (2365)..(2365): n is a, c, g, or t
aaattgggtcttgcctaagcctttcttccataggtttgctcccggtggtttaatggtggggcggcctgctctcctgtcaattatatacctgatggccattcgcaaattgctatgcgccagcggcttgccgtttgcggtgttaattgtatttcctcgaacgcccatgcgatccgcataacggttgcatttgatgtacaatcgttcaatccgctgattcatggtcagctgatttgaaggaatggcaaacaattcacgatgttgttgttcatcacctcgtgcagatgttgatggacctggctcgggcgagtactgtactctcacccttctcggttgcctcactcgttttctgatgtgcacctcatcatcattatttacggggtatgtgcgtttggtccccctcctaggtggaggaacatagggcattttctttcgacgacaacagctggaggaggaggaggttgttgctgctgctgctgctgctgctgtaatggcttttcttcaatttttggctcttttttcgggatacggtatggcactggcctctttgtaggttgcaactcatgttttggctcggttttgattttcgggggcgggaagtacccggcttgcttcgatgtggatggtcgtgggtcaacttcaatttttggttcccttttggtgaagtgacgaggaggaggaggagctagttcaattttcagttcccttgtggagacattgcgaggaggtggaggaggggcgagctctatttttggttctctctttgcgcgatgtggaggaagtggtggaggtgggggtgaagcagattttttcaactttgttggttgtggaccccttttcagttcaactttgggtatagaacgaggcggaggagggggatggtctggtcgtttgtacacgggtggtagtgtgggagatggtggaggagaatagtaaattttgtattttttgtttttatctattccctctccttttatctttcttctgcttgcaagtctttgttgggcggtgtccatttcctcaatttcatctgcataatcaggcaatattggcatgtctccataattttgtgatggtgttggcagcagatacccaccttcgagcatttgttcatcgtcatcgtcactttcaggtaaaggagcagctgctgcctcagcgagtagatcacgtactaccggttgttgttgtaagtcacgtcgcctttgcttccattggttcagtcgaccatattttatagaagaatgatggtttttctttgttcgctgaggacgtggtggacgaggagggtgaggcggatgactatcgtcagacgaggaagattgctgatcgggagggctgggatggcgacggtggtattgatgaggaggtggaggaggtggtggtggtggtggtggagcgggaggccgtggctgagtgttgacgacttcgccgtcgtcatcatcaacacctccatcttgctttagcaaaacactcaagcccttggttaactcaactttggtaggcctatcggcaagctcccgtctcatttgcagatagcgcctaagctgttgattgtatcggacattttttgttgtcggattagtccgttcacccctggcacggtccaggtcatgccttaccgcatccaaattaatgactcccgtatccgacgctgaggttagccctcggtaaatttcttgtggaacgagcaaaaatttattagccattttgcaaatatgtgagcgtgaacactaaaattgtggggtatttatgcgtttttggtcacaaacgattttgctacttcaattagcacgggtgttaggagggcggcaaacaaccccccaaatcccgatcctttctgaacaagcacacgtctcgcgccgcgttcacttctcgctctgctcatccgtcgcacagtctcaacatagggcatcaatcttcttttctgtcgtgtagtcagccggaaacgtgaagcaacgagattcagacaaatttccactagcgctaatagctgatcgctgttcgcgtgacgtaacatcttcctacattttttagaggatttggtcctcgccaaagcacatagccagtccgagttgtcttttattagctgtcctattattatctgttgttgttgttgactatggtcctccatttttgggaatgaaaacaacaatgccttcgtcttcctcctgctcttccttaaatatgtttgcgcgcagacgcaacgatgggtccgatgatgcatgcatgtcgatcagcaaatagccgtagggacgggcggtcgcttggcggtacgcatccagaaagaagtcgagttggcgcgngaaaagttggattccaacatttctgatcgacaacanngagagtgngtgctcgcatcagtaccagntactgggagggacagcgcgccactttgatcttttcttaacaaattttgagtgacaaac

SEQ ID NO: 3774 - DNA, 3301 bp, Heterodera glycines
  misc_feature (3243)..(3243): n is a, c, g, or t
aaaaattaattttgataatataaatctaaagaatagcggaactaaaaatgccaatgttttccctattaggtgcatttccgcgaaattccctcccacgtgctgcagaaggtgtgccattactttgcgtacaaggcgcgctacacgaacagcgcgacggaaatccccgaatttttcgtggcacccgaagtggcgctggaactgctgatggcggccaacttcctcgactgttgaccaaacaaacaaacaaaatttgatgcaaaaatggtagcaacgacagacagacgaaccgatggccagacaaaacactgactgattgtgattggcaccgatttggaatttttgtgccaaagataaagccaattattaatttgtgaacgacccacacaaaattgttttttgcggattcgtttttttatatttatgtaggagtgcagacagtgagaagttagacaacgaagccgcgaaaaaagagttggttttttactgttttaaattgacttttcattcatttgcccttcgccgctcacagttgagacagtataaaaagcacacgccaatgctttatgttttggcacttttacagtgcaacgactttagcatctcttttttggtttttgataaaatcgtggaaaaataaaactaatattcagagaaaattttctaaattttctctcggttttttaagattttcatttaaaaaaatggcaacttttggtgaaatttggtcgtggaggggataacaacaaggaaaatctaaaatttaagtaaaaacactttatttaattgctatttaattaggcttattccgtaattatctaattatatgaaactccacaaaagtgtcgaccaaagttcgcctttttttattccgtccgttttgtgttcctccgttttctctgaccaaaatgcattcagtcgatcgaacgataattactcaaaccaaataatgcattcattaattgacaggaacgccaaccaccgaattttgtgggggcggggcatggaccgacaattcccccaattccctcctttttttgttcgcccattgaaaagcgatggtttggaaatgcatttcactttttaaattcgatttttggctgaattgaaaattgccattttcatatccatttacaattttattttattttttggaattttcattttccatttacacaatttttaattaattcattgatttatttataaaaatatttcccattttcgcgtgccgttactttctcagtccggcagattcaatctgaccgcaacaagtgattacaatctctctccacggctcagaagcggcgaaaaatgagccaacagaaaaaagaaaaaatcaattaatcccatccaaaaaaatgaaaaatcttttcaattaaatattttaaaagtggctaattttatattttgggcgaacgaatttctacattatcttctctagagctcgacattttgaaaaaagcctgggcctggatttccttgacaaaaatccaggaaaaatatctcaaaatatatctaattacaatgataagcgtgttaaatttattttttcattttttggaaattgaaaaaacatcggtcacttgaaatacataataaattctaacattttgtgtagaaatccaagttttttcgtgcttagcctgggactgtaacctgtatttcctggacaaaacccaggttgccaaaaatgccctggacctgtaggcctagctctaatcatcacatttgtgaattgtctcctctctttttttgttgccattttgccctaattatccgacaattttaaaaattttttccattttttggggtaaccaagcattgaattgatttatttatttattttgctgctatattcttccaattgtttgctctcaaatggtgctcaccgactcggcccatgccgaccccaaaaatgccgtgcccttccgtctgcgcatcgacggccattgggtgcgcgtggacgagcggctgctgcgcgcgcacccgggcagcggcgcaatgctcgcctaccgggacagggaggcgagcactgtgtcagtgggggatttgaaattcggaaatttatttgaattttccaataaatttttcatttttcaatgccctcggggctctctgaggtttttgcagttaacaataaattaaagtataagtatttaactctctctctctctcccccccaatttgatcacatttttaatgcgccgaaaatggacgtgtttttcttaattcgcttcacaaaatatttatatatcccgagcagaattgaaccttggccccaaaaacacagggtttaattaaccaacatcggcggggccaagtaatttttacagaaaatttaaccaattttttctcagaaaaagccaatttaatgaattttgctgaaaaaactgagaataaaaatttttaggctgttgattatagtcaaaaatgtttttaatttggatttggttgcttctgagaaaggcatttttcgaagcgttttgtcaaattgccgataaaagtgccgttgtccccgcccgatttgtcactttttctctcagttttcattcgttccatgccggctcaaagcgtgcctaccgatggatgacggaacaccgtgaaaatggtggtgccaccgccgaaactgaggcgacaacagaggcaaacggaacggcagcaaaaaacaaagtgattaggccagaggcggaggaaaatggcaaacaagtgccaaaaatgtaaagaaaatggttctacaaaatggatattttgaaaacagaaaagcaatggcacgggcgccgccctttggccggacaaaatcgacgccataaatatgggcaaatttgggaagagtgccgaggcaaatgaaaaggtgggaaatgttgaaaaataaattttatgcttattttcacttgctacagaaaaaaatattattttaaatttaaatctttattaaaattatttataaatttaaacataaaaaattatcatttttattttccttaatttaattatttttttaatttaaaaaatatataattaaataatattattttccatggttatgttacactttctacaaaaataaaataatattttttttatttcacaaattttgtgaatatttttaaattttaaaaatatattaattaaataatactttttgtattaaaatttcttttaaaaattatattgatcattttttattttatctaattttacttttttatatttttaatagatttaaattatttattttatttntaatttcacgctatcccccaacccccttacacatcccattaaattggtggagtgacaa

SEQ ID NO: 3775 - DNA, 3584 bp, Heterodera glycines
ggcacggggcgcgggcggggggagaggaggggcatcccccctgggggggagattctgattaaaacttattaccacggagacggacagtcccgagtttactgtcccggctggcaccctcacgagggccatccccagggagaagttcgtggctttaccacggggacagtccctacatttgaggcccctcctccaggccccaaatatccattttaaacagttttgtttgcatttggccaactcttagtaatatttaaacccaagtgccatactaatcatagcaaaactgagggggttgggtggttttgtcctgccatttgcatttgtgacggtgtccgccggtcccttttcagtacggtcatcagcagcactttggctcctggtggtggaacgacgtttgtggctatgtgtgcggcaatttgatgcagggcttttcgctcggcggatggaaagtgtgtcggaaggagaagcatttttctgactttttgatttattggcactcggaaaataaaatttcctggggcaatctaagtgtcacactctttcttgtccaggaacagcacaatgtgcaccacgcggcgcccaacgtggacggaagggacggcgacttggacttgttgccgttgtgggcgaccatcggcacacaactcaaagtggcgggggaggggtggaaattagggcgctaattggggatggcatcggtgccaaaactgacatatttcgaatttgatttccaaattccttccagcgcattgacagtgcttctccgctcgcccatctgttgcccttccagcatttgtattggtccttcgcgttgccgttgctccgtttctcgtggctgctccaatccgtccaatttgtgtgccaaatgcggcacagtttttacgatgtgaattcccatttttggcattttccattttcggcatttttttgctcagatccatcgccagagggcacttgttgagcagtgttcgttggcattgcattggtcgttggtgctcgttcagctgtactttttgccggacaatttggtgaaatttgagacacacttttttattactactctattctatgcttttgtaattgtaaatttaattcatttccccgccctctaaaaaatgaaaattcggcaaattctccggcagattttcgggatcgttgaccaacatcaatttcgactaattccgaatccctaatccgaattcgaacaattcaatatacttttcggtcccccccttttcaggcccgtctccaatatttcctcgtctccaatctgttcgccggtttcctcatcgcacacgtggtcacctacaaccactactccaccgacaaattcgcatgtgcgtgaaaacggcactcactgatttttgggccaaattttcgcgcgagaagagaggagggggtgtcttgggtctcggaacttgaaaaaatttgggtcgcgagtctcggcatttttctcgttccgtttcaaatttatacccgaaggttttgggccatcccttcccttacctaatacctgtttttttcgattttgggccaatttttaagaaaattaagtttttcggatccgacggtgtcgataggcacagccgggagaaaaattgaaaattttgaccacattttagcagattttcatcaaaaaaaatactaatttagtgggttttcggagaaatttaacgaacttttttggataattaggggtgaggtaggccttggagggggtgccaacaaagaaaacgaaaattttcaggaaaaatactattttttccttaaaaatttcggctgcgaggctgggaccgtccgtccctttacgcaatttgggaaatctttcggcttccatgcttaattccgtggtgtttgaattccgcctaatcccgccagatgacgacccaatcctggagaactttgcctgtctgcagctgtacaccacgcgtaacatgcggcccggcccgttcatcgattggctttggggtggtctgaactatcaaattgagcaccatttgttcccgacaatgccgcggcacaacctgaagaaggcaggcaaaaagagtgcccgttagcgttgaagcagaaattgccagcccttttaatttgctggcatgtatgtttaatgtttagcccatcccccttgtcaggtgatgccgttggtgaaggaattctgtgccgaaaatgacatcccttacatggtacgtatgtacgacatggcacggcaccgtgccaaaaataatttaaatcgttaaattgtttttttcttgagaaaaagatttctaaatcttttagggtgcaaaagtgcacccaattagcgggtctcgtcacatttgccttttatccaacttggtcagatcaccccttgattgtgatcgggacacccaaaaacacactgaaaatctagaaattttcggaaaaaaaacatttttttattaatttttcggtggacgattatttcacgggctttcgcctggtcatcgaacatttgcgccgagtggcggaagcggccacagaaacgctggtcagccatcacagccaaaaattgccatgaacggacacagcagcagaaagtgatcgtgtggaatgggagagcttttcatatgatcaatccgatcactcactcactgctgttaattactattttaaagagctgaaagcatttttcctctgacacattccatcgttttgttatttttgcgctgtcatttaatacaacaaatgatacggtttctcttcttctgagactgttatattcacactttttgaattattatttataagggccataacatatgtataagcatataaaaaaaagaaaaatttgcacataaagtttccttggagtatattgaattgaaaaatgccaattttgttgcgaaaaactgtaaatgaatctctaaaggcataagcacgggccatagggtgcagcttcgtacattacaacactcgctttatccgcaaatttgatttttttgtgcgggatccgcggtatccgactgaattttttaattaaaaagacagaatgccaaatattttgagtaaattttaaaaatcaaattaaaaccattttccatcgcaaatttcatgcaaaatttatgaaaattttgcccatctacccctctgctcccattaaaaaatttgaccgccaacctatctcctatcgtatgaccctactgaaaaaaattttttcgaccctccgccctttttcatttatgaatcgattaattatttagggtaaaacaatttttggccgtgcccgcatttaattatttcacacatttacatttcatttgttgccaattgtcgttcacttaagcttaaggcaaaaaagtctttaaatccttttacattgccaggaagaaaataccgatttcgtttttcgttcattttcaatttttactctgcaaattccaaaatatggcgtctcaacttcaggaaaggaaaaaacaattggacgcaggcaaaaacttatttttaaaaattcattttgttaaaccgagaaatttccagagattgaacagttgcaaaaggaactgaaggaaattgaagcggacaatgaggaaaaacagaagcaactcactgatggttggtacggtttc

SEQ ID NO: 3776 - DNA, 4160 bp, Heterodera glycines
gagagagagggggcaagagagagagagtgaagggaggaaaggaaggataggatgagtaagagaaaaagagagggaggggtggagtagcgatatccgatgcagatgcttaattggcgtatttgtgaattttgcgtttgcttacgcccacaaaaagtaaacgaccatcggcgtgtagcagagaaagaacagtgtgacacaaaccatcaacattttgacctcgttgcgccttgcttaatcatatagtatcgttgtaaaatactatattacgcgagacgccgattggggatcacatgtggtcttcttgggaaggagagggtgggtcttgtagcttttttcaggaaattgtattttcggagtcgcaataaatctaaaagtcagaaaaatgtttctccttccgactcactttccatccgccgagcgaaaagccctgcatcaaattgccgcacacatagccacaaacgtcgttccaccaccaggagccaaagtgctgctgatgaccgtactgaaaagggaccggcggacaccgtcacaaatgcaaatggcaggacaaaaccacccaaccccctcagttttgctatgattagtatggcacttgggtttaaatattgctaagagttggccaaatgcaaacaaaactgtttaaaatggatatttggggcctggaggaggggcctcaaatgtagggactgtccccgtggtaaagccacgaacttctccctggggatggccctcgtgagggtgccagccgggatagaaaactcgggactgtccgtctccgtggtaaattaagtcatcagatccttcccccgggggatgccctcctctccccccgcccgcgccccgtgccgtgccatcccatgggcccacttcgtggatcatccacccgagctgttgccaggcgatgcccatgcaaaaggcggaggcaaggaaaaagtcgcgcgactggaggaacacggcgaacgcaatcagagcaacgcattggacaaatttgagcacgaaaaaggcgtcgtccgcgcgaagaaggccaagcgaacggacgcgggagcggagaacatcaaaggaacggcaaatctaaacagcagaggggggggcatcatggcaaagtgttaatgggggtaattaaagagaaatggtgacaataaaaatggaaacattgggatgggcaagggggagggtgcaaggcagaggttgcattgggtcaccgtataatttaccttttcaatcgcctcggtttcgccaccactttttgcgttgttacgtcgtccatcggcatggaatgagcagaaatgaatatgccaaaaatcaaaagaatatttaaaaaaaaaagaatgaaaaatattatgacaatttcttaggggctttttaattcaaaaagggggaggggtgagagaatggaaaaattttttattacagattaactctgcggttggcaatgcaaatgcgatgtttggtgctcaaaatgaaaaatcttgatttagcttacttatctaatttaacaatggaaaacaatcaacaaaataacaacaaaaccatcagaacaataacataaccagcttaatcttaacaatggtgtgaatgggaatggacagcaagtggtgccagaagcccagccagtgagtgaacgggaaatcagaggcttttcggggcactgatcgcggatctgacatccaagtttcctacattatatttttgttatataaaatgaaagtgttaaggattccgatttagtcgaaatgggtatcatttcgcgatcaacacccgaaaatgctcggaaatacatatctatgtgttcataactaaaaaacaagaaaaaaaagaggggaggcggcacgacctatcaggtgcagagataaaaggcgggtgctgaaaaaacacctattttctcaaaaatggaggctgctgttagaaacttcacaacccccccccccgttttcgaaaagatttttgtattaaaaatcgtgaaaatatgttaccaagggctgatcacgaatccggcatccatttttgcattcccgacctactattcaacccatattactttgcctaacctaaatcactatatatagcccatttgggcgctgaattgggtggaacccacccccactgcggcgctgttccctgcctaagggacaggggtatgacaccttttttgaaaaatttttcaaaattttcataagtcttaaaaacatgtttctaggggtttataggtacgctgagcacgaatctgacatccatttcgaccaattccgaacccggacccgaattcgaacaaaaagtcgaaaattcatttttcatcaaaattcacattcgtgcacacaccgtttcagttttggcctcccagttccaaaaagatttgcatatgtggctcagtggtttttgtaagatagtaaagggacaaagggtgttggttcgagtccgttgtgcaacatgaatatttttatttatttttttgcaaaaaattaaaaaatgaccatttttgggaattatttttggaggtttttaccaaccaaattgtacaaacttggtatcattcgaaagctcctgataaggagaagctttttctaagcaaattctgagcattttgatgagttagaaaaaatatatgggtgttctaaacttgcaagttttgaactaacgtataaacaaaaataaaatcagtatagaaaaatgcagattttttttctctatcgatatgcaaaatttgaagcggatttaacgttaggaaaaaaagttaaacgtcacgaagtaaattcagtttttctctattaacagagataaagaaatagtacgccaaaaagagagatgtttttttctctgcactctctatttaatggttcatgtctcgttttttgaaacggtgtgtgcaactaaagcaatacaaatgcacgaaaagacgcataaagatatattttgcgttctcttttatgtttccagcttattaattaatatggctgcgttggaagcgtttcggaatttctcatgtgaattttgatgaaaaatgaattttcgactttttgttcgcgggtccggggttcggaattggtcgaaatggatgtcagattcgtgctcaggcgtaccctataattaaacgagtgccacgggaccgggaattttgggcaaaaccgggaccgggacttgccgggacctgagaagccgggaccgggacctcgattttttttcgggaccgggaccgggaccgcaagaaaaaccgggaaccgggaccaaccgggaattttttaaaaattttaaaaattcaaatttttaatacaaatttaaattgataaaattgcttttgttatttcaaaaaggcaaaccaaaaataaaagttttaaattttaaagcaagcaaatagtttgtaagaatatatttggatcagatttaatcctcaattatttccaactcatcaaagttcagcaattcttcatcatcttcatcaggttctgtcgatggtgccaaattcaaatgacccaaatttccttttataagcaaaatttgttctgccatatcaccactcagactaaaaagaacaaaaaacaaaaatttttgatactttttcaactaccgatttcgcaacttgttgccatatatcatccctgcttttgaaaataatcgttcggatgacactgatgtggccagaattgattgggcaattcgtgccaggagaaataaatcaggaaattgcacgccaacatcgttccaccaattaaaaatatcacaatcaatttgagtgcggcctaagactttgtaagtgaccaattgaagctgaatacgcgacgtttgcgtagactgagaagtccctgaaattgccgacggtaatgacacacttccaggcgatttgggtgcttccaaatgtcgacttaaagaataaaaaatatcgttaaaaattttttggtatacattttatgctttcgtcgcttatttcttctgcgtcctcaagaaattggtcattttcgttcaaggggttctcattttcagcttcaacgtttggagcaggatcgctgttaactaaaagataaggatttttggtcgtcctttttaatgaaaagcacttttttctcgcgcgtattcgattaaatcttcctcaataataccccaattggcctttgaaaaaatggtttcgtcatacgcaaatcgagggtccagcaatgaacaaattcgaa

SEQ ID NO: 3777 - DNA, 4730 bp, Heterodera glycines
ataaatataatttgtaaaagcataaaaaaatatataataaaaattaaattgcaaaatgctaccggaatggaaaatttcaacgcaaataattgcaacctacaacggtaatggaaacaatgccacaatctattcaagtgaatctaagtatttttttacattcaaataaataaattttaaatttctagctcggaagtaaaataaaataaaagaaatgtttcatttgtttggacaaaataaatttaactaattaaaagactttaaaattgttgctaaaaaaagaaaaaatttaaccctaatattaaacttataaaatttacaacaattgcaggatgtcttttcatagccaatatttttaatcatttttaaaaaaatcaactatataatgaatgatattttaatttcctagttaaataataaataaaaactttgaatttcaattcaataattatgcattatttcataatttttattcaatagaataaacaaaaaattcttaaaaataccaaattttatgagtgagaaaagataaatgtagagtactcaattgttttattacaaattttcaataaaagaaactgaataaactatagagaagaccttattttttgaatatattttaataagaaataactaaaagatcatagaagcacaagttaaatgataaaatgagaagcaaagaattataaatatatgaaagaaagcgataataaaaattaaagtcaagtaactgatgtgatgaaaataaaagaaataattaattcaataataaaatagcatcattttaataatcaaacatagtcataatttataaatctattagatttaaaagctatagaatggaactaaaacctatagacattaaaagtttaaaaattaaaagaaataaaaattaaatttttacgcaattgaattgaccgggctagagatcatgtcgggaaattccgtcaaaatatttactatttctaatttataaatttctacaatatgcttaaattttaatcaaaaacataaaatatgaatactgcaaggtgcattgataatatattattagaaatttatttcattcacttatttataaacgaaactaaattgaattaattaaagaataaatttttgaattcaaagtttcgacgcaaattatcttttttacattatttataataagtatttgtccaggtctcacaattcactcgacgtgggagtgtcgcgaatagcgaatagcgcgtaaatttaaaacaataatattacgaaaatgaataaatagtagcaaagtgagtactagaaaatttaaaatattaattttaactaaaaaaaggcaatgtaagtgaatctaaaattgtctcaatgaaaaattggtaaatataaaaataaaaacgaataatatccaaaatttaaattttgtactaatgttaaaatgatgatctaacaaatttttgactttataaaattttaaaatatttgttcccataaattatataaagaaatttattagatgcgttgttaaaataattattgaaataataattgaagaaataatttaattttttaagcaggtggagctaacaaattttatatcatatttattaaaaacaaatccttattcagtgtctacgttaaagtgataagcaaataaataaataaataaattaaaaaataaaaatttaattaatattatagtgaataaattatttacatctatttaaaatttttcatttctgttttactgcaataaaaatttgttttcaatatgcgacaattcatattttaaaaaggtcaatacagcgcgctgaaggtacaatttttatggagtcggggtcgtttttgcgtgggacgagtttttgaactataacttttttctttgtcaaccaaatataacattcttggtatcattcgatagccctaagtgttctctattagcctgcaaaatctggaaaaaaagttatagtccaaaaacccctccccacgcgaaaacagcctggccctatttttatgcacttcccatagcataaattaacggaacgataaagatcattccaattttcgactttatgagtaaattatttaattttaaaccattcatgttattttaaaagagaattaataatattggtacatgggaggcaaaaattttatcaattatagaaccatacgatcctatggcaacagtaagacctacgcgagtgtaataaaccaaattcgtaaataatattaatttgtaaaataataaatcatacagagaaaataaaatttcaacaataaaaacttcatgcacggatcggctcatgacaagaatttgaaaataattaaaataaatccttcgggaaagaataaaacatagttctcgaactaaattaaaatcaaaatgtttaaaataccaataataatgaatttatcaatagtatctatgaaaagtgaggcattaatcaaatgataaaataattttaaagtagttactatccagcatgcgtctcatcggcatgattgatgggtttctttgatctcgccgcggtgattaatgagtgcgggaatagcctaagcctatgggggggggggtaattaattgtgtggtaattaggggggggggtgaagcctatgtggtctgttttgcggaaaattcccgcatttgtgggggagactttttgtgaaattttttaaaacttttaggggggggggtgcgcgaactgatcgaaggggtgatcattgatggtgaaggaggggatggaattaatatccatgtgtgaaggggaagggagggcaccgccgcatgtgtgttggatatgcttgtgttaagagaagcgggagggagagagaagagagagtggtaaaaatatctgggagagagagagagagaaaaggtaagagataacagtggatggatagagcatttagattacttaagcttaaaggtgcaaatctttgaaattaattagatttttcctatttttttcaaatttagcaaataaatgcagcaccgccgccaaatgtcacagcactgcccgcaaatgccaagtcgtccatccggcgtccttgttcaaagcgggcaccaaaggccacttcatcaactcgccggtccagcacgcgccaggtcaacctggctgaatgccgcgtggtcgtcaaaatgccaaaactggtggctttaactttttcgaaaatcatatttttaaattataaataattattaaattgttgttctataatttggtcttttttcaagcccaaacgaaattcgtctgaggcggaggaggaggatgtggagattggcaactcggacgtactgcgaccgcgaggggaacgcagcacggaaatgccagcacattgtcaaccgaatgggtggtcaataggtgggcagatagatgattgtcaattcggggaaggggaggctggtaattaaaggtctggtgatggatgggaaattagccgcaaaatttttcgtttttccttatattttcataaattttttctctcttattcacaggtcgatcagtcggaactgacaatctcaccgctcattcactcatcgtctgttttgcgcgagtcccattccaacttcacgtccaccagaaatgcggtccgttcgggagccaaattgatctccaaatatggaggacgcgagacgactgacaaagtgggttttggggaccaaatgaaattttctaagggggcccagccatgtaaatagtttgggggggggggtattgaggaaggcataaataaatgtttatttggacatttacccatcgattaattaaattaattattttttatatcatcacgagccaattttggccgaagcgatcagcatcaagatggaacatgccgccgcaacccaaaggtgcggatttgagaactcggtggagcattgcgaacaaaacaaaagtgtaagtatcaaattaaatggatcgatcgggagagggggcggggcaacagctacaaaaattattaattaaaaaagcgcacttgcaatgtagcgacgcagacaatgatgagttattgaataaataaattaaaaattaatagatgagttctcagacactcctaaatttaaaaaaaatttaaaaaaacagtagagtgctcaggcactccgaaattttaaaaaatgattaaaaaaatagtagagtgagtagtgacccgtgtacttttgttacaatttttggcgctaaattcaaatttgaattttcgcgtcgatattcggtgggtggaggggcgcttgctggggaggaggggagggggcgcgctttggggtgtggggcggtgccgtagggtgtaaggcctatgttattttaattaaattttattttaaattaaattttaattattttaaattaaataattccccaaataattatttcccatcagtgggagggggcgcactcattgagggaagagatgaactttattatatgaaatgtgaaaaataaataaaaaaatgagaacagatgggaggggagggattagcagtgggggcaatcactgcggcacttctgcttccaatactcaacaatctgcctcatccttttgtcacggtcgcttcgacgggacgaagtggtggacgaagaagtggaagaggaggaggacaccgagctgaacgcggttcccggtctgctgtctccaaacagaattgctcgggcggtcgcgatctgttcggccgagaggcgcttgtaggcagtgcgcacacattctctaggaatgcgccgtgaagacgaaggagcctaattggggggggggggggg

SEQ ID NO: 3778 - DNA, 3027 bp, Heterodera glycines
  misc_feature (1097)..(1097): n is a, c, g, or t
aatttaaaattttatagaatatataaaaaaatttataatattttaagtagtgacccgtgtacttttgtcgccccttttggcgctaaattcaaatttgaattttcgcgtcgatactcggtgggtggagggacgcttgctggggaggaggggagggggcgcgctttggggtgtggggcggtgccgtagggtgtaagacctatgttattttaattaaattttattttaaattaaattttaattattattttaaattaaataattcccaaataattatttcccatcagtgggggggggcgcactcattgagggaagagatgaactttattatatgaaatgtgaaaaataaataaaaatgaaaatgataaaacaaagggatcagcaatgagggcaatcactgcggcacttctgcttccaatactcaacaatttgcctcatccttttgtcacggtcgcttcgacgggacgaagtggtggacgaagaagcggaagaggaggaggacaccgagctgaaggcagtgtccggtatgttgtcaaacagaattgctctggcggacgcgatctgttcggccgagaggcgcttgtaggcagtgcgcacacattctctaggaatgcgccgtgaagacgaagggacctaattggggaaatgtttatttcacatttataggtaaaagtgggtttaggctaccgtttgcaaaacatcgcacaacggcagaggcaccggggcatcatcgagcggaaaaggcattgcgaatggtgggaagacgggcagtggtggcatgcgcatttgcaaagtgctgatcgcctgttggacggcagctgaaagcatcggcgatggttgttgctggtgctgtgttgccgggacgcaatgtgtcaattgttggtgttgctggtgctgatcctcctcgacatgttgctgctgctcctcctcctcctcgacatgttgctgctcctcctcatcaacaatggctgcgccgtcgacgacaacctccacgtccggtgatgggacccgggggaaaacctggtcctaaatcaaaaatttgactgttgacatgtcatgactcatcattaccaagggcacctttctttccccaatcaacncaaacaaagcaaaatcctctgcgtgcacgtccacagaagcgatgacgctaaattttttttgtgtattacttgttcatttatcgccaatttccccacattttgcgggccctctcgatgtcgatgacaccaccaacagctgcatgggtatacacagcttccatcagacgagcgagggtatacccaatctataaaatgcatttgcagttcttaaatccccgttctcgctaattttacgtggtcgagcagctcctcgtccttgaggaacgtctcatcgcatgattggtatccaattagataccaatacctcacagcaccgcagatgcgacgatggcgccttgtcgtacagggccaaagacgtcacttcatactcagttgtgccatcgtcgtcctccgcgatgtcggcagcattttgatccgggtgtcgatgttggcactaataaacaaatttgtccattaaaaatgaggtagttacgaatggcttctaactcattttgcactcaaaattatgaaaagatctatctcgggatgagtcaaattatcattttttgcctataatctataatttcacaattaatttagacttattagataaaaattaccccgaccgtccctaatcgcaatttcaacaaattttataacacattcaataaattcaaattttgccgccgccaaaacatgtcagtggggcgcttaaagtcacctattcttttgtgtccaatattccctgcactaatctttgttgatcgccccgagccaaacaaagaaagataacatctgtatgaccatttctacaatgaagaggtgacaaaagaaacaaatttttggagaactaaagtggatggggaaggggaaggggggggggggggtttagcgatcggcatactccgctggtcatttctccgaatattcgcgccatgcagtggattaaatttaactgcacgctttgcccgatcggtctgcattgtttttatccgcgcaagtacgcaaagcctgtgctgtgtgcgcatcctagcgtcaacaacatcaccgactttttgagcaccgggcagcttgaggaagctgcaacgacagcaacaacaacaacaccattcccgacaactgcggatgtgtcggcggcggcagaatgcgcacctccgcccgcgcagctgaccgcatggatcgcggtgtgcacagcgctggtggcgcttttggtgattgcggaggtctgttaattttgggaatttatccgctaaacccctatttcaattaagcttgtgcgcgccggattcaaagtgcgcaaatttttgaaggaccgcgccttcaaaaaggggatgctgcgccgacatcgccagcgtgagtttctcgctattacatttttagcaaattgtaattaacaatttgtacaggaatgagcgccgcaaggcgcaaccgccagccggcaagcgcgccgactccgctgattttgccggctatgttagccggcgtttctctgcgcccgacgggcgtcaatttgactgtggaccgggtgggcaattttaattaaattaaaatctttatatattttaatttctcactcattaaaattacaatttaaatttaaaggcagcggggcagcgccgcgcggatggtgcaattgaggagggcgaagagcccgtgtacgatgaggtgccgcttgacagcgacatcgtggtcgagatgcgcgatggagaaaatggggaggaggaggaggaggatgacagtgatttttagtgattcggcaagcgatcactcaccatttaaccaatcgatcgatttttcactttaaaataaaattttaaaaatgtttgaaaataggataactaaaataggaatttataaaaagctaaaaatagatacaacgaatgcatcagataaaattttaaatgaggatttagaagcattttaaaattgtgggtgggcgctcgctctatat

SEQ ID NO: 3779 - DNA, 1052 bp, Heterodera glycines
gataaaaaagcattgtacaagagtgttattgcggtggttgatctcattataaacatggtcgtcataattttgagcgggctccatactgtctgttccccgtttcattccgtttgaggaaaacggggcgttgacgcgcatgtaaaggaactgagattgaggtggacacaatggtcatcaaggagggaatcaccttatggtcacacgcatagaaaaagcgcagtttgtccatattgatgttgtctacgagcttcccggtcattgttttttcccgtgaagaataaggcaagggtgttcagcgttccgtacagcgaactgccgtcctcagacaggtgcgcccagcctctacccccaccaccaccacaaccaccaatgacaacagcaaaacatcaacggacaccggacgacgaggaggagaagaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgatcaacaacaacaacaacaacaacaacagctatcgtcaaaagaggaggagaagagggaggaatgcacaaacaacagcagtgctgcagcaacaactgaatctgctcccgatggtgatgtaatggacgatttcgtcaatagcattcaagcggcgacaagcaatatgcaatagcaaaaaaagcgcaaaactcgctctgccctatatataaaagttgatgattgctgctcaatttgtcataatttttgaaaatgttaaattctcaatcgttcagtaataaagatatttgtttcaaattgccttgcggtataattatttccgggccctcctcgtcgggcaaaatggaattcctactaaaatttattgctgagtgcaatgaactgatcgcgcccagtcccatctcaattctgtactgttttggtgagatgaattaggcggttccgctactgcaaaaggcgggagttgaggtgtat

SEQ ID NO: 3780 - DNA, 434 bp, Heterodera glycines
  misc_feature (369)..(369): n is a, c, g, or t
ggattttcatcttaaaaaaacgataaaaacgggtcaattaaaaaaactcacgagtaatcatccatcatattttgtctataggaaagccacgagtatacaaaaagaaaattcaaaatacgttagtttccgtagagggatcgaaccaggggaaagaagaagggaaagtcaaggagactagccactaggccatccgcacaattgtcagcattacttttaaagaatatattaatatatttttaattttttctttttaactcgaattttcttcactaattttcactcagacccccattcttaccagtgcttgattttcccggttgccctaccgggaccgggaccgggacctgagcttttcaaaatccgggaacncggggaccgggacctcgaatgaccgggaattcccgggccggtcccggtgccgcggcactcaagtt

SEQ ID NO: 3781 - DNA, 6547 bp, Heterodera glycines
  misc_feature (6446)..(6446): n is a, c, g, or t
  misc_feature (6465)..(6465): n is a, c, g, or t
attaatttgactaagtttaagctaagttatgatttattatttagcaaataaaaaaataataatttaatttaaattttatatcattgatacttttgtaagttcggctcaccacgatttaaattaattttataaatcaatccattaatgttttaaatggaatttttaggaccaaaaaacccgaaatatatacacaaaaatatgtgcaacaaatgcttttgttcaaaccaacataatttcgccatttctaaaaaattaccccggtgacgtggtgaaaaacatcaaaatttgtttcaaatttagaaaataggtccttaaaaatcctcatttattacttaaaatgctcaaaaaagttgtaatgaaaatcttgattttttaaaaccaattttaaccgtcgaattcagaattttttttaatttatttccatggaagggtccaatggtgccgatagacacaattggggaaattttggtaattattttgcaaattaagacgaatttttatgcattcacttcaaaaagctgctgaaagaaaaacgagcaaaggacaatttgcaaatttattggtcacaaaattcggttcggttctccaattctttcaaaaagcggcgtacacttttctcagcagtggcccattcccttttgataaatctctcattttcataatttatcattttgagcaatttttcagccgatacttcgccaaacagtgccattttcaaatgggttttcgggtaatccgttggcttacatttcccatccaaaaaggcaacgatcccttgggcagtcattcgcttcttcggctcaatatttaacatattctgtaaattttcataaaattttggttttttatttttttgccgggataattttttcattttgtttgttagaatttttgttaaagtttagatactctcggacttaccgctgaaagaaaggcaatcgctggcattttttgccaaaccgacagaatgttcgttacagtactcaaatatcgttgccaccaatcttttgagccggactgtgcactttctcttggcagctttaatttatgcatcagtgaatctgataagccaccgtccaccgaattcaatttttcacttcgaaacaattcaccaattttttgatgttcttccaatgcgtttgtctccgttgtgaaaaatgccattgtaaaaattgtaattcccgccgcccaaatgtccatctttggagtgacctatccttttaataaattcaaaataaatccagataattagtgcaataaattagacaaattaaaccgtttaagcagactttaattttcatatttataatcacctcaacgtcaccctttacaccatcagatgcaagtgataattgctaaaataagtaacgttaacattatttaattaatgcaatttctcaatttgaattaattatttaatcctgacttgaagcagctccggtgcagcataagttttagtgcaacctattgaatcttcattaattttaatcatctttctctgttcgtcagaatataaaactgacccttcaaaaaacaaacaatgaaatggcgtaaataaacaaaaaattaaattaaaaaaagtataattatttaatattgcgattaaaaattgaagatttattattatttttttaaataaatattaatacaaatcataaaaattaccgtcaaaatcgataagttttaattcctttacttttccaaaaaaatcgtttctttcgaaaacaattaaattcattggcttgatatccaaatgaatcccaactaaaatgtggataattaattaataaacaagtttaatgaattaattaaattacccttgtgaaaagcaaccaatgaatttataatactcttaaccatgctgttaagttctcttgacgaaaaatttccacgttgaagttcttcatctaaatccctttcgccatgctcaaaaacggtcaaatttgaattatcatcaatgatcagatttgtttcatcaatgttaccacttaaattctcaataattttaattaaaatgaattaaataataatcagaattatttataaaatcactagtctatcaattggacaaagtgttcattctgcgaatcattttctgctaactttttcaaaattttcacgctattcaaatattcttttttaaactcttcttcataaattttgatggcaatgcatttgttttttggcagataatgatttgcatcggtggaaaaacccatgaaaatctgtaaaaaaactaattgtaatttttaaaaattatttgctttgtgtttgtatttcggtcataatttttttcaaaatcgattcgaactcttcgaaattcaattattaaatttttatcatgaaaaatcaagcacttttctgttctgccgcaccctcctaatttggccaaaacaccgcacactcgactaaatcataataaatcatagatttttgcagttttgacgccaggttcttgatcagtgcctaaaataccctagaaaagtgctttactttgtcgggggggggggggcataacggaagtaccaaagatcattaattttttaagtaattacattgtgtgccaattttttaaaaaagattttgatttgcgcagtactctcagttggcctcctccattgggtcgaagggtattgaaatggttccatttgatcagtcggaacaccgcggcattcgaaagacaaaagggcacaatcaaattggaaataaaaaaggaacacaattagcagaagagaagaagcagcattcattttgctaaaaaaaagagaagctaatatgaatataatatattaaaataaagttgatggagagaaaaaatcaattaatgtaagaatatttctgttgagaaaggacgaattgatttcgaaattttataaaaagaaaaaaaaaattttttttagattacaaaaaagcatttaaattttatatccatttagtaattagagttttgagtaaatatttgaagtaaattaaggatttaggcccggagacggtgaaagatgccaccagggaaaaatttaccaaaacataagcgctaatagtctataaaatttcatagattttatacttcaaaatttttgcaaaaatatgcgtgttttcaagtttgaaaaaattcggtttttttaagtttttaaaatttgcatgctgtatcatttatggggtccactgcgtttcggcgcgctcgtttcggcgccagcatgtttttccactatagcttttttctttgtcatccaaatccaacattgttgatatcattcgaaagctaacatgtttagaagctttttctaagctattgattcgccgttagacaattaccaaaaaagttatacatgaaaattgcaaaaagtcgaaatttttgaagtttttttattaataagagttttctaagtttgaaaatcttttcgcttttggttaaggctaataaagcatttcgaatgataccaagattgttagatttggatgccaaagaaaaaagctatatctgacaatacaaaataataagaaaatcagcttttacaatcttgtaaaatttgaaatcgaaattttcggtctatttttaatgcctctttgaggatatatgcatatttattgcgtatttttctaccctttctgcttattcagttccaattttagttttaatataaaaaaggcatggatttgatattttcagacattcgtatgggtgggtatatatatttttttttaatttcaggtttagggatgtattttcgtttttattgctcttttaagtttcagaaaatcgtgagaatagtctgcgatgtgataaattgataaaaataataaaaaaaatttctgaatattttatgtagtcatcatattgctaaattatatgatattcaccaaataaattgtaggatagattaacaaaaactgaatggtacgcatgtggcaggattcgaacctgtgcaggaaatatccctttgcgacctaaacgcaacgccttaaccactcggccacacatgcggtaaaagtaatcgaaccattgtgttaaaaacaatgcaatcagataaaaatcgcatttttgcacattctaagagtccgttagttgcttttggctttgccattttttggtcaacaaagattgaacatttatgaaaagtttggactcaaaattctgttgatatcacgtcgttatagaatattgaaacagagttaattttattagtgatcaaatttaaatatgtcttaattattttttacggatcgaaaataaatttatatatttatgaattgaaaattctaatgcgtaaatatgtaaatttaaaaaataaataaaattatttcaaaaaaacatattgatgaagaaatagcaaaaatgttgaaatcacaggaaggaaatgaacataaataaggaatatacaaatcaatggaaaaatggttggcattggcatcatttccgggcaaaaaattttggaaaaacatttccaatttcaatgaaaataaacgatttttggaggaatataaaagccaaaagaaagccatgagaaaatcataattattttttaatttttattaattattgccttttccaaatcctttaaaatgcgcgccattctcttcctggccatggtttgcttggtgatggctgttattcttgagacaggtggccaaaattaattaaaaaattaaaaatattttattattttagccaactcaaaggcagtgaaaaataagaaaggtataaataaattgataataaatattaattggaatatgcttttaaaggagcagttgcaacgccagcaaaaggaaaagcggcgccgaaaggagcagcgaaaggaggtaaagcagaaaagagagagggactaattaatacaaattaattgattaatcaattaattaattaaggaattaaaaaagacgcaaaatcaaagggaaaaggaaaaaaggacgccaaaggcaaaaagggtaaggattttaatataaagcgaaatttaaaaagttaatttttgaattttagacaaaaaaactaagccagccaaagggaaaggagtgcctaaaaatggtaaataatattattataattaaaattgaataaatttagacaaaaatccccagcggcaaaagccaatgacaaaaagagcccaagtaaataattaattatatttaatattgtgccaaattgccaatttgaagtcaacccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatggacggcgaggcggacgaatgggaaggcatgggggaggagacggagatggacagccaaatggcactctgatggccaactaattggacaaatggcaaacggaacaaaacgggacaaatgacacaaaacaatttttcataaaatttatagagaagataaaattctattaaatcattcatttctgtgcttcaaacttcgagaaatcattttaaatttttataaaaaataactcaccattaaattatcagacaaaaattattcacactgaactaattggaaaatatgcactgttaataggaccgtatttcaaaattattaatctaaattgagaggaaagttagttcctaaaaaatctgttttaatttgctttatttaaggaaaattttaacaaagaaaatttaagaatgtatctttttgataccatggtttagatcattttactaaaaactccgctaaacacacttaaattacctatttattagcaaatgtgaacaatgggaatcattgcaatggcaaagttcggcatttatttaatcatgttaatgtaaatgataaaagtattgggttaactcttaacattcacatttattcaaaaaacattaatccaatttcattaatattcattctcaattattttccattcgttcttttcgcggaatgattcatttcgatggaaaagcaaattttactttacagactgatgaattaatggaaagaaaacatattcatttattcgtttgcactgtccatttagcatttattactttattttggtttagttttggtggataggactaatttttaaaattatttttttagaataataaagacaatgctttttctcatttcgtttgtcctttgttcgcccttttttgcttccgtaaatttggccaattttcaaccgtaaatttccataatcattcataaaatagcaaatgttatcattgtgttggctttcaggctttacctgattaactcagcctctcatgaagcgcatttcgagactgaatatgtcgcgttggatcagtgcacgcgttggggcacagaacaaacgcggcacgactcattcgcactcaaatttcagatcaccggaaaatgcgagaatgngtgggaattaaaaatttanaactattttgaaagcatttttcagctttctgattttgtatcccggcgctttggacccaagtgcaaattcggcatttggtatg

SEQ ID NO: 3782 - DNA, 3582 bp, Heterodera glycines
cattaatattcattctcaattattttccattcgttcttttcgcggaatgattcatttcgatggaaaagcaaattttactttacagactgatgaattaatggaaagaaaacatattcatttattcgtttgcactgtccatttagcatttattactttattttggtttagttttggtggataggactaatttttaaaattatttttttaattagttttttagaataataaagacaatgctttttctcgtttcgtttgtcctttgttcgcccttttttgcttccgtaaatttggccaattttcaaccgtaaatttccataatcattcataaaatagcaaatgttatcattgtgttggctttcaggctttacctgattaactcagcctctcatgaagcgcatttcgagactgatatgtcgcgttggatcagtgcacgcgttggggcacagaacaaacgcggcacgactcattcgcactcaaatttcagatcaccggaaaatgcgagaatgggtgggaattaaaaattttaaactattttgaaagcatttttcagctttctgatttgttatcccggcgctttggacccaagtgcaaattcggcatttggtatgagaccggaagtgcaattccaagtgccaaatcacccgaaagtgagcaattaaggattctcattaaattaaaaagacgcttaaaataacatgtccatggtgggccaaaaattaatcataaaaaaatttctcttaactccaaagtaaaaattgcttataaatttagagcaaattgggggcccaatgcttggcgcatcagaaaaagtgcaacaattcagacccagggaataattgcgatcgtagaaaagtttggcatggcatcagtttgaaaacgtcgaatgggagaattatgcttgaaatgtcaatcgcggcgaaaacgtaaaaaaatattgaaaaataaaaaacaattttaaattatatatatatttaagctacaatcttggcagctacaacaaagcagagatttttagcattcaattgggaaatccgaataatttaatgactaccgcaatacacccaaagggtaaaagtggcccaatttcatttattatgaattcttatttaatataaaaaaataaaacaaatttttcatttttgataattatttaaaattaaataaattaatcaatattttaaataaaaataaaagagtaaaaatgccaaatttaagtgggccaaatagtttttgcggtcgatgactctgtccgtgatgcttattttgctcgaaaaatcaaaaaggacgtcatgctgatcaattatgctggcctttggatgctcggcctggactttttgccgatgaacaaccgcgacactttgcaaatgcacgtctaccgcgactgcggctgcgaaatgcacgcatgggtggggaaaaaaggaatttaaaataggaaattgatattgtttaaagattgaaatcgctaatttgttataaaataaataattaactaaccttatttattaattatgccaattaacaaatttttgaaaacccgacagttttaattgcccaagaaagccgtttcgaatattaattttcaattttgtctaacggctggagctatcataaacatttttgataaaaaatgtgttaattttcatttaaaattatttttatttattcgttacgcctttcaaagtttgcccatccgtccgatgattcgccgctcaaacgcagtaggcaccccgacgtcagcgcggattgtcccgcaaaaattgtcgattcgttagccgaacattttgcattggaaaagccattgcaaatggacagatccatccgacttcgacaacgactgaacaaaaacccgaaaaagatgctgttttggtttggcaatcagcacaaaaagcatttactcgaaatgaccgtggaggagccgccgaacggattaatcgatatcaaatcaatgcaggcaaagacacgctaattaataattaattaatactaatgggggtggaaaaggacaaaatggcacagacactcacgaagaagggctgttggagtgccattgcaaaaacagtgccaataaaaaccttttaaattgttgccagaatttttgacatttaaaatatgaagccgaaaattatgcaaaattttaaacattcccaaaataattttctccattcgtataaattacggaagagattatttgccaataaaatttctaaattgctcttttaagctgtttaaatttcactttttaaatgaatttaatgcgaaattaaggacaataagaccaatgaagaatttgtggacaatgagatgagaaagttggccagagaaagaaaattcaaagcgatggatgacgaggatgaagaagaaaaaggaggaggagaagaaggagaagaaggaagcgggaagggaggaaaaggcaccaacaaagataaatacatcgaagtgcaattggtggcacgcaaatatttttacgaagtgaaagtgggcgaccgcaaagtgttcaattacttcccgaagagcgacgaatggtggaaaacgtggcaaatggaggacataacgcaagtggaggcaagtggccaagcggaagggcaaatttaggagggcaatgggcaatttgtgggggacaaatgcttttaaattcggcaggactttttttaaatgccaataaattaattgtacacctgttcaggtcgctggcgatgtttacccggacagtgtgggtgtgccgaaagtggatgaaaaggtaaaaatgaaatggcacacctatcgttccaaattaataattaagcaacctaaaaatgagaagcccatttccaattcgtacgttgtacgccttgagagaacgctcaaagaaggtgacacggttgtgctcaaaggccaaatcgatcagcctcaacatcccgagaaaggcttgaccttgtttttcggccttttgcacaattcgccgggtttcaatgaattaggtgaacaaattttggcacagtttgtgtttttcgtacctatgaaaggttccggtaaaaatttatatttttaatacgatgaaataacagtttgtttccctggccgatttttgaagattttcgaaaacattgtatagataataccccaaatattcgaaatttcttaaaattaacaatgaaataaatatttttctcccatttttaacacataatgaatgctctttatttattattttcgtttcgacccctttcctataagtgccgcattttccaatgtatcatttacaataaatccaatacaaattccttgtgcagtgtcagtgatgccatggtttttgagtcaagcggacggaagaaatatagcaatgggaaaatatgacccggaggtacaaataatttaaaaattattattaaatgatattatatatttttttatttaaaagggaggttatgattcgaatctcaccgacttgaaactgttcgaagcgggcgaaccttttgaactgcaaattaaattgttgaaaaggccttcggaggacaacctgcccatgagtatttatatatacaattagccatttattattttaaaaaatggaaaatgataatgtattctaacatcattacatca

SEQ ID NO: 3783 - DNA, 1401 bp, Heterodera glycines
  misc_feature (72)..(72): n is a, c, g, or t
  misc_feature (109)..(109): n is a, c, g, or t
aaatgcaaaaaaaagtggcataaatataaaaaaacatttttaatgaaataaaaaattggcgtgaaaaaattnaaactgatattatatatccgtttttaaatttaaactnttactttcagcagaaattctttcttcaatttctttgagtctgacaatgacagtgattgtgagcacgccgaaaggaaccagcaaaaccaactacacattggacagtgaaagctaccgagacatgaattacataacagtgccaaccaatgattaattaattaattataaattattcattaaataatagtgttattataaaattagccaattataatttatttatttaattaaaggttcgtggtgacttggaactgttcgcggaaccttcattgctgaacgatataacagtctgattttggttttaaaactaaaaaattaaaataaatattatggtacttatttgttagctagtttaatgggttaaatgccaataaatgtacaaatataattaattttttaatgtgtcaacacacaaatacttaactcatgaataaataatatttggttttttttataaatttattataatttttaaattgtataatatgtatttgtacattttataggcatttcaaaatgtaagatgtgaatctgcttcttaaattaggtaaatgacagaaaatcatacgatctaaaagaatatttttttaattttcacaaattcataattttttgcttagcatcccattcttcccgtgcttattttgcatcggtatcacctttactggtaccggtagttcattttttcgctaccgtaaccctaaaaaccgtaacctttaccgtccccgcgccgtgaaaccctttcaaatttagaatgacgagaacacggaaagaaaaatggcttttgaagtgttccctttgctcagtgttggcgattccattctgatcgagggaaaactgaaagacaacgcaaccattttcaaaatcaatttgttccacgatgtgaacgagaaaaacccatacggtaagaccatactgtaaattacggcaaatatttatccaataattaaaattgggcaatgaaaaattcttcgttgttttttgcttttctttcccattttgcaataggtcatttgttaattaatatccgcttctcttcttctcagccagtgatttggttctgcaaattttgttcaacttcaccggggatggcacaattcaattgagctcattgattcaccaggtaaataaatagctcatttatgtcggaaaaagcaaagcaaaagcgagtcaatgactcgattttttaaaaacttcaagataaaatttgaaaatttttgaaaatttctttctaaattaaaatttaattcatacgcgaaataaaatttattttttataaatttttaatgagca

SEQ ID NO: 3784 - DNA, 1459 bp, Heterodera glycines
tgcaaaatttgcagtgtacatgaatggcgaagagtgggttatattggtgcgatttatttgcgaaaaattgccgacggttttccgaacatgatggtcagcgtacttaaaaaaaatcagctaaaaaattagtaaaaaaaattttttaaaggtttttctcggctagaaaatccatttaaaatttttttatctaaattctaaattttagttgaaaattctagaaattttttttgtacgaattgccttggtacgagttgcctattcgcgttctctttcctcgcctccactctctcccccgctctcttcctctcgctcacgtttctttcattttctcttttttgttatccgctctctctcatttttacgcctcctaatttaaaattctatttttcgatggggtcgttatcatgagcgccaagcggaacaaaggggcgttgcgattaatatgcctctgaacaatgttagggcgttgtataatgtgatgccggatcagcgtgcgtaccattaaattcacttcaaaagttttcattgggcgagggacttttacacgaaaggtatttatttcggtttacctcagttcggcaccggcatgtttgggcgccggcatctttttagactataacttttttatttgttattcaaatccaacaatcttgttatcattcgagagctcttcagatgcgctaatagcctgcaaaattccaaaaaattttgtcaattttgaacaaacttatggccaaaaaatttgtaaattttggttttttaattcttcaggccataaattttcttaaccttaacgaaatttttcaaaattttgaaggctaatagaggacaacagtattggatttggttgacaaagaaaaaagttatagccagaaaagtgctggcgcccaaacgtgccggcgcccaactgagcgagtccgatttatttgggtggaggggggggggtcattttagtgccgcgcatttgatgcttcttaacttttcttagaaacgaaccaaataagactaaatacaaatattggaatatataagtttttgaattcctttggcagtattcaaaagtcaaagggagcggcagtgagtgggcaaactggtagcgcgacatgttcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaggggcggtgcgcaatcgctatttaatttctcagagaattttttaattttatcttatatccaagaaaatgactatctcttattttg

SEQ ID NO: 3785 - DNA, 3261 bp, Heterodera glycines
tttcctaggcctcccatttaatggcaatgcctcttcgtcgaataactaattactgccggttcatttttgcggcaattagctaaaaaccggtttgaccggtgtttgagaggcgcggcccggaaaccggtcattttgaaaataccaaaccggtccggaaaccggcattttttgaccggcttttaccggtttatgatatagtcaaaaattcttcatttttgttcattttcctttgaaaaaatccatctggcataatgttattaatttttttttgaatttttcggttgaatttttttatttcacacaaccataaaatttttttgaaactttagtgcaccataactttttcttgaggcatccaaattaaactcccggtgttgctatctgataggcaccacttcatttatctcctctgtcatttacctcgaaattttttttttaatttcaaacagaaattttaaaaaatcataaaaaaatttccaaagatataagaaaattttttaacgatttttcaatttgtgatgaattatcgcaaaaaattttcaaaaaatttaattctttaaaaaattcaaatttttttttgaaaatctttaaaatttataattgaagaggcattttgacgcctgaagttaaaaagagtcgaaattaacacttggcacgatttttgttgattttggggttgaaatacatgtgagaatttaaattttaccaaaccggaaaccggttccgggcccggcaatttgaaaatccggtttgaccggtttttgagaggccgggcctggaaaccggttgtttctgaaaatatcagaccggtccggtccggcacttttggaaatctcggtctctactaaaaatatttgttaatttaaaaaatatttacaacaggaaatttggaagaaactgtaaaaatgaaattaaaggaatttgtgagaaaaagcacaaataatcacgaaaagcaattttgacctttcaaagtataaggcgtcgtcactttctcattttacaccttttaaatatacaatcgcccttctcacggaatccatttgcatattgcccccttcccctcccatttggcactttttactaaactaaataccccagcgaactttcgcttgtccaagttttgactcatagtcatgacaatgagccatcatggcaagttagtggtgattggtgatgacgaaacggtgccaatgccattgttctccgtctcatgaagcatccattcctcgggcagcccgctgttggacatgggccaagcgctgccagacgccccgacaatttgcccgtactgcaacaaaaatcccaaaggttggcatcgctcacaaaaaaggcaaaataattcacaagaattagttaactatttgcccactgcgtaggtatagtaatttaaaatggtttataatgccgcggtcgcgttcatcttcgcctttgtcatctccaggcgacttaatgccaaacaccgacatcacttcagagttcaatccgaccatgccgtgccagtgtaactcatcgaaattgcgtgctgttcacgtccgagtatggcaacaccggatgtacgaaagtggacctctgcaattcattacgcatgacgctgttttgatcacttggcattgccgggcgtgcaatggccgtttctttcagacgtttgagttctccacgtccggcaaatcagatcggtgagttttgatttatttttagaaaaaataaacaagccaaatatttttttagttggggccgttatcgcctttaccaatcaaaggaaagacgcttcgacatcaacgtgacttaccaggacatacgccaggtgtacgatcagatgccgggcgcgggaatgtaccacgtcatatacagaaactgcaaacattgggcggacaaatttgttccccttagtgagttcattcaaatataattaaattattaattaatataaataaatcatttgtgaattaattcagttaggtccaaatctcggatcgatgatgttacttgtgcgtgtgacaactggcacttcagagcaactaagattgaaggtaagcattaatttacaaataaggaaaattgggtttttttaaaaagttaaaattttatgcaaaatttgcagtgtacatgaatggcgaagagtgggttatattggtgcgatttatttgcgaaaattgccgacggtttccgaacatgatgttcagcgtactttttggagaatttggaaaagtcatgaggtaggtgttttccgaatttaggtaccaaaccccctccttacccctccttgttgtcatggcaactcgtacaagactcgtacccagggcaactcgtacaaaaaaaaaattctaagaattttcaaataaaacatagaaatttcattaaaaaaaatctacatgattttctagaaactttaaaacacttaaattttcaaaaaatttaagaaaattaaaaaaatcagctaaaaattagtaaaaaaattttttaaaggtttttctcggctagaaaatccatttaaaatttttttatctaaattctaaattttagttgaaaattctagaaattttttttgtacgaattgccttggtacgagttgcctattcgtgttctcttttctcgcctccactctctcccccgctctcttcctctcgctctgtcgtttctttcattttctcttttttgttctccgctctctctcatttttacgcctcctaatttaaaattctatttttcgatggggtcgttatcatgagcgccaagcggaacaaaggggcgttgcgattaatatgcctctgaacaatgttagggcgttgtataatgtgatgccggaccagcgtgcgtaccattatattcacttcaaaagttttcattgggcgagggacttttacacgaaaggtatttatttcggtttacctcagttcggcaccggcatgtttgggcgccggcatctttttagactataaattttttatttgttatccaaatccaacaatcttgttatcattcgagagctcttcagatgcgctaatagcctgcaaaattccaaaaaattttgtcaattttgaacaaacttatggccaaaaaatttgtaaattttggtttttttattcttcaggccataaattttcttaaccttaacgaaatttttcaaaatttttgaggctaatagaggacaacagaattggatttggttgacaaagaaaaaagtatagccaaaaaagggttggggcccaacgtgccggcgcccaattgagcaagtccgatttatttgggggggaggggggg

SEQ ID NO: 3786 - DNA, 2672 bp, Heterodera glycines
ttttgggcatttggccaagaattttggtgccaaaaagacatttttgtctaaaaaaacccaaattttttcaaaaaatcgctaaaatatgtgaaaaaactgccgaaaccccaaaatatgtttttattcccaaaaagtccaaaatatgtttttattcccaaaaagtccaaaatatgtttttatatgtgctaaaaactcgctctaattgaaaggaaaacaggtaaaaatgctatttttgagcttttcatgcgatagcatatgcgcaaaaaaaaacatgtaaaaacatataaatccgttccctgctgataacagcatcgattttctcgttggtacattatctctaaattatgaaaggcgtctgtaataatttttcaatgtatcgtttttttgttggaaatacattgataaatattagagaccgagccggaccgggcccggaaaccggtccggcgattttagggaaaattccggcttgaccggttttccggtttgaccggtttttcagaggccgggcccggaaactggtcattttgaaaatgccaagccggtccggaaaccggcattttggaccggtttatgataaagccaaaaattcttcattttggttcattttcctttgaaaaatccctctggcataatgttatcaatttttttttttgaatttttcagttgaattttttatttcacacaaccataaaatttttttgaaactttagtgcaccataactttttcttgaggcatccaaattaaactcccggtgttgctatctgataggcaccacttcatttatctcctctgtcatttacctcgaaattttttttttaatttcaaacagaaattttaaaaaatcataaaaaaatttccaaagatataagaaaattttttaacgatttttcaatttgtgatgaattatcgcaaaaaattttcaaaaaatttaattctttaaaaaattcaaattttttttttgaaaatctttaaaatttataattgaagaggcattttgacgcctgaagttaaaaagagtcgaaattaacacttggcgcgatttttgttgattttggcgttgaaatacatgtgagaatttaaatttttaccaaaccggaaaccggttccgggcccggcaatttgaaaatccggtttgaccggtttttgagaggccgggcctggaaaccggttgtttctgaaaatatcagaccggtccggtccggcacttttggaaatctcggtctctactaaaaatatttgttaatttaaaaaatatttacaacaggaaatttggaagaaactgtaaaaatgaaattaaaggaatttgggagaaaaagcacaaataatcacgaaaagcaattttgacctttcaaagtataaggcgtcgtcactttctcattttacaccttttaaatatacaatcgcccttctcacggaatccatttgcatattgcccccttcccctcccatttggcactttttactaaactaaataccccagcgaactttcgcttgtccaagttttgactcatagtcatgacaatgagccatcatggcaagttagtggtgattggtgatgacgaaacggtgtcaatgccattgttctccgtctcatgaagcatccattcctcgggcagcccgctgttggacatgggccaagcgatgccagacgccccgacaatttgcccgtactgcaacaaaaatcccaaaggttggcatcgctcacaaaaaaggtaaaataattcacaagaattagttaacaatttgcccactgcgtaggtataagtaatttaaaatggtttaatttgaatttttggaagtcaaattccaatttttcaatgtgcgaagaatgtgtgattgcacagctcatttgtcagcggtgaattgaaatgccaacaaacaaaagcgacagatggcacacattttgccaaactaatgtgaattcccaaatttgtaattagcattactaggcttacaattagcagtgccaacactccagaaatgcgtacgtccatcaaaacatatttattcttgatgcgtacgttgtctacatgactatggtagattaatgttatacggtagatgtgcgtacacatccacatactcacgatatgcaatgctccagaaatgcgtacgtccatcaacacatatttattcttgatgcctacgttgtctacatgactatggtagattaatgttatacggtagatgcgtgcctacacactactccaggaatgcgatacttacggtagatgcatcttacgcagaaccctatgaacaactacggtatgcgtacgatgcctacggcagatgcatcgtacgcagaatcccattacggtatcatacatgcgtacgatgcctacggcagatgcatcgtacgcagaatcccattacggtagcatacatacgtacaaagcctacggccgatgcatcgtacgcagaatcccattacggtatcatacatgcgtacgatgcctacggcagatgaatcttacgcaaaatccagatattcaacgctccagaaatgcgtacgtccatcaacacatacgtattcttgatgcctacgttgtctacatgactatggtagattaatgttatacggtagatgtgtgcgtacgcatccacatactcacgatatgcaatgctccagaaatgcgtacgtccatcaacacatacgtattcttgatgc

SEQ ID NO: 3787 - DNA, 1168 bp, Heterodera glycines
accgagcagcctattctcgaccatcaccgggaccaagcagcccataggcacgggccctgctggcgagagaagttagacggtgactctctcgtcgctgtagaggttagagagtgcactctctcgccccaaaagaagccaacaggtgtggggtggaaatcaatcgataattgaagtggtctgttattgtagtagcgaatcggaggcacaaaagtgatgggcccagcattcgacggaatattcacagtcggtttggccatctgaaaaggcaaaattagtaaatttgaatctgtaatgcgaaagaagggaattcggggtcaaactcaaaaatttgattacggttcttctgcccacgtttggcttttgagtttgcaccgagccagtctcggttaaatgtgatttttttcctattagccttttgattaatttgttctccggccgaaatcccatcggacaattgtcagaaagtgactgatcattgtgtgcagagaagtttctcaaaagtgaacacattttagtcgtttaataaattatcaatgttcattatttaatgtaatactgtagttacagtttcccgatgattaaggtcattgtgcatcatttttggtccgacagatggagagatagacctaggggttggacaatcacaagcccaaccactttctcatcactgagagaaatcaaaacacccaacatttgggaaatgggaggggggatgaatgggacggggggggtgaaaaagattcgaaagagatggaagggtaagtccatttctgtgttaaattgtccccaaaaaattattccccccccccctctcagatattcgtgctttcttctctcctccccggtccacttttcatcatccctttgatgagaataataaacaattggggatggtaggaaacaaaatgcccaaacatctgggagatgggaggggggataaatgggacggcgtgacgggggtattcgtaatgaactttggcgaaatatggcgtaagtgtgtggataaaatggagaaggaattaacaaatgaaaaaatccgtaaatgagcagaggaaaatcaaaagctaaagaggatgaaaaaggaaagcaaaacgcaacaatttgcataattcggcaaagagaaagaaaaagccgaaaagaaaaggggatttgggggaggtggcgggaa

SEQ ID NO: 3788 - DNA, 1120 bp, Heterodera glycines
tttgccagaaaaactggatgaagtgaaatcctcttttttgtcgggccacacattgacttttgatgaacggaaagagcatttgacacaaaaatttgacgcccaacttggcacaatgtatcaaatgagaagcaaatggcaaagcaaatggcgatgtgccaaactgaagagtataatactcaaaaagagtagcggggaggagaagccggatttgccagaatgtcaaaaaatcagtaaatatttggatgttttgcatgaacattttgttagaatatataccgaaggttcgtaccgagttttgagtgtacccgaaggtttgagtcccattgtttctgtgtcaataaaaatggagggtcagttgaatcccaaccgtcaaaagctgggaattttgacagaaatttcggcaagtgccagattaatcaaaaaaattcctaaaatagatttaaaaagtatagaattttccaaattattataaaaattgatgaaattccggtaaaaaactatgttcttattagttatcctttctgccggcaaccaaaaattttaattaaaaaaagcatagagcacaaaccttttgcgccttaagcgcaggccgttggaccgaatactgggcctccgttttatgtgaggtcgaaaaagcaccaattcggaaaaattttggccaacagagccacacaaattttttaatccttttcacctgttgtattatataaagaaaaattcttcataaaccgtttggaatagtgccaaggcatgttccttgggcctgaatttggcggctcggtctgtgttgtgttgcagtttccggcccaactcagtgcggtaggtcttgcggccacggccatgtggacgactctcgaccggactcggcacggatttggcctattgggcttacggacggacgggctcgtagtgcctatgttgtcctgccctgaaaattccttagaatttttgacaaaatcttacttaaccttaaaaatttgtttttattagagttgtacgggaccgggacctggacacggacaactgagtacaactgagtacctaggtcccggttttgaccagttttgaccgggaccgggaaattcccggttttcccagccaaaaggtcccggtttttcaa

SEQ ID NO: 3789 - DNA, 1350 bp, Heterodera glycines
tatggtcataaaatttcaataagacttgagtcaaattgtttgacaaggactttcttaattgatatatttgatattctatatttatttttaaaatttcaaaaaatttattgtttcaaaaaattcttgaaaaaatctaactcattacttattgaaattttattactgaaattttatgaccaaacctttttataattttgtataatttataaaaaaaaatattttttaaatattctgataaagaacacctagagctttggaatgaaaatgaaatattaatttggtagaaattgagctaagttatgaatttatatttttacattttttcctactacttggcggttttgagtagggtaggtcgggtccaagacctggacacggacaactgagtacaactgagtaccaaggtcccggttttgaccgggaccggcaaattcccggttttttccaggttttcccagccaaaaattcccgggttttcaacccaaaaagtcccggttgtgcccaaaattcccggtcccgacctaccctagttttgagtaacgccttcttattaccgcatgctagaattactgtagataaattcattccaaaatattattattattttattttttgctaaaatgtccttcactgaagaaaaatctaatttatcaggcgataacaacgcccaaaaaatcaccagcagaagcggaaggaaaaaatgaccgtaatccggcttattggaaagggtaccgtaagcattttgacaaaatgttgaaacagatgtggaaaagcgcaaaagccaaagcaatgagcgaacgcaaacagttttttaaaaatcaacaaagaagaagcattgagcaaaaggaccgtaatcagacagagcaaagtgaaatggccaaaaaatgtgccgaactcaacgacaaatttggcattatttacaaagcaccaattatttgcttttgatgggagggagtgacaaatttgcgaatcgaccaatttaagacacaaaaattttttcttgatcaatccaaccggtttattgtaatactggcgatggttgccaccttttttggaaaaaaatattttttccttttaaacatcatgtaaacatttttcaaaagactttctgggtcgctgatcacgaatctggcgtccatttcgaccaattccgaaccccggacaagattttagattttcgagttccgattttttggtcgaaaatgtttaaaaatttttttattaagcattggtgacttttagtttgtttccttttcatggtctttgaaaggaaaaattttttttttccaaaaaagggggcaaccatcgccagaattacaataaataggttgtattgctattgaataactt

SEQ ID NO: 3790 - DNA, 3354 bp, Heterodera glycines
cctgaattcaagaaacacaaatcatagactaatattttgactcccaaaaagattaattttgaaaggaaacaacccaattaggcgcggctcgctttttttagcgtgagttttttaagagaagccggttcggaccccgttttaaaaagattttttcgtagaagtagttgtaattttcaattacacctgttttaatgaaatttatttaaatattatattaacaaggtaccaaaataaaattttcagaatttttgagaaaaaaaccgggttaggtgcattgtgtcagtttatcctgacaaggacagggtctccaagatggagcaggacggggcaaacaggactaaagtccttgcttaacaagactattggtggtcccgggaccaacaaaccctaggaaagaaaatcaaataaaattctttcaattcaaagataaaatacccgcggaagtgccacaatttcaaattaacaacgaagaggcgacgatttttgccgctgtgaaaacggtgaacaaaatttcagcgtcctattttggtgtaaaaatggacaaaaactatttcccgctgcacaatctgatttcgaaacttggcaccccaacgctattagacgagaaaaaatggttgaacaaagccggacaggtcagtctcggacaaaacattggcgcccagaaaaaagcaagtgtaacaccaagcagctcacaatcagcagaagcactttcaaacaaaaaggtactggagatcagaaaaatctttgtgtatttataataatagagtagagcgttgtcggttcctttaccgatcggtaattaccactaattaccgttttttattggtaccggcactgatttttcagaatcaaaattactggtaccagttttttgtagtaccggcggtactggtactaacctacaaaaataaaaatggataacccgagctgaaattattcatgaaaatttgggaaaagaagttttcataaatatggaacttttggccaatttttaaacaattctttttttcattttgctattaattagagagcggaccggaccggcccggtactggtttttaccgggcccggcaaaccggtccggcgatttttggaaaaatccggttttccggtttgaccggttttccggtttgaccggttttccggtttgaccggttattgagaggcccggcccggaaaccggtcgttttgaaaatgccaaaccggtccggaaaccggcatttctgaccggtttttaccggtttatgatatagccaaaaattcttcatttttgtacatttccctttgaaaatatccctttgacatgtttttaatttttttttgaattttcggttgaatttttaatttaaataatcttattttgcaaattggcctatttaaaaaacgtacaagaaagactcatacagaaattctgtattttagacaaaaaattgaggggggggggggcatcaacttgcgaagctgacctttttttttgctttttgaccccaatttacaattttttcgggaaattcaattgaaaatgtgtcccaagaatccacacaattcttgcaaaaatttaatctaaaaatcaaaaagcatttatttttttgcaaaatctgttatgaaattcacttaaacaaatatttttcgcggtggtgcctatcgtgtatgcactcactttatttatcgcctccctcatttaccccgaatttttttttaatttccaaacagaaatttcaaaaaaaaacaaaaaattttccataagaatatcttaagaaaaaatgtttacgtgatttttcaattttatgatgaattacttactgttttttttagaaaatcgcaaaaattttagaaaatttaatttttttgaaaatttttgaaatttaaaattgaagaggtcatttttgacgcctgaagtgaaatagagctgaaattttacacttgacacgatttttgtcgattttggggttgaaatacatgtgaaaatttaaatttttaccaaaccggttccgaaaatccggtttcaccagtttttgagaggccggcccgaaaccgattgcttctgaaaatatcaacccagtccgggcatttctgagaatttcggtctctactattaattttgataaaaatttttagaattgtgaagacaaaattgttttttttttgatgaaaatttcaatttctttcttcgacctccttcaagagctttctcacccaaatttcccaaaaacttcgtaaaaattgaagaatttttaaaatcctttaaatgtttgttttgacaaatgaaaaaaatactcaaaatcgcttttttgactttaacgcgattttattatttatttttcatttacatttcaccccacgaaatgtgctactctcgtcatttctttttttacgaaaaaaggctaactaaatagtttctaaaatactaaaaattccaatatagttgtcaaatattagaataatactgctcaataaatgcaaaaatctcctaaagataccacctcattctttatccatttcgctagcataactgcaaatcaaaatcctttcaaatcagcacgaccggatcccaacgatcttttttttgagacccaaaaatggcaaaacaattaggattttggcgaaaatggctataaatttctgtttttctccccgaactaaatttttaaaataacaccaggggttcgatcgatttttttcaaaattatgacatcgctggtcaacaataaaaaatttttaggaattaaaaatattaacatttgcatgcattagtttcgcattttggttagaaacagtggcctaggacttaaggtataatgtaaaaaaatttgacggattcatttttttttctaagaattcaaattgcttaatttttgtttagaaaaaaatgagcaaacccgtagtgtacccatggcaaaatgccaatttgttgtccaaaatacaaatactcatcacaaaagaataatcaaaaatttaagtcggttgattttcattcacaaattgtttttttccagccgaagtcaaagtcacaagcaaaaggagtaaccaaaaaagactttaatgaattattaaaacaaatgtgggaaagtgcagaaaaagaagcgatggaaaagcaaaaactttttaatgtagaaaattctaatttggcttcatcaaacaaattgaaggatattttagagcgtgaaaagctgaaaataaaacgtgccgaactcgacgacaaatttggcatcttttacatagatgagaaatcgcctttagctaaggtgatttagtgtggatacgatagaggatgcaaaacgattgtcttgggttcgcaaaacgagaaatctatgttttttttgttcggcttactctcggtctaaactttttttt

SEQ ID NO: 3791 - DNA, 1211 bp, Heterodera glycines
cctaattccaggattttaagcatatataaatccagtccctctcttgacgtaaaaatcatttatttgaatgagcggtgaaagcgctgaaaaataccgtcgtgaaaaaaatattggatgtgattagatattgtggattttagagacaggagttttggaaaactcggaactctggatttcgagatggacccgggatatgttaaaaaagaataattccgaggatggcaaaagtaggaggtagggaatggaccaaaaatatctgagatttaacacgcatcccttgcatgaaaaatgccattcaaatttttttcattaatgtttggttttctgtaagctttgtcgtagttaaagacggtctttataaaaaatcaacaaaaataattttgtttctttgttataacggtaaaaaattgacaaaataaatttaagaaagcggttaatctatgtcttggcgaaatgtaatcataaagcattggaaatgggctggcaaaaaagtgacaaaaataattttacgtcattgtaataaagattttgtgcatattaacattaaatagatttttacagcctaaatccatccattccatcattcttccattcattcattcattttcattaaaaatgaaaatgcattgctttttcactcatccaatttttgattttattttttattattttatttttacaatttcaaaagaagccttggcggcaacggtgggttttccttaatgaatagggccggcaattatagtcactataaaacaaaaaaaaattgacaataaactcataaaaatggtcgaaaagtgacgaaaaatttaagcaagtcatgaaaaagtgcaataaatttttttttatttctttcaattatgtcaagaaaaataatatttaaaatttagaaaaataattaatgaaaaaattttcattattagtgtagtacttttcgagtttcaaagttgattcttaggtttgattattttttttttgttttttttttgtaaaattttgtgctaacattttcaaaaacggtaaattaggataattttcacaatacattttgggaggggaggatatggaatttcgatatttgttatactttattctttaattacccatatagactgatgatgattcggatgcatttctcacatttgtgaacggaaagaatggaacgaaccgtgcatttaaattccacgtattttgtcaggatctttacaaaa

SEQ ID NO: 3792 - DNA, 4268 bp, Heterodera glycines
aattttgagaattgtgaagacaaaattgtttttttatgaaaatttaaatttctttcttcgaccttcttcaagagctttctcacccaaatttcccaaaaacttcgtaaaaattgaagaatttttaaaatcctttaaatgtttgttttgacaaatgaaaaaaatactcaaaatcgcttttttgacttgaacgcgattttattatttatttttcatttacatttcaccctacgaaatgtgctactctcgtcatttctttttttacgaaaaaaggctaactaaatagtttctaaaatactaaaaattccaatatagttgtcaaaaattggaataacactgctcaataaatgcaaaaatttcccaatatataccacctcattctttatccatttcgctagcataactgtaaatcaaaatcctttcaaatcagcacgaccggatcccaacgatctttttttttgagacccaaaaatggcaaaacaattaggattttggcgaaaatggctataaatttctgtttttctccccgaactaaatttttaaaataacaccaggggttcgatcgatttttttcaaaattaggcatcgctggtcaacaataaaaaatttttaggaattgaaaatattaacatttgcaaatttgcatcagttttcgcattttggttagaaacgtggcctaggacttaaggtataatgtaaaaaaatttgacggattcattttttttctaagaattcaaattgcttaatttttgtttagaaaaaaatgagcaaacccgtagtgtacccatggcaaaatgccaatttgttgtccaaaatacaaatactcatcacaaaagaataatcaaaaatttaagtcggttgattttcattcacaaattgttttttttccagccgaagtcaaagtcacaagcaaaaggagtaaccaaaaaagactttaatgaattattaaaaaacaaatgtgggaaagtgcagaaaaagaagcgatggaaaagcaaaaactttttaatgtagaaaatgctaatttggcttcatcaaacaaattgaaggatattttagagcgtgaaaagctgaaaataaaacgtgccgaactcgacgacaaatttggcatcttttacatagatgataaatcgcctttagctaatgtgattttagtgtggatacgatagaggatgcaaaacgattgtcttgggttcgcaaaacgagaaatctatgtttttttttgttcggcttactctcggtctaaacttttttttatcgataatgctttttgtctttaaggcctgaaatttcgacagaccaaacaaaaactcgttagtttttgcgcggtttttgagtcaatttaaaggaataaagggaattttggagctcgggcggtgccgataggtgacgctgggaaaaatttgaagatttgagtgcactttgttaacagatttagttttgaatgagagattgttgtgaaaatttaaaaaattttatccctccatcactgtgaatttttggtgaaattataaaaaagcctaaaagaattagttgccggtaaaattttgaaaatttgttttttccactattttggtttacctttttaggcaagaaaactgccactaagtaagtagattcgaaaaaacctcaaattaggaactagatatgggataataatcggtaataatctataaaaagtttaaagtttaagggtaaactgacatttgcaatcagacagaatacgcatattctatgaaaaataataaaaaaacttaattttcaataatatattatattttaaaacgcaattaatatttttaagtatttaattaaatttccaatacgatttgaaaattttgcgtgtacagtaaagccatgccattggacggatggctttggcactgttccattctgatgttgtcaaagcgtgaacgccaatggaatccaccatgagaaaaaaaaattaaatttttattgacataatgccataatttaatcaaaatattgatgaaaaacaaagatttccaaaatttctttgaatttcttttaaaaacttttccaaatgctcatttccaaggacgtccttggaatccaaactttaaaataagggcaagtcaataatccagggtagccagatctgaggctttagcctcattttgtggttttttgataggttaatgaggctaaattttcaaaatgaggctttgaggctttttgtggctttttgagaaattttgaagatttttgatgtttttggggaaaattctcagatttttttaatttaaatttatttttgataagttggcataatgtttttggccattttggacaaatctggtaataaattgcttaataattacaaaaatattaaatatttatttagtgtttcgattattaacaatttttttttgaaattttgtctattttattttaaaaataaaataatttagtgccagctggtctcttttttttaaagattttcttatccaaaaagacacttttatgggtttttaatggtcttattcttcaaaattctcaaaaaacaaaccaatattacgggtaaatgaaaaaaatgactctatttggcaacacgctagaattaatagcatttagcactaattaaccatttaactaattttttccattaaattttcttatttacttaacttttttgaacataaatttgcgaattattttctttatgaatttctctgaagttgagaaaccaaaacctttaagatcctcatcatccattacgcattgcataaaaaaataaaacaaatttataaatgccgcgagatgcgtccctcttcttttctgctcttcggtggctccatttgccagcgcaatgtacgcgttgtactcatctctggcacgctctggtagggtcatctttggaagcccaccgcgaacgagaatccagttcatcacaaggcgccccaagcgtccatttccgtcaacataaggatggataaatacctttgttgtttgttttttttattttaaattaaaataaaacttttaagtaaataatttataaatctattactatttttgataaaaaaaaaacttaaaagcaagcattagaatattcataatctgcttgcataaaatcattgctctatgctgtaagaaagaaaaatttttttatttaaactacatgctataaaatcctctatttataaatttgtttgttgtacagtcaatatgagtttttagtagagaccggacaagagggtcggtcgaacggtttcggataaaaaccgaaaaactcaaaacattctcggccgaacggtttcggttaaaaacccgaaaaaacagaagaaaaattttcggtttatttcgatttttcggttttttgaatttgtttattttttccaaaaaagtaataaactatttctattaaaaaccgaaaactcaaaaataattttatgtaaataggggcgatgaatttttgtggaaattttccattttagcgttggtttttaaaaattttggtcatctcttaaatatatatttcgtttttctttattggatccgatttttaaaaattttgagaacaaattttaaaatttaataattcctttataaattacttaagtaatgtttttaatttttggcaatttaaaaaaattaaaaaacttgcgaaaaatgcttttttatttaaatttattatatatattatatgccaaacggtgccgctcagttcggccctcacggttcggcccagcatgtttttccaatatagcttttttatttgttatccaaatacatcaatcttggtatcagaaagctcttaacatgttctattagaaccttaccaaaaagcgaaaaggtttttaagcctggaaaaaacatttgagaagaaatttataaaatttcgacttttttgcaattttcatgtataacttttttgataattgtctaatcgcgaagcaatagcttagaaaaagattctaaacagattacgctttcgaatgatacaaacaatgttgggtttggctgacaaagaaaaaactttatagaaagttatattgaaaaaacatgctggggccgaaccgtgattttaatataacgactcatcaccatagtaaaaaaaccaaatttggtgggacaagatttaaattccatgtcgaaatgaattttttggcgttttatcactagggtgaggatggaatggtggtttgccatctattgtaaagaactatttggtttttttatattcatttaccgcaatctcggaaagtccttataccgtctggacccaaaaaaatacgttcaaataatttttt

SEQ ID NO: 3793 - DNA, 349 bp, Heterodera glycines
cattttcggtctttgatcactaaaaatttcaatgtaatggatgttgttagtcgtcaaattcacgaaaaattgcgatgcattatatttgaaacggagaatatatatttatcatcagaaatatatatagaaaaaaatttccacttaaaaaactgtcagaaaaataatgtaaaaaatcaaaaaagaaaatccgtgttcttataaaaatctgttgtttatttaaaaaatttaagcttcaattatttttgccaaaacgcatcaactttatttttttaatgggtaataaaaaacttattttacttttttcaagattaggacccaccccattcatacaaattaatcatttgcctta

SEQ ID NO: 3794 - DNA, 3488 bp, Heterodera glycines
ccgccgagaccattgacattccttttatgctccgcctccgcttttggcatggctgctgcccctggcgggggttccttccgtctccaccctcgcacatcgccgcccccgaggggagagaaagtccaaaaaaaaggcataaattgaaggagggaaaaccattagcatgagcattagcatttgtgaaattcttttttttactattgtcgagattcttttgccgactgagtcccgtgctcattgagtcccagtcgtaatttgaaacaaattttatcgtatattttatgaaaatataattttttggtactgtaatcccgaacaggtttcagacagtttccgacaaaaatatgcaaattaccaaaaattaattagcagataattgatattttggtacacaattttataagaactcagtggaaatagtttttgcacctgtactaattaggagcaacttaattaatttacaataagtaaccgtttaatccaaaaggatctatgaaatttgtaaacgaagattctttaaaattaaagttttacatttaaattttattagacttatttgtacgtggactcgaaaattactgctcaccttataaaacatccgaaaaaaatcattagtcattagtagagaccgacttttgaggcatatgcttttttttctgcgcactagtttcgatatattaagcataaataagacactttccacttggtttgaggcttctacgttgacttttattatgcctttttttgcctttttcgggattttcgtgccttaaatgccttttttggcattttgccgttttggtgccttttttggcgtttttttccgaaaaattccataaaaaatgcaataaaatcgggaaaatacaccccttgaaaatgactaaaaaaatttcagaaaatacacacctaataattgaaaaattttgtcaaaaattgatcgccaaaatttcatttttttctttacaaaaaactttaggtttaaaaattttccttattcgaaaaacattataaaatatttaataaatatttaatgaccaaaattaagttaattggttaagttttacgtgttttgcgccctaaaaacccttaataaaaaaagttttaagtgccttttttcatgccttttttgggattttcgtgcctttttatgccttttttccgatttttttgtgccttttacagtgcctttttcgcgatttttggtgctttttagtcggtctctagtcatttgcggtacgagttaatggggcaccgaggagtgggagagcaattaatttatggggggcggggcgttatgttggccctgctatttgggactcatttgtccgtgagactcaagcgtctgaaagccttccataaaaggcactaaaaaagggaatggccccgaagaaatcattagcagcagtacgagtaaatgaggcaccccggaggggtggtgtgtgggggaggggaacacttgggcgacggagagaagccattgaatatttttgggggttttggcatggcccttggccccggcaaatcgaaggcacttgcctggggggtgctaatttgggggaaatgccaacggaacgccaaactaagcgaaaattgggtggctttgaattggagaaggacacgttttagtgggagcggctgctgttgccctccgagaagggctaaacttaatggaattttggtgccagaaatggccaatttgtagggcaaaatgaaatgaaataaagtaacatttttaaatgtaaaaaaaatgtaaaaagattttattaaaaaatggcaaaaaaacttttaagggcaaagatagaaaaaatttttaaatttatattaaaaattatattaagttttttaattcagaaattgaatcttattgcttataaataatattttatatttttgaaaaaatggaataaattaaaaggggaaattattttttcgaaaaaattcattataatacttttttctcaatttaaaaaactttataaaaaaaaatcgggtcaaaactttttcgttatttaatattttattatttaataaaaattcaaaaccataaatttaaagaactaaaaaaatgaaaaatgtgaaaaataataatattcaaaatgaaaatttgtatttcctattctttttttgtggactggttttgacaaggaaataagaaattttttgtcagtgaatgtggaaacacaattctcggatagaagcagccttttaatttgttcggccatgccgaaaatttggccgtctcagcgccgggcacagcgcaaaaacgttgggactaacaaatccgggctgatatggccgcgcccacgcaaaaatggccaaattgggacgaaccaacacagtcccaaccggtggaaaactttatatttttctcactttttatgcaaacaaaaaccaataaattttaataattttaaaattttagtaaaattcaaaaatagaccagtaaaaattcatttaaatccattttttttaaaaaatttaaaatttaagagattcaggcaagaaattaattttttgaattctgtaaaaaatgaaattcttatttaaaattttaaaaaattatgcgaagggtttcgttaaaacacataaattcaaaggattcctttttatttaaatggaaaaagatatttgaagtgattatcataaagccaaaggtgtgtgctttttgagcaaatgcgccaaaaatggcaacattatgccaacggatgttaattaagcaggtgtcacatgcaaattgaatattatgtacaatgctaatggatgacgaattatcaaagagtatactaaaattactgtattttttagttaaaaactaaaattcacagccctagtaataacagtgagaagtgattatttacccaaaaatctaaggcacaaataaatgggcacaattggcatcatccccatcaattttgtgtgccattctaaacataagttagttagagaacaaatgtgccataaaagagcacgttttggccccttccttgaggtactatcggtgaggtaaagcggcggcaaaaaatctaatcctctaataatggggatgaatgaatgcccctcggggtggggaattgagcgctaaacgacaaattaataaatttttttaaatgcccttgagcgagcaatgacaacaaattatgcgatggttttgtggttttggtgttgtgccattgacaggtggcgcccgattgacgaccaccgacagcgaccggctggcagaaacagaaaatgccatgccattggggtgcgggggggggggggggggcggctgtcaaaaaggggttacggatgatcgcacattttgtggccataataatttgttacttctgctgctgtttctggcccgagggaggagcctaaaacgggcactgccccccgttgactgtgttcggctttttgtttttgtgtccacagagtgtggcacaattcgaggggatgcatatggggcaaggtgacgtgatgtgtaaaatggatggccaaggggaaaa

SEQ ID NO: 3795 - DNA, 3256 bp, Heterodera glycines
atttaataaattataattttttatagattcttagcatttctagttactttataattcaattaattgaccatctcgagaaattatcatttttcttttaaaaatgattatctcaaattttttaaaataacacaaattattaattcagaatttttagcgagttatattaattttcacatgattttaaataaatctgggtgttttaaaaataattatggattagctactctgacggattgtccactgatggattgtccactgacagattgtccgggagcctgatattagactttttcaagacatggaaccgggactcggacggacccgacttttaagaatcaaaacctgaaagcgaatcgccagggtttagcctcgtccccgccctccccggccgcccctccgaccatcgggggatagaaatactggagatcagggatattccttttagcacgattttacgatttgaagagaatcagacaaaaaatttacaatgaaaaagtcacccaaaaattcccaacaaaaatatagcaaaatcagttcaactcagtctataaaattcggaagatttttgatagagttgtacggaaccgggaattttgagaaaaaccgggacagggacttttcgggttgaaaaaccgggactttttggctgggaaaaccgggaaaaaaccgggacttttcccggtcccggtcaaaatggtcaaaaccgggactttggtactcagttgtacgttttttcagtaccagatcccggtcccgtacaactctaatttttgacaaaaaattattcataattttgctcaatgcaattaatttttaataaatgttctctttaaggccttcaaatttttaaaaaaatcatttgtttctgaaaaatcatggctaggagaacttaaaaaccctggtgttttcgaacatttttggccatatcatttttaaaactaaagaaattttttaaattttccagaccagtataaaacacttaaggctaacgaaagaaattaagaattaagacttggttacatttgcgcaaagttataagcaaaatttttaattttgctgggttttgagtaacttcataacatctcaagactatcatcataaacaaaaattttttaaatcggttgctaggctttttcataacaaaaaaaaaaacccaaaaaaagaaggccaggccaaggccgcagcataacaaatacagaaaattcctaaatcgttggctaggcctgcactatgctttaggaatcgctgaaagtaaaattttttttagttgggccaccatgactttgtcccgacaaaaacacgcatttttgagggcacaaatttgtcgccgtgccacggcattttacgcctaaaattgacgtttatggaccgcggtacaatgcattttccatgcctttgggggggggtgggggtgtccacattttgtgccaattcaattcgtttcgcccgggagggcgccgatgtgttcgttaaacacattttctgctgttgttggtgcgccgtgccaacaaaattttttttccccaaaaatatattacatttttaggcgtctgttttggaaagaaaagaaaataatggcctaaaaatttttggaaatcgaattttcaattttttattaatttttttttttcaaaaaatcgaattagatgcattaaaaataaaaactcaaaaattacttaaacgaaaatggtagagtccaaattttgtaggaattttgaaaaattttaagaaaatttattgaaaattgttaattaactttaatttttattttgaactatcaattaaatagctatttaaaatcattaaactaaaaagttttaaaattataaatctagcaaaaaaatttgtcaacttttcgtaaaatttgaaaatataaaaaatttgtacaatatgcactgtttaaaagaaaatattgaggatttatgttaaacaagttaaaaaataaacatttaaatgtttaattttataaattattattcgttttggcgccacaatttcccgcatttccaacgggcaaaatgtgccaacaaattcatttcctcattcatcttcatcattatcatacataaaattcttcatgggaatgttcgttatgcttccactctgattaaatatgtacataaaaatgctaaaagagtggagcaatttgaatcgtctaattaattaagcctatttgtctgagtaaaaatgggaaaacaattctaattgaaaattattaaaataagaattttgtttaaaaatttaatttatatttttcttacttttaatgatctaatttatatcaaaatatacaaataatgaaaataaaaaagcatttaaaaaatatataacaaaccaaataaaaaaggaaataaaaagtccgttttaaaaacttatataacccgtcgcatttttaaacaaaaaaaataaaataataagaaatttcgaaagttttaaattaataaaataaaaataaatcgatttttcatatttaaaccggttaatttactcctaagcatagtcggacctgaattaattctgtcaataaaaatcactggaaaatttattaaattttaacggatggtattcggttgttcagtggtacggctttgatggagacgaaagttcgattcccattcgatgcactacctttttttgcccttttaaaatatcttaaattttgcctatttcatttcctaaactttgtaaatggaaggaacagccaaaatggggaggaagccttccactatttgttggaaatgggagaagcattgagttaggggccgggacgaaaattgtgccgtcgatgacgataatgccgaagggcaaaaagtcaaggggggaaggagcgacaaaaacgttttgccaagaggcaacaaagaaaaaaaaaactaagtggaaaagcaaacattttgctatggcgggggaggggagtagcaaaattcaaactgaggacggggagggatgaagccgccgatggcggaaggaaacggcggaaacattaagcggacgggacagcaagcaaggaacggcacggcacaaaacagcaacaaaaaaaaaattgggggctggagaagcatgtgccgaagaatagtattaactgggaagacaattggtgccagaacagctaaacttggtacggttcagtaccagaacaaaacaaaaactggcaagaatttcgggtttaattgggaagtacaatttggtagacggacctttcagtaccactaaatagtgacatgacactaatgactggactgttgtgtggttgactcta

SEQ ID NO: 3796 - DNA, 3746 bp, Heterodera glycines
tgaacggagtgtgtgtgcatgagaaaatctgttcaactttttaggccgatgaattaaagggcgaaaccctccccattttcgagaataatttatggcacgcaaaattgtggtggggcggcatggaaaagacaaaaagaaagccccgctgggaaaaggaagatgaaaatgggaagaattttttttattatttaaaatcaattaaaaaaggaaaatcataacaaaaaaaaactggtgtaataaaaaagggaaattgaaaaacatttaaaatgcatttctaaattattttaattgctaattttgtttatttatttatttctttatttttattctgtaaataaaagtttgtcatcagtagaacggcaaaaaccatttacatattctgacaacaaaagagctgctttaacagagggggccgttttaatagaaaaatttttgaaaaaaaaatgctaaaatatgcacatagattgcgttatatataaaaattttgcgcattttcaagacggtaattatgtgttaattgagataattaattggctttgcggtaaacactcgcgaatcaggcaagcgtgcgtaattatcgagaacgcaaattaattgccaaaaatgtgatcaatgcgcgcgcgcataagacaaaaacaaaccttcgtcatcaaattcatgcgttgagtcatcctccaagaagtagtagtttgatctgaaatgcccgatcagatttgattgatcaaagaactcgaaaggtattgaaaagtaaataattaagggtttctgattctgaaaatgccattcctactaattaccaaaaaaaaacacaagaaaaatttgtaaaaaattcaatttttttaaattaagttttaggaaaaaacttttaaaaaaatgaaagttttaaaaacatttttaaatagaaattttttttatgaaaatgttttattttttcttgaaatttttgcttgaaaaatattaaaaacaatcaaaggtcttgttttaaatttaaattttttcactaatttataaagtagttagaacaagttttcctatggcgaagtgttcggtgcaaacggttatttcaaattgtaattaaaaaacgatgcaattaaattacttaaaattaaattatttcaatttttctttaaaacaaattcactttattatacaacatggcacttgtgaagttgtattaaaatatttgtgatattaaaaatgaaaatttattatattttattgccactaattatttgtatcaaatatttggattaaaaatgaattattatattttattggcactttgtagtttgtataaaatattaaaaataattatttttttttattgtatattattgaatatgtataataaattttttattttaaacaaatatttgatacaaactacaaaatgcagataaattataataaattttcatttttaatatccaaatatttgatactatacaaattatatattttaatgcgaactatattattagcgccaataaaacaccaaaaattgtcggatatattattattctctcataaattttttaatatttatgaaaaataagagaatgttcaacccagtttctgctatattctttataattattttcctccatttttcattttcaatttcaaatgaaaatccatcggtgaattttgacttttttttaaataattttttttaatccattttaattaggctgatgacaaaatgctaattgattttgtgaaaggtcagcaagaaattcaaattagtgaatattcgaagcagaaatacgaagctcatcttggcattgtgtattttatgaaaaagaattggcaatgttcaaaaatttcggagaaatttgaagaatatgaacggacagaatgccaaaaatatcgcaaatatttggacattttgtacgaatatttgttcagagagtacgtcggaattccaactgtgaagccaaaatttatatttaaagataaagaggaacaatttgaaattaatgggccaataatttatgtggtgaattgtttggtcaaaatttcgcgattttattttaattcaaaatggaataaaatttataaatataaattaaacaaattattcaaatcggtttataattttgaaccaaaattgttaaatgagaacagattgaattatggaataaaattggaaaatgtacaaaaattgccaattaatgaaatgattttggaattggcaattgacacagcgaatgaatggcaaacaaatgaaagtttaaacggaataattcgacaaaaattcgaagaaaatttgcaggaaatgttccaaaaagcggaagaaaatgcaaaaaaagactattcaaggagagtcaatattataaatgatgacaaacataaaataattatcttttcaaaattcgatgatcaatggacatgggtgagacttaacatttaatgaaaattaaataaattcaaaatttagacaaaagatgctttataattaattttatatcaatttatgcttatttagattaatgacgcattgttttctgagttcgtgaaaggacaagcggcgacaaattttaagcaattttctaagaaattcatcgaaaaatattcgaaaaaatgtttagaaaactatgaggcccatctttgtgttgtttattttatcagagagaattggcaacaatgtgaagccaattgtaaagataatgcaaagtgtcaaatgtaccgtaaccattttaacattttgtacgaatatttgttccgactttatgccgaaggtatatgctattatataatagtttaaaaatatttaaaacattaaattaattaagctaaaaacccgagtgagtcgaaacaattagcaccggtaattaggccaatattttttggtccaaatggcatagctctaagcttaattgaggttgttagcagttttaatcatgtttcgaaatattcttgcaacgaaatgtttgggcagatttccaaactgtatccaatgaaattggtaaatgaggtggaattcaattatgatgagaataataaagatgctttaaatgaatcgacggatttaaatgaatcgacggtcactgatgaaataattagaaaggaatttgagcaaaaaatgaaaaaaatatatgaaggataaaagtaaaagagctcgaaaaaccctttgtttattggataagatggaaaaaaattatgtcgaaaattaaaatttagatgaagaatttgatggaaaatttaaatttgtcgcatttaaaatttcaccattaaaaaccaattagctttactacaaatttataaaaaaaatacttttctttacgacattgatatatataattagaaacaaaccccaaagttttctttaaatttttaaaaataagccaaaattcaaaaatagaaaagaattattaattaattaattaatgtaagtcctcccatttttaataaaaacataagcacatttgaattttctgaaactcgtactctcaaaaaaacacaaaacatatagaaataagcacaacgcgggaaatacctgttttatccctattttgaggtttcgcccctatttttttagcccttatttcgcaatttttaaatttttcatataaaattcatttgaaactttttcgcccctatttcgcaaaatttttgcccctattttggactttttcgcccctaaaaatccattccctactgattattacaggaattcaatttttaaaataaaaaaaatttgcgatttgcgctcaagccgactccaaccgaatgcaaccgcccac

SEQ ID NO: 3797 - DNA, 2862 bp, Heterodera glycines
ttttaacgactgatttgacaataaaagagcaaacaattatatgtgtgtatgtttgtgctgataattgccgatcgggagatgaagacacacaaattattataaaacggaaaacaaacaaacaaaatgtggagcgggtacggtacaacatggaaggcctacggtagttcaggggaagggatgtttcaacgcctagcaaaacaggaaaaaaacatgaaatggactgttgttggtgctgctgctgttcatattggaatgacaaattttttcgtgccgaaaagcaacaaaaaaagtgccgggttttcggtgcctcccgccgacttaaatggttaaacccaggaatgaccaattcactgcacccccaagggagtaaaagttcttaaaaaacagataaaacgtcagaaaaattaatcggcatgagattttttctagcgggtacccccccccccccccccgcaaaaaaaaaactccgaaaacccaaattcctaggcccgtcactgattaaactttcccttcctggataagtccgtgtcgaccaacacacacatttttttttaattttttttttattcaacctaaatactcaatcaaataacaaacaacacaatagcagcagcaacaccatttccatttcattgtacacaaaatgtgtgtgcatatttgtggtggtgatcaaagcatccctcctcatccgtcgctgatcaaaatgaatggaccgatcagacgaccggcttctgcggcggctcgatcaccttcagctccggctcgtccttgggcggctttggcgccgacgactcgggcgtccacccgcggccgggcagtcgccggaagatcaccttctccgtcttcatcagtgcccacacattgcgcttggcgtacagtagcacaaacgtgagcagtggcaacagcgtgatcaactgagtgtgtgtgtatatgtgaaaatttttgaaaaaatgaaattttcccggctggtaaggcaccagcgaagccatcaaaaggatctggtgccgatgaaaaaaaattttttttttttttttggatttgtagggttataaatttgccgattttcgaggcaataaaaaagaaaaatgggggataacactttttgaaatctatcaatttattggcaattttgcaaaaaaaaaaatcctccggcagtgctaaccggcaccgttgaacgggtgcactcggtgtacccctgaaacggctccgctgaaatgtggcgggacaaaacttcgcgaaaaacatttttttttattgccaagcctaattcggaaagaaaatttcaaagaaataaaaaacaagtttgttccatgaatttttgttttcaaaaaatttcaaaacaaatttttgagtgccggcgacgctacggcggcaacgttttgttcagtttgaaacgtttctcgagtctcgggaatttaggtggatgtagagcagtccaataaacagagcatcccatctttgccctccccccggggtacgaattccggacttgttgttcccccggaattgcagattccgtttttttttttatttggggggcctagaggtctacgaaactataactctggggtaagtgccaaccaccgcaaatgacaacggcaaattggctgaccttccatgcccagcgtttgcgcgtgtcgtgccattgttcgccggcccagcgcaagaaggtgcaaatgtccttggcctgttgcgacattgttgccggtgtgccatcctcatagtcaatgccttcgtcaaacagttgttgcggcatggccaacacacagccgttggggaagtacgggttgaacgccttgccctcctccacgtcaatgcccgccggtgcatcaaagccatagctgaaccaaacaaaatgcaacaatgggaaattttggggaattgaaaaaacgaggaattaaatttttattggaaatcaaagtccaacttccccatttcgtccgtatccgacaaacaccgcaaatgctatttaaatgcgagaattttacaggattttgaaaagaaacaattcaacaaatgaggggggggggggggtagattctctctgacaatgaaatcatcaagagtctgatcacaatctgagtattgtaagcatcttgatttcttgattcactgacaggtgtacaaaaaacaaaaatttaaaaaaatggtcgaatttttggaaaatttacctattcaataaacagtaattcttcataaaactaaaaaattcgtttgaaattttttcaaaaatctcgcgtatttttcactagagtaggtcgggaccgggaattttgggcaaaaccgggaccgggacttttcgggttgaaaacccgggaatttttggctgggaaaaccgggaaaaaaccgggactagtcccggtcccggtcaaaaccgggacttcggtactcagttgtccgtgttttggtcccggtcccgctctactctatttttcaccgtacgactaactttttcgctgctcttccagtcctgggttggaaatttttttttaatttttttgatttttggtgggtctaaagaatcttgggacctccgtcactgtacactacgcttttttaaaaatgctgacaacaacaaacaaacccggtcaacagatggaacacgtagtcctcggccccttcccgggcccacataatcagtgacaaatcgggtggcaatgcgccactgttcgccgccgcggcagctttgttgtttttgtaggggcttggcaacgtgtcgttgagcagcccgggacgaagaatttccacaccattatcgtccaagtccgggatcagtgcctgaagggaatgagtttttttttttgaaattttcgccatttttaggggttaaaggccccgacccagtgcggggggttcgaattg

SEQ ID NO: 3798 - DNA, 1659 bp, Heterodera glycines
agatttttttccacaattgacgccttctcatcgatgagttgacgatcatcaggtgtcaacacgtccatcccgaccaacaatttgttcttgatggcctcattttcttccctcaatgcatccaatccttgggcaacagttcgtgtatttcgaaaaatttcttcttgtgaaagcatttttctaaattttatcttttattggatgtgtatggtgtttatccagcaatttccgacaaattttgtcgggaaatattcctccccgatacccgacttttcatatcaagcagagtgtcaaggcttaactctacattgaacatgatttatccaaaacttttggctccgtgttatcatttagtatttgataattcagggagattttgttgtatttagcttgttaaatttttgaaaactaaaaatcgttaccaaaaaggttgaaaaccctgattttttaaaattaaataaacccataaagaaccattgagacattaaacattttatggttcgtgcaacatgttaaaattaaaaaaaaagactcaaaaataatgctcaaattttgcaaattttacggcaaaaaaaaacctcggcagcctccgtcttcgcctcatcccgtgtcatgaaattgtcgacaaaatggttgtaacggatgaatttcaaggaatggcatgcggcacacacttgcttgtacacttggtaaccgcgacgaaccctgaaaaaataaaataattcataaaaaacatggaggggttccaattttgggtattatttgagggaccaaaaaactcatccataatggttttgcttgcatatatccaccaaactaaatagaaaagtgccctttttattgcgaggtaaatagaaaggattgatttcaacggtttcttggacgacgagttttttttaatttcaggcgttgattaaaaaaaaaaaaattttttttttttaaatcgggccaaatccaaattttgtttaggcaattggagacattacggttgaaaacttggcacattaaaataaagatgttaaatgtggaacaagaaaaaaaacggacgatcgcatgtcaattgcgtccatcagtccgccgtgggaccatggcaaatggctcgggtgcacaacaaagtcgtaggcacgcgcaccgctattctccaacgagtacagcaacacactgccaccggtggccaatgcgccgaacaacacaaatttggatgctttacgctgaaatttggcgaaaatcaggcggagaaattcaaaaaaaaatttttgtttgtttggcttaccaagttaagccctaatgccgctgctgaccgaaatgacataatttagaaagaaaatattggggtattttgttcggtctaaacatggaaaaagaggtaataatggcattaataaaatttttggcgctatatggaaagtgaccagttttgaaaattttttcaaaaggggggacccttttgttttgcaaaatttttttaagatagtcataaaaatgtattctctggggtttttggggtccccgatcacgaatctttcaattattttgatcaattccgatttcctaatctaaatttgaacaaaacatcataatttgaaaaattaaaaatttcgatttttattcgagtgagggttagtgattactacttagtcaaaagacatgtaagattcgtga

SEQ ID NO: 3799 - DNA, 5624 bp, Heterodera glycines
tcagaagagtgtctcatttatcaaatacaggaaaaaaggggtaaaaaaaaatagaaaataaatggtctaaaatttaacaaaaatatgggaaaatttctaaacaaataaaaaaactacctaagcagtgacacgtttttcagcaatcttggccattttgttcgcatctttggccaattcgagcgaaatgaaacagcgcaagtccctttccccaatgcatactttgctcagaatggccaccaaatccttcagcaaacccttgggaacgtctttggcccgaagagaacggaatgctgcgatgacatcgatgcactcgacgagagcatctctgagcaaccgtttctccactttgaacttgtcgaagatcaccgggacaacaaacgaatggtgaggagtaaatttggcgccaaatcctttggcgaaaagcatcacacatttggtggcacttgcggcgacaaagatatttgcgtcatttgccataatctaaattacaaaatgttaattttataaatttttcattccaattttttcatttcacttttttttataatttataacctttgttaagcgttgctactttaataatttaattaaaatgatgacctcccggtaatttggcgtatcagtaacggtcggcgattgcagcgatttacattaaaaaacgagttcaaaatataggctgctcaaaattttgaaaatttaagcaaaattaattaattatcatcagtcagctcaatgacccaaagataattcaaatcccatttaaaaaaataataaaattgaaaattctgaatgtatgttgtttaaagtcattcgtagcaatttaaaaataatttttcttgataatttttttgctcccttcacctcttccccataaattgtttttttctgttattcatcattatttttagattttggatttagggaagttaaaaataattatgcgacaggtgaaatgtcctgtggtaagtggtgaagaggtgaaaaaacaatatgcgacaggtgaatgtcctgtggtaagtggtgaaaagaggtgaaaaacatttggaaataggtgaaaacaggtgaaaaaccaatatgcgacatgtgaatgtcctgtggtaagtggtgaaaagaggtgaaaaaacaatatgctgaaatgtcctgtggtaggtggggaaaagaagtgaaaaccaatattcgacaggtgaaaatgtcctgtgttaagtggtgaaaagaggtgaaaaacaattggcaacaggtgattttcagttataagtggtgaaaagatgtgaaaagtctaagaacattgatgaaattctagagaagtgatgaaaagaggtgaaactaaaaatggaaaagtcaaatatttcaagaacagaaaatacaacgaacgacgctgattttcgtgttaagtgatgaaaggcaaaacagaacagtagttgagatagaagctattttaaagtggtaaaaaggcaaagaaatgttcgaatatgtaaaaatataataaaagaatttaagagatttacatttataaatggcaaaattaatcgctgttaactctgcaaaaggacagttttgtgacgggtattgttatcacaaacacaaaatgacaaaaaataaaacttggtggaagtgtgaactttaccaacaaggatgcaaaggttggggttttgagagtaatggtgagtttttcggaactcgaatgcataatcatcctccagaccaaattctacttcaaatcgagagagaacagtagatttgaagatgtcaaacatagaaatcagatttcaccttggaatttcaaaatatcacacgaactttatttttcctctcagctgcgtgattttgggtaacccaaaacttggaaaaaaggttaggtttcggttggcacacacccctcctataggctagggattgttggagtgagcaaggtttaatgaggaaaacgagatactcaagccttttaatccatgaaaatgtataatcttattaggtgtaatctaataaaatcattacattaaaatgaatttttggacaaaatttgcgattttaagctttttgtttttactaaaatattaattggggtttttacatgagtaatcaatatcttaatatcgtcccgatctttttcaatgccttaagcttggagattttaaaaggtctaagttgggaagtgttttcaattatctagacatattcaaaagctgtataccatcttatgtcacaaaaaaagcattttcaagggaagaaaaataatattataatttaaacattcaaaaatgtagaacggttaaaatatatacggccatggagaagtggcagacgcagaccaattgagcgaacctgaacaggaggaggaacatcaacaacaacaacaaagtatgggcaagtgaaaggaattcttggcctttctattcataaaagtgccaacaaatgaggaagggtcctggggatttgcataaaaaaaattcaaaaaaaaaatcgaaccatgattaactattaaaggaaattcacgggaaatttttgatcagaaacagagggcgagcgtcgcctggtaagattttatgacgtaaatggacaactcttgtataaaaaaaataataataatacctttacaatatatatatatttttgttttttacatggcttgccaattcctcaattaaggcctgaccgacaggttttctcatgccccatttgaatcacatttgttttagaattttaattcgccacttttcagatgatcaggttcaacagcagcgcgttcacttggacgacgagggacaaaatggcacattggaattggacgccgaccaatttgcgcattcttcgtcgaccaacactgacacggacagtgatgaaattgtcaatgtggcacgcaaaaagccgacagtgttcgaatacttttgtatggaagtgtcaaggtacgtgtgccattcaggtctgtaaccagaaaaatcggatttcatggcgggtcagaccccacgaatttttttgctgattttttttttttttgcctatttgtcaaccgattttggatcaaattaaacatcttggggaaattatattttgaaatcttggagccgaattttaagaaactcgctggtatcgttcaaagtttgccagtttttctcttaaaaactttttcaaattcgggcgctggaacatccacccaaatttttctaactaaaaaaaaaaatttcatttcggttacgggcctggtcccattctcatttttttgtaataaattccaatctttggcttatccccccatttttaaggcgctactcacttcagaatgagaaggaacaatatgcggagaagcggcgcaaagtctatgcatttcttcgaattccagtggaactggaaaagttcatttattacgggttccgtcagtgtttggacgccttttgccacacatttaccattctgccaatacgcgtattggtgagttattgggtcagggccaatttttcaaacactggaacattatccctgaaaccaggtaggtacctaaccgaaaaaaaagcatttcgtcgagaaatcccgaaaattttgtgctttcggcacctaaaattttttccatggttaattttttaaattatagggctctattaacgaaaaatagcgtttgtataagaaataactaattgtgcattttttgtcaaattttgaaattttcaagtgcatttattggccggcagtgccaatgggtaccgccttgattttttttttttttttttgcaacttttactcaatttgttgagaaatcttaaacaaatattcaaaaaaatttctgacctttatttaacttttttatgcggtgttctcatattagaatcaaaattccgttggatagatttctccccgaatttttaaatttcttggcaggcaacctgcctccgaagccttcagcagaatgggtactttttcaatacaaaatttctgattttttaaatattttttttggatgaatccctctgcagaatatatagctaatgtgttaattaattgccactgttttttcagttcaatttgtttgcttgctcagttcgattgaagcggtggtcggccgccgacacctgtgacattctcaaactaatcatcattttttgcgcttcttggttcatgcaatttgttgacacttccgtggtctatcacattgtccgtggtcagggcatcatcaaattgtacattttttacaacatggtgcgttaatgttttatcaaggaatggacggaaaaaattttattaaaaatccaaaaagagggggaaaaaaattttttttttgtcaaaagtcgtgacaatttgttcctggcttttttgagaccgctcgctgattatgagtttgaccattccttctggtaaattccgatacttaactcgaacaaaagatcgaaaaattcaaatttctcgaactatccgaattttgtttctcgaattcggttagacatttttcagaatttgttaaatgttaaatttgcgacccagaaaaactctggaggacgattttttaggactaaccaaaaaaaatttacaagccaaaagctccccccaatcctttcgaaaaatattacctttttcactatttaaatttagcttgaagttgccgacaaattgttcagcagttttggacaggtgcgtgcgtgttaaccgctgtttgcttataatataacgaaaatttttttcaaaatttaagagaaaaaaaattttgtgttttttaatttgtttaattctccgtaggatattttcgacgcgctcctttgaactgcctccgaacggggcacaaataaaaaaaagttcatttcaaccgttttccatctgaccgttgccatcatttacgtagtctgtcacacgctggtcattctgctttttgcttttttggcattgaatgtaattattgaaaatagttttttagaacctatgaccacgtgactgtgaagccgggaccgcacattaatgttgtaattggcccgaacggaacaggtcggaagaggaaaagcccccgacttttcctacattttcacttggatttagagacttaggaattttactgaatttagtataaattctccgcaattctttgcttcttcattgcccattcattcaggcaaaagttcaatcatttgcggcatttgtttggccgtcggcggctccccgaaattgttgggccgttcggatttgatcggcgattttgtaaagcacggcaaatgcgagggaagcgtcgacctttttctgtatgtgttaaattcattattacttttactatctgacagacggtcgaattagatttatttattttagctttttcttttgggaaattccatgtaatttggtttaaatttatctttatctgttgtttttcattctgtaattgtgtttagtgcatcttccgttggtttccaataagtgagcattttcagttgggacagtcgacgaagacgcgaacgctgtttcagcgtgcacataaaattgccaaactcggcctccttttttgtggacaatcagtcgatgaagctgacccaattgcgcgagctggtcaaggagtacaacatcccagtgacttcgttttttttgagtggtccaatttttagaatatcaaaacgacaaaaaaagtcgggcttgggtaaaagtgcgactaaaaa

SEQ ID NO: 3800 - DNA, 657 bp, Heterodera glycines
aaacagtaaaaactaccatttaaaataaatttttacatttttttactttttttgatgggggtgtgtttaccgaataataaaatggagacaaaattttcccatcccttataaaaatcttttattagttagtgaagcaggaagaaagagttaatgttcctcttccttgttccagggctgaacattcaaaagaacgagcagcacgagctgttggagaccaagctgaacaacgtcgttcgactgacgggaaatgcgggcattttgagcgcatggaattcgtattggaagaacaaggacaagttccaggggccggtgtacgtgccatacttgcacagtaagtaatacgtttttttggctttaaatatggctgatttttggtattatgtttttttattttaagtgcgtgttcccaagcagtccaacttggtgttcctgaacaatttgattggcacccgagacatgggcattttcgtgttctcctgcaaagaggacgagcaactgctgatgcaggggaacaacccccaccgaattcactcgacaatcattgaccaaaaatatgtgcgttggtactttttttctatttataaaaatttccatgttgggaatttttttttttaattttcgaggggaaacaatacggtgaaaacgaacagttccatc

SEQ ID NO: 3801 - DNA, 5107 bp, Heterodera glycines
tctagagtcaatggctcgaaattacagaataggctgtatttagcattgtcattttcaatgatgttactacaatgaaaagccaaagaaatgtatttattggattttctaattttgatttttaaggacactaattaattatcccaaaaagcctcaaattttgcatttgaacaaatttgacaaaagacaaaactttccgtgtgttcctgtgctgctaaagatcgggattcttagattgttcataaaaaccaaaccaattgaatgtgcgaattgcgaatttgccgacgaccagcagaaagtgccgttcatgccgtaaattaaatgattttagtcaattaaaaatagcgatttacttaattttgaattttcttttttgtttgatcaggacacacaaaaattatatttaacgaaaacaaaaataacaaataaatgcgagtgtttgtcgtctttgaattttaatggaatgttatgagtgtttatacttttcttttcatttcgattttatgtttttaactcatccgaacaattacacgaaattgtcaaattattcgttttaaatattttctaaataaatatatttttaatttttttttaatttcaattaaaattatacaacaaaagcataaaaattggaattactacaacacatgattataattcgagaacaaagaatgtcaattgataaagtcaacacggaaggagcggacggcggcggagagagcgaacgaatggcggggaaaatggaaaattaaatgggcaaattaacaattaattatgagggtaattagtaaaacaaatgaatgacattgaagcattttggccagagcaattcctgctgataaatggaacagataagaaaaagcataaggcaaatgatcagttctaaattctttgaaaattaaatgtaaatatttccaaaatattttttcaattaaaaaatgcgccaaattattaatttttatttatttgttctgttcttcgcacctaattttgctgaaaaacttcggtatgtacagattatttggcgccacggggacagagcgccgctggaaaagccttaccccggcgatttgaatggtcaacgaaaaataaattttaaaaataaataattaattaattaattttcagatgaaagcaaatgggccaaaggatggggccaactgacaattgttttgtttaaatttcgaaattcaaacagtgcaatcaaattcaggatggaatgcgacaaatggaggagcttggccaattcctccgggagcgttatgccgctgcaaatttttgccccaacattttgacagaaaagaggtaagaaagcattgattgattattgattgattggggatagcaatttgtaaatatttatctccgaaatcaaaaagtgcggtcaatttttaactggaatttaatcagaccgctatattagaaattgaattaaattgtaaggccaaattgggaggtgactgatcagttcgtcactgcttgttacgtcactgagaaatattttaaaaacattggtttaatatataaaaaaaaattgtttctgttttttaattgttttagttttcacgcaatttccagataagtcctcgattaatttttttttaaaaatgggctaattagctttgagacagagaaaaagaaacttccgcgagaggaagtaatggaccaattaaggagacaattgaacgccaaattgggaaggttgacaatagaagttgtttgaataaaatgtgctaattaccgaaaaatcaatttggggaaggacgaaccattatgagaataggtaattattttattcgtttctaagataatcattcgttccaccgacgtcgaccgggcgctggaaagtgcgcaatcgctgctaagcggaatgttcccgccacagtccgacggggaccgattcgacccggcgctgaactgggcgccaattgcgatacacgccactcgggaagcgaaccacgactcggtgagacagacagagttcgaaaatgagacggacatcaataaattaaaattcatttaaatattgtttaatcaaaaaaaaatgaaattttggcgatcaatttttgggaaaattttcaattcttcggggagtattttcttcctatgggtgtatttccccgattttattgcattgtaatggaatttttcggaaaaacgccaaaaaaggcaaaaaaaaggcttatcttttaaaagcttttgttttatatttttcagttgttaaatccgtccggttttccgtgcgcccgttataagcatcttcgccaaattgttgccgatgagattagtgcacatttgttggacaaatatcgcccgttggtggactttgttcgtccccacctgaacatctcgaaggaaaaaccaatcaaaatggtccaattaatggcactccgtcacataaagcccgaagtaaaagcgtaggaacttggcaaaatgctattccgtcacctgtgaaattaatggacagattattgaccgacaaaaacataaaataaaataaaaagccaattcatacaaaaaataatttaatataaatattttttttaacttataattagggaaatatttttaggtgctaaaactgccaaaatagttaggttttaagttctaaccccccccccccaaaaaaaatggtgctaaaaatgggaaaataggtgccaaaaagtttcaaatttaggggtgtaaactacaaaatgtattcaaaaaattttaaaattatgtatttttgaaaaattttgggtcaattgttaggggtgtttcgtttttattaccttttttgttaataaatttggacaaaaagctttcgtgcattttataccatagggagcacaggaaaaaaaataagtaaaaacctaaaaatattagccctacttataattctttaagataattcacaatttgcctcaacccaaatgggtacacaaaaaatgggaagaatttggcaacaaaacgaccatcgaattaattatggaaatacgacaaaaaagttggcttccctatttcaatggaaacgaagaaattacgcgtttaaatggcggtaaaataatacaaaaagcaaaaaaaaatgttaaataattattaattgaaaaataaaattaattaaaaagctaaaatatatttttattttattatttaaactttcaggagttttgttgaacgatttattgcgtcggtttaacattgtttcacagggaaacgcgaagaagcttgacgcgagcaaaatggtgctttattcttcggtaaatttttaaaatacaatttttcccatttttaataataattaaaataatattttactgttctttcccactttttaaataattaaaataatattttgctattttccccattttttaataataattaaaataatattttgctatttttttcaatttaagcacgactcgactctgctcggccttttgtccgtccttaacgtaaaagtgccgagcaatgcactcgatttgcctccgtattccgcttgtgccatgatcgaattgtacgagaaacgcaaaacccagaggcaacaaaaacttttttgtcaaagtaaaacgggaagaaaaataattttaattaatttatttttaatttagttattttatcgacgaaatcaaattttggagccaatggcaatcgccggatgtgaagcgaaatgcgatttgatcaattttcttcaaattcttgagcctcggtcaatccgagggggcgaagaggaattgaaaattgtaattaaattagcaccttaattaagttaattataatgtgtaaaattacagttatgcgatgaaaaagtgccgaattcggccgcccggcgcatgggaaacattcccggttttgcaaaaagtttaattattgccatatttataagcattgcagccataaatcacggaacacaaagcacagtaataaatgtacggtaaaaaagttttaaaaattctgcattttctatttgttaaaaaacttcaattgaaaaataataaattctgtgtgctatctatgtagtgaaaaaaagattttctggaggtgtttagcggcacattcaagccttgaagtaattaatttcttcaaattatttcaaaaatccaaaaattttcctttttataaaaaaaaacttgtatcaacggttttaaaaagcgactgtgtttttttttgcgccttctgtcggtaccgccggcccaaatccgttaaaaaaaaatttttttttttcaattttgtccaaaaaccaacctttctttatacaaatcagttaacaacagaattaaattttcaaaaattttcccgggcggtgcctaactgtaaagcgggccatcctccacaaaacaaatttgcaaatgacgaataaaaattgaaaaattgttatcagataagaccaaaatttagtgtttttagaattttaaatttaaagtaaactaatttcgtgctgagtcgatcctaaaaaagtatcaatgataatgaataattttggtgttatctaaagaatatgaaacttaagggatgttctttaataataaatatgcagtcatgcaacatatttcaacgaaaaaattactgtaaaattaattaaaaaataaaatatttatataaattttaaaatatttttattaacaattattaaatttaattattcattatcattgatacttttttaggatcgacctagcaccactaattttttcggtttacaataaaagtaattgtgaaagtgaattaattttgaagatttttgagcttaaaatttgagatgaacccttaaagaaatgaatatttttttagtaaaaaatgttcagtatttttgtgttttatttacattccgcaacagcccttgtacaaattttgtaaaatctttccgttaatgaaaatccggttcaattgttcaaaacccaacccggaccccaaatcgcgtcaaatgacgagtttccaaaaaatgcatattattaaatgaatatttacactcgttattgcacacataatacatacatattattatttacatagcatatagacatataatatagggctcggtggtctaattgtatttgctttgggttgtacaaatcatcttcgtcaagctcatctgcatacgatttcggtcggccatcttctgctgctg

SEQ ID NO: 3802 - DNA, 7119 bp, Heterodera glycines
  misc_feature (6858)..(6858): n is a, c, g, or t
ggtaggcatgggcgggaatgccaatgccaacgagcactacaattcatcagtcttgattgactactacccaattaaaagtgctaaagtttcccgtaattgtctaactccaaaagattttagattttacagaaaaatccaagcaagtttaaaattttacagaattgtgaacgcaattccccccccccccgaaaatttaaagaattcttaaaatgtaaaaaaacaatttttcctatttcattttgatttttcaaaattaccaaaataaaatgggtggaattgtgtttcattcgtcctttttgaacttttccttataaccaaccaatcgtactttatatttgaacatcaaattgatggcactcaattatttttaggccaaaaacctgtaccaactttgtgcaaaatgggagcagctcgttccccccccccccccgccgtttcccccccgagaaattttcagcgattttttggaaaattttttaaaaaactttgtaattcaccataaaaatttctcaaaaaaatttttttcttagaattttcttaagaaaaaactttcctagattttgcttgaaaaatttctaagtcagtaaaaattcttttttaaattttcacggggggaaacgatgcgaggggaaacgaactgctcacgcaaaacaaaaactcacaattccagtgcggacgccctttttcggatgcggaaggcccatcggcgatggctgtggcttaaacagaggaaatgacaggcaaattggggaagaatgggcaaaaaatgattggttcactttgaatggttcaattttctgcggtttcgaaagcattgaaggaggcacaatcttaaacaattaagggaaaattgagaaaagaaaggaaaaaatgcaaaagccgaaaactcactttggtcacagtgtttttcttttccatggaggggaagcgagaaagaggagggacagcctaaacggaagagaaaaagaaagagacagcaaaagggggaagtgtctcactttgagtggctcctttttcgtgaacggtgacggaaaacgaggcgaaagagtcttaagaaatgaattcataaaacaagaaaaaatgatgatgaacgaacggtaaaaacccaactcgtactgtctttcgaccaaaaagtcgtcataactttttgttaagtcgacccaatttaacatagttggtatcattcaatagtccttaaactgctctatctatatgccaagcttcaaaaaatttgatcaatttagctaatgataccaagaatgtttaatttggtcgactttatggtcttaacaaacgaattcataaaataagaaaaaatgattatgacgatttttttgtcgaaaactaagagtttggtgtcttcctgaacgaactcactttggctttgatgaatggtttcttatccgaaggcggaggacgacgcggcggaataacgaccttttaaaaacgaattttgaatgggaaaaagaaatcccaggcaacaaaacaaataaataggcaattaggtaaactcactttgcctttatgtgttttcttggccggtggtggcggaggacgagagacagccttaaagaaaagttgtggattcgaaaaacaacaaaaacatcagtgaaactcgctttggtttttgcatccgtttttttgcccgacgacggcggcggaggacgagaaacagccttaattaacggaagcgaaagcaaatatgaagacaagacgaagaaacggaggacaaaaagacgaaacaacgaactttccatttgcctgtttttgcacaatcaattggatccgctgaatacggagaagttggaacatcctgaacacattgacaacaagaattgattgaaaaaaagaaaagcgcaaaacaaaaagcaaaatcaaaaactcactattcccgcgctaacgccctttttcggatgcggaaggcccaccggcgtggtcttaaagtgggggcaaataaataaatgcaaattatggaaaagcgctgtgctcactgcggttgatttgagtggtttggtcgggcccggaggacgcgaaggacggacgacagccttaaaaacagaaaaaagatgaatgccgaagacacaataacaacaacaataacattcactttgcctaggtcggcttttttgttcggcgcgctcggagcagcagaagttggagcagtacgaggaacaagcgaaggcggaacagccgaagaagggcccgagggagcgattggagtgggagaaacgacgacacccgcggcagagggatggacgggcttaagcgaaaaaagggaatgaaaaagcgcaaaaagaaatcggcggcgtggacaaaacccacttttttgtcgtaagcaggcgaatttggccgctttttcttctcctttcgaccgaaacacatttatcagtacaggcaaagaaaatattataaattataatgctttgagcaaaaaattataaatttagaaattattttagcaaaaaagaggaaaaattagcaaaaaacgaaattacggaaaaggattatcagagaggaaaatgacgcaaatgaaatgatgaaatggagagcaaaataattcatttatatacattcagggatgggccgaattgaaaaataaaaagcgaaatgcgaaaaagcaaaactgaaaaatgcgaaatgaaaaaaaaagttttgaaatgcgaaacggcaaaatgtgcgatataaatttgactatttttttcttcaaaaccacttttttgcggtgcaagaaaccggaaatttttcaaaaaatatacaatataataaaaaataaatattttaataggctaaatttttaattcttaaccaagtaaaaggtatttcacaaatgtttttagtatattcgcttgaaaaaattattcaattattttatcaaaatcttttttttctgatttttcattattttagaaaatttttgggaaaaggagtgactatttacacgttttttacagcgcgattatttcagaaactttttaggaacttagaggagggtacagcggtgccgataggcgccgccgggaaatttttaaaaatttcagttcaatttattaacagaaattgtgcaaaacttactagttttttgaaaaaaaaaattaaaaaaatttccgacttttcatcaaaaatttcggaagtcggaattccgaccccaaaaatgtcggaaatcggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgcgttaactttaattaaattcagggctgccaagtgtcctttttttaaagattgtcctttattttaggcttccccaaactttttaaattttttgtgcttaatgatttatttcgctgatattttatttatttattttcgttttaatactattttctcttcctctctttccctctcaccataactttttgttttttttgtgcacacaacctattgtcagacgcataactatttcccatttttagcttttttacatttcccaaatgccccaccaaaaatgcaaaaattttattgtgaaaattatgcaaaagaattccggcacataaagaaaagtcgaagaatttgccctttgtatcgtctgcaacgatgatattaatctcctttccattggaaaagctgccatttctcagcatcaaaatactggaaaacaccagaaagcggcaaaagcagcaaaccgatcaattccattgcaagaatttttgccaaatacttcggccccatcgactgaagatcggaaaattcttgctgcggagggtaagacattcaaaatcaacaaaaaaattcctctctcacaaggagcctgggcttatcacaccgcgcagcactcccattctttcaattccgttgattgtgtgtcttcttctggactgttccgaacaatttttccggattcggcaattgcaaaaaaattcagttgtgctcgtataaaaacagcaaaaattttgacaggtagaagaattaataggacggtaaattgactttttacaggggttctggcaccatattctgtgaaaagtttgctcgcccgactgggaagtcaaccgttttctttgtccatcgacgcttcgaattttggacatgaaaaactctttccattggtccttcgtttttttacaaaacccaacggaattgaaataagattgcttgaccttgaagcattgcccggcgagtcatcaatcgagtaataattcaaacataaacttcttaaaatgatttaaatcagggttcatcaatggattaccaaaatcgtcgaaaagcacaatttggacttctccaatttaacggctttctccgccgacaacacaaaaagcaattttggtggggaagagagaagaggagaaaacaatgtcttttttcgacttcgtcaacaacaagaacgattgatcggtgtagggtgtgtctgccatgtattgcacaatgcagcaaaaagagccactgacaatttgagaatagctggcaatgctctggacattgaagcagtggtttttaaattggctggccatttcaaaaactcaactttgcgaactgaggaattaaaagggttttgtgacgaattggaggtgcaatcccgaaattgagtttaacttttaacatgcaaaaacatttaaatgacgcgttggacttggccagacagattgccccggacctgacaaataatctctttgacgatgttagcgaagccaatcaaattctcaattcaatcccaaaggacgaattgcagaagctcaacactgaacaaaagtggatgaagctatttgaagccgatttaccgcacttgtacaagttggtcagcattgtactttccgtgccggtctcaaatgcatttgtcgagagagtgttttcgctttgcggctcacaatggactgatgttcgaaattcgttgaaagtcgaaaccgtgaaggctctggtccagacgaaaataaattttgatctcacttgcccagaaatgtatcagatgctcatttccaatcacaaactgttggatcagatcggtggatgggacaaatactttgaatgactcttttttgaaaaaaacaatattaatttcaataataaaaccggagtaattgtgcaaatttgttgtattttgcttttataaaagccaataatgctttttaactgtttttacaaggtaacaatcaattttttcaaaaaatcttttttttggggtccaaatctttgttttagcctcgtttgtcctttttttgaaaaaaaaaacttggcagccctgtttaaaccctcaaaaatttcaaaaaatgtgtatgtattcattttgcttaaataaacctaaaaaacaataaacaaccaaaaaattgatttaaaacataaaaatgcaaatttatttattgtcgtccatcgtataaaaaaatttccaagtttgccaaaattttgaaaaaaaatttcatttaaaaaaaagaaaataaaaatgccaaaatgacgacgaaaactcaaatttttcggattttttgggctgtaatttttaaaaatttccaaaaagtctatctttaggggtgtattttttcgcttttcttgcatttttcttgtgaaaatttgccaaaaatggccgaaatatggactaaaaagacaaaaatggcgaaatatgtatttattcccgaaaacccccaaaatatggatttatatggactaaaaaccttcaccaaatcaaaaaattttaacgtagaaatgctatttttgagcccctttcttcatagcatatgagcagaaaaaatatgttaatccatataatttacaaccctactaataactcgaaaagtatttaaatgttcgactgcgcgggaatccgatgggaccccatcccacacaaaaaattttgagttcctttcacgcattgaattcgcaaaacgaacttcaacaactcgcataggtaaggtatgcaccaatttatgcactgccaaattaacacgaaaattccctatttaactcggcaaattgtacacttcgcctcattccttcgatcattcattcctttcgtttttctctttttcccttcaattcttaaatcgccttcctttgccatgcttttccaatttcattactgggtgaaaaggttaaatagcttcttttttcacaaaaatgtaaaaaattccaaaattttcgaactttataagaatttctcaaaaatctggaaattaggctcgaactttcgctcccagtttgcgccagaaagcggctttttcattccaaaaaagatgcatcggcgctggggcggctacataaacccggcgccaagaaactgctttttctttttttgttaggtcggcttaaattgtaaaaaaaccagcttttacatacatatttgcatattccaaatgttctttttttcctccttacatattttagagccatgaaaatactcatcagaggcggacttttcttcattatggtgcgcgtttcaacaattattttctcgcattaatttcaaacgaattagtgcacaaatgtttttttggtccatggctttccgaatacctaattcttatatttgaattttttaatttggctaaaattttctcaaatgaagctgtgctacaatttttaacatctttgcgccataggaactcgcgcaaataagagtcgatgatttttaaaaaattcaggcccaaaacggaaaagtaccaatattttctgttttgttatttcaaaaacaaaaaaatatcttttttgggttttggtttacccnttccccccccccccccacagattgctttcaccgtcgcttcgttgcttgtcattggctttttgctttccctgtggttgggcggcttcgccattcgtgtggttgccgttgtgatcgaagattctgaggaaggataccacggtgggtggactcaatgttttgcaattgtttaataatgctaaatgaaattggaccattcgtactgcggctatttgtacttgtccagtactaagtttatccacccgatacttttatgtactttaa

SEQ ID NO: 3803 - DNA, 5591 bp, Heterodera glycines
gcacacgacggggaagaaaatgcaaaaacccggaacatcagtttaccacaggtgcaataatttaattttcttatcaacaaggcgaaattttaaatgctaaaaaatatggcgaaaacctcaaaaattaacaataaattcgaaaaaaaaaatttttaatataaatttttagcgccaaaaatctgtgccaattgtgtgaaggacgaactgacgttggtgcagggtgatcgagacaaagtgccggatccaatcttggatgacacgcaaattggaccagacggatgcgcatttactaaagtgacatgcgaaaccaggaagaccgaaggcgccaaaatgaatatttgtgtaagcaatgttaaaattttaaaaatttttataataaaatttaaaaagcaaaaaaaaaactccgaattcgaaaaaaacaatttttttttcgaattttaaataaaataataaaaacattggtgatttaggataaatagtcgaacaaacgccttttttatttattttgaaaataaaattattaaaatggcaacttttgtcgcttcccaaaaaggcagtacataacttgagtttgaaggacatttttcttggccccacccaaacattttacttttaattgtctaattaaaatttaatgaatttaagatcagaaacgagtccaaggaatgctgcattgaatccaataaaggaccgttcaatcacagtgacgctttgctaaattgttctgggactgctaatgagccgaactgggtgctgaacggcgcaacttgcaatgtgatcgatgtggcagaggtcgtttaatttaatttatagtattttttaattatttcaaaatttaatttaatttattcattttaaatcactccttttaaattgatttgtgtttacttgaaaactctctaattttgcaattgttggaaaaaaaattttgaaatttcaaaatatttataattcaccaaacttgccatgtcgtccaaattcatgagcaatttgatttatttattttgtttttttttaaatttagatccaatgtaaagtcaacaaaatcaatgtcgaggatcaagcaaaagcgtcgaacaatgcaaatggtaatcaagcccaaaaatttttaaataaactatattgaaaataacatttagtcaaaaaacgattggacgccatgcaaatccaaactcctaaaaaggcacgctcatcgtctgcgcagggcatcgaaccatccttgggtaagaaatgattttgcatggaaaaccgacggggcactcgggacttgttatcaataatccattggcaacaattacttatcttattttagataaaaagcaatcttcaccagttcggcaaattgatccgaatggcgaaatatcggctgtaaagaatgccgcttctgctgaccaaattcccgacaaatctgctgaccaaattcccgacaaatctgctgatcaaatacccgacaaatctgctgataaaatacccgacaaatctgctgatcaaattcccgacaaagcctccgctgccagaaatgccgcttctgctgatcaaattcccgacaaagcctccgctgccagaaatgccgcttctgctgatcaaattcccgacaaagcctccgctgccagaaatgcctcttctgctgaccaaatacccgacaaatctgctgaccaaattcccgacaaatctgctgatcaaatacccgacaaatctgctgatcaaatacccgacaaatctgctgatcaaattcccgacaaagcctccgctgccagaaatgccgcttctgctgatcaaattcccgacaaagcctccgctgccagaaatgccgcttctgctgatcaaattcccgacaaagcctccgctgccagaaatgccgcttctgctgatcaaattcccgacaaagcctccgctgccagaaatgccgcttctgctgatcaaattcatgacaaagcatccgctgccaagaatgccgcttctgctgatcaaattcccaacaaagcctccgctgccagaaatgccgcttctgctgatcaaaccgacaaagcctccgctgccagaaatgccgcttctgctgatcaaattcctgacaaagcctccgctgccagaaatgccgcttctgctgataaaattcccgacaaagcctccgctgccagaaatgccgcttctgctgatcaaattcctgacaaagcctccgctgccagaaatgccgcttctgctgatcaaattcctgacaaagcctccgctgccagaaatgccgcttctgttgatcaaattcccgacaatgacaaagcaccaggtgtcaagaatgtcatgtccaattccgtgttcgctgatgagcccaacaaaactttgtctgtccaagccgctacagatgaaaaaaatgctgccggaggaaacaaatcgaaatcggctgaaaacaatgcattgtcatctgctgccaatgatgaatcattagcttcagatgaagcggataatgccgtgccgaattcttctgatgaaaagtctgtgccaaaagctggcgacaacaccaaaaaatcagcttcaccaaacggtaattcttctgtgccaactttagttcaaaattgggcggtaaatctaatgggcgggttttcgatcaatgatgccaaaaattcgttattttaaatgcgaaaaaacttttaggcaaatccgccccagttgttcgaaacaattctggcaataatttggcttctccgccaaacggaacggcaacagcctctaagaatttgttggcataaacacagatgcattttgatgaaatgatttgataataatgattttattccattaaaaagaaattgcagataaaaagcaaaattatgtaaaacttaacttttaattttggttataaattttctaatttattttaattaattgtttcttagcttaaaatataatagctacacaaactgttgaattttttgaaattaataaaattgaaaattaaaattcagtttttagtcccatttattaaaaatcctaaattttgagtgttttcactttttaaaccttttctttttgtcaatatttttactaccgttttcatatatttcattatttaaatttaataaaattaatttgtgtgagaatcattacatgaactgattcctatattggaattttgttcaataatttccacattttttacttggacaattcattaaatataatgaatgatcagaaagctttgcatcattgcctctgatcgcaataatgtgttgttgaactgctgatcaacaacacattgccaattggccatctgttgttgttgttggaccaattggccatctgttgttgttgttggacaacgaactgcttgctctgctaatgaatgggaaaacagcaactgttccccccggatccatcaaataaacaaataatgaaaaaaaaagtccccaattttttgatcagagattgtcccaatacacacatttaatgatggatgcttttccattgtgtaagcaaaaattaaatgtacatttttcctttttttcgttaatcctttttttcgaaaattttaggaatttaatttcatttgaattctttaatattcaataatatgttactgaatttcccaattctttaaaaatattctgttgacttttaagaaggcatacaaccagagttcaacgaatcaaagaattaaatgtgtttattccaaatttattacgttaattgggaaggaaatttttgtttgaccataattttgattaatttcaattattttcttcgtttttcaaaaattaatttgttttcgcctgccaatttcttgttttctttattttgacacagtttttctttactatatttggttttacatttttgctcagaaaatctgtaattaataaaatattttcccctttttatttaaaaatatttatttatttttaaattattttccaataaaatttatcaaatttataaaactaattttagtattttttattttaaaaaaatattttcaataataaaattcatcaaattatttttacggtttttatttcaaaaagcatttcctatataaaaaatttagttgatttgttaaatttatttttactatttttatttcacaaaccattttcccaccataaaatccattaacatatatgtatataaaacgttttttttccttttgcacagtaaattatgtacacattttgtggaaagattttttccctagataataggcaatttaatcgtcgtgtcgtcctccaatcccaatatatcccttcccattcattcattctttcatctcatttatgtggtggtgctgctgttcatctgtgttagttagtccgtccgtccgttctgcttgccacaccaaaaaaactttttgccatccatcccatcattatcatattcgttttgcctttgcctttgccctccgcccctcccccaaatgacagaatgccaatatgtattttttttgattttttcccccaacattatgccaatgcaaatgaatgggatgggatgaaatgagaggggggcagagagaggaagaaggacggtttacccaacacaaatgtacacaaaacattgtggttgggtgttggattgtgtgtttgttgtgtataaaattggattctcaattccccattttgctcatttacgccgcggtacacattgaaaaaaattttttgagtgaattctgctggtaaatttttttttgaataccacctaaatttgaaagatttaatggatgtctcaattcgtgctcctctccattagggaaagtttttttaaatggctaaaaaggctcataaatcgggaattgatcaaacttcaattaacctctcctttgttaatccgttttgattttccataatttaaaaaaaattgcacttatttaattgatttcagaaaaactttccacgccttatcatcccctaaacactttgtaaaaatgcgttttacttcaatcccgttgattttttgccttattgcactggtttgcgtcattgcatcagttcctgaactcccgcaaaaattcctcaaatcctggtcggttgatcattccgaaaatttcgacgaatacctggaggtgcattttttgatccacttttttttgaattccaacttcaaatttgttttattttaggccaaagggtacggctggttcatgcgccaagtggtcaagcttggtaattttaatttttctatcattttcaattttttaatttaattatttattttgtttttcaacttttagccggcatcaccaaaacattttcgaagaatgagaacggcacatatgcatgcaaaattgaaaccaccaaaaagaatgtggagtggcccagcttcaaattgggcgaggagttccaagccgagtatttggacgactcagtgcctaaggtgggggcaaacaatttcattttattttaaataataataattattattattatttatatttataagcaaattggcttcactttattcacgaaaagatttaaaatgaagcttctaaaaagcacagagttctcaatatttttgccaaaaagaactccattttgaagggttttttggtcctccggtactgagatgtctaattgtttacacagaatccaatataccaatataaaata

SEQ ID NO: 3804 - DNA, 3495 bp, Heterodera glycines
agaaaaaaagttaggaatatttttttaaattaaaatttcttttaaaataatggtaaaaaaaatatgaagaatattctatcccattgggaacttgaacccaagcgagaaataataaaatcagaaggtttagccacttgaccacttatccatatgaacaaatgctttaaatgaaaataaataatttaattttttttctcaaaaaatttctccttcttcatcattccctactcttttctcacccagacccccattcttaccagtgcaaatttttaccggcggtaccggtactagacaaaccggtaccgatactttgatttttgaaaaaaccggtaccggtaccggtaccaaaaaaaccggtaattaccggtcggtaccgctcaaccctactaaaattgaccaaatgtcgcactttttgactcaatttctcgttgcatatatttgtcagggacatgaaaatttttaattttttctaagatttgttaactaacggcgcgggattttgcgggatcccactccgaatcaccaattctttgtaatatgtgtaatctgcgagattgcggaattctgacggagattattgatatttttgaaaaattttgtggactgaatgccaaatatttttgaattaattaaataataaatttaattaaaattaactcattttcatcgcaaatttcattcaaaatttgtgaaattttcccggcggcgcctttcggcaccgccggatcggcttttacttaataatcctgtagaaattgagtcaaaaagtgcgacatttggtcaattttagacaaaatctatccgcaaatttgaaatttccggtctctagtaataattaaataattaaaatgacccactgccaattattttttttaattatccaactttcattttttgaaattctcagatcaccttcgactacaacccaacaaccgacgagctgatcgaaacgcacaaaaaggtggactcggaggagaagccggacatctacaaatacaacatcgactcggacggctttctggtgatggtgaggaaagagaagaagcaattttaataattaattattgtaattaaaattaatttggattttaaatcatattttatttattattttagcaaatggaatataacggagtgaaaacgaagcgcttctataagaagaatgaatgagcggagggtgaatgctttgtgggggtcaagaacgatgtgcagatggagaagaagcgacggatgattttgatttttgcctgattaattgccgatgttcattaattaattaaatccaataacacaaatttttgcccacattcataaaagcaatcagttaacacggataaagtgtttaaatgatagcaacttttaaattgcaagcaaataatgaaaagccaaaatgaaaaatggtcagtttttttaaattagttaatctgcgaaaaaataatttattttaccccattaaattatttattccaaaaattaaaattagaatattaattagaaaatgttaaaagatgaaaaatttggtatttctgctaagctccatcgactaaataaaacatttcaatcttcggatttgtcaaatcacggtccttttttgcgcgttgcttggccttccgtgtgatcagaaatgttggaacatcagtggaatttcttggcacgaaattactgattttatgtccattcaaatacatgcggcttaaaagggaataaagaaaggattatttaaatgaaaattgaaatttctagaaatagtaatgtttaaaaaataaatattttgaaaataattgtaaatcacatttgtcatttattagggtaattaaaaaatatttaaataaaaattttttttggctcacgtttgttggccattttcagttctgttgtcggcacttttgccagactttggcgttctgttccttcttcttaagcagcacatatgagcggagcatggcatatagccgggcggacaaatgcaaccaccaggagctgaaaatcaaaaacaataaatttaattaaatatttaaatgctataattaaatcttaatgagatgggtaattagttacttaattagagaattaattataaaattttctaccaattggcggaggtggaaatggtggtggctgaaattgaactggaaatggcggcggtggaggtggcggcagcagtggtggaggaggaatgcctatgaattttttttttccattaaaccagaaataaataattgctttatcccgcacttagagcaattatgaataaagatgccaaaaaaaatgccaagaattatgcataattttttttcgaaaaaaattaattaaattttttctttatatcacttagaatttgttttcttttttaaccataatatatttatttgtttgtgttttgatcatttaaattcataaaaataccgcccgcgacgggaaggctaaaacaaaatgtgacagccggcggaacctaaatttaaatttaaattatatatttttaataattattatttacagcgggcaacggtggcggtaccatggggaggggctgtgccaaaacaattggaggcgaaggcggtattggcggaggcactgcaggtggaattggaacgatctatttaaaaaagaatgtaaaataagttagcgaaaatggtataaaccgaaatagcgaatccgggctctaaaaacgggtgccattcgaaaaagggtttgccaacttttttagccttttaaaaaaaatattttaaaattcctgaaatttaattttcggacaccttctataggttactgcaaaaatactttaaattagtgaataacaatttttatttttatttttgaccatttgaggtgccgcgccagggaccggcaatggttgcagaatggctggtggcaggtcgggcgcgcaggccgtcatgcagaaggtgttcagcggcacggggaggggcggcgacagcgcaacggctggcgccaatggcgggggcggagggggaggcggaaatggcaccggcggcatcaccagctggaaataagatttttccactttatgcgttaaattaacgccaattgaccggctggcacatcggagggcagaatggcattggggcatccggaagaggcaaaaattgtggcttaatgtttgtttaaaattaaaaaatatataaatttttaaaaaatttgaaacattttgaaaaaataaaattactgctggagctgaaaacattatcggatttggtggtggtggcattggcaaactcatcacaaactaatatttgaaaaaaaaatgctaaatgtttttatgaatttacactatttttttcacacctgttgcatgcacggcggtggacaatttgggaacggcaaaggctgcgcaagcagtggcggtggtggtggaggcggaattggaggcggaaccatgacaaactttaaatttcggaaataccaaaaatttaatgtaacttatttaaattttaaaatagtaaaattatttaaaaatttcaaaaaaacacctgtggg

SEQ ID NO: 3805 - DNA, 2608 bp, Heterodera glycines
ccattggcaaaacggaaccggcggcggcggaggtggtggtggcggtagaggaggcaaaggtatggtaaattgttggacgcactgtggcaaacacatgggcttaattaaaaaaaattaaaaaaacaactaagtttttttgatttaactaacctggcattgtgcaacacattccattggagggagaggcggcggtgccattaatgccttcatttaatatttaattagcaataatttgtctcgtaataattaattgtcccaccattggaggaagtcttggcaatggcggcggtggtggtggtgcaaattgcgcgggtggcacaacaaacattggcggtgccattgccataggtggcggcggtggtggcggtagaggtggaggcattggcatcatacattgaggcatgcactaaaataaaattttcaaattaaatatttccataaatttttaggataaataggcattttgaaatttccaaaaaatttgggtatcaaagatatatgccgaagtcatgaagcgtccgtgtggaaaattttttcaaaatttaaataaaatttgttaatttatattgtaatttttgtgtgtggcatttattttgaaatgatcaatcaacaattacaccccaatatatacttttaagacatacatcatcttattgtatcaaaaccaacagtcagagattatttttcaaatattcctttacaaaataataaataatccgaatcattgaattttgaataatttcattaattaaaaagaacaaaaatttaattaattaattagagaaatgtttattattgtaccatcggctgacacattgccggacatggcatgatcgctggaggcggtggtggcaagggaagtggtggcggtggtggaattgctggtggttgtaagtagatcggaggtggtgatgggggaggtggtggtggaaagacaattggtgggaattccttaatttgtttttaaatcaattaatgataattaattggatttatccaaaaataaaatgctaaaaagtacaggaaaaaagagtgtatatataaatttagtaattaattaggttgaatttttttttacctgaacacaagctggagcacatgtcggcatgcaaggaggtgcacacggcatttgaggtgcctgaaaaatgccgaatatttcgaaattaattaaatttttgttagaagagatgtcaaactgccaaaggatttcttggaaaaattaaagacttatgcaaaattaaaacaaatcgaattttttattattctcaattggcattgtgcttttttaatgattttcaaggtcgtgtcttcggtatgcagacaaatttttcggggagaggagcgacaataaataattaaataaaatgccaaaactaaaaaataataaaaacattgtttacgaaaagtgcgaccattggcacaggcggtggcggtggtggtggtggcggaggagggggcgggaacggcacaggtgaagcaaaaggtggcatctgcataattggtggagacattgcagcagcaggcgggaaaatgcaatgaattgtacaggccggctgacacacctgaaaaaaacattatacattgacgattaattaagccgcgattattttcacgctaattaattaccggcagacatggtggtggtccaagtggcataaccgggcccggaacaggcaccggaggcggtggcagtggcattggtggtggcggaggaggtggtggcaacaacttaatcattattaatttaaatttaaaattatgaatttttgaaatatttgccgtcggtgggggaggtggcggtggtggaggtgggggaaggaaatggcggcatgggcggaggcattggcattggtattggcggtgggcacacttggccacaagtcacctgtcaaattgtagaataaatttgaaagttattttaatatgaattttttatttttatatttacccaaaagttgaagccccatatttagttcattctttgttttatgatgtgaaaaaggctgttttttaaatacctattaaaaaaaagaattttatattctttttcttagagagtttaaatttcatgttattaataatcctttttaatttaaattttttattttaaattttgtataaatctattaaattataaattagataatatttcacttgataagtaagtggacatccgcattgtaccaattgttcttgccacattgggcattggcataacattggtggtgctcggggtggaaaaggaggaggaggtgggggtggtaactgaaattggaaatttcattcgaaagatttaaaaaataatatttttggatgacttaaattattaaaaatatttatttattattttacgggtggcgaaagtggtgggggccgtggcattggcatcggtggtgcttcgattagaattggtggagaacacccgcattgggtcgctgcgagtccaccgcaatcgcattgttgtaccttttttcaataattgttgaatttaatcatttaaaaataatttaaataaaaaccatctatttttgtaaatatgaaacataaatgatgctaattagtattgctagcgccccgaccctcggtgagagaaaaaccggggacaaga

SEQ ID NO: 3806 - DNA, 1647 bp, Heterodera glycines
taatagatgataaagatgccgaaaacaataattcacccgcttctgactgcttctggaattatgaaaggtcttactactggtctggcgttttctgcgtgtttaccaggggccgacagtgcacgaccgattcaacaagttcatgtagcgacagttgctggtcactcatgggtatcgcaactagcagcagctcaacaattggaccaaatggtaagtgtgccccaggggcgtaatcgaaggcgcacaaaaatatgttgcggaacccgaaatgattgcttaaaaattctagtacccacccttaaaccattttttcaaaaattttcaaattaccgagtcataaaatgtaatacagtcttccgaatataagtggtgcaatttgaaaaaaattctttgaatttccgttgcctcctatgcaaatgaaaatgacaagcgacgatggacaagcgtcactatcaactgttcatcaacgaaaaatgacaacttcaataaagacaactgaacatttgtccaagaagaagaagaaaaaatgtaagaagcacccggagaaatgtcacaacggcgtctactaccacgaccaccatgaccatgaaaaaaaagtacatataaaattttaattaactatagaaaaaatgtggtaatttttaagggatgttgctgatcagcttggacgtaatgtcgaggagaatgaaaaccaatgcagaaaatgggagaacagcagaactttcggattttctttttgggtggataaattttatctttttctttccgtagattagcttattccttcgctttttcctatcgataaatttttcaaaattatttaattatttgataatgagaagcaaacgataaatttattttatcgattttttcgggaaaatccttaaaaattttcgtgttttattttaggtgcgattatataaaaatgcgagtaaagatcatcatctgcttaagattcactgtccctcaaaaaccaacaaaacagtaataaaatttaaattggcagccttaaaagattagaccgttttttatattgaagtgttcgccgttaacactttgttttggaaattcaaattagggttcgagccccgcccccgtcacccccgcccccgccgggggcgggacaggttttttgggctcacccccgtccccgactgcatttattatatctacaaatgaaaatgaagttttttcattggttaattatttgtcaagaagattattaattattttatcataaatttttgcactgaatattttaaatatatatttaatgtccaatattttaatctttgtaccaaaacggaaatgccattcgcttcctgccaaattgaaaaacattttgccgaatgtttcccaacatgtaaatatgttgaggaaaccctttaaaaatcaccaccaaatttgaaaggcaaagcttatttttatccattgttgggcaaagatttttaccctctccaattttctttttgccaattttttagctaatgtttttgcccgttccttcggataaaagtcaaaaattccgagcaacatccgaaaaaaattcgggggatcccaaaaataatttttgttgaatcattggagcaatttgatcaaaaaaaccactatttaatggaaaatggtggacaaattttagaaaaaaaaaaa

SEQ ID NO: 3807 - DNA, 7570 bp, Heterodera glycines
gtttagttattttatgttttccgcctttttgatgagtgtgcccacagcctcggcttcgtccgtgccatgttcgtcattgccgcctccgcttcttcccatgccagcaacaacagcgaatggcaggcattgagtgcccagtttggtcagcaaatcagtgaaattgactcgaaatgtgccgagtttggcattggcattgccaaagtgccatttgacggccccaagggtaaaactaataagagacaataattaattaattatgcgatctcttaaggtgatcactagggacgtgaattttaggttttaactatttttttcgctcaattgatttgaagaaaggagctcaaaaaacgcatttctgcattaaaaattttcgattctgatgtcattatcggtcactagaaatcactattttggcaatttcgtcactaaaatagttaaaaatcactattttggcgttttgtcactatttttcactatttcgacattttttggaaaattctttaacaaaaatgcaataaaaccaaaaaatacacccctaagaatcgacctaaaattttttaaaaaaatacacccctaagaatcgacaaaaaaaaatttcaaaaagcactcctaagaaatgaaaaaaattttctcaaaaaggtattttcgtggcaagaattttaattttaaaaattatttttttatgtacctattgtgtttttttgcccttacaaatagggttcgagccccgcccccgtcacccccgcccccgccggggtcgggacatgttttttgggctcacccccttccccgcccccgtgactcagaccttgcaacccccgcccccgcgaccttcacccccgcgggggcgcgggggtgaaaatacacccctaagaatggcatattcgttgaattaaaggcaaaaatttatacaattttgaattttttaatcatcttttacaaatttttatgaaataaagtaaattttgcttatattttttaaaatatttgtggtttagtggttagtgcttcagcactaatagaaatctttgttatgagttcaacgccggttgacgttttccttaaataaattttttttttcctttaattaattttttttctgattaatacagggtttctttatgttcttgtttctaagtgttctgatttgggagtaaatccttattttcatctaaaaagaggaaaacttctgaaaaattttgctaagttctaacaaaattcatataatttcttaaaattttcccctggaggcgcctataggcaccgccgtcccccaaaattcctatctttttttcttaaaaattagccaaagatcgaaaaatttgcttattttttgtacaaaatttgttaacaaattgcattcaaattttcaaaaaatttccccggcggcgcctgtcggcaccgccggacctctcccctcgcacattcagcaaattttttggaaaaatgtaccgcaagaaaaatttaaaaaatctgagttccaattttccttgagtaaatcatgattagggctgctaattttatgtaaatacatattttttcctggcttctccatagcctaatcagtaggaaaaacactttcttttttgtgtttgcaaacaaaagtttggacttttatttacatattttagtagatattttgcaaatttgaatatctgttagaaataaatttaaaattcgctcctatcggcacgccggcccccccccccccaaaaaaaacctttttttcttaaaaaattacccaaaaatcgctaaatttgattatttttagtcaaaatctgtgcaatttatgtcaaaataaatattatcaaggcgatcaacgaataaaagaatgtggagccaaagaaattattcataaaaaatattttttttgtgagatttttggagctaattcaaagcaaacccccgcccccgcccccgcgacgcggaattatcgtgcccccgcccccgcgaaaagccacccccgcccacggggctcgaaccctaataagaatacagaaataaaaagaataaatcgcattttattaaaaaaatgtttaattatatgatttttattatttttcgtcatttaaattgaatgaatttacgtcataatttattggatttattaaaaatttggaggaaaggcaaagtgtaaaaaaattttgcaatttatcattataagaaatttctgggtactggtcctcccgagcctctaaaaatttacataattttcaaaaaaataaaaggactcaaaaaataatatttttaaaattttaattttttttttctaaatttcaaaaaatttccccgcggcgcctatcgacaccgccgaactctcttccctcacctatacccaaaaaattttaaaaatttaaattgattttcggaaatgtataaatttctcatttctaagccggaattgcgcagaaaaatagttggcggtgagtaatgcttggttttgttgaataaaaatgcatttaaagttttggaagcgcgttttaaaaatgtccttatttttgaccctaaaatcttatttttgaccagcgatgttcttatttcgggaaattttcaagggtaactctgaaaaatagtcatttgcgccgctcactcaaaaaaatatttgaaaatatttttagcaattttcaacaaattttactcaaactactgtgccaccaaaacaaaaaacaattaaaataaaataagtttctctgatcaggatctggtatccatttcggccaatccgaactccggaccggaatttgaacaaataccaaattctaaattttcgagtttatcattttggttcaaaaaaggcgtaagatctcttattgaaagattgaatggctttgtttttgtgtattttaaccggttttgaaaaaaatattctttatataacaatgatcagacattttctttatcaatatatcattttattttcttctaaaaatgggaattattttctatgatatttttttttattcaaaaatttttgttaaaaataataccaaaaaaaaccaaattatttattatgataattaataatttgtcgacaaacacactatttttgataaagtataaactttttatataaattaaaaaaaaatattattgaaaagtcacataattatacctcagcagcagaaaaatcatttgtgaaaacacacattataagaaagttcagaaaattttttgcacaataatattaatgaatataaataatatttaattaaattttgattcatttaattttctcatggcaatcatttcaattaataaaattattaataattgtaaatttttttacattttccttccgctgttttcttcataaaaaagacccaaatattttggcagttagtttagcataaataactaaaattataataaaattaatcataaaattttataaataatgaaattttatgttatatttcttcttttattattcataatgaatttactaataagtgaaaagaatgaaggaaaaataaggccaacctttgaagaaatatttggccaagaatgggaaaatgacaaaacaattgaaagcgaaattaatcaaaacttaaataatcaaaatgatttgaatttggctgattcaattcgtaatatcagaatgatgaattcagagatcaacaaaaatgcaaaattattcacaaatttcatgcaataaaagaaggaattaagaaacggggaaaatattcggcaaaattttagggttaaaaccgagcaaaaaattgcgaaaaaattgggaattaatcgaccaaaaatttacgaatggaaaaaagaatttgaaatttattattataaaaagaaaaaacaggaatttattgaacgaattgatgaatttaaaagaatgtccaaaaatggaaaacagaagcaatttgcgaaagagttgggcattgacagaaaaacattaagcaaatggaaaaaagaatttggcattgaaatgagcaaaagtaaattttaatttaatttttcaaaataataaattaaattttaatttaatttaataattatttatttttaattttttaaggatattcgaatgaagagaaaatgagcaaaatgaatgattattatgaaatgaaaaaagcaaatccttctttaagtgacaaagaaattgctggcattttgaaaattggatttgccactctaacgagatggaaaaaggaaaataattcgtaatttttcgtttttcttatttgtattggtttcaaatgatgctttttattctaatttttgttttttataatttttccctcttttatatgtttgttttttaattgacccatacaaattaaaattgtcaatttctcttaatttttttttactgtttttcggtgtacaaaaaccctaaaataattgtcccaattttcttttccgccagcatataaatttcgatttgacaaaacatcgaccaaaaaaacatgattgagtaattgaatgcaaccaaataaattatcattaattattgtcttttgcttgtcttccgtgtccgccgcatcgcctaattaccccccgcggcgaatgttttgtgattgagaaataaaacaataaaaaatagaaaaataaaataagtagttccactcaaaaatgtgggttttctgattttattttaattttatgtgctgttctctgtacatttatttcattgtgtgttcattttcttaatttttccgctcattttgtcacttaattaggtaattaggtgggctgactgattcttcattattctttcattatgctaacaattagtgatatttaatcgagacaaagcaataaatgcttcccaatttctcttccgcgaccatataaaaataaattagcattagtgtatttattgctttgtgttccatgtccgccgcgcctaattactctaattaccctcccccctcccctgcggcgattgttttgtgactgacgaataaaaataaaaataaattcaaaaataaattgagttccactttctcaaaaatgtggtttctttcatattcattttatttaatttcctgctttcctgtacatttcattgtgtgttcattttcttaattttccgcccattttgtcacttcattagttaattaggtgcactaattggtcattgttcatcattaagaagtgcctcaattagtgctgctgctatttacctcttgacaaagcattctgtccaaaaattaatttgatgccttttctcagcgccagcaattaatcatttcggtaattgacccgtgttactctgcccacttatgttcttatgtgtaaccccgtataaatacacatgtccaaaaaagaagtttcacttatgctatgaaccattgaatttttctttttttctttttcaaataataacaaaaaaaattttttttacaaattttacaagaaaaatttttatttccaacataaagttgaaaagctcattttgtttaagatttgccaatctaaaattagtcttaagttttgtatttattttttcattgccattgcgagtgtttccttaattaaaatgaaagaatttgacactatatgtaaataaatttgcaaaaaaaatattattttttattttaaaaattcattgtttttcaaattgccatagtttgtctatttttataactttaaaatataaattatatttatattataatttcagttaaaaagctaaaaatgggcaaagaaatgcaatatttgaaggcggaggccgaatccatcagaaatgttgcaatttttggcgtttgcattgccacggtggccagtttggtaaaatttcaaaaatattttaatttttttttgaaatttaaaaaatttttccaaggtttgcacaatgtccattccgttggccgccctttactttcagcggatcagcgttcagatggaaggcgagctgcacttttgtccaatccgatcaggaaatatcatgcaagaagtagggaaaaactgtttatttactaaaaaaaatgaattaactaaaatgcgatatcgtaatcaaaaaagaatttaccgtaattccttaaagaatttaatcaaaagatggtacagtatttcctacaataaagtcccaacctcttaatttcccgcttctaaaataatatctccccctttttttttggggggggggggggtttcttactagctttctaaattaaaaatttggcaatttttgaaatttttgaaaattgtgacaatttgacgtttcacaaatttggctaccattggcattttgccaaatttcaccgaaccaacatttttgctcttacttggcacagagtttgtccaatcaaaaattgtgcaggtaacgcgcacccaagtgctgtccgatgtgaatggtggcgcaccacgggcgcccgccgcgggcgcagcaacgcccaagcagcgccagacgcgcagcgcccatcaccacttggacacggtgctgcgcaatggacggctcagcctatggaagcgcagcggctatggtgccgaaagtggaggcgttacaggcggtggcggtggtggcgcgtgctgcggatgcggcacctcggaacagggaccgcctgggccaccggtaggcgcgagaatttccatattttttcaaatttaaaaattgctaaatcatttagcaatgctttttaatttagggggccattggtgaaccgggcgctgacggacaaccgggcgcagctggcaatgccggcgaagacgcggcgccaccgccgccggcgccgtacattgagccgtgccaagaatgtgggacggcacaggacggatgtacgtacaaatttaatattttaaattaatattattataatttcacaattatttagcccaagctttggcatttaatttttttaaattttttagtcgagtccatttctacaattcagaaaaggccgtaaaatttcagatttttatgaaatatatgtatatgatggaaacatttatttcgatgtttctgtttttagaaaatttttgtcggcacttttcgctaagcgccgtcaaaatttttatttattgttgaatttttgaataatttacaaaaatttagtgcccgggccgcaaggcgcgccaggaccggacggacggccgggcgagcccggcgcgcctggcgagcgcgccattcctggaccccagggtgatgaaggcgcgccgggagtggacggagtgcctggaacgcctggaggtggcggtcaaaataaattttgcaaaaaaatttccaatttttcagagcctggccctcccgggcctcctggaagccttgaacaaggtgcagaaaattttgttttccttgatcgaaataattggaacaaaatgccagattatgccccaattgttggcccacccggacccccgggcgcaaatggacagcccggcacagacggaacgccaggcggtatgtaactattttttaaaattttatcgtgaaaaattcgggtaaaaattttttctcacaaattagggctgtttgagagtcaaaactaagcattgattttgctacaattcgagaattcgagctctatgaatcaagaattttcgaaattccgtgtcgagacaaaaaatgacaccgaaagctacaggaaatccgagaaagttcgaaaaccctagcaaatttggg

SEQ ID NO: 3808 - DNA, 1031 bp, Heterodera glycines
ccttaaattgcactttttgttaccattgccctcccccgtcctattgcatttgtcgtttacgccaattttccactgactttgtcggcaatgaggtcgagacgcgcttccaaagtggacgagacgcggattttgccgtctttggccaacaattcgacgccgcccgcactttccggggacaaaaagtactcattgtcaattttcacctgaaaaggttgtattcggcggaccctttccacaataattacttcgcttcgattgccccacgtccgctgaaattcctccaaacattcgggcaaaatcctcgccaccatttcctcgtctttcttgcggcatcgcaacacaactttgctttcgagcaattggaaaaggccctgccaatggacaaaaagtgccttttttgccgcatggggccgaaaacctgaagcaaaagtcctttgagaatggccggatagcgctctctgtccgccgaaattttgctgagattggcgcgtgcctcctccaacacatttttcaaatggtcgtccctcgccttcaaacatttcaaccgactctgattttgcatattcgacctctgaatcttgcgctgcagctccacttgcttctctttcttctcgtaatattccatgattttctgcctttgctgttgcaccaatttcccctaattaattgccttttattaactaattaatttaaataatttgcaatttaatgaaccttctcaatgttaaactcctcctccgcttttgcgtcgatttcttctgctttttcgttagcttcctgctcaataaatgccatcatatggcgaagctgcttttggacatcgttgtcggaaatgcccattttgtcaacgaatgcttttttgattttttggcttttggaacagacaaaaccttctttggtggaagtaattttgtgattaaaattgcaaaattaaaaaataaagatcattatatgataataaaatcgtgttgaaaaaaattcatatttaaattttattttattttattcacattgtatgaattgaattcaca

SEQ ID NO: 3809 - DNA, 2841 bp, Heterodera glycines
ggattggtaagaggagcagcaggcgttgatcactttttccaccattaatgtttcaactttgtttagctaccgcgcgaggacgtgacggagttgctgccgaacgacggggacttcctggtgcgcacgacagaagaaacttcgggcacagagcgcgtctttgcattgtctgtgaacgtcggaggcctggtgaaccacgtcatcttccgccgacacaaagggatgtacaccgtggacctcaactccgacaagggtttccgaacaatcgaacgattcgtcgaccactaccttcgcaccggaacatcagtcaccagcgtaagtcaaaaatttaaattataaatttagtcatttccctttgttttcaggagcgattcgtcactctcaggaaggccgtgcaccgggcgaattgggagctgtcgcactcatccatcaccgtcagcgcagagttggggagaggggcattcggcgtggtcaaaaaagcagtgctcaccgaacgcaatgggaacaactcgcaggtcgccgtcaaggaggtgtctcagacgagcaccaaggagcaggtaaaggcggagtttgaagcattgagatcgcaaattacacatttttccttttcagatcaaagagttcatgaacgaggcgcgcatcatgcggcagctggaccatcccaacgtcatccgcttccatggcgtcgccgtcggacaggagcccctgatgatcgtcatcgaactcgcatctgacggcagcctcaccgactacttgaagactcaacggagaagtgcgcgcaccagactcttcatgtgcgtcggagcagctgccggactgacccacatccactccaagggcatcatccattgcgacatcgccgccagaaattgtctctactcgaacggcgtggtgagtcaaaactttgttgttttagtaactaatttcgctctgttcccacaggtaaaaatctcggacttcggcatggcgcacagaggaccagtgaagaaaatggagcccaacgcgcgcgtccccgtcaaatggctgtcaccggaagcactcgccgagcgctgcttcaccgcgaagagcgacacgtgggcctacggagtgatgtgctgggagatcttcaccaacggagaagtgccgtactcacaaatggtgggaagcgacgtggcggtatcggtgggtgaacacaactttttttttttgctttttttcaacttttccttccttttcagctgatcaacggacagaggctcgacttcccaagagatgcaccgtcaaaatttgtcgagttcatcttgcagcacatttgggatgcggagacgagcggcagatactcaatggcagcggtccacgactggctgaagcgacacacgtaaggagcctagtggtgaacggattcaaagccatcagaagagccagccgaagcaaacgtcattgtgtgtgtgtatatatatgtgataaccctatgcttgttgtatttttacatattgcttactcattgttgtataactactattatgatatgtataaatgactgatgtcctgatgtttgctgattggcactttgcctgaaagaaaaactgaattttatgactttaaaatagaaatcaaaaataaccaaaatttttggtccggcggtgccgccgggattttggaatttttaatgaatttgttaaaaaaattgctgcaaatttttcctcttttctcccttcgccggtgattctttttctctccttaatttcttgaccgcgcttgattacgctttttggtacttatgtatatggttcgtacgccacaaatttaaattttttaaaaatcatcttaggttgcttagaaaggcacttatatggttctcaggggcgctgaacacgattatgacatctatttagaccaatttcgaaccccggaaacggattcgacctaaagccgaaatccccaaaaagtcggaaattcaaactttttcaacaatgcggcagtgatcaaattcgtccatgatttaagaaagaatatgtaagtgcttaggaaaattatataccgtatttgctctaatgatcgccccggggggattattagatacggggggataaagacgggggggggggattattgttcaaactcctcagaaaggaggggataattggagacggcgggattaatggagacggggtgataaaaagagcaaatacggtatgttagttgcagtattatatgaatgcgaaaattgattccccattattgttgtttctttgcatttggttataaaatttaaattttattttattcaaattttatgaattgaattcacaccagggcggggggggggatcctcgggattttcatccccgtccccgtttctccatttttcatacccccggaaacggggattcccacactttatctccgccggggacacgaaaatttaaaaaagtctgacatatgagcaaacattggggtccccggtttagtcatctccgctctccccacaattattttcgtgcttttccactgccttttttctcattcttttcgtatgtgaaacatgaagagacaaaagtgtcgatgtcgtcgcacgaaaagcgaacgtacattctgaggaagaggcaattgcttctcacccattcgcttgggttggaaacgccaaaagaagtcgcgtatctgtgggcattcggtggatttacaagcatttatttatggtgattatgaagagggaataatatgcggcgaccttttcattttctgacaattttcgcgtgtcatttgcagcgaatccgccttctctggcggcgaattcgctctttgtgctaatgacttctttctgcctccgtattcagttggtcttgatgaatatttggtcattcc

SEQ ID NO: 3810 - DNA, 1309 bp, Heterodera glycines
  misc_feature (8)..(8): n is a, c, g, or t
tttattanagggaaaaaagcaaaggggaaaaaaactaaaaaaataaaaatgcaaaaacatcgcttttcattaatctgtcacattgccctctctctttcaaacgtaagaaatgtaacaagcggctccttgggcagggaagtacccgtggacatgggctaaaacgggggggggggggaggaacaaaacaaatggcgagagagaaacaaactcacccaaaatttcgcatttgaattggaactcgcccagctggaagaggttgactgcccggcaattccgagttacacatgccgccttgcactcgtcgatgtccttcagtttaggcattcgaattaagcaaaagtgaaaactaggcccattaaactttacctggacctgattgatctcgtaaattttgcctcctcgacattccatgttctgcatcagatagtacggcttgtcattgacgtattgaatctgtggaagggctgaagcggggaaagtgccacgaaacggacgaaaagactcacaaacgcaacacgcggccaaaccagcgaagaccagcagacagaagagagggctccacattgtgttcaggaggaaggacgaataacgctttggaggaggacggagaaagaagcggaagacggaagaggcgaaaagcattccgatgggacaccttttatagcgaaagccaatcaaaggaacaaaagggcgagcgaatggccaaaacgggcgaaggaccaacggatgaatagcaaaaagggcggaacaaggcgagccgaagaaccgttcagttttaacaatgggcggggagggggcgacattctctcggctcaatcaatgcccattcaatggccaaagacggccctttatgacttggcatgtttgactttctgatcgctcactatcagtggaaaaagaaagagaaagaaaaaaggaccgacgagccaaacccacacaaaaggacggactttcattgccaatttcactgctaatcacgctactttagataaataaacttggataaatcacaattaacaacaaataaattattgtggcctggccatttcgattcaaaagaagagcaattgggggaaaaacactcccaggcgaattgagggggcggggggcaacaaaaggcgatgctcgggacagactggcggattttctacttgcggtgacgagatagagacggaggttgctgtgtttatgtcaaagttcgggatggatcgacacattcactcaaatggaaatgggaaaggttgggacggtggggggggggcgagggaagggtaaatggattccctccccctccctccccctcccctcc

SEQ ID NO: 3811 - DNA, 1465 bp, Heterodera glycines
accggacggctagcacagatccaactacgagctttttatccgcagcaataattctatgcattatgagagctggaattaccgcggctgctggcaccagacttgacctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtgaccatttctcaggtcccttctccggagtcgaacccttatcctccgttacccgtcatcaccatggtagtcagatacattaccatatgaaagttgataaggcagacacttgaaagacacgtcgccggtacaagaccgtgcgatcagcttatttccctccctccccctccccttccccgtttccgattgctcaaatccataactgtcgatgaaaagaaagatagggcgagaatctcgatgtgcgttccatgtttcccttttacatgatcataaaagaaacatcggtcgacaatttgaatttgagaaggaatgggaaagaaagggaagggaagggatgagagaaggccaacggattcaaagccaaacaacggaacgacgattgagaccaaacaattgttaagggcacatcgtaaatcacaagcgccgagacaaatgttatgatcagtaaaacagatcagtgagtcatcatactgaaacatcaaaaatgaacaaaataatgtatttatttttttgacaagagttttttatactgatttggcttaattttgttagctttttgaatgaactaattttttgattttgcataggcccatattttgtgccctctatcgaattctattttgttttttgaaagtatattttctaactcgagatcagctcttgcgttttacaagggaacccaaaaaattttaagtttgcaaagttttggcgttctgaatacgaaataaataataaacatttgaatttaactcgcgtgtttaaacgcgttgcagcagacttttttttgatttttctagccacaaaaggaaacctgtaaaagttgttttgtgactttttggatctggggccgttaagtacatatttaccaaaaccatttcgatgttcatatactaaaatttctactaatcttatttttcgttaattgaggtgtttctgtcatgaagtcaacatccgaacttactgatgaggagttgaaagcggaactctcatcatttgggttcacagccggtccaataactgatacaactcgagggattttgcacaaaaaattgggttcctttcgcaacggttctggtgttctagcaaagacgaaagcatctggcaaaaaaacgaggactgaaactccgacgtcgcatgtcaaagagtaagcgccaatttaggcagtaacatacaaaaaaggccaggaatgcttctgattcccttcgacttcctgaaaat

SEQ ID NO: 3812 - DNA, 2154 bp, Heterodera glycines
  misc_feature (2128)..(2128): n is a, c, g, or t
ggggtgaccggactagtaatcgtttttttttaaattttctattatctttaggctcgattcggtattcccgaagcagtttggggactgggcgaccggacactccgccgcttgatctcgctttcaaaggctatggctcgggcacggcaacctttgaaacaaactttggaagagatgaggaggaagaggatgacgatcacactgagtcttcgcgcattttgtctccggcgactcgttttgctcccacccatgggattggcccatacactaaaaaagcatcgcctgtggaaaatttcaaaaagatggcttggggtttcttctcgcgtccgcttggaacttctacgccctgttctgatgtgagtttgggttgttttttgtttcattgggttttcttttttagaccggcgacaaatacgttggctacgcttccagcaaatacaaacgccactcgccctctttcgaccaagcgactgttcgtttcttcgacaccaaaaagatttctccggacatttcgcgttggattgcccatgcaattgttgcgttttttgctctgctttttttcacttatattgcaaaagcgcactccgagaccgtctccagcggaatttcgcttactgctggttatttcaaaataattcttgcattgtttctgaccataattaaggttttgctgtgtccacctttcgatttctttacaactacgcatttattcccatcattggaatttgcatcggtacttccttttctcataatactgaagaactgttttccggcgcaaaagtttcaaattattctaatatagaaaagttaaatttgtgaaaaagcatagacatagcaaaacatcaactcgaacccataatcaacgaattttttatcctaaaaataaaaagaatttgtttttttttgtttttgccataaaataggttcttcagtattaccctttttcttacaattgtttcattttccattttcagttggacttttcatttttggcatttacaaattggcttcgttccgtaattatcgaaaggttgaagagaacagaaagcttattctgttggtcgaacgtatcactgacatcatttacgagtcgggcacttccggcgttgctgagccgcacgtgcgcgatatgattatgccgcctacgaagtaaggaaggagttcgagatttacaagtcttaactgaaatcactacgacccgttcaaacaatcattcgtgttttaaggcgttcggaagaggaagccaagcgatggaaggaggcggcccgtttcatcaacaacgaggactcgcgcattcggaccgaaattcgtttgataaatgggaccgagtgcaacgtgtggatttgggtcggggcaggaaaagaacgctggcagggaaccggtaattgaaaacatagggagaagaacggaaaaagccggccgcaacaaaccaaaagataatccaattcaatgttatgtcttttttgatgctaacgatactcatttgccttcctttatttgtttggttttttaaggcacgtagccgttaaatccaatgctttttaagctaattgtaagtttcaaatacttgctgccggctacgagccttaaacattatgattgttttgctttgaatgttccgtttattgtcgagaaataaatttcaaaaaaaaaacattttaaacttcagcccttctcgaggggtcgcctatggctcgggtacccgaacaagcattgacgcgctgtttgaagttacgcggagttaatttttccccgaagtgagataataaattagattttaaacgaaaaaccaatcatagcatcgttgagagagactccattcgaaatgaacttctggctaaaatgcgaccgattgttccgcggcacatcggatttgttagtggcgcggaaagtgttgtgtacattaaattaaaagtgagtggaaattacagcggagaaaacacacggttcaaaaaacgactcaataggtggatttacgacaaaaaaatattttttttagggggggggggggggggggggaaaaaacttttggggagttataccaataactatattattatcacaactttttctgtcctacagactttgttcaaatttgcaaatcaaacccacacaaccctcagattgcttntttatgtgaaaaaccaaaattttttt

SEQ ID NO: 3813 - DNA, 717 bp, Heterodera glycines
aatttctccgcgagaatgtttacgaccaaagccgtccaccccgtaaatggtcgtgtgcccataccttcaccagtccggtcattgtaatctgcaagaattcgtataattgtataaatatctcaattaaattcttactctcccaaaaaaagccagttcgtctaaattgattggcaatattctgaacaacattggcccgcagctgctgaaacaattcagaactcagtttagcgaattggccaccggaaatggcataatgtcgaagagaatcaagcgcgagaaaattaatctaaattcggggtttaaattggtcgaaattggtcagaatcgaattttccgacccttagttataaaaaatgtagccctagttttctgactattcgagagaataacgaatacgtttatccaaattggtcctcgccaatacggagggtcatgctcggtattacgggccaaatagtagggtgatttcgtcgcaatccggatgattcctgggataaaattgaggaagaaaggcagcgatataacgaattgttgaagttgatagagacaaagtcaagcgagcgtgataatgagaccgacacacataggaagagaaaaatagaagaggaaattgctcctcttcaaaatcgatcattaggtaagaaggcacggatagatgaattagaagagcaaccgtgaaggcgtgacgagggaaaggaagaaaaagaggagagaact

SEQ ID NO: 3814 - DNA, 1710 bp, Heterodera glycines
atataatttatttctttttctctccattttccacactatttctctaatttctcaatctttgcttgcagccattcaaaagaatatactttatttctttttctctcctttttccacactatttctctaatttctcaatctttgcttttttgtttccttttctcgtttcctttctttctttgacagaggaaacaaagacgcacgcattcgtcgaaacaaagggaatggaatataagttctttcttttcctctcatggttccacactatttcttaaatttccctttcttttcttttcctctcacctttcctctcttttctttggtctgtactattttctttttcctctcatttgctttctctgccatttgtgtaacaaaataacacattcatttttttttctctttttctcatattatttctctatcttccttttctttcctctctcatttcctctctttctttgtgcatatgctttctctgccatatttttttctctcttctcacaatatttctctctctatcttttcttttctttcctctcccatttcctctctttctttgtgcatttgctttctctgccatatttttttctctcttctcacaatatttctcaaatttctctctctatcttttcttttctttcctctattttctttgttctgtactattttttctctctcttcccatttgctttctctgccattttgtctgctatggtgttttgtattagcaagcagcaaaaattcatttgtttccttccttacatatttattagagcaattgaattttatcaataaactgctaattgttcactaatacgcaccatttaaaaaaaattaaaatattttttcaattattttcttggcaaataaaccccaaacaaaatcacctcattttaattccattagcagcattccaattaaaaatataattattttcgttatttttacacaaataacaaataaatattcatcatggcaacaccaaaagtaaaatgggcaaaaaataaaattaaaaatttaaaaaaagtatttattttattaaagttgtacaaattccatgtcgaaatgacctgcgaaggctgctcaaatgcagtgaaacgtgtacttggcaaattggaaggtcaaaaaaaataaaataaaaattttgtttctcaaaacctcggcaaaaaacaacaacaacaactttgtctttgattaaatctacaagcattgagatggcacagaatttcgacatttttggggtccgaattattccgattcccgaaatttaaaaaaaggtgaaatcttcggaataacttttttttttgccaattcaattgggcatcttggccgggcattttaatttctaaaataacaaaaaattagttttcctaaaataataataaaattgtttttgaagacaaggtaaagctgctcagtgtggacctgaacgccaaagaggtgcaggtggagagcagcagtatgggccaagatgaggtgctctctctttttttgggggggggggggggatttatgcaatatgtgtgttcgatatattcaaaatattaggcagaaacttcttggtctcgtggtatttggtggagaaatgctatgtgaattgtataagaattattactttttttcgaaaaaattttccaaaaaatcggaatatgtggaatcgcattttctaaatgctaggttatatcaaaaggatttttttccattttaaga

SEQ ID NO: 3815 - DNA, 2753 bp, Heterodera glycines
  misc_feature (1066)..(1066): n is a, c, g, or t
aaaataaatccaccccccccccctaattcgagtttcaaaaaaacacccctaaaatcgaatttttgacttcagccccccatgaagccgcgctacaaagaaagagctatttaaaagcaaaaaatgtaaaagattgtcaatttattaaaacaatataaaattatcaaaaaaaaatttagcgaaaattgttgaaattattaaaaaaaatccagaaattttggactcagaacattcaaactgtaaaattcccggtttttctcgcggtcccgatcccagtcccggacgaaaatccacgtcccggtcccggtcccgacttttctggtcccagtcccggtttttgtcaaaattcccgttcccgtacaactctacccctaagaattgaaaaaatttctcaaaaattgatcgccaaaattaatcttttctgatatccaagtgatccacaattgccattgtgtatcccgtgcttttcatattttcgaaaaacgttcaccttgtttatatccgagcttttcaaaaatctcaatgtggtccttggactgcgcagtgactgggattagtccatttctgtaatatctacaataagcttttatagtgactgttgttccatcggcttctagcaaaatctccgcgctgatgatgatgatgatgatgatgacgagactggtggtggtgggcagcatttttggagtaaaatgggaaattttttggggatttagattttgtgaattttccttgacattcattcgacttttataatgatagcacacgcacgccaaagcgcatagcagcatatgccaacaatgcaatacgtatgcttaagccagatttcatcttgcgccagaattccagcaaagaaataaaaatctgcaaaagagaattaaccgatttcaaaaatttttctggtttagaaaataaaataaatataaaaattattgaaaaggcatttatatttttccaactgctgaaacgcagtatttgaaagaattttggcaaggaaataacagaatttttgaataaaaataatttcttttcgaaagagcagtttgggttcttaaaaaacagatccacngacaaccctaactattaattacagacattaaatgatttttacgaagctatacaaaatcaaaaagaggttgatgtcatttatattgatttttccaaagcattcgattctgtttctattgatttgttacttgcaaaaattaaaaatgctggaatagttgggaaaattttgatgtttttacgtaatttcttgttacaaagaagttttagggtaaaaattgaagaccgattactctgaaagctataatacttttacgggggtaccacgagggagcgttttgggtccgattattattcctaatatttatcaacgatttaccggtaaatatacctaaaaatgtaaaaattaaaatgtatgcggacgatgttaaattgtatattttccatcaaaatgattcaaatacaaatgatctatctgaagctataaaaattcttgaaaaatggtccaaatctaacggccttgaaatatcggtcgaaaagagtcaaacattgtatattggcaaaaataattcaaaaaaagagtattttctcaatggaaaaattattccaagcttagaaaaagtcaaagatttaggagtaataattgactctaaattatcttttgctgatcatataaataaaataataaaaaatgcttacttaaaggcataccatattttgagaataatgaagactagagagctaaaaactattataagaatgtataagacttatgtcagacctcaattagaatatgctgttgaaatttggaaccctaacttaaaaaaagatatagaaagaatagaaaaagtccagaaatttttcacgagaaaagcctttaaaaaatgcggacttttacatagatcatattcagaaagacttgaaatttgtcagcttatagaattagccaagcgaagaaatattgctgacttaactaccgcttttaaaattatgaagggttttacgagtcttgatgctagtaaactttttactttttctgatcgacccactcgtaggccattacttttgagaatgcggcgcacaaccacaaaaagtaagaataatttttttaaccgtatagccaagaattggaacaaattaccaattgttccaattcaggcagataaggcaaatcaattcagggcattgctaaaagctatgtatgagttctaagggatttcattgacatttgcattgacattatttattcattatttcattttattttattttactttacatttcatattgttgtatttttttttgacattatttattttgattttttttatgcgccacataagagcactaatgtgcctgtggtttgctcaataaatatatatataaacaatttttctgcagctttgtctcgttgagaaatgaataagaagcactttttttgcctaacaaaatgttggctttcaaaaacggcgcaatgcccaaaatccgtgacccttacatcttaaataagagattgttaaaaaataagaacaatttcattctttcgagaggatttttgtaaaataaataaaacctaaacgaatttttttgctacatttattgttttttgtttttgcctttttgagttgaattttataaaattttaaggaaatttgggtataggttggaaaattttggttttgtgttatgaaaaaaaaatttcttttcctcaaatacaatatacagataaaaatgaagcgaaaaaaaccaat

SEQ ID NO: 3816 - DNA, 1979 bp, Heterodera glycines
  misc_feature (1921)..(1922): n is a, c, g, or t
gcttctcgacacaggaaaaattgacgaaatgaagcgggtcagtttggtcaaaatttgattcgagataaaattccatttttaaggaccgtgaagaacaacaagaagaaatcggaggcaaggagagcgacggagaaagcaatggagaagaagaacaattcgattttgaataaaaacagttggatgaaaggtttttctttgtttttacagaaaataaaattaaaaaaaaattcttggcttctttaaaagttgttttatcatttcacatatatttatttgctttaaaaacctcaaaatacagctataacatgcattggattcgaacctgagaccccccttttggtgactaaaaaacatgctggcgcccaaacacgcgcgcccaaacacgtggctcccctgattggactcacatttccgtttaaattaaaagtgaaaaataatgttggcatagtgttttacccgaaaatgtgcaatttcgcagtttttatacacataccaatagagcccggaattttgaaatggccgggaccgggatcgggaccgggacttggaaaatggaccgggacgggatcccgggaccgggagtcccgtttttccggaactcccggtcccggtggtttgaccaaaaaacccgggaccgggagtccaggcaaaatcccggcgggatcccggtcccgtccgggctctagaaaaaatatcatgacccataattcagcactgttatgtttgtatttgattttcggagtttcggcatgctgttctgttttattattgctcatgccgccgccgccgttttgcttccgctttaatacggcatttttcgcaacatggttgttttagccgcttctcaggcctttggtgacacttcactgagttggttcgattcgttggtggaccgtttattgcgtataaatcttcaaaaaggaattttaaaaatttgaaaaacaaaaatttcagaaaaccaagcaactccaaccgaatttgttgccaaactttttgctggaattactgaccgattcattgaatcggcggctggtcagtcggccaatttgccacatttttttgccgtttttaattatttttttcagctcgtttgccgttgcttggccgtcaatgtaccgacaattatggttcgtaagaaccaagatttttgtttgagcctctgggtcgggaatggaaccatggtcgaatttgctggatcaaaatttaatccaccccattttctgggtccgcttttcctaataaaaagtggataatgatggggttcatacaaattccggtttgaccattgccctgtccgaactcgggataaacacaaaattttgcaagcaaatgcgtgtcagcataggcttctgttattttttttattagatccggtcctctgtgtttcgaaccccactaattttttcgtaaaaattgccgaatttcgggaacttttttatggggtttactgttggtcccttttccggctttttttctaataaacaatggaccaaaatcaaaaaatgcctcccctccaggagaataccacgccacattctctccttttcaactgtcactacagtttttgcatgccatggcatttcgtgccggtgcaggcaccggtcgggaattggcacaacgaccggaccaatacttggacatcttggtaagtttttggagttacatacctgttttacaatggcattttttaagcggtaaaatttcagacaaattttgactgttgttggtcaacgcctgacgaagtgcacgcaattgctgaacaattagacgaatttgtgcaccacgaaattcggttagttttcattttctgaatttttcaaaaatattattttcggcaccgtttaaattagcggaatgccgttaacggacatggcttattgtcggaaacccattccataaggctgttcaagtcggtccgctnnaatgccgtgccgaaatatggaaatccgccgccaaataaaacggagcaaaacttgggt

SEQ ID NO: 3817 - DNA, 5633 bp, Heterodera glycines
  misc_feature (2906)..(2906): n is a, c, g, or t
  misc_feature (3017)..(3017): n is a, c, g, or t
ccgggccgggatatcgggcctgccggtcccagtggtttgtccaaaaaagccgggaccgggagtcccggcaaaatcccggcgggatcccggtcccgtccgggctctacataccaatctcaaaaaataataaacaaatccatattgtcccttcatccaaaccctaaaattgtccctgaaattcaattgctatgaaatacttgccgcccgaacttttgagtgaaattaccctttacatattgtacccaaacaaaaattttccgaacattttttcttcttcctggatactcagggaatttctgattccccatgtcactaaacgcaaggaaatattaaaaaaagtgtgttacatattagaaatagaaaagggttttggtcattttctgacccattatattcgttttattcagctccgaactggtctccaacgcatctttaatcaggcagtacatgagccaatttggatctgtttcgcaacatcatcagggccagaaaaacagacaatagacgacttcctgttttatctcgaagaatacctcgtaagtattgattggtacattttaccaaatgtttaacatattttcaacaaaattcagaattttcccatttcaaatccaccgagtgatgaggaagccaaggtcaattatgagtgtaaaaataatatataaatgtttcataaaattgatttaagcaaatgttcaaccggtcccgagaagtgtacaagtacttcgttcgttgttcaaagactactgcatggtcccttatcaaagtttctcgcactgttcagcaatttcttgatgagctcagctcattcttcactttggtatgcgcattatttgacccgattattctttgcattctccaactaatttataggtctttgatttatcacctgaacattcgcaacaccagcagcaaagtgaccacgaggtttacgcaaattttgaagccacctattcttctccacttttgctaaattgtgtttactttagacggtgtcaactgatcagacgaattcggccacatctgaccctcgtcctctgcccgttgtcaccgagtcggtgccggtgagtcaatagcagttactgaaaaaatgtaaaaccctaacaattttaggaagaatcgacttacgatccgccctgggacgaccgccctctgcgtttcatcgaaaccatggctgcttttgaagcgcaccgatcaacaaatgtaattgatatctctactatctttaattgctttttaaatgttctcaattagtagcaaatttatttttctttgcatttttgataaattgtgtttactttaggtagtgcccactgttccgtcaacatcggctgcggcccctcgtcctctgcccgttgtcactgagtcggtgccggtgagtcaacagcagtttcctcaattacttgcaaaattttagaaaaattttcaaattttgaaaacagcctttgtaaagtgtaaaaatgtttatctgttgaacaatggataatttgaatttgttttggacccgggcccagccattttatggccgtcttgtttttaataaatcacagtgtaatttttaatatttcttttcgactttattaaaatcgctcattttattttagacatcagaaattcctgccctgtttgcggagtttttgcgcaccaactgtgttggacatgtgcccaaagaggttcttgtcgcttacctggaggaggccatcaaaattttgaattgtggcggcggacaaagcgccaacactcccaaaatctcaaagttccgcaaggtattgtttcattcattacaaaataatcgaacaagacgggcccagtggggttttaccgggtcgccgggtatcactttcttggaccaaccaccgggaagggccatccgataaaaccatgtttttttttttgaccgggcggcccggccccagtcaatcgtctaatccgggtgctttcaaaatatcggttccacgtaaataaagaaataatggataagttaattttttcgggtgtgtggcaaaatcaaataaaaatttctttagttccttggaacgttgaagaagaacaaatgaatggacaccagcaacgccatccaatttctcgccgtacacaaataccaatacaaacataacactcacattcaatgccactttttttgttttatttttcgacatttgtctcatggtttttttcattaacattatttccttttctagtttattttttgcttgctttttccaagataaaggaaaatttctctttgtgcaaacttcttacacaatgttttatgtgttgaattggtcggtaaaatttagcaaattttttgcgattgcagatccagcgcataaaatccaaatccatccaatcccccttcggtaaagtatccgttaattgatttttcattttgatccatttcagtgaaatgacaaaacagaggacccgaattttataatattttctaaagaaaccaaattttaccggtggtgtcaactgctgtcagatgaacaaaaatatgtacatattcgtagcgtgaaaatttacaaatttatgatgcaaattttgttaacaaatcaggctaaccaaatcccatttcaatttgatttacaaaaatggttcgaaatcgcccatttttggactgaataattcatacaaatgctcaaagctataaaactcgtaaagaaacttttttttaatactgtttcgacaaagacagacaataacatgacaaatacacagcatatataacattgatcattccatccgatttactcataataaagacacatcagtggcgtgcctagctgctttcgctgtcgtcgtcggtaccagtcttctcattattcttgtcaaagattttcgaatccacttggccaggcgtcgcataattaggatcagttgctgaaaagaaaaagaattattanataaatccaacgaatttatccatcattttttacttgtcgcataaccccgtccccctcctttcgcctgctgtttgattggcgctgtttttgttggtgcattattcttcacanaaatgtccgggtcaagcttggccagcgtcggataattgggattgcgcgctgaaaaagagataaagcatttgaattgaacattctctgatcaaaaaatggttttactcgaaacgaatatcatctgtccttcctttgtctgctgctgtttttgttgtggcggttttgttggcgcatttttctcaaaaatgttcgggtccaattggccaagagttgcgtaattgggatcctgcgctaaaaaatgatcaggggaatcatttttgttgcagtgttaatgatgtcatgtccaacacactcactcgaaacgaaacgaggcccaccaggagcagcagcaacagtttgtggaggagatggctttggtggagctggtggaggcattcgcttggcatctgaaaatggggaaaaagttggcccacagaaagttgcgccattccccttttttctgcccaccactgccacacctttcgcctgttgttccttcgcgaaaatctccgtgtccaaattgacaagcgtcccgtaattaggatggatagctaaaatggggaaaacaattatcatccgtcaaatcattggttgttgtttgttacgtgatacgagttctctctgatttgcatcggcatgtggtctttgcactttgggcacgtttttcggagtccttatcaataattatatttgatgttgtaacgcatatgctatgtacacatgtaaatgatggaataaaacccgtaaacaaaattgagaaccattttttcaacacctattcgaaaatatgatgtccttaagttaccgaaaacccatatgcagttttttgcaattcttagtagtactcggggagatggtatgggatacgaatcggtgggattttaacatataggatgcttgaaaataattgagggcaacgtattgaattgttttctcaaaaattcgcacattgttcgcagccttagatttgtgtacacataagcaatttcaaatggtccacatatcgcaccaaaaatttcatgtcaactgatcaactctttataaccaaaaaatcaacaaaaaaaatctccagaaatcaaagatcaagcattcccgaagttcttattggggagcaggggcacctcctccacgtccgaagccctgacgatgactaatcggagcagcaccaggcccagcctccgcttgtttatctgcggcagcgcgataacccccacgatcggtgtcggcgcgaatcggacctgataaaaggctagagaatttaaaaaaacattcaaatttgtgtctagaaaaacattgattcaattaaataccgaagattcaatatagtttaatactcaaaactctatttcgcaaaataaataaaggacattgtgattaattttttttaaattgcttataacctcggcctcctttgtctgcaaaagccttttgaatagcgtcggtcctttgcttgtgcgtgttcggcaacacatcgtcaggaagtccaaggtaagcacgcaaatggacaatcccttcgggttgaaggtagaaataatagtggtgccaggcatactgctccttgacaagtccacgagatgcaagactcttaagcgagaaacagtgaaatgagtcattgaatgtaaattaagcctcggatttcaagatgcatattaaataattagtgaagaaaaaaccttcaatgccttgatgacgtaaaggttcttcactcccttaatttcgggatgcgacttcaagcagtagtccttcttcgcgatgcaaactccatcctcaaacaaatgctcgtaaattttcttccgatcaccttgtggcataagcattttgaatacgctttacactttgatgttaatacagtagctaaacaaattagtaaaagtgtaaatgttttaggttaaattttaaaatgtctttgaaagatccataagtcttaatatgaattatcattattaatgtttagctaacggtaatggataaaggccaaggaacgtgcattactttacaaaagctttggcacaggcacaagcacaagtactctccttttatcccactgacttttttacgttttattttggtataaaattaattggcataatgtttttgtcttttaaaaagtttaaaaaaacaagaattataaatagagctcggattttgaggcatatgccttttttttctgcgcactagtttcgatatattaagcataaaaaacgcattttccacttggtttgaggcttctacgttgacttttattatgcctttttttggtacttatacagtttgacccacataaaattttttgcttttaatgataaaaagtgtttccaggggttttcggggccgctgatcatgaatatgaactctatttgacgaatttccggacccctaacccggaattcaaacattcttgaaaaaaaaaatttcagaccaagcattaatgccaattttatttgttttttgatgaattacgtggcatcagtgcttggtctgaatcaatatattatgagcatcacaccggagaatcatggagcacatattttggtacatttaaaaccatttttggaaaaaaaaattttcaaaaaactttcgtatttcgggttagggtttcggaaattcgtcaaatagagtttatattcatgatcagca

SEQ ID NO: 3818 - DNA, 1173 bp, Heterodera glycines
ggcgggtgtgacattcgccatgcaatggcaaaaacagtgcaaatgcagcagtgggggggggaaggataaaaatggaaatgcggggggggggggaggaaaagcgaaggaatgtgagcaaggggatcaatgaccagaaaaagcagggaaaagaatggataaaagcgcatttcgtaaacccggtctcgagtcgcggaaccctgactcgaacatcacgaaaaagtgagcgatttaaaatgaattacaataagcaccatcgcaggcattccaggaggcactaatcgctttctcggaaagcggcttatctcatgacaaggcaaggaaggcactttaaaatgctttttggtataatcgggacgcgaaaaattttcgtgctcgcggggcaaattaaaaacattgcagcgtggttcgcagcaaaggcaccgacggacggacggacaaacggtggtcggcacatttccgtcatcaaacgggggggggggggggggaagccccggcggagcgcattttgagcaattttatgctaatcttctgttgacagattaacacgctagtatggccaaacaacaaaaaaagagattttaccggagatttatgaagccgaaaatgttgtcattccctctccaatggcattggcattttcgaaaaagtttttaaatttaattttatctaaaagtaccgcccataaattgtatgataattcgtaactttgatgctgttaactcattccgatcatcaaaatgactcaattctcgccccggggcggcttttaagccttttccgtttgtcagccatgcccaagcggaaattggcgaccaaaagcggggctggtggatgctcccggcgtgcccttcctcctctgccgccccgcccctttaaaacagtgaattccccaaattccttacacgcctttcaaagtttcgagggcttctccccacgaggaattggcgttgtgtgctcccgagacaaatcttcacgcctttcacaatggaattcagtcaccaaaatttttgcaaaactccgatcggaccgacgaaaattggaaatgatttgtgagtggttcgacggaaggggcggggggggggggggaagagaagggaagagagggaggaaatttgaggatttttgcaggcagcagcaaatcggcgtgaaaatggggggggggggagggggggg

SEQ ID NO: 3819 - DNA, 3331 bp, Heterodera glycines
cgaaaattggtttgaatcgtgaagtttatcatttctaactcacttctcaaaatcgttgataaattgcaaatatatttttgcaaaagtctgtggacactttctgaaaataaattctatactcatgtattttccacttattagattttgcaggcttattgctgcatgttctttgacacttcttcaaaatatcctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcccggttaattagagcaacgaaaattggtttgaatcgaaaagtttatcatttctaactcatttctcaaaattgttgataaattgcaaatatatttttccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgcgtttggattgacaagcccggggggggtggcataatgaataggcggaaagatgacactgatttgaaatgattgggggggggagcaaaacggcgccgcaatttcaaaaagcgacggattaaattgcggcacaactcacaaaggacagccaaaaaaacacgacgaaagcggcaatttcggttacaaaaacagtggcgcttgcattggccttttgctctcgattctcgcgcattggagggacaaaaacaaagagacagtcggagtcagtcacttagccccatttagcctaattagagggatgtaagcggcagcggatgaaaagagggaaaacaactaatgaccactaatgagtggatgatggatgactcatccatccatcacgggccaatcagcagcagtgtgtgtgtgcccacaaacggcttttcattcctcacattttgctgcaatgattgcccggagggggatgaccgacccgttgctcattgtcagatgcaatgccgcaggggtgcaaagtcagcaggtaaatatgtaacaaatccggggggaggggactttgtgatcagtgcgtcattcattgcgtaatatgcgtccaatggatgatgatgattcattcacccttttcccacattccgccgacgtgtgaatgaaatatgtgagcaattttcgccaaaaggtagggaaatcggcgtttgctgattgttccgttatttatgtattgtggcggcgtcggaatgttccggaataattttgcaagaaaacattaaaagaaagggcaacaaaatgattcctctttttagtgttaattttatttgctaaatgaaaagtgcagggccaaaaatggaaacaaatgcaaaatgcagccgaaaaaagagggaggggctgcgcactcatttgtcagccaaatcgttgtaaaaaaagtgtcctatacttaatttcatacaaaagtacagaaatagttttttttgtcgataattgaccccaaattgctcatgctcattagtagggaatagaatttagctttatcgagttttttcttctaaagtgatttttaataccatatttagccatttttgaagggctttactttatattaacaaatttaaagaaattttgggaaattataccctcaatttgaaaaatttatgtccatatttttgccattttatgtccatattttacgatttttggtccatattttatggccatatttcgcaattttatatccatataattacactccctactcattagtgctctatttgctcgaaattgatgcattaccagttataaaaaaaattagcgcaaataaaaaaatattttaaaacaaagcaattattgcaattaacaatacagagtcagagaatggcaaatgggctatacaataagtaaagcgaacagcagaaaataactttaatatcgtaatgggaaagtacaaaacattaaaaaaataaaacgaaaacagaaatattttgcacgtttaaaaacagaaaagatattggttactggtaatgtaattttggagatttactgtgatatttgttactgtttgatatctgcagaatggtgagggaacaaacactaacttaagtgagaaaagtgattgtaatgatgaaaagcaatagatgatgaagctgaagcgaaaggcataaattttggcacaaagcgaaggttttttgatgagaggcaattaattaattaactaattaataaatggatacgacataaatgatgaggatggaagaatgtcggccatttgtgggcaatgtatgaaagaatgggaaatagcgagaaaatagtggaaaagaggagcaaaaacggcggatatagacaacagaagtgtttaaagtaaaggaaatgttgtaataatatgcacttgaaagaatgcaacaaaaagtacataagcgaaacaaaaatggaaaaacggaaatggatggcatccgaccatcgtttcccgtttaatttttaactaaaaatcattccaacaaacaattttggattaaacaatatgggatcagaaaacgatgagtcaatggacccaaaaaaaagaaaacaaaaatattattttaagatgccgacgcattgtcgccaccggtgaagtcgtgctgaagctgttggagagtttcaatctgaaaaccgaagattttaaaaggggggagttggagagactttaaagaagctgattgtgagagcaattcgaactttaggttttaagaaatactcagtactaatttaaaacattaaatccgctttaggccgccgcagtttttcaaaattctacaaaatggcatttaaaaatgcagtttcctccaataacttgggcttaagttccctccgcccttttccccatttttcaaatgcaaaaaaaaacgtggcgacgagcgacagacaaacgttgaaaaaagaaatttaaaaagattgcacaaaaagccgtcaacaactgctggccaaacttttattttttaaatgtgcattatccacccaaattaatgtaatatttgtacaaatttattaattattttaccatcacacggaagcaacgtacaggtgcaaaaaacatcaattagtcccaaaaaattatccgacgaaaccttttaaaataaaagtgcagcaagaagaaaatcaaattgacattaattgcgtagtttgaaaaaatggtttacgcttcagtaacaccttgcgtcaacctcgtga

SEQ ID NO: 3820 - DNA, 1373 bp, Heterodera glycines
gcaaaaaattacgacgagaatgagctaccttgacttcactttcgtcattttcgatgatggcattattggaaacacttccggcatttgaggggttgacacgaacactcgcgtattgggaggaggaagaagaacatccgtaaggcgtcgctatggcattagatgacgacacagccaaattcacacggggctgaaccatcgcacggccaaccggcactttggcaccgttgttgttgtaggcaaacttatggactgtggagaagatgaagatgattagtgaatgtttgacaattgctcaaaaacaaagaagagtaaagtaagagaatccttcaaaatccaaataatattttttaagaaaaaaaggcgattctggcttttcccacgctcattatcagtttacggtcctggctgacaataattaccggaagttggtgttgttttttgcgcttgcgattgccctgtggcacttcttatggtggacggtgatggactggcgcctccggcaacgccgccaccgcctccgacataaacaatgggtcgaacaatgtgtgccatcctttgctgttggtggtgctgatgcttagctgctttttgttgttggtgttctcctgctgatgtaactccgtgctccgctgcgtcacaattcccgcctttgccgtcgtccccatccgccgtcgtcccattcacaaaggaaagcattgcagcgccgcctgctgcattggctcgtccgccaacggtttggtagccgttactgtcatttctgttgtactgctgcacatttgctgctgctgttgttatgcctctgttggcagccgtcaacgatggcggaggtggaagcggtggcgtgccgccagcccctgaggcagaaacagtgccggaaaactgatgccgctgttggagattgtgtggcgaatcatgcggtggtccaacaacaccattggacactgctgacccactgacggtaaagtccattttggcaatgggctaaacaaatacataacgatgcggtaaattgaatattcagacattatatttttgcaaaaaaccggacagtcgacctgtctgtccactcgcgtgtacaccacgtgcgcattacgtggtgtcagtggcgtgccacccaaatgttgttgctgtccgacctgctgctgctggtgttgttgttgctgatgaatgtgcaatggttgaggcaccgaattcatttccaaactggcagacgaattgtaaaggtgataacggtttgactgtccgcgggggagtgtttcgaccgaatccactgaatttggtcaacaatcatatttattatacattaaatatttaatgtttcattgtttataagtgatgtaaatatttttaacacgcgtaaaatgggttagaaa

SEQ ID NO: 3821 - DNA, 3006 bp, Heterodera glycines
ggttagaaaatgttagaatgttatgaaaaatgaagggccaacaaaaaaaaaaaataaacacgcttaaaatcgcggatgagtttaagaacaacaaccaaatatgcaaccaacgcagaactgaagaacaacgctcgcattaacactccaatggcacatacacttactagccaaatcaacgactgatggcggtggcacattttttgatccatcgtcgcatccgttcagcttttcatcggcggcatttctctgctgctttttcattgttgtgttagcattttcaatctccgtttccttctgctgccgattctccgtgtccgcattggcatatttataatcttcatcaacgtcatcgaccagcgaattgtcaatgaacgaaatccctttgtcgtctttacttccgttccattggcgttttgtttttttgctccatttgttgtagccgccgttgtcgtcatcgtccgacgagacaatgaccaatttggaagcaaaatttacgcttttcgtgggtgctgcttgctttcgtgtcaccgctgttgttgcttcataatgagcggttgttttccgctttgcttgtttgacttgtaacggcatcgatggaaggccaatgccaacacggaaacgttgcagtggcagaacggtttcgtgtttttcgtcaagttcgttcaaaagggccgcagttcgctcaatagaattaggcccatttgtttgccgaagtgtatggccaagacgaggagaaatgctcaaatccaatgcgttcaacgagctaaggtgtccacaacaatgtgttcgaataccggccactccttgctggcatggaaaacgagtgccatacggagagtcacttcgccgtccaaatttcgtttcggcaatattttgcgttcctcccctaataccaaaatggtcatgcttgccaaaagcatggcaattgtgttgccaatgttgattcggttgtggacttttgttgttggtggcaaatggtggcgacatcgtggtcgaattggacggacaaatgtgtggcggcaaggaattgcggtgcaatttgcgacttttgttgctactttttggcgagtcgccgacggtcgtcatcgaatggaatgactccattagggagccgcccccataaaattcacctcctccgacagagatgcctttctctctgtcttcagtcctccctgatatgcaattataatatcacaaacagccaattttaatcgatttcccagaatatttgtaatgattaaatacttcaccaaggggcaacatgtcaacaattcgaggacaaagaaaaagatactcattagaagagaaaagacgaaatgattacttcaaaataattaatgaataagtcatgaccctaaactaccatggcgttgcgtcgccgcatggtacgcattttgctggtagtgttttggcgtcgtacattccatttgggcagactgaaagttaggcccaccagctgcatttgccggcgcaaagaaggccctctgttgtccgtcaattagaagaatgcccgtctcatcatcaacggacgatccatagccctttaaaatgtttagaaaaatgaagctaatggaccaaaaaatttggcaaaaaaatatactcacgtcaacattggacgcattgacaatggtggcaaaacgtgcgccgccagggtttgctgccgaatttcgctgctgatggaccagccaaagatcgtcgtccaactcggcaacggcggacggagtggagacggacattttgcggccggggatgtaagcctgttggtggtgtttggaccgtttgttacgctgctcttttttgcttctctgctgcggtcgattggccgctgcagcggtggaagaagcgctatttttgttatgatagaaacaaagtgagcacagagcaatgaataacagcagcacaacgacggcaacaacaatgccaatgagcacgaagaccaagttggacctgtgtaagcagcgcaaatgagaaattgtatgcatttgagcaatgcttgaccacctcaatccacttaaaaattggcccattaaaatctcaaatgcttccgaattgcttccggcattgacggaatttctcggtccattcgatgtcggattggaagtgaaagtgtccgcggtggtgacgctggtcacaggcgtaaacggaccgtaacccttcacattgcgggcttgcagcttgaaatggtaggtgaggcggggccgaagattgcgcagttcaatcgaaagtcgatcgcccttcacactttccatactccaatccctgtcaggcaaatgtggccgatccgaaaagagcataatgtattctgaaaagcaataaaaatttgtacaaatgttatgtttccggatttaaggcttttaagccatttcaaatacagtttaaaagaggaatttattataaggaaaatcactaacaaaatcattacgtaataaaactaaaaagattaaaaatttgaatgttgcaaaaacagcacaaacaataaaggaccttgaatttctccatttgcatattttggcggttgccatgtaagcgttatcgtgccgggatcagcattctcgtgttggttgttgaactggggaccaatgacggttaaatcacgtggtggcgaggagggcggtgccggatgggttcggttgagcgcgttcaaactccaatgagaagattggaccagtcggacagcaaattcgtacaaagtgtccggcctcagtccatcgaagatatgctcagtttctgtgatgttcagctgcttatgttgagactcatctgaattgctaaaaaaacaccaaattaataataataaaaaatgcaattagccgtaccttattccgtatttgatggtgtacatttggttaaatgcattctcatttgggtcagcccatgaaagtcgaatttgtgaggacgaaactgtctccgcaactacgccaactggagccgataaaccgttggaattgcttggcggctgttgttgttgtccaccaaatccggcaaaagtggactttggatcagaga

SEQ ID NO: 3822 - DNA, 5489 bp, Heterodera glycines
tttgaattttgattgatagattgctataaataataactttaaaaaataattcgatcaaaactgcgtaattgattaaaactaaatagaattttattgaaataataaacaaaaattacttcatattatcctcccagtcaattgaaaagttcgagtaagacagatcaaaaattaaagaaaataaaataaattattaaatcattaaacataaattaaataatgaaaggagtaaaaacaagtaaaaataattctttaataaattaaattttaattgttaaattataattgataatgatgagaaaatgttttaatcttcaaaatgtgcttaataaaataaaccgacaatataaaataaggtagaaaaaatattaataaaatgaaaacattttaaaagaaaacgaaaaattatggtgcaatttaataaacggtttattctatcattgctcaaaaagaaattgaaaattgaaaaaaattttggaaaaataaaaaatgaaaaaattaaaataaaacatccaaattatataaataaattcacaaacatagaatctgaatattttaataaaatggaaaataatttttaaattaaaactcttaaaaagaattgaaaattatttaaaacgtaaagaaagtaagctaattttttcaaaaactcttacattcattttatggacttttgtgttgcagtacattttaaaactttaaaataatcaaaatataatgacaataaaataataatctatattattaaaagttgaaataattttaattataacagcaataaaaatttctgcctattaattaaacaattaattttctttaattatataaatagattaaaaattttaaaattaattaaacgaaattcataaaaacaaaaaataatattcagaaatgattaaatattatgaaactaaaatatccatagatagcatgatcatcgtcgtcgaatcgctatcgtcaagaccatgattaaataaaagaaaaaaataacattataaaataaattataaatattaaataaaataattttttatattataacagccgtaaaaaatataaacattaaagataaataataagaacataaaaagaatgcaagaaagtatgaatgaaaaataagtaaacttaattttttaaatttcttagaaagcctcaaaaatggcctcctaacttcctaaaaaattatgaagaattttcaattatacgtgccatgtgttaattttttaaaaattcaaaatttggccataaaatggaaagtactgaaaaagtgagaaataaataattaattttatttaatcagttaatatggaataaatagatatacatacgtaatcagaaaattaaattgaattatctagtaaaagtgacatttatttgtatatatttttggaaatggcaaaaatttttacaaaagttaattaattaactttgtaacattaattattaatgttgaaaaagataaaaagaaaacaatctgttgcaaaactcatcagataagagaaatcttttatcataacaaataattattttaacaattaataaatttaatggaaacagacaaaaatattcaattgcctactttttatggcttttccacctttttaagttatttatgattttttaaacaaatcttattaaatcctttctgtcatttatttgcttgatttttctactatttttattttctccaatatttgccatcaaacaaaaaaaaacttttataaagcatagagtaaatttatttgtttaatattaaacaatttttaaatttttataaaataacaaaaatggaaaaaaatttagtgtaaaaggaagtttggggggattttggagaagaaaaaagtctcgggtctcgggtttttttggtctcggtctcggggttttgggtctcagtctcagtctcgagtctcggggtcgagtctcggtctcgattctcgggaaattttcggtctcgaacagcactattcagcagataatggacaatgtaaaagaaggttggggggattttggagaagattgactattaagagcatggtaaaataatatgtgaaaaaatttaaaaaatggaaaaattaaataaagtaaaccaatgtaatttaaataaaataattattataggaaaaaaccaataaaatacatattaatagaaaaggaatttcatttgaaacagacaaatttattgagaaaaaagaaaaataaaacgaaatatcattgaaataaaaatggtcgcatctttaaaaattggatttaaaatgaattattaattgaatcttaataaattacaaaataaaatttagaaaaaatacaacaatataaaaaaacattaaatttataacaactcataagataaataaatagcaaacagagaacacaaacggaccccccaattcataagcgaacaaattgagcaagacgtgagaattaaaaaatatatgaattaattttatacgcaaactcaaaaataattgccaatattaaaagctgaaataattttaaaatataatcgcaataaaaaataattaagtgttcgagttttgttattaacggttcatggaagaagcctaatttaaatcctttaaaattagttgaaaagatagtagaaatttataaaaatggtaaaaataataatatataatttatgagaagataaatatatcaaaatgcaatttctcaattgtcaagattaaataaactaaacaaaaatattcagcttttcacaagatataattatataaagcagcaaaataattattaaaaatatagattttttaaattaacgtcggaatttaatttaaaatttaaatgattatcttcataattttataaatttatattaaaaaaagccatccctcagcaggtgggtgtttttttgtttatagataaagaagagaataaatgaatatctttaatttaaaaattcttaatttttgcgaatttgaaagaaataattaaacaaaaaaattatattttagaaaatcacacatattataataaattattattataatgaccaaatacaacaaaagtaataattaaataaattaaaaaaaaacgcaaaattataatataataaataaataaatccaagccaaaaatttatatatattaccgacggattgtggcctttatttaataaaaatgaactcgaaaaataagaaaatgtttaaaacaaattaaaaaaatatgtaatacaaaaaggaaaatataaatttgataaagattagtagatatttataaatggtacaaaataataatagtaaataatttataatacaaagtgacttggtacgatgcgagccctgataaatcattctttttaattagaaatttacactagggttaagccccgaccccgagccccccggcccgagacgttttttgggccgatcccccgaccctacccccgatatgtgccccccggcggtccccgacccccgactttttgccctccgaccccccgacactatttcgggggattggggactccgagcgttttaaaaattaaaaagttaattcattcatgaaggcgggaaatattgaaaaatttttgagattttgaacaaattaaaattcattaaaaattacgaaaaactttccggtggcgcctatcggcaccgccggccccccaaaaccatggtgccgatcggtaatttttcaaaatatgaacaccaaggctgaaaaataagattttaagctcaaaaataataacatttagcaacattttttcaaatcagtaaatttttacaatttatttgatcaaaatgctatcaaattttagggccggcggtgccgataggcgtcgccgggagaatttatttgaaaatttgagttcattttgcccacagattttcaacaaaaatgagcaatttttgccgattttgagaaaatttttaagaacaattttgcggactggcggtgtcgatagatgccgccgtaaaaaattgaaaattgggagcttttgatagcattttttacataaaaatggccattttaaagttttttttctcacaaaccagcgaaataaaacattaatcagaaaaaatttgaaaagtttagatgaagcctgaaaatatgaaaaatcttagaaagaaggaatacggacatttacgagccctgcttaatgacattatgagataaaatttcaaaattataaatatatttaagaaatctgaacaattttcgcactaccccaaaatcagaacattcttataaattaaattagaaaaaatatgcataaataattcataaatgttttattaaacaaaaatttgacatattcaacaatgaaaacgattaaaaaaattatttataaatacatggacatgatttaattaaattcaattaaataatataaattaattataaaatcatttaatgagtaactaagtaataaatcagtaaaacataatcaagaattaactcttataaatgataaacaaattaaaatataagtaattctgtatttaatttaatgctttaaattaattgtttatttttttaattaaaagcttacaataaaataaacattgttttctgcgccaattgtcgcttgactccatataattgcttgctgttaaaaatgttgttttagatatatatcaatatattttttattaattatatttattaaagctaactaataaattggtcattgaatattattaaatgtaaattaaattttttgtgtttttaatttttactatttaaaaataatcatattttaagtattgttcattatttgataatgaggagaatattggcaatttcatttttaaaaattttgttcacttaaactcttaaatcgaaaaaatattgaaagatttaaattaaaaaagtatattatataaaaacgtgaaaataatacatataataaaaaaaatcttttgaattaattttcactttctaaaaaaggtatgttccagacaatgaaaaaattctacatcctgtcatgagagagaagtggataaaaggctttattaccaaaattgaatataaaaaataagctacgaaaaatttaagataataaatttcaaaaaaacttagaaataaagcaataaaattaatgaatataaaataaagtgcaaataaaatacctatttaaatgaatttgaaaaaatattaaaagaattttaacttatcaaactgccggcaaaccgacgaagaaagtggagaaaaagagaagaaatgaagatgaaaaatgagggaaataaaaggagagaaatgggaaaagaaattggaggagaaaaaaaaaggagagagagagagagagaaaatggaagagaaatttaattatgattaattggataattttaaatctgtgatttgattcttttatgtgatattccttatttaatttttatgtgatatttcatattttgtgatattctgtccgattagtcactgctctttttgtgcaccattctctgtcccaatttgctcctcccacgctttttgactgatattttaacacgaacatttcctcacttatactc

SEQ ID NO: 3823 - DNA, 2144 bp, Heterodera glycines
  misc_feature (2107)..(2107): n is a, c, g, or t
  misc_feature (2125)..(2125): n is a, c, g, or t
agtataataaaaaaaaatgaagtggatgcataatttaaaatttactataaaataaattttttattaatacattgaaaagactaaaatataaaaattagcacattctataaaaataagaaattttatcagaataaatcttggttttaattttatttgcagaataacaaatgaaaactcagctaaaaattagtccaattaaataattttggtatcgaacgatagcttaatctgataaaaataagatagcttaatatgataagaaataaagtatatttaaataccgacttatttctatggggcgataaacgagagatgttaacacgaggcaaactcatttataaaatatatttaatggttgattaaaagtaaacgaatgtggataaggtgcaatttattagtcatataaatttcatactatttaaaataccaaaatattgtagattaaatattattttgtgtttattcagtaaaatgaagaaaatcaaaaataaaaaatttccttttatgtaacattcttaatactaataaatttattcaaaaagattaataattttagaaatcaaaattaattaaattaaagagcacaaaattcaaaactgataaaatgagagaatattaattatcactaatacacaatttattaatataaagactaattaattttataatctcttttaattctaggcaatttaaaaagtcaaaagctataataataatattaaaccaaatatcgtaaaaaacggatcatcatgcggtttgtgaaagttttttaccaacgagagaatattaatttattattattttaactaaaataaaaatttaatttagaaaattaaaattaatattttctcttaatgcataaaataaaataaaaattttttattgacggacgaaaaagaaaaattattatgcaatgattattctcggattcattttgctgtatattttataccaattaaataatttagaattataagtggctaatataattaagtctctcgcaatacttttttatggataatttaatgcttatttataaaaataaaatataaaaaattataaatttaaaataaaacaagatacgaatctgttacatttaaaaagattacttgatattaatgaattttttttttgtttaaattgcaaatataattaaagaaaacaataacaaattattagtttttgaaataattactaacgaactaagacgattttttaaattaataacaaaatattgaataactaataatataatttacttttaatataatttcacaattaagtaaagattaatttaaaaaatttagaaataaatgcagatgaatttaataaaaaaacaagaacatattgttaaataataattaatatctcaattattaagaaatcaatcaaataatccatccaatgtaattaaattgacaacaatgagcagcacttttgtgaataattatggttatttaaaataaaataaacatttttaagcaatcgacaattaaaaagtcttaataaattaagcataaaagctaaatattaaagtggtcgtgagcaggaataaattgtataatattaaaataatagcaaaatattaagcaggaaaattcaaactctaaaaatttttttggtatttccttaacaatattgaagttgaatattaatgctatcaaagattaaaattataatatcatcatatccttaatctaatagataatatggttcagaaattaaacgtattttaactgagcattcaatataaaagaatattttcatcaaaccatatttaatttttcttttggttttttcttaaattaattttttaatagattcacttaatttggtttaatttatgtgttgattcctgccgagtaatattttttaattgaaagtttaatagactttaccaaaagatgctaattgttgaacgtttcaagttcaaatttgttggcttttggtttcaattactatttgttagaattagagacattatccgtagtttttgaagaatttttaattttattttaggatggttaaataaccctaaaaccaatacgctcctacttactattaaattcatattaatatacattttgatgttcaaaaagtatatcanataagcgacacaatgtanaatatttttaagtgagttt

SEQ ID NO: 3824 - DNA, 987 bp, Heterodera glycines
aatattagtttaaaataataaaaaaatattaaaaacacggaaagactaaaacggccagactaaaccggccagactaaactgacccagtccgaaaaactagggttcggaccccgcccccgccgggggcgggacaggttttttggcctcacccccgtccccgcccccgtgactttgacccccgccatcccccgcccccgcgaccttcacccccgcgggggcgcgggggtgaaaatacacccctaagaatgacatattcatggataaaaggcaaaaaatttatacaattttgatttttttaaccattttgataaattttttatttattaaagttaattttattattggtcattgatgtgtagtgtggtgtagtggttagtgaatcaaccttgacattactttctgtcgtgagttcgattcaggttgacggtttcttttttaatttatttttttaattttaaaattcgcctggcgctgcctatcggcatcgcagggcccaaaaaccacctgtcacttctaattagtgtcaatctacagaggtcccgggtgtgttactactattatctaattattttcataaaaatcatggaaaatcctgtgtttgcttttagcactttttgaaattaatgtttatgtggcaaatccatatgtgaattcttagaaaatttaaaactcacagggttgtgatttcatcaggctattgtaattacacatttcaataattaaagagccgaaaaggaaaaaaattattgtaaaatgttaatttaaataatcaattcgaatttatttaaatttttcttattaagtattcataaaattgaatggttttttgaaaaaaattttttgtaaacattcaataaaaataaaaataaaatattttccaaatgtatctttggccaaagaaggggcaaaattcgatatttacagaaaatttaaatattttatatttttcaatttttaatttatttttcatttatattttcttccgta

SEQ ID NO: 3825 - DNA, 1712 bp, Heterodera glycines
  misc_feature (1620)..(1620): n is a, c, g, or t
  misc_feature (1649)..(1649): n is a, c, g, or t
  misc_feature (1655)..(1655): n is a, c, g, or t
  misc_feature (1672)..(1672): n is a, c, g, or t
attcattttaaaaaacaattgatcaaaatgtaaaagtttgagctgttgtctccagttccaaaaattaccatctgatggctgtagttccgcagctgaataaacacaaataatttttaattatttaaattattattaatatttaccacaatttcgtcattttgtccatcaattgcgctcactgaacgtccttcacaatcccttgtccccaccgttccgtcgtccattgaccgaatgacgaaaattcgtgtggttgcctcataaccaaccctttaatttaaaatattttaaatttaaattttctcaattttgtggccctatttgggtttttaataataaatcctgccgattttttcggcttatgtaaatttaaaaaatagttttctaaaatgaaaattcctactttgaattaatgtcatataaaaattgggaatggcatcgcatgccattgacaggattgcacggcattgcccactcaaaaagtcggcacaaatggacagcttcacggttggcaccgccaacgccgatgaatgtatgcaccaaatgggttaatggtgggcccaattgttcttcggtgtccacacaaacaccaccaagaatggcctaaaaatggaaaattaattaataaatttattttttaaattttacggtacaccgccaattacagtaactttcttgcaataggtgatcccatactgtagccaataatatccacttgagatgaatgagtaaattgtgtgattgcacgaatcattatgcgaatctgaattgtgtggtaattattttcgaagagaaaaatcgattaaaataaaatattaattttttaattagttaattaaatttttatttttaaaattaaactgtgattaatttaattattttattataatgccttcattagacacctactgaggtaattgttttcaaggaataaagcgaataaaataaatttaataattatttttatttcgacgaataaaatgatcaaaatacaaattaaattagggttgagcggtacacattttaaaaataattccaaacattaaaagtttatcatctttatcaaaatttataaaactatttaaacctatgtaaaaataaaaataatattatggaataattttttggcattaaataaattaaatttgatgaaaatatatttatataattgtaaattttaattgaaaattcgaatgacatacaaaaacaataaacaattatgtgtatgaattagtaacagtctttatgttttgttgaaaatagcatttaatagattcttattaaaaaatgtttctttaattttttttttttaaattaaggaattttggtttggcgatgccaacaaatgtcgccggaaaataaagtgaaatgaaatttgctaacaaaatttttcataaaaaataacttctttttaaaaatttgtaaaaaaataataatttcctttttaaagttttgtaaaaaaattaaataaaaatttcctttttaaaattttttaatattcagttataaatctaaacaaaataaatacatatcattttggagcaaatttttaaaaatgaagcaagaaagtaataattatacagaaatataatcaaattgaaggattaaaaaaaggttcattanaacataaaaacatgactatatacgataanatatcnaatcattattattcatncatgatgaatttgaagaaaaagaatctcatagtcattact

SEQ ID NO: 3826 - DNA, 2528 bp, Heterodera glycines
tttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggagtacacacatgcacatgtggtgtagtggttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaatcacaaattttttcccggcggcgcctatcggcaccgccggccctccttgtcccccaaaagtcttggaaaaaacgtgccgcgtaaaaagcggtgttgaaagcaaaaaaaaggtcattgatttacattaatttacatggccggagaccccttcgcaaaattggaaaattggctgctgaccccttgttttgcaataatctgaattttgaggtctacatctgaattttagtgttctatgtcctgaatttgaaaaaaaaaaacttggtcaacctgaatatacatatacttctgaacaattctaatgctaaaaaacaggtactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccgatcagtaccggtaccggtttttttgcaattaccgattaccgctcaactctaaaattaatttttattatttaaattaatatatttttattttaaaattaaactgtcattaatttaactattttaatgcgtatttagacagacaccaaccattttcacatgatcacatttcattgcatcacgtagccatttccatcccttcataccgtaaccgtaagtggtcgagtacaattcgctgtcacggtagccgcctttttcgcggaacagtcgccgaacgtagtccaactctcccgctaaatttgttaagccgtgcacaaaaattacaggacgttttcttaaaaatttgaaattggcttcaataggctaattattgaatttaattttgaaaaaaaattaattaatttataatttacatactttgccttaattcgcccttttccaccgccaaaacttccgtcagtgcccaaatctctgcgtgcaatgttcttctccacctcatcattgaagtaatttcgtagaaattgtgaaaatgccgtagaaatagtgccatttgtgggaggaaaagtgccaaaaaacagaagcaggaattgacaaattgcgacaaaaagtgccaaattcatttgctatgattttttaatattgggatatttaatattaaacgactaattattcttctaattaattgcttcacgttaattagctagccaaaggataatttgtaaagatcaaaaaatagtattgaataaacaaaaacggttaattaccaaatattgagtgtctgatcaaaactgattaaaactacttctttttgaaagaccattgatagtctaaatcattaattataaataaatgattaattagcataattaatgacaactcagggcaatgaagaggaaaaatttgttggttggataatttgaggttcattgaaaaaattttttttaagacttaacaaaaggcttggttctaaccagacaccgatactgattagatttttgagaatttatcagttcaagccaactatcattgaataaaacttgacaaataagcaataatgcattataatttgacctgatcaaaaattttttttttctttgatcacaaaatgtatttgatttgtttgattgtcatttttaataacaataaaaactttccaatgtgattattattattattattattatttatgaatggagaaaagcagcattattttatttatttattcaaattattattatttttttatttaagcacccaattgttattggagtgcggcgcgagggcgcgacacaacccgggacatttggagggcatcatcaccgccaattgtgtttagttggggggggggggggtattaattgcgcaatttatgatcatattatgtttactccggcttggccataaagcgctttgtgctgcttgttcattcattgtctggcatagagtgtgtgtgttttggagagagcgaaaaagagggcagtgaaaagggtgaaaaaaagtaaaactccgaaaatttatttaaaaaaaaaattttaattaaatttttagttaatatgctttacaggaattgtttatttttatgtatataaattttgggaaagctgaaaattgagcaaaaattttttttaatgtgattaattggggttaaaatgttactaaatgagt

SEQ ID NO: 3827 - DNA, 5606 bp, Heterodera glycines
  misc_feature (279)..(279): n is a, c, g, or t
ttttttaatgtgattaattgggggttaaaatgttactacatgtgtcaagagttggttttttgaatcttagtcaagagttggttttttgaatctttttttaaattagaatcatggataaaattgtacattgaaacccaaaaggtgacaaattcgtccaatttttctatttttgttacgaatgattaaatgattaagcaaaaatgaagagatgatctgcgattctcatttgcacaatcaccaattaaaaatcattgcaggcaattgagttaattggggggngggggggggttaaaaatgtaaatgagccaaatttagttttttgaaaaatatttatgataaaaatttataacttgacacacaattcgtacaattttttttcaatttttatttcatttgattaaccaaaaatgaagagatgatctgcgattctcattttcaaactccaatcaccaattaaaaatcattaatgaaattacatttttggtaaaattttctttttaaattttctcaaccgatcactgccgatcaccatcatcaatcacatttatttgtcaatttttgtttgacttcatctgctgctgctgttggtaaatcgtcggagtcggacagaaaagggaaaccacgagcaaaaaagtctaaaatgctaaaaatagaaattgcctaattaggtaattaacaaatttaggcacaaatgcccttgatgatctattaatttagccctgaatttttgaaaattttaataattttaatggggtaataaaccaaactcatccataccagagatggcattccgaagcccaaaattttcccggaatcggaattccgagacacaaaattttttttccggaaatcggaattaaacccaaaaaattgcgaaaatttttgaaaaaataaaaaaaataataaaattttctaaataatttaatagtaaatttaaaatatcaagtgaaaggtgatttaaaaaattggaattctatgccatccctgatccataccaggggtatgacgaaatttttttctaaaaatatcaaaatacactaacaaaaaatttgccaaaatttcgaaaaaattctctaaaagaaaaattttttttattaattttttattcacttaaatcattaaaacattttaaataaattttcatatttttgcattaaatttatttcatacattgaagcaataatgcttcttttgtcgcttcggttttgtccttttggcactctgcggaagtgtggccaaattcggcaatcagaaaaaggcacagcaaaataaagacagaatattggtgataagaatgcatttaaatctgtcgggattcattaatgttgaaagttttttttaaattaaatatttactatctttcctatccttacgaagaaattttatgttttttttttaaatcttccgttttttatttgaatattatgatgttctcaatttgtttaaattggggcgagcttttttgctcaaaattaattaaattaaacatttttcgaagttattatttggaagccattgttgtgctcctcctctattaacctgccaaaatgcgaaaaattgagtttttggtgagccctttcgtcgtaaccttaaaagcagaaagtaaaaaattcgaaaaaaatgaaaaaaatcgaaattctttaggggggggggggacagaaaagtataaaaaaaaattaactaaataataacacacggcaaaataaataatttggcacagcacatgtttttacattcgccaaattcaattgggccttaagtatcatcggcggggcagcaggtgggcgtcggttttggttgatctgtgcagcggtgtcaatttgatgtgagtgatttgggcaattaactaattcatttggcttttaagtgtgagtgattcggagtaattaattaattacttaattttccttttaatttattacatataatgagagatgagtttgaaaaaatgtgccgccaaaaactcgaattttgttgacaatagcaattgggcgtgatcatctgatcgcccatcagcaaccaaaagttataagaggcgtcagatcaattacgtaaaaaaaaatccagggcaaaataaaaatttaattggaatttgagactaatttttctgagagattattttactctacagagagaggaaggagaaggaagtagattttcgttaatttaattagggagtgatttttaaaaaagtaaataaaaatatgtcctcttattgtaaacgcaataaatttttcaaatttttttattccgtctaccatatccatcggaaaaggcaagaagaagttttttttaattaaaatatgattttattttaatttaatttattcggataaaatagtgatcaggaaaaaaatgctccctaaattttcgggccattagaattttttcatttttaagaatcttttgtaaattcttaccaaaaaattgtcaaaataaacatagaaaagaattttaattattttgaatttgaataattattagctttttaattaaatcggtgatagaaagagtgaaaaataatataatgttatagaaaggattttaaccaatttattagggatttttagactacacataccgtattcctaaaaataaagcctccgaggtctttatttttcacgccctccccctccctcataagttgggttttctcaggggtctaatttaggggagggatcaggttttaagcttataaaaatatgctccttaatcaactcaaaaattggatttagtaaaacacacattgatggtctatgtatgtaccatcaattccaaacgccaaaaagacaatttgccaacccggtttttatagtctgaagaatgccaaaatgtcaaataaacgaggcaatgatggaacaaaatttgaatcacataaaaatttgaaaagatcaatcggtgccaatgcgacacttcgtcaagcatttctccttcgtttcgaagcgattttcgttgccgccacatgtctgcgcaccaaacggataacattgagcggtgaccgcgtcaaaatagtagcgcgtcagcaacggtgttgacgcgtgtcgcagttgcgaagcgtcgtcgtcaccgtccgcaagcccctcgcctacggtagcgcgcgaatcgtctactgtagcagccgccactttgatgtgatcagtgtccgttgtacgatttgtcgccggcgggcacatgccggattctgttgattggattttttgcatatgtacataattaaaattccaaattcggcgcaaaattttcttaaaaatcgttaaataaagtattaactttgaagaaaaccaagtaaaagtcaaaattttccattttggcttatttgaaataaatttcttattttttgaaagtttaaatgaccaattagttaaatgtctgaactgagctaattaataggatgattgactaattatgaaatgccatactgaaacttgcctggaggcaagtaacaaatgcttggataatgggaaatggcctcgaagattggcggcccgggcagccttggggatccgtcattatggggaagcagtagcagaacaagcacagcaatccttctcaacaaaaatgatgctgctgatgaggaatgtccaaattggcgatgtgttattatgggaaagttattctgataagctgataatgccattctaaatatagaaaattgttatagctcataattttcattattacagtaatttgaggagttgaaattgtaacaatacatcaatttgagggcttgaaattgtatatttcttttaaatattttggaaaatttcaaaaaaagaaatttcggaaatttaacgccgataaagaaataaaattgaataaaaaataaatattggtaaatcattgctcaaaacatgttaggttggtggataataactatttcgattcatttaacccatgattttgcgctgatcaaaacaggctctgctgtccaatttttggatggatcaaaatccgaaaaaatctccaaaatcgccgctggcgctggcggcgcgatggacagacagtaacgccaaaacactgcgcactgcgcgcggcggcgacccgctgctcatccgggctttgtgaaacgggaaatgaagcgggacaacagcaggacagtgaatttgggggagcaaaaagtaagccagagccatacaaatggataaattgtcaaaatccatgcgcgaaaatgaaaaaaaagaagcaatttgaaagcctcggggcggagtgtgaggggaggggcaatcaaatcaacgacggcaaaacgggcgaaaagcccagcgccgcgggggttcaatgggcggtggagtaatgccaaacccatttttcatatgcccaaacaggtcagtttggaggtctaattaaaaataaatgaaaagttctaactattagtgatttggaggggggggggagggaatccgaagttttttggtcttcagattttcggtgttatttttattaattaatttttcactaaaaaatgaccaattttgtgcttttttatcaaattttaaaaattttattcttttcaaattttaaaatatttgtaaaaaaaattgtaaaaaaattccaaaaaaaaaaatattattttccttaaaaatttttattttttattcccgacgggaatcatttttatttctatttctgagggcacccaccacctcactcctctggttgtaagcctggcctgctggtgatatctttgtagtgccaaacactttttacatgaccaaccaaccagacgacattttgaggcctcattagtaacaaatgagataagaaactttggattaattaggtgaagaagaaaacatcaagcgcgaataaaaaaaaagagaataataatttgaatgtctcctcaatatgggggaagcagcagcagatgttacaatattagccccgcggtgaatcaattagcggtggggttgggggacggtggtcgttttacgtgagccgagttggtgtgaatgccaaaacttttttgttttatcacacccgccaaacaaacaaacataattcttggcttcatggtaattatcctttttgtcaagcgccctaaaatttaattttttttaatggtaaattaccataaaaaatttaaaaaatttgagaggggtgacaaaaaggataagtaccgccggcttcattaggataacatcattttcgatcattttatcactaaaaaaagtttaaaattttgattttcaaaataatgtgtaaaaagttaaaaaaactgaggggtttgagaaaaaacgctttatgaaaattagaagggatattttggcgttctgacataaacaatgcaatttttcgggtgaataagcctttctgcctgaggcaagctttttctgcaggatgcacataaatgggtcatctcatctctccatcgcttgtgccccccccctacccaaatttccaacgccgcattttttttgcaaaaataattggggcttatcgaagcagcactttttcgtcacattttcactaacgcaatgctttcaattttttcaatttatttttattgctaattaaaaatattttaaaacaaggactattgaaaaccaaaaagaaaaatagggaatttaatgaattaaattagaaaattttgcaaaatcgcctaaaatggt

SEQ ID NO: 3828 - DNA, 6630 bp, Heterodera glycines
catgtagaaaaagccggcgccgatgacagtgccaaccctttagacaaagagcagctttcgtcgtcggagtgcatttgaaaagggcacgaatgcttttcgactgttgctagcggacattttgaattatttatttatttttattaattcccaaaaagggaatatttacaacaatacatattaacaataaatctaaacccttaaaaaagtggtgaaagtcatttgttttcagacaatcaaaaaatttcttttggagtgggaggtggaaaaacaaaataataaatgagcaaaagattgcacaggttgcgcgcgtcagtcttcgcatttttacaaatttattggtggacaaaacaaatcaaaccacacggtacaaagttcgcttaatttaaggcgaaaaaaataggtaatattaaaatgagtaagtaaatttcaaaagtggaattcgtccttggaaatctttgaaaatcggaccctgattgtgagaggatttgttgaattatttgaaggttagcgtagcttccaaatgataagaagcaaaaaatgagaacatcgcaaatttgatttcatttgaatcaaagttttgccttcaaaatttgtaaaagtctatggcaacaccaaacaaagactgaatgaatgaataataaattacctagcaacacttttaaagattgtaaaaaaatgatgttttgccttgctgattgtggtgagtttcatcgtcggcggaggaatgttaaataaaagaatgaaaaagggaaaggggaggttaaaagtgaagggaaaagacaaaatcgatcacttcaaatgaaccctttcatttttgttccttttccgaaccctcccccgctttttcattcactgcttttgcttgaacacaatcagcggcaaacgttcaaaaattgaacgaaggaaagggtttcggtggtacgatattttcaccaccggacgggggtagattcacttcgatcatttttaagcgacctctccactgatcagagggtgtaattagaccaccaaaatgtaaataatttgaatgttggctaagaaaaccttttcaggaacaccaacaacaaaagtgaaagttgttttatttaaaatgtgtatacaacaatatgcataaagtacaaaaaacaatgatcaacagacataattatggtatacgatacggtactacgtagtgacagtgacacctgatgatgattaagcttcgaacataagtcaatataatgtttggtagtgtgttattgaattttgtgggattgggaaaagtacaataatttggtatttggcccgtcatatggtcttggatgtgtgtagctcgaatgaaattgactgtacaaacgcgtgaaaagaaagttgcttgaccgcgccgagcgctaattaattgagctgtttggtgggcagagtgaatttcattttcggcaccgacattcgcccgatggtgcccaatcccatggaggcggaccgcgcactgcgaacgacgaccgcggaagcgcttttgccattgcactgaaagtcttgacgccgacttgtgccgttggctctgctggtgatgaatgtgtcggggcagaaggcgctgttgccttggcccagcaagtcttgcatatctccgccttcttcagtctcctggaagcaattttaacattgaatgaatgagtcaggagaaaacccacctcacagatacccagcagatgcggactgctgctcaatttgcgcatcccaccggtggacggcaaaaagttggtggttttcaggcgggaaacaatgccggacattgctggcgaagtacgaccgctggacagacaggacggactgggacttctgctggacagtcgggaatcggggctggcctggaaagtgttagtggaaacaaaataattagcaggttggccaattaccgtccgtctcattcgacccgacagccgggaaaactctagtagttcttgaatggcatggggactaatccgatcgcatgacgaatggagactgctggtggcacgaaatgtgagtggcgctgatggggaggaattcctgaataaaaaatgaaaatcaaaaacaaatgcccgagcagaaaaaactactcgccttcttgtaagggacgatgaggaggggcgtttgatcaaattggcggcggaagagatcggcaaattgcacagattggtgaagttcggatgccgttcgagcagcatgttcggccagcagtggacaacaccgttgttgtttggatttggcgtgggtggactggtcgccgagcacggttcgagcagcagaaatgaagagccgttttctttgccaccaattccatttgaaatcggaaacatttccaggctggaagcattacgcatccgcgaatggttatggccattgcgtgttgtccgcattttttctggcgatgatggaagcggcggaagatggccagcggaggacggaagtgccacgcctcggccaggcaccggtcgtggggcggacgcaccaaaaacggctgaatggggtcgaatccgtcggacaatgcctccgccgcttgcactttcatttgcaacaagcggaacatcgaacggaaaggcactttgaacggaatcgacggcggtatccggcgattgatcgcgaaattcgcaaattggggcgagaatccgttgcaaaaagggtgtcgaagtggcggatggaggcggaaaatcgacggactgtgccgttgaagaagtcgagggagggagggatgccagagcgtcgtcttccgactgggattgactttggtcggtggaggaagtcggcttctgttgttcgtccgcctcaacttcgtcctccaaaatggccgatggacccggcgcaaaactgtcgttgctattcgctcggctggtggccaacaaattggaacgggcggaagcgtcgcgaggctttgcactgacagcaacgccagcagacgacgggacgacattgaaaaacctagaaattgttggtttaattcgattcccggaaagtattccgtcggtgggcagcgttaaccccgcacacttttcacccccccccccccccactgacctggacgattgccgcgacgaggaacgcaagttgtacgaagacaactcctcctcgctctcctccttcagtatggagtaggcccgccgtggtgccggccctcgccacgagttgcttctgctccgactccgattttgattcgccgttgttgcagcagtgccaccgccgttggacagttgggaggagaggtcgctggacctgacaaagggataattaataataaaaagaataattagaaaatttaatggcatttattcaccccatttggcattcctcaacggctgccatcagacgattcgcctgtgcctggcgatagcaggaaagaacacgttcggcgagcagaaagtaagtggccgtcaaatgattatattcgtttaattcaatggcactgaaaatggcaaaaaagtcaacgaaagtttcttaatggaaatgaaaaaaattggtaacagaaaagcctggccatttcccctggaaaaaataaaaattcgaccctatagcattttttaccaaagaatttcctcctctccgccaattttcccggccaccatttgctcgacaatggtcgcatgagcacacgcgggcaaatggtcgcgtattatcagtggcagtgcctcggcgtgtcccttgtcgccggcttttacctaagaaaaggaaataatgacaaatccttcatcaaaatgtattccattttcaccgacttacccatttgttctgcacaatttgctcaagggttgctctacgcgacggatcacgcaaaagcatcgacgaaattagcctaattaatggggcgggggaaacaatgtaatcacacaaaatgccggcgaaggaataccttcgacaatcgacggacacgtggtcgggaaacgaaaatttgcagtccaaaatcctggtgagtgtttccgagtcgttggactcttggaaaggcaatcgaccacagacgaacatgtagagaatgacaccgagggaccaaacatctaaagaagggggggggaatgaaatttaattaccaaattttaattgggttttcaccgactgccggcgcatcgtacgaatcgcccagcaaaatttcaggtgccgaataagctgtaaatggggtattttatgtttgctatttttttttattaaaaaaccaaggcttccacacgacgtttgaagctgttcgccggggacgaacaaattggagaagccgaagtccgtcagtttgaccatgccaagccgttcaaaaaacaccacattttcaggctgaaataacaaatgttaggaaaatagacatttaaaacttttttttgggatgggcaatggaaaagtacggcaatttgtttattaattgtttttgtctctgaaattccgtccattgccaaccttcaaatccctgtgcaccacgtgtaacttgtggcagtagttaatcgccttgacaatttggctaaagtacagctgcgcctccgcttcgccgcctccgcccttttcgtagggtcttctcatcacccattcgtacatgtcgtagtcgcccaactcgaggattagaaacagttttgtctgagtgtcgatcacttcgtacagacggacgatgttcgggtgctgcaccaatttcatgcatcggaccttaaaagttaatatagtaatagaaaaaaaatggaatttgttttgccatggcattaaattaggcagatttaactattgtattgaaccattccgttgcctggacttcattctattttaatttgccctaattttaatttaaaaaaaataagtttccgggtgcccaatcggtcggtacaagtaataaaaagggttaattttgtcttcaaactttccctacaatttgtctttgttcaattccgttttgttttgctcccccctttttgttttgcttttcccacttcctgcatcatgtgcgcctgcgagaccgggtccagccgtgtcttgtcgatcactttcacggccaccttttccccggtgaacacatgccgtgccaatttgaccaccgcaaagtgtcccttgccaatggtgtgctccaagtcgtacagtcccgcaatccgtgcatcattgatgtgcagcagtgaggcggaggagggcgttgcgctgctgctgtttttgcgacgcaatttgttgctggtgctcattgacgaacaatgtgatgtgattgaaataacaattcggttctgttgttgctgctgaggaatgaatatgctcgggtggtttcgttacttttgattatgttcgaatgatcgctctttgaccttcgctggtggttcatcagtttttgacaaaaaaaagaaagaagaaataaagtaaataaaatggaatgattagagataatcaaaaattgaatgacagcaaaatggaattaggagaagggaaggaaaggaagtagggaaaaaagaaaaagaaaaaaccaacaattaattttaattacccaattaggtatgtattgaacaaaaattaaaatgaacaaaatgaacgatgaagacaataaacaggaggtttaaagcgatttgaaaagattaaaataagaaaatttgaagaggggattaaatttcagagttcaaacgaagttcaagagaaagaagagactttaacaatttcatttccggttcgaactttgattgatttatttttttgttgttttttttttactcggactcagtcggttgcttttgaaaaataaagccaaaattttaaattaaaaccattaaaaaaaactaaacggcaattaagagaaaagtgtattttttcttaattagttaaattacatgtatattctaatattttatttatttattcaaataaaagaatttaaaaaaggcaagagccgcttacatcttttggatgtgaatggtcaaatctccaacatttttctaagcttattttataactttgaatggagtttattgaaaagcatttataaaaaaaagaattgagaaatataattattttattatgtttacatttactgtatataaaatttaataaaatcaattaatttttttcaaaaataattaaaataaaaaaattattttgctactgaaaaatacggagaaaataaatggttgaaaatggcgaacaaaaagaaatgaacggcgaagggacgaacaaacgaactaacacaaccaacacatgtttttctttctttggagaagccttccattattttccgttgtccgattgaatggctaaattgggccgagggccaaaattgtattaaaagacggagggaaaatgctgtggcgggcggcggagagtctttcccccgccctccgccaatccgtcggctgtcagtcgagcagaaacaggcggagaatttagccatcgcaaaaaaaaggggggggggggagctgttttacgactgttattaaatggttttttaatttagccattttcagtgaaatttcggaaaagtgaatggaaatgaaatgggggggggggtaaatgataaatgcaatttgagtggcgatgagctaaagagaggggcgagaagcgaatttgaaaggatggaaagggaagggattaggagggagcacgcgcattgacgtgtgaggtcaaagtgagaggagacccgcaaatgcaataataatccgtaaacatttcatttcgaatttgcag

SEQ ID NO: 3829 - DNA, 1621 bp, Heterodera glycines
ggattggcactgtcgtgacccgccctcccccctcctcccccactcttcgcggcccctcaactttttcagctgttcgtggattgagttggagaaatgtcccactccccccccccctccctttttttgattctcgcgcaaaaaaaaacaacgaaatttcaacaaaatgatgcaaaagggcagcaaagcaaacaaaaaaagacaagcaattaaaagcgagaacggagaaaagaaatgacacaaaatacaaaatatttaatttaaataattttaaaatttctaaatttttattcaatggattaaatgggcaaaaaaaaacgcacggaaaaattaaaatttaatggaacgcataaaaaatcatcggaataccgactaatgagtgaactgaaaatgcaaaactaattcagtgaaagatgaaattccaagaaagggatgggagggaagagaagagatgaaagaaaagaagaaaatggcaccaaaaatggaattggcagaggattaaaaaagcctaaaattgcgacacaaaattaatattgcttaatgggaaaggacacaccatagaagaaggaaaagacgaacggagattagagagagtgtgagaaagtgagagggagagagagagaaagagaggggagaaaggagagagagagggaggaggaagaaagaggagaggaatgaagaggcgaagggaggggagatagccggggaaaatgagagggggagatagaaggggaggaagagaggggagagagacggagagaaagagaaggagagagagagagagtggaagagagaggagagagagggagaaagaggagggagggaggagcaatgggagaaatctgagagagagaggggagagagacggggagaaagagaaggagagagagagagcggaagagagagagggagaaagaggagggagggagagagagagaggggagagaatgagagtgaaaagatgagagagatcgggcaaattaattataagcaattaatttttaaaagtatcgctattttccaatctctgaataatcagcagagttatcaattggtactggcattgctttacacgcgaaagtccgatagcatccgtttgccgaacttctgctgcacgctgtgcttggacatcacttccacacaaagcacggccaacctcctgaacagtttattcgtctcaatgtgttttgtttttggcattccgcagcccactttccctgatcaaataactcttcaatggcatttccctctgatcagacctccccgaagagattccctctgatcagatcactttccactaacattcccccctgatcaggtctctcccatggaaatgtccccaccacctgttgcatggcatttcccgcgactgatcagtcagcgcgtgccgcgagtggagtggggaagccatgccaaaagaggtcggctctgctgatctccactcagcacagtaagtcagtgatcggagaccgcccgaagaagatccatgccaaagccaacgatcggaccttaaatcaatgaacaaatagttgatcgaaatatcggctatcagaagatcgtcaaccagttgtgatgatcgaaaacattgcgacggtcgaaggtgtacaacggcacgtgggcgtgg

SEQ ID NO: 3830 - DNA, 1068 bp, Heterodera glycines
aaaattatttttaactttataaaaaacccgaattgttcgttgagtgatattaaaaaaaaaactttttttaaatttaattttttcgggagggcgagagaaaatctgctcacttctggttggattttttaagttattgcatttaagagccgctacacccccccccccccctaattgtaagagagactggtagcaaaattcttagttttattagcaaaaagggcccaacttttgccggggcaccaacttttggggccctgcccatgcttaaaaaacgcactgtgcgactcgcttcggcaccaactgctgcacgcgcgtgtccatcagctcggaggtgcgcactgtgttgcgcatgcccacgctgctgcccacctttttgtgcccgctgctgacgacgatgaccagggcacggagttggggccaatgggcggtgggcgccagtttctgagaggacggaacaaattcattgttaaaaagcagttcattctcattctcgcatccaacggaatttaaaaaattaactgatttcattgattcgtcccaagaataaaaaactaaaaataacaaagatagaaaattaaagaaaaatttcggtaaaaaattcacaaaaaatcggtgtttttcttagattttttagggggggggcaacggggaggggaaatggcaaggggaaagtgcatccatttttggatagataaaaggaactgggaaaaaactaaagaaaaccttatacatacatgaaaagggggggggtcagcggccaattttgcgaaggggtccagccatgcaatttgacgaccttttttcttttttttgctttttaaaatctctttttttttgcggcgcggttttctcaaaaaaatttcgcgaacgcgggagccggcggtgccgataggcgccgccggggaaaatttttaaaatttaagtggattttgtaacagattttcatcgaaaattggcagatttttgcgatttttagccaggcgacgacttttttcttctttaaaaaacgctttttttgcgacgcgctttttttaaaaaaacttttttttggggggggggggggggggg

SEQ ID NO: 3831 - DNA, 4762 bp, Heterodera glycines
cccccccgaaaaattaaaaaattttcggggggggaaacgacgtggggggaaacgacgggggggggaaacgacctgctccccccattcccaatacaatttttttcaaaatttagacgtcgattgagaaagaaaaaattcgcattttataaaatttttatactaaaagtttagtagtttgaataaatgttttaaaaaatttacccacattttgacaggaaattccaaattctaaagttcgacccgtatcacccgggtccagaaacctgtatttctcttgctaccacatccaggaatgagtcattcatttctcgccgaatccaacagaaatgctactcacctcgcaaagacagtccgagtcgttttgctgatgagtgcccgccttccagtgaacaaaaccgccctgaatgctgcgacaagcggagcccgagcctgggaaaaagagcaaattacaaagactttgctgcagaagaactcagaaatataacttttcaaagaaatttttgtcccattttttacataaataaaatatttaaatttttctggttaataaagtttgtaaagtgcttttgaacaatgccaaaatgcttaatttggtttattgttagaaaagttatggctaaaaattcgtccgacgtcgttttgtcctctacaccaaaatttaccaaattatcccacttgaaaaaaatgtgctttagtgtagatgctaattgtaagagacgtacccattcgggccattctgacaatgtctcgctccggcaagcggaaaattttgccaagcccaaacgcaatggcggcaaaaccggcggcctgaaaaaaaggaaaattttacttttttttttttttgttggtaaattgtgttggaatttacgaaaagcaaagtgaagggaaatgctttaataaacaaaaatctcaaaaatttaacaaaaattccctcttgaccgtcgctttcgacagcattggctctaaccaattttttgtcccaaaaaatcgtagccaaaggaagaggtatcaaaaaaaacattttaattttgggataacattatctttttgagcttgaaaagcaacaaatttttgctgggaaaagaagagaagcgcttacggatgaagcgagtcctgccgaggtcggaaaatttgtgctcgactcaatctgtaacgaagaattatagaaggatggtgccgttattttggaaaattcgattatatttttggcacttctattaagaagggggtcgacaaaaaatcagagtaggaatcgaaaaattaaaaaaaaattttgcgaaaccaaaggtggacccttttgattcgcaatttttttaaatttttggtgcctcccttccctggtttttgcaacaaaaaattttaatttctagacctttattttgattttgtcgacgactcctaactctatataaatgcctaatttttttaatttgcaaatttcactctttctctccccatttttttctctctctctctcaccttggtgtgccaaccctttgaagcatgctcgcccttcagttttcgctttctgtttgagtattcacgaatttgcttaaaattggggaaggagttataaataataattttaaaaaatggatgaaaaaatatgaaaaataggaaaggcacttctgttgttttgtttttttgttacaaacagcaacagcaagtaaacttggtaatccaacggacttggtgtcccaacaagaaaaaaaaaacaaattttctttgcacatatttagggtaaaatgcgctaacacgaatccgagagcagatttagcaaaacccattgatttttgtcatggctttcatcaattatttgaaatttttaggtttttataaaattagttagcggtaataaacccatatactaaatggttttatatttctgtaaatttgaaaaggtaccccccccccaaaaaaaaataaaaacctgaaaaacgtttcgaaaccgcgaactgccggcgatgtcaatgccgactccgttcaatgtcaccgagtccgtgctcacatcgggcccaattgtgatgtgtgtggtggcgctcagctcatcaattgtgatagcaatggaatcgttgagcggaaggacgagttcctgggcaatggacaaaattaggcaaattattaggtggttttaaaaaagattttaggtgtggctcgtcttaaaatgtttattttattttgttttaaatagacaaacaataaacgctcatttgtctccgagatttagggttaaaaatttattaacattgaccaaatttttgggaagtcagtcacagagacggtcccgtgaataaaagcaaatcccactttttccttcgccaatataaaaaagaaaatatgaattttttgttgttttcttgttgtaactttttttttgtggttgattaacctaaccgattaagcccggtgtaacaggaaaaaacagatatgaaacccaacggcccaaatcacaaaggtaaattaagcaactaatggcattttaaaattaaaattttttaaacaaaacgtttacctcattcctcttgccccaatatttgatcagtgcgatgttcactggtgcttgaatcgtaatatggaagccaccgcctctgttcattcgaattaattgtactaagttttgaattttatctaaaattaggtaatttgaattgtgtcatgtataaggggatgaaaggatttcggtagggcttggactttcactttcttaggcacctgctgatttgattgtgagccataattttgggtaataaaaatgccaaaaagtatgtttagagttgcttttcaaatcaattttttacgaagcatttttcaaaaatttttgggaagaggacggtgtccggcggtgccgataaacgttgccaggaactttttttgatcatttcttaacggtgttcttaacagatttttaaaaaatgactcaccgctcaatgtgctttttcataacgccaataaatttattgtaaattttttgcgctaattcaaaaaaagttgtcactgccttttttgactgtttagtagagattggcattttccgcacacatgggcacgggctacggggttagaaacataaaattaaaaatgttttcggttttttgcttgaaaattttttttctgcttttaacagaatctttttatatcagggttgccatccgtccttgaatggcaaggacgtccttgaaaatgatcctctttcttgaaaataaaaaatgtccttgtatgcaaggacgtccttgaaaatgagcatttggatatgtttaaaaaaaatcaagaaatttgagaaatctatgtaattctcaacaatatttttgataaattatggcattattatgtcatttaaaaatgtatttttgagatttttgaaattttatgtattaagtcatagtcatatttttcttaaaaattaaccaaaatcccaagttttggtctttttgaaaaaaacttggaaaaaatctcgattaaaaattacaaatttttcccggaccccccatccccaaaaaaattttaaaaaggccccccaactttaaaaaaaaaaaagcgtggaagggtttaaatcccaaaaaaaaaggaagtttttggggaaaatttttaaaaaaatatttttaaatttttaaaatattttctccccggggggggtgggggcgggcctccgaaaaacatctctctctatatacaacaacaaacccctcccccacccccccaccccccccccccccaccccccccccccccccccccccccggggggggggggggggggggggggggggggggggggggggggggcccttctcttttttttttttttgttgggttgtttgcccccccccccccccccccccccaaaaaaaaaaaaaaaaaaaaaaaaaaaccccccccccccccccccccccccccccccccgggggggggggggtgtttttttttttttttttttttttttaaaaaaaaaaaaggggggggggggggggggggggggcccccccccccccccccaaaaaaaaaaaaagaaaggggggggggggggggggggggcgccccttctttttttttttttttttttttttttttcccccacaaaaaaaaaaaaaaaaaaaaaaaaattttttttttttccccccggcccccccctttttttttttttaagaaaagaaaaaaaaaaaaaattttttttgtgggggggggggggggggggggggcccccccccccccgaaaatattttttttttttttttttctccccccccaaaaaaaaaaaacaaaaaatatttttcgggggttttttttttatttttgggaaaaaaaaaaaaaaaaatttttccccccatattatttttttttttttttttttaaaaaaaaaaaatttttttttttgcgggccaaagggggcccaaagagggttcccacgggggcttaaaaaaaattttttttttcccccaatttttcgagttttttggaaaattttttttttttttttttttaagaaattttgggggccccccaaaaaggccccccccccccaattgtggtttttcaactctggcccaacaaaaagttttttggatcagaccaaagggcctggcctggaaaaaatgccagaccgaggtcatctcattttggacacttcagtaccaggcgaataccgcgtccgggtttgatgcgagcgagggggcgccagcggactttttgtagagctttcgaagctctatctatccatctttaaaaattttaaaaattttcaaaaattttcgagctaggcctaaaat

SEQ ID NO: 3832 - DNA, 688 bp, Heterodera glycines
ggccccccccccccccctctgtcccacaaaatttttggaaaaagcgcgccacaaaaaaagcgtttttaaagcagaaaaaagtcgtcgtaaatgaagaaaatgataagtgaaaacaaaaaaaatgttggaaaaaaacaattccggtgaaaaatacaagccatttgaataaatagtgaaaaaaagtccgaaatagtgacgttttatgatataattcagtcaaaattaagcaaaaataatttactcactacattattgttgcaattgaggtacatttctttcctaatattttcttagcaaatattgaatttttaaatcaaaaatttttgtcaagaaaaagaaatttggtggatgaatttttgagaaaattttccaaaaatttttaggtctattattagtgaagtatttttttgaaaaaaaattttgttcgattcttaggggtgttatttattttttttttaggtcgattcttaggggtgtattttttgattttatgtattgcatttttgttaaggaattttccaaaaaatgtcgaaatagtaaaaaaatagtgacaaaatttcactattttaaatgaagaaacgctaaaatagtgatttttagtgacaaaaaatgacgttcgaacgaaaaattttaacgcagaaatgctttttttgagctcatttcttcaaaacaattgagcaaaaaaaaa

SEQ ID NO: 3833 - DNA, 1716 bp, Heterodera glycines
cgtatccaactgagaatctgctgaatcggctgtatgcatgcgctgaccctgaatccgatgccgctgttgttataggagcccaaataattttttcggtcagttattgtacctgtttcgaggtaggctttaaaatgaggcttttgccaaattagctctcgagaatgtagccagacggaagcagggcccagccgttcgtccagttgattttttatagaagtttggggtggtattttcaccaatcagttttttatactgttattgatcgtatccaactgagaatctgctgaatggggtttttggctgcgctgaacccgaatttgatgccgccgttgttataggagcccaaataattttttaggaattttattgtacctgtttcgaggtaggctttaaaatgaggcttttgccaaattagctcttgagactgtagccagacggaagcagggcccagccgttcgtccagttgactttttacagaagtttggggtggtatttttaccatcagttttttatactgtttcaaggtaggctttaaaatgaggctttttccaaattagctctcgagactgtagccagacggaagcagggcccagccgttcgtccagttgactttttacagaagtttggggtggtatttttaccaatcagttttttatactgttattgatcgtatccaactgagaatctgctgaatggggtttttggctgcgctgaacccgaatttgatgccgccgttgttataggagcccaaataattttttaggaattttattgtacctgtttcgaggtaggctttaaaatgaggcttttgccaaattagctctcgagactgtagccagacggaagcagggcccagccgttcgtccagatgactttttacagaagtttgggatggtatttttaccaatcagttttttatactgttattgatcgtatccaactgagaatctgctgaatggggtttttggctgcgctgaactcgaatttgatgccgccgttgtcataggagcccaaataattttttaggaattttattgtacctgtttcgaggtaggctttaaaatgaggcttttgccaaattagctcttgagactgtagccagacggaagcagggcccagccgttcgtccagttgactttttacagaagtttggggtggtatttttaccatcagttttttatactgtttcaaggtaggctttaaaatgaggctttttccaaattagctctcgagactgtagccagacggaagcagggcccagccgttcgtccagatgactttttacagaagtttggggtggtatttttaccaatcagttttttatactgttattgatcgtatccaactgagaatctgctgaatggggtttttggctgcgctgaacccgaatttgatgccgccgttgtcatagaggagcccaaataattttttaggaattttattgtacctgtttcgaggtaggctttaaaatgaggcttttgccaaattagctctcgagactgtagccagacggaagcagggcccagccgttcgtccaattgactttttacagaagtttggggtggtatttttaccaatcagttttttatcctgtttcgaggtaggctttaaaatgaggcttttgccaaattagctctcgagactgtagccagacggaagcagggcccagccgttcatcgagttgattttctatagaagtttggggtggtattttta

SEQ ID NO: 3834 - DNA, 1667 bp, Heterodera glycines
  misc_feature (1595)..(1595): n is a, c, g, or t
aaagtcaactggacgaacggctggccctgcttccgtctggctacagtctcgagagctaatttcaccaaagcctcattttaaagcctacctcgaaacaggtacaataaaattcctaaaaaattatttgggctcctataacaacggcggcatcaaattcgggttcagcgcagccaaaaaccccattcagcagattctcagttggatacgatcaataacagtataaaaaactgattggtaaaaataccaccccaaacttctgtaaaaagtcaactggacgaacggctgggccctgcttccgtctggctacagtctcgagagctaatttggaaaaagcctcattttaaagcctaccttgaaacagtataaaaaactgatggtaaaaataccaccccaaacttctgtaaaaagtcaactggacgaacggctgggccctgcttccgtctggctacagtctcaagagctaatttggcaaaagcctcattttaaagcctacctcgaaacaggtacaataaaattcctaaaaaattatttgggctcctatgacaacggcggcatcaaattcgggttcagcgcagccaaaaaccccattcagcagattctcagttggatacgatcaataacagtataaaaaactgattggtaaaaataccaccccaaacttctgtaaaaagtcatctggacgaacggctgggccctgcttccgtctggctacagtctcgagagctaatttggcaaaagcctcattttaaagcctacctcgaaacaggtacaataaaattcctaaaaaattatttgggctcctataacaacggcggcatcaaattcgggttcagcgcagccaaaaaccccattcagcagattctcagttggatacgatcaataacagtataaaaaactgattggtaaaaataccaccccaaacttcggtaaaaagtcaactggacgaacggctgggccctgcttccgtctggctacagtctcgagagctaatttggcaaaagcctcattttaaagcctacctcgaaacaggataaaaaactgattggtaaaaataccaccccaaacttctataaaaaatcaactggacgaacggctgggccctgcttccgtctggctacagtctcgagagctaatttggcaaaagcctcattttaaagcctacctcgaaacaggtacaataaaattcctaaaaaattatttgggctcctatgacaacggcggcatcaaattcgggttcagcgcagccaaaaaccccattcagcagattctcagttggatacgatcaataacagtataaaaaactgattggtaaaaataccaccccaaacttctgtaaaaagtcaactggacgaacggctgggccctgcttccgtctggctacagtctcgagagctaatttggaaaaagcctcattttaaagcctaccttgaaacagtataaaaaactgatggtaaaaataccaccccaaacttctgtaaaaagtcaactggacgaacggctgggccctgcttccgtctggctacagtctcaagagctaatttggcaaaagcctcattttaaagcctacctcgaaacaggtacaataaaattcctanaaaattatttgggctccctatgacacggcggcatcaaattcgggttcagcgcagccaaaaaccccattcagc

SEQ ID NO: 3835 - DNA, 1137 bp, Heterodera glycines
aaaaattccacccccaaacttctgtaaaaagtcaactggacgaacggctgggccctgcttccgtctggctacagtctcgagagctaatttggaaaaagcctcattttaaagcctacctcgaaacaggtacaataaaaattcctaaaaaattatttgggctcctatgacaacggcggcatcaaattcgggttcagcgcagccaaaaaccccattcagcagattctcagttggatacgatcaataacagtataaaaaactgattggtaaaaataccaccccaaacttctgtaaaaagtcaactggacgaacggctgggccctgcttccgtctggctacagtctcgagagctaatttggaaaaagcctcattttaaagcctaccttgaaacagtataaaaaactgatggtaaaaataccaccccaaacttctataaaaaatcaactggacgaacggctgggccctgcttccgtctggctacagtctcgagagctaatttggcaaaagcctcattttaaagcctacctcgaaacaggtacaataaaattcctaaaaaattatttgggctcctatgacaacggcggcatcaaattcgggttcagcgcagccaaaaaccccattcagcagattctcagttggatacgatcaataacagtataaaaaactgattggtaaaaataccaccccaaacttctgtaaaaagtcaactggacgaacggctgggccctgcttccgtctggctacagtctcgagagctaatttggcaaaagcctcattttaaagcctacctcgaaacaggataaaaaactgattggtaaaaataccaccccaaacttctataaaaatcaactggacgaacggctgggccctgcttccgccaaaggctacattctccagattctaatttggatacgatcaataacattataaaaaactgcctggtaaaaataccaccccaaacttccgtaaaaagtcatctggacgaacggctgggccctgcttccgtctggctacagtctcgagagctaatttgccaaaaacctcattttaaagcctacctcgaaacagatacgatcaaaaacagtataaaaaactgattggtaaaaataccaccccaaacttctataaaaatcaactgga

SEQ ID NO: 3836 - DNA, 2602 bp, Heterodera glycines
tgccatcagtacgccgtgctccattcctccagggaatgttagtgcctgtggatgaagaaccggacattctcgttggaatggcagacttctggaagttttttaacggcgtccaaagagtgtctccgcaactgttcaaagttcaaactttaatcggttccactgtctgcgggcgagatgaaattccgtcccgtccaactgccgatcatccactgtccgtcatgcccgtaaccgtccatgtttctgccaatgaagacgagatgaccaattcggctgtcaagtgaattcagaaaaatgagtccatctctgatctcgactcgctacgacaattctgggatcttcaaaacattggcatcagagatgaccctctcgaaaacgatgacgatacggcacaacaaatcttcgaccagacgactacgcgcctggcaaacggaagatacagcgtgggatggccatggaagaattttccgccggacctgccctcaaattttgccatggcccatcgccgattgtcttcaattctcaaccgtcttcaacattttcccgaactgcttgccaagtacgaagccgcaatacaagaacagcttcgactggggctcatcgaaccagccgttcgtacccgaggactcgagcatttcctgcctcatcattgtgttgtcacacacaaaggaatactcatgcgctttcgcctggctgggattgcgctatggggtgacttgaaaaaggccttcaattcactcagcctgctggaatgcgaccgagaattctgcaaagtgctctgggttaacgacgtccgtaaaccaccgttgccggataacgtggtcatctaccgatggtcaagggtgccattcggtgtcattgcctcgccctttttgctggcagccaccatccagaagcacctgaagcaggacgggtccccattggccattgaaatggctgaaaatgcctacgtcgacaacctgctcatgcaatgcacttcaccctcagaagcgctgaacaagtacatgagcagcaagactctgttccgcgcctgtcaaatgaacattcgcgaattcatctgcaactcagacgaagtcatgtgccgaattccgaaggaagaccaactcgtgaaagaagtgcccaaagtgctcggccttcactgggagttgaggccggacaagctttacatcgactttccgcccatgacaccgaaagtcgctgccttactcgtcgaactgttctccagcagctcgcctctgtttttgaccctctcggactggtgtgcccggcacttcatgttgccaaaatgtttttccaatcactttgggaaaccaagcttgactgggatgattctcttccgactgagaaagtgcaagaatggaacacgattgccacgacttggaaccagcaaaaggtccgtgtcccgcgcagagtcatcccgttggaagtgacctctcatcaactacatgcctttgttgacgcaagcaaagatgcctatggagcgtgcatcttcattcgggcacaacatgaagtcgcaatcacggcccatctcatctttgccaagagccgagtgaaaccaaagggatcaaatctcactattccgcgcatggagctcatgggaatgctgattggcattcggatgcttcaatttgccgaaaaacagctcggacttgccattcgccacaaattcatttggtgtgactccaaaccagtccttggttgggtgtcatcttctgagcagcaacctcgttttgtggagaatcgcctaaaagaaatccgtgctgtcgaccaagttcgctttctctacatatcgacggagcaaaacccagccgatgtcgcctcacgcggatgtactgtgcttgaactcacctcccatccactctgatggagcggcccaagttggctagtccatcccgaggatcgttggcctatcaccatggaagtcaagcctgccaatgatgacatccaaaacgaagctggaatcgcggccatcgtgcctatcgttcaaagggacgaagcatgggttcgtgtcgaccggttcagcaattggacttgccttcggaacgtggtcgtactcgtcctccgtgccctccgtcgttggctcacaatgtccggcaagcccatcatcggattgtgctcacgtgtttctacctctgggccaatccaagacagcgatttccagttcgccgagtgtcttctgatcgaacttgcccaacgtgaatgtaccgatttggccaagcaaaggccagaactacgtcttcgctctgatgaacatggactgatccgcctggagaccagactcggcagctgtacagcaaatgatgactggaagagctcaattctgcttccagatcagtcaccaatcactctgtggagaatcgcctaaaagaaatccgtgctgtcgaccaagttcgctttctctacatatcgacggagcaaaacccagccgatgtcgcctcacgcggatgtactgtgcttgaactcacctcccatccactctgatggagcggcccaagttggctagtccatcccgaggatcgttggcctatcaccatggaagtcaagcctgccaatgatgacatccaaaacgaagctggaatcgcggccatcgtgcctatcgttcaaa

SEQ ID NO: 3837 - DNA, 7697 bp, Heterodera glycines
cgttgcgacgagcactacgcccgccacccgatgttgaaactttgtcggctgcctcgtccgatgaaggcacaattatggttgaaccatcctctttggcggggagtgtcgcgaaagcgactaagaaagtggagaaaaagaagaaatgatgggaaatgagggaaaaggagagagagaaaatggaaaaaaattgaggaagagaaatttaattgagttaaattggataattttaataattgtgattcattttattatttctgtgatattttcatatttaatatgtgatttctgtgcttagtattagtcactcttcattgttgttcgccgctctgtccaaattgctccacctacgccttttcgctctttataagcatcacataaaaattaacaaaaactttaattttgcttacatttcaattgttttaagttttttcacataaggacacttttagaccaaaaattttatcaagaaaaaaataatttatttttggggatcaatttttgtgaaaattttttcttttctttgggagtgtattttctgaaattttttcgggtcgatgcttaggggtgtattttttgtttttattgcatttttgttaaggatttttccgatctccgctgtccctgttccccgggttggcggggatcgtcccccctccccctctctcggctcctacccttgttcaagttaatgttttcacttttcgtcgtctactaactaaaatgaaatctaaacattcgactgattggagttcgttttatcgtatttatggaaaatttccaaggcaaattgagaagctcttcatttaacccagagttttcgtgtccattcatcgtccacctcatagaattcacaaagacggtacaagtctaaaatgtaatgggcaagactcataaatataataaattatagaattttttgcagttaaataggctgagatttaataaaaaaatatttacgaagaagactgccaaaatgaaaattgaaaaaaaccattaatgaatttgaatataatgttttaaatttaaaattttcgtttcgctttcatcagacgaaatttgtaggaaaagaaacgaaaattacaaaaggcctatatgaaccaatgctgggcgtaattacggattatggaaatttcggcctttttggacccggtcatgactgattatgggttaaggattttgggatttttcgtaattttaatctgtaattgtgtttttggattgtttttcgacgatttcatgcaagataattttttttaacgattttttctacttcatttaaaggactacccgaatttcatgatttcttctggattaaaaaccacttattcttgttaatttgtagtattattaaggtaacatcataatttgagtttttcgcttagaaaatagttgcgtttttgtcgttttttgctcctattttttcctcacctagcttttttaaaattcttatcaataatgaaataactatataaatcatttttgttaataatttttcaaaaatatcaaaagagttttttttcaattttttttaggtttttggctctaaaaaacctagaaaatagatactaaaaacacgaaaagtagctgaataaccaccaaaaaaaacttgttttgcgtgtgtttcaggccactggagctgaggaaaaaatagataaaaccctaaaaactggatccctgctaatgattagattcaaaaaatttaaatccagtcacgcccagccctgattccttttcgctctctctatccacacaaaaaattttgtaattttcctttttttctcattactctccggtatttttttttgttgaggaatccaataaaatgcacagtttagctgaaaaatcatcggaaatgacttgagagagaaaatggaacacaaattgtgcacacgttgaaaagcccagctctgatatgacctcgttctgaatttgtcaattcaattttttgaaaggttcaaaaattaaaataataaaatttagctaatctttgttttcaaaatattctaaaatttttgacttacacatattgtaaaaaaattgaaaaatttacttattttccgagaatttacttttttccactaaagcattttctacgggcccatttcccggtgacgatttggagatacaaaaaaagtctttcggttctattcctctcataacggaagatgttagcagctatttgaaacattttactgaaaactgcttcatttttacaaaatatatctactaaaaatccaagtccttttttctgataaaatctttaaaccaatttagccaaaaattctcaacattttcccggcggcgcctatttatttttttaatttgttacagaaatcaacaaattggtcattgttagtttattaacaaagcttacctgaaaagaaaatagttaatttaaagaaattaaatttcctaataaattttgaaaaatattaaatattttaaaaatcttcatcattgatatttattggccttctaaactttttttcaaaaattatatttggtttttaaccttaaattttcaaatttatttgctagttttaaaaaaacccaaaaattgacaaaaatttcttatttttctccaataccaaaaattttctatcaaaatttaaaaaataggccggagctgtactttcaggaaaacttggaccgttactgaccagtgccgggaccgggacctgcggtcagtccctccattggcttacattgaggaacgctggaagagttcgatatcatccagaagcatgtcgcgaataatggccatgtctttgcgatacaattcgaagttatatgagtgataacggcccgcaattcacttcaaaggaatttgcgaagttctgtgaagaacgtggcattacgcacacgctcacagcgccataccatccgcaaagcaatggagaagcggagcgattcgtccaaaccttcaagaaaggaatgcttctcaacaagaaggagaaaaattgggaaaacgaactcgcgaaaaaccaatttctgctgaaatatcggatcacaccgcattaagcgacaggacaatcaccggcaaaaatgatgttcaacagagaactaaggacaaaactcgatttggtccagccggttttcaacccaaagaaaagggaagaaaaggaggaaaagcaaaaagttgtggacaactacagagaccgagtcaaaaggaacttcgatcgaagcacttggaaaaggtcattcgacattggcctgaaaatcttcgctaggaatttccgcgacggaacaaagtggatggaaggcgaaattgtgcgccaaatctcaccatcacttttccttgtcagaaccaaaagaggaatttggaaaaggcacttagatcagcttaaatccaacgaaacggacagcgaaagtgccgataccgattcaaattcgtcaatggcagagcaagctgagatggacacggacgttgaaaatcagccggacattgatgcgcaagatgaaccgcaaaatgtgctgacgaatgatcaagaggagctcagacgatcgagcagacagcgtaagccgagaaccatcttcgatccaagtcgatgaaccgattgaattggtggggaggagatgtcatgtctgagaacttatttgatgggactcaaatggacttttttcatatttgccctcttaatccacaactgctctgtctatttaaatgctgtctttccctcttattcccgcagtcttcccagtcattcttcatttattattttgttctccctcatcaactttgacctccgcatatatttgtttatttcttcactgcaaataaaatcaatttatttggctgttgagtcggacacaacacaaataaatgttaataaatgaaggaaaaatagattttacacagaataaaaaaatataaaaacatataatgttgagaagatgaatttaacaaaaaataaactctttttctttacaatatgaaaattaaaaaagaaaaaagcttacaacaccttcgattcccaggacgtctccgttccaagtactaagaaggcccaacgttgcttaacttgccagatcggacgggatggcgtgttttcaacgtggtatggtcgtaagcgaaagggctccatttgaaagcaactaaatagtcaattttataatgcattttttctcttttaacttaatcattaatcaaaacaaaggatatttaaagaatttggaatacacttaaataaggtaaaataaaagaaaaattcaatagtttttatcaaaattaaagtgcaaaaattcggaatttgaattctttttttaactaatttcccaactgcaaatcggctgaaattgaaaatgagttatataaattttgcatttcatcaaaaattctctttaaaaagcacttataaatccttttcctaggaataatttaattttttaattagaaaaaacattgaaaatcaaaatttcttatgaaaattggttaggtggtgattttaagaaagtaatacacccatcatttatagtggctaaagtcatcttttgagatgcaaattcgcattttattgtattccgttaagaaatctaaaaaaccatttcggcacaaaatgccaaaaaaggcaaaatggggatacaaaagtcatacaaaatttatcaccacgtttatagctgttcttttgaattcaaaaagagattttcttgaccctttggataaaacaaattttatttaacaaaattttttgttcacttttcattttttgttgaacaaattttacctttctctcaaattattttttctcacattctgagacaacaaataaatgttaaaaaatgaagaaaaatagattttacacagaataaaaaattataaaaacatataatgttgagaagataaactctttttctttacaatatgaaaattaaaaaagaaaaaagcttacaacaccttcgattcccaggacgtctccgttccaagtactaagaaggcccaacgttgcttaacttgccagatcggacgggatggcgtgttttcaacgtggtatggtcgtaagcgaaagcgctccatttgaaagcaactaaatagtcaattttataatgcattttttctcttttaacttaatcattaatcaaaacaaggatatttaaagaatttggaatacacttaaataaggtaaaataaaagaaaaattcaatagtttttatcaaaattaaagtgcaaaaattcggaatttgaattctttttttaactaatttcccaactgcaaatcggctgaaattgaaaatgagttatataaatttgcatttcatcaaaaattctctttaaaaagcacttataaatccttttcctaggaataatttaattttttaattagaaaaaacattgaaaatcaaaatttcttatgaaaattggttaggtggtgattttaagaaagtaatacacccatcatttatagtggttaaagtcatcttttaaaaaatctaaaaaaccatttcggcacaaaatgccaaaaaaggcaaaatggggatacaaaagtcatacaaaatttatcaccacgtttatagctgttcttttgaattcaaaaagagattttcttgaccttttggatctaattcatcagattgtggtcttttttcagatgtatagtggctttgtgtggcagcaacggtactgtgccggtgccgaatgggtgctcaaggtggacgatgacattgcggtccatctccgacggatggtcgaatggacggagaaaaaatttcaaaaaatagccacagaacatccgttgatttatttcggagtcccggctgatagaggcctatctcgggacaagaacagcaaatggtagttgaaaattatataatgtaaaatgccgtttaaaaaatataagtaacatgtcaacagtaacacattcagtgcagaataattatatgtggaagcgaaaagttttaaaaaataaagtgttcccacaaaaaacccaaaaattaaattcaaaaataaatttactatgtcaaaaaattgattatttaaaaacaatttttaaaattttatttccaatcctaaatcacataaaataaaaatgaaataatttatttaaaaattgggcagcgaaacaatgtattttttatttgtttattaaaataatattttgtatgatgtcatgaaaattatgtaaaaaagtaacatttattcttttatggatattttatgttttacgaaatttttccgcttttttcttaatttgtgatattttgggcttcaaatgttgcattaattagatgacatacaattagcagcagagcagaaaaagcttcctaaattattttatggccatgggttcttttttaggtacgtcccttatggaatgtttacgggagaacattttccaccgtttttgtacggtggctgctatttgacaactccaagcaccatcaaagccgtcttggaacaagctcacaaaaccgacagcttttatttggaggacgtgctgtacacgggcattttggccgagttggccaatgtcaccgtatcggaccaattgagccatttttatgggaatggattgcaggtaattaataattagggatgtcaattttatgtaaatacggaaatcctcaaaaaaagccaaaatttcgacaaatttcattttttatatatattttgagaattttcgaaaattttttagaaattttttgtgaaaaataaaaaatcttttttttttaaatgtaccctaaaaaataccaaaaataatttttataaacatattgaagtcatttttctttattatgtgccaatttaacaatttacgaagattttttccaaaaaataacttttaataaaaattttatttacatattttcgtatacattttggttttttttacatattttttttctacatatttatgtacatatttttgacatccttattaattaataatcagtgtgcataataaacaataaataaaaaattcttggaatgttgatagcccgttatattttcaaaatttaaaaatggttgtcataagtttgtgattatccatttcttaattataaattaaaaaaatatataattattataaaatttaaaattacttataaactaaggatgcaaatttgatagtgttaagcaattttatgaatttttacatacaataagaaaaccagggccctgcgggccctgtgaaagcgccgggggcgctttaaacgctggctctagtgggagatataatttggggcgtgcaaaaaacatctattggccgctaagcgatcctcatagtttaggaatatgagaattatacaaaaccaaaaaaaataaaaataatttttaataattttttaaaattaaaaaataaaaaaagcttggaaatgaacaaatagttaatttaaaaacgatattgttttaaatttaatttaaatgagatatttttatttatatgattgtgattttttataagattttttgttaaatgtcataattctaaaataaataattttcgagttgtcgctcttccactttctgttcctcttccactttctgttcctcttccactttctgttccgcttccactttatcttccactttctgttcctcttccactttctgttcctcttccactttctgttccgcttccactttatcttccactttctgttcctcttccactttctgttccgcttccactttatcttccactttctgttcctcttacactttatcttccactttttgttcctcttccactttctgttcc

SEQ ID NO: 3838 - DNA, 2775 bp, Heterodera glycines
  misc_feature (2653)..(2653): n is a, c, g, or t
  misc_feature (2665)..(2667): n is a, c, g, or t
atatttcgggcatttttagtccatattttacgtttttttagtcattattttggagggtgcaaaaaatatattttaaatgaggatgtttttattaaaatatatctttatttaaattattctcagaaatgactatttagaagaaaaaacatttatgccccccgcatgactaattatgtaattgcatttttgttgcctttcaaatgacaaaaattgtaaccgaattgatttattattatgaattccaaatgcgaagaaccacgtccatttacatttacacacttttgccccttttcttatcattcaaatgcaaaaataagcatacaaattattattaattatgctatgtatttgttgttaattactatgcgtagtaataaagtgtgattattgcataatttagtttaatttaaaaatgtgatcagggattggattttatttagaaaaaatttaaatattaaaagttatgtgaacattaaaatctgagaaagttccgaaataagcaaaaaaaaaaaaaaaatatatatatatatatatatatatatatatgtgtgtgtgtgtgtgtgtgtgtgtgtgtgtgtgtgtgtgtgtgtgtggtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgagatagataatgtacaaattacaatgtgtgtccaaaattcagcacattgaaattgaccccgatgattccctttcccacaaacgggcgataacatttttgcataggcatggaaaccacccgacctccctccctgatgtttggacgaaggaagttggggtatgtgatgattatcggctcgtattcaccacttgtcgcgtaccggaccacctcctctttgaagttctcatagcgcatcccctggttgttgatcacatcataatttagcgtcagcccgcgcacttttagtacatgttccaattgggctcccgcctccgcgccctttcgtcgcagacacaggccgtactagagtgttaatgttcattaattaccgcaaaatgagccgaaaattcacttgttttgccccgccactgcaaaattccacaatgtcgtggtcggggtattcgtcggtgaactggcccaaatgggggccagttttcagtgggcaccgctcctccgggtggacgaggatgaggctgtcagtgtctaaaataaatgtttgtgcacaaaaaattttttgtagtttgacttaccagtgtacaacagatccgagcccggtgatctgaccaccttctgcattgccttgagcagaacgaggcgcgctgctgaggtggtccatagtgaaatgactgaagtactttaacaatttattgtgagtgtgtgtgtctcaccaatgtttgagcatgagtgctcatccacccagtccttcttctgcagataggtgatgagtatgtgctgctcgtccaactcgtcgattgatgtcacttcgatggatttgttgtccaggtactccgccaaagttgctgggtcgtcagtgatgagtgtttgagcgagtccaaagttgcgaagcgaaaatcgtccccctatttttttttaaatataataataatggacgacagtactcacataagttgttcaagcagagcttggccagggaccgcttccctttgttgaccgccattttggttgggtcgatggtgatgtcgaactgctctgcgcactcccgcacaaactgttgttccttctccgcatcgcctctgatactgttgtcaaacccactggcctggatcttttggccataaactcagcgatgtacgggcggaagagcttgtcgtcactttgctcatactcgaggacacggaagacctttgtgacgaggtagccctcgtccaacgcctcgttgagctcaatggaggtgcacgtgctcacccacccccgctgtctgtcggaatgctcgcagtggtagtcgttgtccactcctcctgtcgggtgctctttggcgcaagtgatgcacagggggaagcaaagccgctctccaactttcacaggtagaacggggacgtcgacgcgtcggggaggctcaacccacactttgagcaatgccaaagggtaggggttgtccgctgcactgcgccactccgcttcctggttcaacacatgcactttgggagtgccaatggggtagcaggtggtaaaactgtgaaggaaaaaatgttaaaagttgttacaaatttaactgtgctcaatttatgtacgggtagagcgatgtgaagtcataataggagattttctctcccggtccagccttgcgcagcagcttcagtggtccggttcgccctcccataaacgcgtcgcggatcaccagcggcccatcatcgacgtagtcctcaaaagctttgcgcatttctttgctcctctccagcatccgatggatttcgcattcccagtagacgtccatccggttgaccttccccctcagaaattccatccgcttggcatcccgttcgcgcattggtcccgcagtcttcccactgnggagcagcatgnnntgtcgttggggtaacaccttttgcacccgtgccacgtgcagccttaaaatttcccattttaaaataattgtgcataaaattcagctaccattgacttcaattgcgcgt

SEQ ID NO: 3839 - DNA, 4583 bp, Heterodera glycines
tatttccactcgttgctgcaataactgagaatcgagaacaaaattattgttatagcaaaatatttttacagtacctcgctaacgcctcatccaatttgaaaggctcgtggcgatgctcggcgtaccacacatcaaatttctgccttttgctgggcatcattccactagccaagtagtcttcgggcgtcgggtgaatctcacggccgtagttctcgggtcggttggccaaatgggggaagaagggcttgtcctcgacgtccagaccgtaggaggggatgagcgccgccagcgcgcacggcatcaaattgaaagagtcacggaagacgatgtttgggttgcgcctcttctgcttgcgtaccttcatctcatacattttgttgccctgagatttttaaaatatttttagacaaaaaaattcttaattgagtacccgtcgaagcatctccgggttgaacccaatacggaatagctcgcgaaagaccagaaccatgtcaaaacgccctccaaagtgtgagttggctcaatgggctgaatgaagcatccgcgctcgggattgtgaaacgtgttgcacagctgacaataggtctcgtggcatttgtgaccctaaatccggcaaagaaatacaaaattttatttaaaaatcaccacttactcgctttccatttcgattgttgtccttgacattccaaataacgccatcggacgcatttggactttattaatcaatggcatttcacaaaattgacactgactccgtgaactcaatcaccaatgctttggactttttccgcattcccccgaccaatgtgagcgtctcttcgtccaaagtgtttgagcttttgcctagcaaccctctgaccgacacaccataccacttcaaactccactcatgccaaaactacattgatctttccaaatgctatttgctcaccgagtttcgaatccagaaggaaaatgctaatggacaacttgttaacctaaccattgatgatataaacattgcaccaatccaaatgattggccaaactttcatccgtaacataaaaatgagcatcaatgggcgcgaaattttcaatgccaatgcactgatggcttacaaaacatatttttcacatgagctttcctattcaacaacggcaaaggactcccatctgaatgccgcggggtactaccgagacacgggcgactcactggaaatgggagacggatgcacagcgcgacgtgatttgtttgcgaatagtaatgtagcccaattcattgccaaaattgacaccgacctgttcaatcagccgctgtatctgatcaacttttgtgagctggacattgaaatattgcccaacgacaacgaatttgtgttaatcgcgccgaccggtggtcggtaccgtttcgaggttgtgggactgaaattatatgtgaaaaaggtgtctctgatggacgggttggcattggacattgcacgaaagttggaggtgaagcctgcccgttatgcagtgaggaagacaatgatgaagtctgtgttcatcagtccgggcaggtatgagttcacagccaatctgttcatggaccaaattccccgtcgtgttacaatggggctggtggcgaatactgactatgtcggctcaattaggcgcagcccattcaactttcaaccatttaatgtgcgcgagatttccattgttgccaatggtcgatcttacccacaagcaccctatgacttagactacccgaacggaaagtatgttcgtccattcaatgatatgaacgaagcggtgggattcgcaaattcatctgagagcaatggcataacttttgcccaatacggtaaaacccattgcatttacgtgttcaatttgaccaacagcggggatgatcaagcggcactgtttgatttgataaagaatgggaccacagcggtgagcgtcaaatttaaccatccagtgcccgagggaggaataatgttggtggtgatgggcgaatgtgactctcttgtgatgttggacaaaaatcgatcgataagcaccgataccactatttaaacgcgcatcacattgtcccatttcatttgcataaaatgtattcaaaaaaattgggtatcattttgttcttgctccgcgtttctattcctgttgtttcaacattccatgaacaaccgcaaaagccaccgccagagaatacatattctgcttatttgaaaaatttgactttgtctcggcaacaacaccacccagaatattcctacactgaatatctgagaagattgtctttgtcaaagattgctacgacaacaacatttaaacccaacataacgaccaccccgaaaagcgacaagttaattgatgagcatttctctgctgttcttccaccgcttatccaactgtgtaaggatctaccagcggaaagcaactttgcgcagaaagccatttgcggggcattgttcgccctttatttaatgctcatcctcagtctgattcttcatcaactttgttcaattttttggctaaagaatggacgcctccaaattataaagatattgagcgaaaatcggcagaccgagccagtgtttcggggctgcttcgccagtgaccaattgccgcctcccttcacactacagtaccccgcagcgctcgtcgtgaacagggacgcccaccacaaggagggctctcattggtgcgccatttatgcgaagggaatggatacgccaggctctactatgacagtcttgctcaacccatccctccctccatcacatcatcatttttgtgccaattccccaagggattaacgaagaattcacacccatatcagtccccccttgtctccacttatgccgcccactgcattgtttttatttaccatttgtccctcggagacacatttaatcaatttctcaaccgacttgagtcttgttcaaacccagatttatatgccacggttgtactccataaaattttaaataaataaattaaatggttgaaaaaaaagaaaaaataaaagcccgatgattgagcataaacatcaagatagccaatttcatcatcaaaatgcgggttctttaaaatgtatgcctgatcatcatcattggccgacaaaggctcagttggctcaatcccgcatgctaccatttcgctcggtgttgccttcaaaattgccggaaaattgtcgcggtgcacaagatcgatggatgtgcacttcttcattgagaacgggttcgcactttttgtgatgtggttgagcaccagattgcaaagtgcaccattttccttaacatttttccataaaaaattgaaaaagcaaaaatagttcaaaagttttacgagcgaattgtgcgagtcgaccaaaattcgggagcagaaaatgcgcccagatttgccgaagcaaatatatcggacgaactcatcgaaaaagcccgggtcacacagctcattgttgttgaaacggaaatgcaggtagagctgtccgtctgacatccatccttttgcactgatcatgtcaaagttgagagcaagccgtttctgaattgacaaattaaaaataaacaaaattaaattgaattattattacaatttgggtgaagtttaggtgacgcttggcccgaaatatttccataattcgattgaccaccgagattccagatggtgggcggccttaaattttgcgaaaaatttgaaatttgaaatttttttttcccacctggcttgggtgttaccccgccaaacaaatacattatgggaagtgagtagataatttcgaagaggagctcggctggtaatcgcttgggcatcatattggtcatgaaatttgaatgaatgaatgaatgaagagtgaattaaaatatttttgtgcccggtcctcatgggctcattaattattcaatagttaatattgacttcaaaagacatttgaatttgcgacaatagtgaaggagatgagttcaaaggaaatttgaatttgccgacaataacgaagaagagttcgagaaaattaattggtattcggatggggacaccccgcccccaatcttcataaatatccagtccaaatcacatttcattcacatctgctcatatctttactcactttaataataataataataatatttgtaaaaataattaaattacaataaaatttttattttattgctgttaaccagggcggttgctctccaattgttgggctccgtttatcctggcagcacttgtgtgtcttttagggcttggggttgtgcgcgtgatctttactaattatcagagccgtttaggtgccctgtcgtcttatgcttcatgggtggcagtgcgctgctcttcagggcatagttggttaaaaaattttaaaattattattattattatccattaatttgcattcacaacgacaatttccatgcctcaaaaatatgtgtcaagattgttcattttcatgcattcttttcattatttttccctgaaaaattagataatgcaaaatcagcctcccaagcatccctctctgttttccattgaccaaattctatccggcccaagcaaaaaggcccgtcgcggcttcctcattcatgaattggttggagaagtggttccagaggg

SEQ ID NO: 3840 - DNA, 1310 bp, Heterodera glycines
aaaataaaaattaaagtagaagcttcaaaccaaatggaaaacgtttacacaaatcgcagttgcgttccactaaagaacgctttaagtctctaatgaattttctgtgcgtttataaatgtcaaaattaattggttgatatttaggcgcttctatctgatacacattgtgccgacaacggaagtggaatttgtttaagagagaagcacagcaacggaagaaggtgaagaagtggttgcttgtagtaagaaacatttgtggacattgatggaacttttttgttttttcgctttatggtaacacgggaaggggttaaacgatgcagggtcggttgaaaggagtttttagttaaaacaattaaccaattaattgattgacactttctgattaattgggcaggcgcaacaatccatggagttttatttgtccgagtccctcttcttccttccgtgttacctaaatctcacacagtttctttgaatttaaaacattatatccttctgttttgggccattttttatttatctgacttcgattgtttgttcaaatgatgaagcaaagataaagacttttctgggaattgaattattaaaattaattggcattaacggaagttaaaatttttttaaaaaaatatagtaattattttttattttttcgaacttaatttatgcttatcaaaaacaatatttccagacgactaattttcttcaaatatttttaattgataaattataaaatatagctataaataaaattaaaaattttgatattttatttcttatgccatatttgatgattttataccataatttaatttcaagtagagtgccacggggccgggaccgggaccgggccgggaattctcggtcatccgaggtcccggattttgaaaagctcaggtcccggtcccggtagggcaaccgggaaccgggaaaaacaagcactggtaagaatgggggtctgagtgaaaaattagtgaagaaaattggagttaaaaggaaaaaatttaaaaaatatattaatatattctttgaaagtacactgccaagtgtgcaaaagcctattggctatctccttgactttcccttcttctttcccctggttcaatccctctacagaaattaaattattttgaattttctttttgtatactcgtgggtttcctatagagaaaatatgattcctcatagtttttttttaaattgatacatatttatcattttttaaataaaatcctaccaattgagcttaataatcccaaaaaccaacccttttttgttgaaaatctgttaacaaattacactcaaatt

SEQ ID NO: 3841 - DNA, 3852 bp, Heterodera glycines
ccggacccctttctttcccaaaagttttttggaaaagcgcgccgaaaaaaattatgtgaaacgtaaatctgaatttctaataatattctatcacttagtccaaaaatgattaattgtttgaaataaatgaagaaaatttgatttgaaaattttcattaatttaatttagctttaacttttggattttattaaataaaaaacaaaataaaaatttaattttgtattattttcagttgaaaaaaaattaaaatttgaatttttttaaaaatttttgaatttttttgaattttaaaaaattcccggttggtcccggttcccggtcccggtttttgcaaaaattcccggtcccgtggcactctagtttcaagcctcccaaagagcgtaaataaacacaaaaaaccttaaaaaactgattcaattattatttgctattttttattaccttttatttatgtttttgtatgaaaaattccttttccaaaaaacattaaaaatgtcttttataattcgaaaaaagcaaacgcagacattccgcagcagttgagtgagatcgcatttcatttaatggatttttccgctcttccaattatttgcccatttaaatgctatcattccccaacagttaaattccttaaattgaataaaaattaattaaattaaaaaagcatatttaaataaattttaccgtgttaaaaaatggaaattcaaaataacatcgacgtttccgggcttgtcgctctcatcaaatttcacgatttaaacactgtggtaattggcgcatttaaaatttaatttgaaagcaaaagcattttgggctggcgcaattgcctcgctgatctgcgcgacaacagttgctgtgttctttagctcatctcatttcttaaaactaaacaaagtgcaatttctgtccgtgtgttaattattaaattaatttattatttttaattgctacgacaacattcagttgcttgcccttctgtccgttgccgacttgtgcagttgcctgggcattttggctttgggactgatgcgcaaagcgctctatgaacgaattgtggagacgagccaagtgccattggaagtgaagggccatcattatcttttaaaataatccatgtctcgaatttgaaattccgggattggtaaacaaattaaaattacaagggaaagaaaatagcttttttttattttggcattttttccagaaaaacgattgtttggcttttaaatcccgacaacgaacagtcccataaatccataaatattttcaaaatattactcatcaattattcacataataaatttccttcttccgctgcttaagacaatttggtcttgtgccagcaaacccttcgtttttctgcgcctaatcggcgtaattgtgccgccttgggttattctgtggatcagtgccgaacgtttcatggccgttttgacaccaaaaatttattgtcggcacatttttaaacggtaagtaaaaaatgattaaaaatgccttttttttttgttttggattttcacgatttgtgatgccaatcattcttacatatgcctttttctcgctgctttttgtttattccatcgcttggacaaaacgaaacgaaccggtggaagcgtattgcggacggagggttcgaaattttgaaaaattcaaaaataaatatttatttattttattttaaagaaagttttcaccaaatactactcaatttacacttttatggtggacatattttcttattcaattgcgtaagtgttcagcaggaaatgggaattattagtctcataaattgaatttggggcgcaattattattataatacggacgcgcatttgtatttaaaattagattagcatttatcactttgaaaaacggatttgcgattaagaagcctccataatatttatcgtatggagcccatgcttctcataattttgaattcttggaaaaggtgaaaaattagacaaggggagggaatcgccagtaattttgaactttatgtcattttaatttaattagattaatttatctcttcttttcataacatttttcaaatttatgtccattttgccaagtttggccattaattgtgccaccgccctccgtttggcgcgccttcggtcgcacctcaaaagtcgcgggcacattcagcggcagctgaaccgcgtgcattacatgctgctcatttcgctgttctccacgctgaccgtaaccgtgcccaatgtgcttttcctcagcaacattttgttctgcaaatggatgcattccgacctgaccgacccgtccaattggatgatcacggcaaaatgtgccgcaaatttctttgtgtttctgctgtttaaagaggtgagaaaatgtgtaaaatttttcaataaataaattcgttctgtaccgtaaaccccggtcattcattcccctgggtgtacggtaaccaatgtgtggtagtcattcatgccttttgtaggaattccgtgtccgaatctacgaaattcttggctgtataagccgagacccgagcaatgaaagacagtacgaagtgtcggcattgggcatagccatgacgagcagacggaggaaaatatcagtggcagtggtggagcagcagaggaacgaccagcaacaggtcacaattggaggcacaaatcaaatacatttggaaaccaaatgaatttgtggctaaaattttaatttccgcccttccaccgccggtgggcgactttctttctttttttttgcttggcacggcacagggaaattttttgatgtacttttgttaaatttagccatttttactttttccaataaactcagtacttcgttctcatgtggtatgaatattcgaattattactgcattttttttttagtatttttggaaaatttccatataaatttaattagaaaaaaaaattcttttacaaattttaattgcgttgggcaattattttcccttcaaagctattaattagcacttcagaaaatgcaagatgaaggctttttcatcttggctgatatgctggtgaacaaaagctccaagtcaaacaacgaacttacggtcgaaatgggaaggggcaaccgcggggaagaacaaacgacgcgaagatcggccaatttttagtcacggcgaatgagtgaatttaattggcattgccccgaataagcacgaaaaaatgttttatttaattgcataaattatgagtcaatttcaaaggacttttgggaattttgagcagttttacccatttaacctcagctcaatgtttgaattattttatgaacttttgcaactaaaacagttgccaataaaaaggagggctaagattctttgatttatttaaaaataaaaaagaaccaaaagaagggcattgctgccgcttacacttttggtgaaaatcaggtcaataagtaggaacgccgacttgcgccgtgacacttgcgccgcccagccaaataatccggtgctgggacgttagtcaaaaaccatcaaaatgggcgttagtcaaaaaaccatcaaatgaataatttttgacagaaaattattcataatttcgcataaaatggatcaaattttataatatagatatttttagatagccctaagtgttttctattatcctgcaaaatttttaaaaaattctttaagtttaaaaaaagttatgacctgagaagctcaaaaaaccaagtttttttgaacatttttagtcataactttcttgatacttaacgaaactttttggaattttgtaggctaatagaaaacacttagtgctatgtaatgatatcaagaattaaaaatttagatgcttttgaaaaaggttatatcaaaaaatattttcatttgatggttttttga

SEQ ID NO: 3842 - DNA, 2980 bp, Heterodera glycines
cttgtcagactaaaccgaccctctgactaaaccggccagactaaaccgaccctctgactaaaccggccagactaaaacggccggactaaaccgaccctctgactaaaccgaccctgactaaaccggccagactaaaacggccagactaaaccggccagactaaaccgacccccaccgttcattagctcattttcttattatgaaaagccaaatcattaggggtgtaaaaaagtctcggtctcgagtctcgaaaatcgagaccgagacttgaaaacccgagactcgagaccgagaccaaaaaaacccgagacttctcgagtcgagaccgagagtctcgaacagcactactcgtcagactgcttcctccgccctccgtctcgccccgctacttgctccgtcttcgcatgctcccttttgcgaaatttttgcttttaaatggttatttattttggtactgaagtgtccattttctctgggactcagttgtcccagtgcttagatggcattggttcgagtttataccttgttttttagacttagctcatcaaaagctttcgaatgataccaaatttgtccgaatttgggcgttttaaaaggtcaggagccccccttttcactcaacttttcgagttttaaaccggtacaaaaaccggttttttggcatttccgcaattggagacctactttttcgtgcatagctcgtcgagacgaatcgattggtatatcatttatgtcatttttttccggggggttgactatagtacacccaaaattcccggtcccgtactaccctaataaaaacatagaaaataagcgctaataactcgaaaaatcaccaaaaattaattgttttggtacttttctagtttactgggcagatttcacatacattttcggaacgccgacatttgcgcctcggacatttgcgccgtgacttttgcgccgcagacacttgcgccgcgacttttgcgccgcagacacttgcgccgcccagcaaaatcgacatttgcgccgcgacacttgcgccgcccaaacaaatattttttttaatttgcaacaatttattaatcctattgctaatagttaacactaattccattcttcgaatcccttcattccgattcggtattgaagggcatgaatgtggctgatcaaatcctcgtcatttttatcttctttggcatcgtaggcaacaactagtcttcttattgcttcatcgttttcaacatatttttttggacgtggacgatcatcaagcccgcgtgtcacgtcaatttcgaatggtcgcagtctgttttgttgatactcttcttcatttttcaggacgtttatctttgtgattagtcatttgctaacttctattagggttttatcaaatattagcgttaataaattgttgccaattaaaaaaaaaatttttttgggcggcgcaaatgtcgcgctacgaataagtaatagtgctgaagtcaattgacattttgaaataggaaatgagatcgaatgggtagttgtatagaagatagttgaatttgagttgaagaagcggtcaaagggaaattttgttttttatgggaggagaaaattttggggagaattttagtaagaatgtttggagtatttgaggaagttgttggaggtctgggcaggactatttcttgaatagctggggaattgttttttgaaggattgcaattggctgtttaacttgtcgaggaggatttcttcttcaacggagttctgcgttttgggaaagtgttcgtttgccttcttctgttctggtccatttttgttgacgggaatcgggacatttgtttgtgggagttgcattgccggtaccattggagagcaaatgcactccaagaggaattcggcgggaagcgcccgactgattttttcactcaaacactgcgttttgtcatcacattatgcgaccctaatcatcgaaatggtctttgagcagcaactccaatttcttgtagaattcggtgtaaaagttcatcttgtgcacttttattggttttacaaaagtcgtcgattagagtccctaaaaacaattaattaatttcatattaattttagactttttaccgttaattcccctataattgcacataaatatgccttgttgtcatcactttcgttgtcggcagtttctaaatttaatgccattacaaagttttcctgcataaaaatttcggcacaatttgctaaaataatcatgtgtaatctcgagagtccggactgaggacgtgacccccgctgggcttccaccccccgtatttttgagggaaatattggggacgggaatttttgaaacggtgccccgtccccggcccatcgttaacccccgtccccgcattttttaaaatttcgttctctaatgtttcttcttatgttcaaacttggagcacaaaaacaccaattagcaaggccattgattttagccgactgacccaccaaaaattgccgtgtcgatggccttgccaaatcctctaattttccttttattctcctccattgcgaacttttgccgttttgcgaattccctcgtggtcattccttcggaacttttaatagttttctcattaatttcgctgatgaatttttccgtttctgtttttgaatttttcatttcttcaacaaggcctaaaattcggctttctttttcaaaatccacaagaagttgatcaacaatatcattatcagcagcagcatctgtgcagactttaccttagaaaagaaatcattaacaattttatatacacacctatggcaattaacgatagcgaatttcatcgtaaattaataattgccttaattagagttaattatccaataatagatttatttatttgtcgttttttgccttggctctgcagatgtgctttctgcttttaaatgctaaattttcttatttattttattggctaattcaaatgaattcaaatgtttttactttgtcgctaaattgcggaagtgt

SEQ ID NO: 3843 - DNA, 3756 bp, Heterodera glycines
ccctagtcgatcgtgtgcgctgtttttcgcgcaataaacaaaactcattcttttaaattttatggtattttacaattgtcatacttctctcaattccatttttgtacagtaattctttctgattcttagtttacaagccaagagagattccatgcgttttaaatgagttgaaggttcagtcccaaaggtacttggccatttcagtcccgggtctgtaattcgattgtgattgatttcaagttttttgtgaaagaattgttaccgattgttgaacgaaatttctttctccgtaaaatacttctgctttatttaatctctgcagttgttttgtgcaaatttacaccaattagtaaaattaagttaaaatttattatttctttatgaattcatttgctccgtttcttcctcgtctttgctgctttcccacagatctctgaacagtttcgtcggcttttcctgctcttccgtcgcttttcgtttccttttctgtgccgtcgtttccgtgccgtttgtcccctgcctttgctgcgcgtccctttcgagctgtttctgcagcaattgggctgcgtattgcgggtgtccctgcacaatgtgccaacccatcgccgcctcttccgtggtcataaaccttaaaaaataaattaattaataaatggaattggccattctcatggaaaacgaattgtccatcaaatttataaggcaccaaattttgatccactttttaattcagcttaaaaatgcattgaaatcccaaatacaaatgagttaacggcactaactttttcccgcattccatgcattgggccaaagaattgccgttgcgaaactgacgaagttcgaacaaatcgatggcccaaatggacgcctaaaaggaaaaaaagggagaattcgaactgaacaataaaaaaaggattggtcatttggcttagttttttctcacttttaaattttgttgccgccgaagggaatgattttccgttgtcggagtaaatggggaagaagcttaaaaaatccaaattaaattaaagatttaatttatttttacggcaccgaaatgcgtttggctctcccttagccaaatgtcgaaaaatttgataatctcagcaaattcgtaattgacttctttttggttctgccgtaattgcgcatgattttgctccattttggcggcatttacaaaaattctctcctaaattttttttgttttaaatattatattcacttttttaaaatttattcaccttaattagtctattttcgccttccctttcaattggcattttttcaatttccctgtaagggaaaaatgaaaataaaataaaaaatgagttaaaatgggaaaatttgttcaaaattcacaaatttatttattgtttttttacataaattgcaagattttcttttttcctgttcgcatttattgacaccaattggatatttatttatataaattgctttaaataaaattgtggttttgctttttctttttgctttaccctttcccttttcgaaattgatcatttcgcgccaattgatccttcagctgatcactcacttccatcaattcgttttcaatctgatctaactttgaacgaaactgctgtaaaaaagcggaaactttttaagtaaaaaagaggaataaaagtcggacaatgtgtcattaaattatttttaaattagattataaatatgactttcattttaggtgacccttttaattgggaatcacctccaattcgttgtgctttttctgcatgttctgttgctggcgttgttgatcaacagttcgcttactcattttgttttgtgcttttcactttttgttatggtggtcatataaaataaattaatatatttaatttaaactttattaaaatgctaaagaaaatcaattgatgtcatttaggaacaaatgaattgatttttaattgtctccaattgttcaccagttatattatttcatcaaaagtaattgaaagaaaggaaagggtggaataatctttaacatttaatgccatgcaatcactattttgcttcgggcaaatttggttaattgtcggattaaattttaaggaataatcaatgaaaattggaaaatttgcaaaaatgaatttttttttttaaattttttctttttggtcagcagcaaaagtcaaaaattccgtcccccgcaaaaattcaatgggcaaagcaaaaaaaaaaatgacaccaacggacgcatcgcatcgcattgacccgacgaacgccgccatgtccaaaggatcgataggcggaaaagttgcggaaaaaagcatttgaagcactttcccgccacttttcagcaaaaatcagtcaaaatcttaaggggggacatttccacttgtgagtggccaaaccaattttaaatacgtttaattgtgtgtagagagagagagagcgagagaagagaaagcaccatcatcaaattaccattataaatgtttttccgcacccaaagaaatcgaaaattggaaattaaaaaaaagatcgactcatttgttgccatgatttctgttgaaaatgattaggacagaattaatctatcgaacgataaatatctgaaatttagttaattagggagtcaattatagctaattataataattttcttaaagaaaaaataaataaaatctaccacattggaatggattcaaaaacctgctaatttcattaatattaaggaaaaatttttcaaacaaagacaaaaaaaaccttgcttccatatgtgaggcttaagaaatggacgaggctttgcctaattttctggctttttgagatgaagatgaggttaactttttttttaaaaaagattttctgcaaattatggcttttaaattttcatattggaggttactaatttgtaagatgagctgaattggttacgatttttatgaatgtcaataacttttttggattaaattaaattaaaatatttgtgtcgtggggcggaatcgaacccacacctcttttacattgaccatctcacaaaaaccactgagacacagataaaaatactttctgaaccgggagcctaaattttcgatgttttttcaaacaaacaaagcttacttctttattaaattattgtaattatttttgatcaaaaagaattaatggatctatatttttgaattgtttttccttgggaaaaaatattttaaaatatagtttttttagatttttattttattaatttattatttaaaaaaatttgtctgcgttttgtttgcgatgcataggcaattaaataatatgaataaataaacgtggattatcctcccataattaagaaaataaagaaaaaattcattttgactttttaaataaacaactcttatttaaaactaattcaattattattgaaaattcattttaaaaaggcattattatgatcataagaattgcagcaattctgccgattatttttgtttatggcatggaacgtaagagaacatcaaaaaattgattaataggttattaaaaattttcaaaaaataattaaggtaatttagggtacccggacacaacaaataaaagagacaatttagcaatgaagaaaaagcagcaggggaatttgagctatttatattcaattggagaagacgaaaaagtgttaattgattattaattaattaactatttaattttaaaattaatcttttaaatgaatccgcagaaaactttggacgaagaaatgtatgaagctgatttgaacattaaacgctttaaattgga

SEQ ID NO: 3844 - DNA, 7075 bp, Heterodera glycines
cttaaatgattaaaaacaaattattattgtaaatcaaatatttttagagttcccaattttttcaaaatgtcgagctctaaaataatattttccattgggctaaaaatgaaaccaatatatatatatatatatatatattaaatgacttttgcctttggtataaaggctgttttttagggtgtccattaccaatttgcttaaaagggcatttgaaaaatgaaatttaaatcaaattgaaaatagaattcaatagaattgctagaaatgtcctttgaaaataattaaaaattacaatttacattttcaaaatttatataaaataattttattttcgaaataattcaaaaaatcaaaaaaaaaaatttctgccgaataaaaacataaaaaagcacaactattaatatgaggtagccaattttttaaacagaatcagcttttttagcttccaatatatttatgagtggaataaatataatttatttaagtaaaagaaaatattcaaatttattttaattaaaaaaacagtttttcaaaaactttacttttttttatctgtttacttttatgttcagttcatgcctttgccaatcgtcaaatgcccaaaaattaatttccgcccccaaaaaaagtaaagggcaatggcaatacaatttaatgccactcgggggaatttgtgttgtgtggcaaaaaaaaactaagccaccctccgatgcgacagaagaagaagaagccatggagcagaatttttggctatacataaaaatgaattaaaattccaaaagtcaaaagggaaaggaaacaatttaaaaattgaaaaaataaataattatgattttatttaaatttttttaaaaaaggatgaaaataatttatatgagaaatgtttttacgacagatgttcagaaaaaaataataattaaaggaagtgaaagcagacagagaacatttcccatgggttttgggcgacattaaaagtctgaaaatttttggtctttgaacatttatctgtttggatgaagcggcttttgccaaattaattttatacggaacaaattttgcattcgcagtttggtttaaaaaagaaatgccatttttagattatgtttttgttttgtctggcgtcagatgtggcgctaattagaaattttgatcttgaatttaacaattccttttcattggattcggaatcatttaatttataaaatgtttaaattagtcatttaaagcttataatttaaaaaaattttaaaattttgtttaattttttcaatttctttttttcattaaaatattttgtttatcgagcttaaacaaataaatcgatggttttagtggaattaaaccgggcatttttcgcctgtgaggcaatgctgaaaattcaattttcgctttgctagaaaaatgaatttgtaagcgtaagttttgttcacaccattgtaaatgtgttagagcttagagcagaaaaaatgaaataaaaaattctaaaaatataaataaataaataatagaattaaaggtaataaaacaatttctaaaataattaaaaattgattcattttgattgaaaacacttggcaaaatgaacttttattaaaaatgtttttaagcagattggctggcaagcaaacgatcaatcaaattgtgatcggcttcgtgagaacaaaatatcatcgaggatttcaattgaaaattatcagagatcggctgtcggcaatcgatggaagaattttaaaaaaatttaagaaacaataaacaattaattgcattagtttagggagggaaattattcaaaaagttttgcgggggcttttctgctaaatctatatatattatatatatataatatattatataatatataactctttttataacgattcatattcgatatacatttcaaggatttgaaaaatttcttaagaacatgtaaaacattttaattttttgattttttatttttgaataaaaaaaaagtttttgcttttatgatataataaataaaaatcagacttagttggttttttctagaaaatatataaaatattttgacaaacatttcactgattgtcgaaattgcaatttaattaaatcgctcctttttcaaaacgaagaaaaaagttttccccacttaaaagtcgatttttaaagtgatttttttcatttttataatttttttcaaaataaaatttttataagttttgttattaatctgagaataagaatttcattttcaaaatagaaaaatgaattaaaatacaccatgaattttaactgataaaaaacaaattctacaaaaaacatttaaaaaaaattcatatctaaattatatatatgtatatttttaatttattttgttttttatttgctctaaaggaataaaatgtaaaaattttttattctcgcagaaaatcaattcgtatagggtggaattgtacaagggcacaaatacatatgtgcattataattatggattaacatatgcatagccattcaacaaaataatttaatatataagcattaaataaatcgataactcacgtgaatattcattgaaaatatttcttaatataatgggaatgagaaaacataaataagccatcaaatcatttctttacaacaagaggaaaaatcttttttttattattattatttaaaattttgctagaatataaatttcaaaggcgacaaatgaaaccgatagctttggtttttatcattttatttaattcattttctaatgccatcgctttaccaattccaaacacaaagctgctgatgagtgatggtgaagcaagcgaaatggaagccgaatttggaaagcgccaaatgattaagcgtaatttgtttattagtagagccgggattttgaggcatatgcctttttttgctaacttgctatggcctatacgcacgaaaaacgagtttttaacttggtttgaagcttctagcttgaacttttttggtgccttttttgccttttggtgcctttttcatgccttttttagtattttttgaaaagaaaaatggaaaattttgcaatttttcttatcatatttcttacaatttccaaaaaaattttcccagcggcgcctgtcggcaccgccggacccccattgagaaattttcgtgcctaaaagtccgggctctatttattagtaatgaattaatttgtttatttttaatgggttacggatggtcccttcgcaaatcatttttggcattgattactttatattaaagcactgaatcgggatttggtactgagttgggattttcgctttttgcttaagattttaaaattgatctcatttacctatacattctttaaatcaaaattttaagaaaataatcattaccataaatttgttcaacaaaatgagcatggcttaagcaatcgaagaggacagcgttcagttgacgattgtccagattgttttgggccaatgttcgtctacatcagtgataaaaccagttcaagcgcgcaaaattcaaaaaattcaccgcaaaatatagcagttttttacgccatcattatgatcattgtcgttggcatatttcgcattcgcaacggaatttttttctgattttttaaaatatttttgttattgtgcttgggatggactgcccaaatgtgtaaatctcctcagcgccttttgtagggcaatttctgagttggaccaggtgtttactgatggcatttcccaatttctcccttaatatgaaaaatttgctaaattttagactttttccctaaaggaaattggaattccaatacccaaatatttttcggaaatttcaaaaatttagaattgagaatgttgagcttatttattttgatttcttcgaattcaattttttcatttttctttcgatttcggttaaaacatccaaatttttattcattagcgcctaatttgttcgtttgccaaacaatgtttaattaagtgaaaatttcgacgaaattggtaattataaatgtccaccatattaattttgtataggcgtactttagagaagacaaggcttccccgagaggatgattatggatcaattaagcagacaattgatactatataatcaaaattattacagtagtattttgatcaggtgtacttttttcgaagtctttttatgttttaaaatatttttaatgatgtaataagaaaatatccttatatttgacctatttttcggccaaataatttgcataatatgaaaaaatatcgaaaaatgatttacatagagaggatccggtccaaaaaagaaaagcgaaatgtgctattcaaattaattgaacaattaactaattaaatagttggaagggtcattggcacaccgtaaaaagttatttttaaaagggattttgtcattttctttatattttccctcttaaaattaaattttttcaaaatttccaaaatcccgcaatcccgcgctgtatcccgcagattttaaatgcgggattaatcccgcgggatcccgtcccgcaaaaaatttgaattccaatcccgcagcgggatccgcaatttgaaatttcccgtctctatgcagcaacacgggctttatttatttatttatcatgacaatatcgaaaaatcagtcatttaaatgttacgaaatacatcaatcgactacaatttgcatagctcagactcgaaaacacgtgaatatttatcgaaaatatttctataattttatttaaatgagaaaatgtaaattaatcaatcaaatcatttcttacaaattacaaactaaaaaaaaataaatcaaatatataccgatttatatatctatagtataacatgtgaagattcattgaaaatattttctaatattattatttagaattaatcaataaatgatttcattacaaactacaggcttaatgtctaaaactaaaaccaaaaaattaccaatttttaaagcttaatcttccttatggaaccaaattcgcataatttgttggctaaagccgaacgattattaattgttatatttgtgatcaggtaatcatttttcaatttcgctagcacaatgttaatcaaatgttttccaatgcttttaggcgtaaatcttatggaactttgaaacccaaattcgaattcaaatagaacaatttcatcaaaaattgagtactaaagggaagataaattaaaaattacttcgtttatttatgtgttaaaatttttaattaaaattgattgtttacccctggcattcaaaaaatgaattttattatgtatttattattacgtgttatttattaataaaatatttgtaaacaaatgtcgccattccatcgttgtggacaatttccaatcttccgccatttctttacatccattcgtttcttacaatcagatgactaaattgaggctgactttggcacaaattttaaattcaatttaaatttttatttactttaaacttgttgcggttgcaattcattcattttaattataaataattatataagaaatttaaactgaaatgataattttaaataaatataaattaatagggcttcgatttttaggtaaatacctaaaatttttgcgcacttgtaacgttgagataagcataaaaaacataaaaaacgagtggttttgagcttctacacccacttttataatacctatttttacctatttcgggatttttctacctattacctaggtacctatttttatacctatttcggcattttggttacctattttaaggattttcaaaaaattcttaacaaaaatgcaataaaatcaaaaaatatacccataagaatcgaccaaaaaaattttcaaaaatgcaccctaagaattggaaaaatttctcaaaaatttatcccaaaatttatttattttttctattgacaaaatttttaatttaaaatgtcaatattatctaagaaaatattaatatatttaaattttcgtttacaaagagatatgtagaaccaaaattttccctctttgtttgcttttttccactaaaaaatcgttaataaaaatttttatttacctattttggtacctattttggaatttttgtacctatttaatacctattttgagattttttttttaactttttaagtacctattctgcgattttttttacctaaaaatcgaagccctataaattaattgttagaataaattatttctttaataaatgaacaaatatttattgggctcaataattcattattttcccgttttcaatggatggtgatgattcattttgcttcagaacattaatcaaaaatttaatgtttaaaaaagaaaagaaaattaattgactattcataattgatatgatcgtatgaatggatgggtggtctaaatgaaattatcggataaattaaaaagacatttttcgaatggtttttcagtccaatgctttattagtttattgttgcgaattgctcatttcaagcattagtcactgttgttgagataatataataaatttaaaattcgaatttattatttctattttttagttcgatggatatatcaaattaattgataatctgcataaaatgggtcactggtcacccatttggcctataaattagtttgccaggaatgttcgcatgggtctccgttttgttcaacagttcgttaattttggtcacttttacgaaaatgtaagattttttaaaattcaaatttaatttattttcggtttaatgaaaggatcacaaggtgtggtattggctttcaattcgttttgccaactgtttttcgcttgtcctttccttgccaattttttggccctcattttacagtataatacagtccattaccgtatctgtactggtactcttatggcatcaactttgacatcgtatgcctcatttttgacactttttttgatatctgccgaacgattattgattgttctgtttccaattaagaaaataaattttaattatttaatcattttttagaatgaattggatcaaacaacaaacaattccaatacccggtacccgaccgggtaggtccgggtacccgggtaccaaaagtgcactggtaagaatgggggtttgattgaaaattagtgaagaaaa

SEQ ID NO: 3845 - DNA, 2350 bp, Heterodera glycines
gttcataaggtaatttggactatacaacaaaaactcctgtgttcattcgatagttgcgagaaattccccggagaaactgcaaaataatgtgaaaatgtgcaaatcagaatgtacatcaaattggttaactattaaaaaataataagatttggaataagtaaaattgtaaaaaatgagcgaatgttaattaatcctaacttatgccaagtggcgagggatccctcaggtttagtttttagaatcttaatttttaaaaaagcacatttttctatttttgggttggggcccaaacgaccccggggcccaaaaacgggggcccaaacgctctggtctctgaagacaaacatgagaaagatcaaataactacaaataatatttaaatgtaaatgataacgcgaaaagaatcgccatgaaaaataacaaataaaaggataaagcactatttattttcgaaaaatttttatccaaaaatgtaatttaaaattttatttacatatttaatttacatatttgctacatattttgtatttttatacatatttcttacataatatattttgcgcttttttcttacatataatcgctagggttataaattatatggattaacatattttttctgcgcatatgctacgaagaaaggggctcaaaaatagcatttctaagttaaaattttttggtttggtgaaagtttttagtctatataaatccatattttgggggttttcgggaataaacccatatttcgacatttttgaatttttagtccatatttggcaaattttcacaagaaaaatgcaaaaaagcgaaaaatacacccctaaagatcgacttttttggaaatttttaaaaaatacacacctaaaaagagaattttttcgaaatttcgtaaattttttttaggtattttatccacttccaaaaattttcgctgaaaacatgaggttattacaaaaattttgggttatatttgatttgcaattgtgaagcttgtgccgcccaacaaaagcgacacactttttgctactgtactaaagattttgtacataatttcaattagcaggaatattactagacaaaactttaaataaaactaaacaaagccaactaatagtttcctagtttagttaatgcttcattttaaaatttatttttgagtgggtggcgaaaatgccggtttttctggtcggcccaaatgtcgtagcggaaatataggccaagcaaaacaatcattttatgtcattaacaccaggaattggttttgcatacatcttttatcttttagggtaaaattgaagaattatgttatttaattgaaaataaatttattaaatttttaaattcaaaaaattcctccgatggaattattgctatttcgtcgcgccgattttgaaaaattgtacaattgtacggattcaatgcgtaaaatcccactggaacagcgaacagacattgtgaatggatgtgttttggtcacactttttttcgtttttgaggtttttttgaggggagataattaaggctgaccaaaagatgacaaaaaagcctagaaaatttctgaaaattttaaaagaaatattcgtggttggccacttcacacaaaagtgcaaatttggcggttcaaaaaaagtgcacatttgggcacttcactgaagtgcaaaaatcaaacatttcacttttcctatgattttttatcaattttttaaattttaaatatgttaaaatttaaatttttgcttaaatacaattcacatagaagtttttttgatctcgaataaaaataattaaaaatctcgaataaaaatatttaaatttttccaaatattaaataaaatcattaatcagattactttgaatttttaataattttgaagcttaaatggtgcctaaaaaattttataaaataaagcctaagcataggcataggcccatctaatttagcttgatatgaagcggacaaatttctatataaatatttcaattttttatataatttgagtgctaattgaactttcaaatatttaaaaaattaaaagtaatcttgctaatgattttatttaatattaagaaattttaattatttttattcgaaatccaacaaaattttagatgcatttcagcatcaatttaattaaattttaacatatataaaaactaaaaaaattgataaaaatcataggaaaaatcaaatgtttgatttttgcactttttgtgtagtggcctagcaacgaaatattttttaagtttctttacttcccgtgtatggtgtcaattttcaaatacatgaacaacaatccatgttacaaattgatgtttctgattggcatattggacatggttattattttaa

SEQ ID NO: 3846 - DNA, 3960 bp, Heterodera glycines
gttttcgaggtcgctgaatacgtactgggcctatgcctaagcctaagcttaagcataagctgaagcctaagcctaggcctaagcaagctgaagcctaggtctaagctgaaccctaagcctaagctgaagcctaagctgaagcctaagcctaggcctaagctgaaccctaagcctaagctgaagcctaagcctaggcctaggcaagctgaagcctaagcctaggcctaagcaagctgaagcctaagcctaggcctaagctgaaccctaagcctaagctgaagcctaagcctaggcctaggcaagctgaagcctaagcctagatacatgccaccaaattagcgcaaattttattacgcatttctcggcagtttggccaatattttgatgattttgtgtttgctgaaaaaaaactccgatttctcgagttaaggttatttaattggtcaaaatggatgtcataaccgttttcagcgacctcgaaaacccataaaaatatgttttccttgtaatttatgaatttcgaattttggttcgaattcgggttcgggattcggaattatgaaaaataaatgtcatattcgtgatcagcgccccaaattaccctagaaatgactttttatttgaaaatttcagggggggggtcacaaaacagaaaagagccgaaaattcgcctacattgaatttgcgactgatatcgttttttataacccgtctaaatgtttataatagcttaagaaagcttccccttgccaagagctttcaaagattgcccatttttgacaaaaaatcttcaaaagtgattttcaaaacccgttaaaaaattccaatttgcctaataaaagtcaatattagtaattcatccttcgaagacgagaggtccgtcagtcatcagtcgatcacacgataaatcaaattcataactcattcggttggcagttcacgaaccgacccgactttcataaattcgtgcgttattaatgtgctctcatttctttttcctaattgtttcttcgatttcccattttctgttcgtccaatggctggccaaccgaaaaaataaatgatggattatgtaaaaagaaaaattcgttaagaatttgttggaggaacgatgcaagaaaaaggtgtcgatcataaccgatcgacacacgaaccaaacaaagtaaaacatcgattgagttttgtttttgattaatgagtcaacggatgaaacggcggacgaacggagtaatggcgaaggtcgaaggaaaaggaagaagaagcattatcatttatgatagccggagattgcgtaaatagtgcagaaataagccatcactaaaaatagagaagtgatgacgacaaaacggggatgacaaaagcggcggatgaaatgaaatgaatgaatgaagcagcacccggcgagaaccattcatcggcgcagtttcatacttcacacatcaaagcactaaaaattatatcccaattaaacgaatcaaaacgcaaaaatggatggattaattgccaaagaaaacggcggcaattaatttacaaattgtttctatagcgcagcaacagaataaagctaataaaagttttatttttattttctcaaaatcttttaatgcgtcgaatcaacggaaatgaaaatggtggccaattgtttcccctgacagcagttccggaaatgcatgttccgtaacaaattcctattcttccaattatattccgaattcctttaaaagaacgcatcgcataaaagaaacatttcgccgcaccaattttaattaaaatttgttgtttttttcacgtaccgcaaacaacaacaatcaattcaattattgttttcattttattttatttgccggtatttttttttgatgcggtaatttcggcccggcgccaagcgctaaaagttggcacaatttaaataatttcgaatcattaaaaaaccggaatttgaaaagtttacttttcggcttttccgggtgtatgtataagattcgtcatcagcgaccccaataacctcgtttacaaatcactctcagagtttcataataccgcaaaaaacagaaaaaaggcatacctaaattcagttaaaaaatttgctgcgcaggttagtaaactgttgaattaccttcaaatgattcataaattaataaatcttttttgcccctttgttgcatggttaccattcattccgccggtgtaaaaaatttgccttgccttttcttcaccttatgctattcattttttctttttcttttcatattttgcaaattcgtttcgtccgttttgaatggttccgcgccgaatgacgtcacttgtgctgaacattggccaagacgaggccaaggcgcagcagcagcagaagcactgcgttttgctgggagagaaaggcggcgaagcggagcacggcattttgttgttgggggaagagagggaaggaggcaaaagaggacggagaatggacggcaaaagcaatggcgggcccagaagaaacagcggggaggaggaggcggaggaagagggcacggacagtgccgacgacacagcatcgatcatgacggcggcacttcattttgcacattccacacgatatttggtctcattttatgttcttacacaaaaaagaagagccggggggacttttatgggaaaagtgtgccgaattacttgaaattgaagatttgtgtttcaaattccaatgttttaaggtgctctttctgacaattttgtgcctcacaatggccatgtccaattcggtggcgctccatttcaccgtcatttgtatgtacaaagatgctgctgatgtcgtccaattgggcgatggttcggctgatcctccgatgagtgacagcggctgggaaccgaccgtaccaccaccgcaaattgattttgacgggcagcgacagcatttttattccaatttcaccgccaccgtattgtcgtcatccaccagcagaaacaacggcagtcagtaaaacgacagaccattaaaaatcggccattattttttgccaactttaagcacccaatcaactgatgttcagcaacacccaacgtgccgttctcttctccgccgtccccgttggctctttgctcggctctttgcccatcactccgcttgttttgcgttatggcatgcggtaattagcatctagccacattgattttgtacacatttcacctaatttgggatgccacaatctgtcattcagtttatttcaagtccgaatgctagacattagtcttttttcacactgattatcattttgaaaattgggaagggataccttaacataaagtacggcatcggatttagaggtttcccttccccactttagcaagacgttctttctgtacggtcttctgtccatgttcgccactttgttcacccccgtgtccgcctacacgcactttttccttttgcttctgatgcgtttgcttcagggcgttgcggttgcaatttgtttccctgccagtggtcagtccgactttttttttcactcatttatatttttggggaggcgagtcggtcacagcgaaacatcctttccgagaatttttttaaaagtttttcaaataattattaaaacaatttggtgaggggaaatgagttgcgttccgtttgtcttgtatgagttttggttttccccttttggtggcattatttccgagtggtgtccgttgcgcagtgctggcactgtcattgcgcttctctcctgtcacattcaggtgctttgttgtaatggttgtctaattccttttaccacatctcatttttcacttttgcttctcacagttcggccccattttaacgatgccattggcgggcgaactgtgcgagtcgcgttggggttggccggcactttattacattcaggtgggggtgggaagtggaggttaatggatttttaaaatctgcatgctgtgtgcaaataaccgttacattgggctttataccgtattccctcattt

SEQ ID NO: 3847 - DNA, 4220 bp, Heterodera glycines
  misc_feature (11)..(11): n is a, c, g, or t
  misc_feature (14)..(15): n is a, c, g, or t
tataaaaaatntannaattaattttcacttttcacctccgttttcagtctctgctcaccgccctgtgttttgtcgcatttttcgcctttttccgcgattcgcctcgtcatcacagaaatgtttcgagaagagaattgggcaaaatctcacgcggaaagtcttcctcccactcggacggttcggcacgcagagaaatcccttacggcgcaatggtggacaaagcaaaatgccaccattggcattttttggaatttctccaatttctttcattttttacagttccgtgacccggcagtgtggggcatctttacgtgtacaatgggcaccacttttggcttttacgttttcgtgcagtacggccccatttatctgaacaaagtccgcttcgaattcccttccccccttcccaatgcatttatttttgtctaaaggccctcaaatttgatgtcgaacgcaccggctttgcggtggcattgccaagtcttttgtcggtgttggccaaattcatcgttgggcccgccagtgattatgcgacgtatgtgctcaatttggtttttctgttacccttaatttgccactaattaccgttcctttgtgagtcattcccccgtcctaaaatttcagctttttgtccgaccgttcccgtgtcattttcttcgccactctctcccaattttcgatggccctttgcttttgtgcgttggctcttctcccctccgattcgccgcgttggcttctccaaatgtttttcaccgccgttactgtcgcttgtggcataaattgcgcgggggtaatttaaaaaacaaattttatttttgtaattttatgttttaggttgggaaaagtgtacaattggtcagtgttattatgaattattacaaaattaaacatagagactaatatattttttaaatttcaacagaaatttctccccattttttcagatttcgcgtcaatacgctcccgttttgtccacgttcaagtgatcaaaccaataatcctttttcccatttgttgcttcctcggtgttcagtgtgttcgcctgttcctgcaccatcatgctcatccccgtgttggtcagtgcgctggcgcccgacaacgaaccgtaccaggcgagaaaagcaattaatgcacacaaatgccgatcagaaaatgatataacgcccttgctgctgttctgtttcagtggtctcgcatctttctgatcgccgctgcggtgattctcgtctgtctgctggtgttcgactgcaccgccgaggcgtctccgcgtccgtggacaaagacggcgacatttgccaaacaatcgacagacgaagaggacgtgaaaacggacgaaagaaagggccagatggaagagacggaagagagacagacggagaaagagagggggacggacaatggaacggcacggacgacggacacggcatcgagagcgatataatgagagttgacaccctgaggctcgggagcgaaactctcgagctgcaccaattttgatttttttatcattcgatgaatttgcccatcaatttggccaattaaaaaaacgcgttcgctttctcattttgtgtaatttgtcacttactttaccattcttttttttgttgttgtgatttgctacgcttaatttgtaacactttttgttttttgatctcccccccccccccccacaatccctcacacattttttgctgaattcgacattttacagcccaattttgcagatcaatcaatgctcattcattgttttgctttacaatttcatcactttctttcattttttatttcttttattgtaactttcgttggtattattttcctattaatatttttgttcaaaattttattcccttcagtttttatttcaataaaaaaatggtaataaattttgtgagtgtatttgtgtaaagatttgagtgtatataaacaaaaaaaacaccggaaaatgaattgtgaaaatggcaaattgggcagaaaatgttggaaaatccataaaaaaagagcaattgagaaagagttttgaggtgaaagacagacaaatcccatcttttgggaaaagaggataagccgaagactgactagtgatcactgatcggaaatgatttccaatcacaaaatggatgggttttgtcccctggaaaattgggcacaaagtcgctattatattgtataatccagagtaaattgttttctgttttagtgtccaattctccataggattgacccacgctgatcactgcttttccctgatcaggcgggcttggcccagtctgaggatcaaggttaagtgggtttagccctgactaccggagatcattccctgatcaggtgggtcggctgggcttagcccggcccgctcgctgattagaggaggatccaattggattttgattgcttgcttctaagccggggagtgatgagatttccaatcacaaatctgggcaggcttggtggtctgcttctgactgatcacagttttgcttgtccccttccgtttttcctctgctgatcacagtgaccccgttcttcctcgctgtgccgaggaaaccgtcgagtcggtgttttcccgcttcagcggcaacggtggcctctgctgcagctgctgctgcgagtggcgaccgttggcgccgccatgccgcaccgccgtcgtccgttggcgccgttctccgccgctcccgcgccgtccactctgaacactttcggagtccatgtcgctgaactcgtccgtcagcggcgccccatggccccgcggaggtctcagcggtggcggcggcggacgatgcgagcggtggtgggcgtgtgccgtgaccgaaacgcattggtcagacgcggcggacgcgcgcgagcggcgtcgctcatctgaaatacaattgttggtttgtctttggctattcccctgaactcgcatcgtgccggcagcggtggtggcggtggcggcactcgcggtggcggaggaggcggaaagggcacgtcgtgccggaatgccgctacatcatccgcccccatggcgccgccgctttccaccgcccactcgatgtgatggcgtggacgcggcggcggtcgcccgcgcggcggtggcggcggatattgcccctccgcgtcacattcgttctgtccacgccgaacactccggtagcgccgctggcgacgtaattcgtccgccgcactttcgccaggcggaggggacgcgtccaacaaaggctgccggtgcctctttttcttgccccattttgcgtgcccattgtcgcggtcgtccagcgtggccaacttaaaaaggagtcaagagtctcgaagttcaggcacgacatcggcacatgaaggcgcaagtgccatgtttgtgtatgccattagttggcaacccgtctgtacctcgtcctcctctagcccagtgaaagccctgttgcgcgcctggtcgcgccgctccctccgctccgcgcgcggttcttccgcgtcccatgagtccgcttcgctctccattccctcgtcgtcctcctctgtgcccatccactcttcgtcttcctccgtgtctctggccgtcctgtgcttctgccgcactctctcgcgcctccgcctccgtctgtttctgttccgtctcttccgtcgtcgttcttcctcatcctcttcctccccctctccgttctgttgcgcgtcctttcgctgcaaaagcgcgttcagaatggcgtacagaatgatgaagaaggcgagcagtgcaaggccaagtgcgagcagcaaataggggaacagacctaaatgacggaaaaatttacacacaaattttaagagaaaaaaattttattgtattttttcgtccccccgtgcccgcggcacaaatccccgtgaaagcggaagcattccccccaaaaatgcctgaattggctagccaagggcggcattcattcattaattcattcactgcttgggctttgctcaccgtccatgtcctggcccatgtcaatgccccacccgccccctcctccgccagcgtttgccgtcgcgccccgcgccgcgtcattcggctgtgccgtccgcttctgttgttgctgcaagacgttgttgttccaccgtcttcgatgctgatgggtgtgctcctccgcttcaacagtctaagcacatgacaattcgtcatcttttttgatttgtccatttcttattgacaatttgtctctttttttactaattatcgaagctcctttgtccatttttgtgtatcatttgtcttt

SEQ ID NO: 3848 - DNA, 1238 bp, Heterodera glycines
atttgcgaaaggatcctcatccatttgatgagcctcgatgagggggaggaggaggcggggaggggccatttcctgcgactttaccccgtcgtcctttgctgttacgtcatggaaacgccgagccgagtgtccgccgctttggtcaatatgtgcacacaaatagcaaaagctaaaggtgagcgatgaagcaatcactaaacaaaataggggaaaattaatggtaaattcgttttaatttagaaaataaaaatggggacgaacattccgaattgattcgccaatggactcgccatttgttgaatttcctcaaggagagcgacctgtttaggcaagcactgaagacatatgacgtcgaaatcgctctaatggtcgcctcaatcgaccaatcttgttagttttatgaaatgtttttgtttaattatttttttaaattcaggatccaaaggaataccttccgtcccccccccccgcccccggggggttgtgacaatgagttgatcagtcgcgtggtggtggcgggggcgacaactcactcaccaaaccgaccgaccgaccgactcttccattattccccattgatttggtgatcagcgcggggaaaacgaatcggggagggggagaaattggtgagaaaaacggcagagaaatgataataagagagaaatgtcgaggaaatgcggggaaatgaagcggggaatggtcgaaaaattttcaaaaaatataaaataaaccgagaataaaatgatcggaaattggggagattcgtagaattaagtatggaaatgctgcagggaaataattaggggaaaattaacagcagggaaaaatatgaacaaattaaccggagaaaatttgagggggggggggggaactaattggaaaaatgcggtgcattaattgggacacaattagtcggagccggggaatgaccaaaaaacggggaactgatcggtggaaaatgcgagaaattggtcaaagaatgcgggaaataatcggagaaaaatgcgggggaaacgacaaaaaaagaaaccggggaaattgattttgaaagaatgctgagaagtgattagagagaaacatgcggcgaattaatgaataaaaaaggtcaaagaatgcgggaaaaaatcagagaaaaacgccgggggcgacagatcgaaagaggaattagtcatcgatttaaaagatgacaaaaactgtggtggacaacggacggcgcggcggaagtgatcggaggcact

SEQ ID NO: 3849 - DNA, 3078 bp, Heterodera glycines
  misc_feature (48)..(48): n is a, c, g, or t
  misc_feature (3058)..(3058): n is a, c, g, or t
atgcgttggtggacaaacatttcaatggcaaaagcgcatttactattntggagacgaatcgaaattcgtcgcaagtacaaaggaccagaaacgaagctgtctgtgtggatgtatgacggatgtgcggaatttccattgccggacgaccgtccgttgcccagcaaaattcgctttaagaatcttcagacattcgccacttgcgcttttcccgtggtgatcatttggaccatttgcttcgtcaaatttcaccgacaattctcgctgatcttaaccaattgaattcaatccattcatttggtctgtcgcccgctgcgtttggtgatggttttgatgggccaatttcaacaatttcttctggccaagcattgtccaaatggttgcactctccgagaaaagatggacaaccaaagcgattgcattgcggtaattacaacaaacaaacgaacactgattggatcaacaatttcaaggaggtgtggccataattcgacaaatcactgattttgttttccaatcaaattgtttagcattttctccgtgccaatgccatttcttccgtcagttacgaaattcatttttctgttcatgtgccgtcaatacaaatggtgccatttgaattggtgaacgaatggacgaaggaaaagctgacattggccaaggcaaacgaaaatgaatgggagaaaaacagttggataatgaaacgatgcaaaattattggggagacagcggcggtcaattggaaagacggaaattgggacaacaattgtaacaatgtgttcatttggctttatatttgcaataattgcattgggtgagcaattaaaaaaaacatttgatttttatccaatttgaattttgcgcttaattaaggccattgtctccgccaccggcagaagaaacgggacaaagcatcacaaaagtggcgtcttctgctgacgatgaatgagtgaaggacaaaagaacgaaacaatggtgattagtggaagaagaaatgaattatttaaaaatggccaaccgatcataattcatcagtgatcaaatgcaatttatgatgaaaacctctcaatttcggtaaataaatcggacatataaaaatggcaaaaaatatatttacgaaacacaaaaattttgagatttgcacaaaataatcaacaaaaattgacttttcaggcagggatttccgggatcactgatcactagggcttccaattatatggaaatccatatttttttcctggacacgcaagaaaaacatgtttttagcttggtttgaagcttctaggatggatttattctatatccatatttcgcgattatgtccatattttgttagccattttagatgtattttaattgaatttaatgaatttgaagaatatttttgaaaatttacccctcaattcggaaaatttatgtccatatttttgctattttatgttcatatttcgcgatttttcctaggttttattgccatattccgagattttatatccatatttttggaagccctactaatcactagggctgggacaaatattttgataaaaaagccagaaatatttacgaaaaaatatttttctgtaagtttttggcgggccaggacgttttcgcgtggttgcatataaaagagaagtgcaaaatcaactctaagcacacttattgatgtcaacagaaattcaactaatataagaaaagaaaatttacaaaagcctagtaaaatgtcatgggacgcgtaaaatgttataggacgcgtaaaatgtcatgggacgcgtaaaatgttatgggacgcgtaaaatgttatgggacgcgtaaaatgttatgggacgcgtaaaatgttatgggacgcgtaaaatgtcatgggacgcgtaaaaccgactagaaccaattttaattattttttccgtttgacgcacatccgaccaaactgacaaattattgtagaagatactagccgcaagaaataaaaaagttaagaaatttgtccgaattcgggttcgggattcgaaacatggatgttttgcacaaatccgaccaatttcagtcctaaacagctactcacgcgaaaacgtaccccacgcgaaaacgaccccgaccggtttttggggtctattccttcaaaataaaaccctagaaaataggccctaataactcgaaaagtagcttaacaacagccaaaaaaaatatgtttttcgtgcgtttcaggccatggggagctcaggaaacaaatatgtaaaaacctaaaaacatagccctatttataacacatgaacaaaaagatacaacaaacttcatcaatccctcccttttcatgactataaaaggtaaaagtgaaggatactgacgggatggaaaatgtatataaattatataccaatcgactccgctcggtctctaatgaaagaatccgaaagaattttttggcggtaaccaatcgctgaagagttacagacccgggactgaaatgacaaaatggctttgggactgaaccgtccaaacccttagacgcatggaattgcgacaaaattcatataaatcgattccgctcggtctctaatgaaagaatccgaaagaattttttggcggtaaccaatcgctgaagagttacagacccgggactgaaatgacaaaatggctttgggactgaaccgtccaaacccttaaacgcatggaattgcgacaaaattcatataaatcgattccgcacggtctgctaataaagaattcgaaagaatttttggataaaaaagaaattgacaaaagttacgggtccttaaaaatctcaaaaaatgatttattgttaattaaaaaattaatttaggtgagccaaaaaaaacgtaaaaggtttttgaacttcgcaaaattaaaatagtcctaaaattttgaatgttatcatgattttccttgaacttataaagattttaatttaaaaaaatggcaattctgaataaaatctgataaaaacttgtgctgctccatttttcctaggccaatgacttcttttaaagattttttttaatagctcacgtttaaaattaactgtagttttaatatttgccanaaaattgcgcaaaatttcca

SEQ ID NO: 3850 - DNA, 3605 bp, Heterodera glycines
gcccgcgcccaagcgcaatggactttttaattttaaaaatttttttaggtaactattttgggttttttggtcttaaaaatcccagtccttctcatttgcaactgcaatcagtgaataaaaattattttggcttattttttggctgaaaattatgtcactattcgtcactatttcggactttttgtcactatttcttcactatttcgagatttttcgtcactaaaagttgctgccctaatgatgtatattaagcattaacagtacaattatggtgaataaaaagtatattcacaattttttgtctcaaaaaaattttgcaaaacaaaagtcactccccccttttgttttgataaaattaaaaatctgtcactttataactagcgccaaatttgcttaataggcccaaataattgtcatattcgtgatcagcgacctctaaaacccccgggcacttggtttcatgactttataaacaaaacaaaaaaatttaccaaaaaaaagtttaaaaaattttcaaaaacggtgactttttcactagcgcctcgagatttttagtcactaaaattcctagccctagttattaccaaaaatgttgtaaaaaacttggttttttgagcttctcaagtcctcccattggcacattgtccaacccctcggacgccaattggcaacaatttaaggcgaacaaaattcaaaaattatttggataaaatgtgatttttacgtttctttcatcaagtatatcagggttacccttgaaaatttcccgaaataagaacatcgctggtcaaaaataagattttagggtcaaaaataaggacattttttaaaacacgcttccaaaactttaaatgcatttttattcaacaaaaccaagcattactcaccgccaactatttttctgcgcaattccggcttagaaatgagaaatttatacatttccgaaaatcaattttaattttttaaattttttgggtatggatgagggaagagagtccggcggtgtcgataggcgccgcggggaaattttttgaaaatttaatgcaattttttaacaagttctgtccaaaaaatgaccaaaatttgcgatcttgggctaattttaagaaaaaaaaataggattggaaaattttaagaattttaatgaattttgttaggaattagccaaatttttcagaaatttcctcttttaaatgaaaataaggcactcccaaatcagaacatttcttagaaataataacagatacagctctaatagacgttgctggaaaaatttttgtaatttttaatacgaattcttaacgattttgttcaaaaaatgacaaaattacgattttgagccaattttttaaagagaataagaaaccgccgagagaaaaatttgaatattaaatgaatcttgttaagattttgcatattaattcgcttcaaaaaacatttctttcaaaaattatcatcaaaaactaaatttctccctaaatccaaaaaataagacgaaaataaggacaaagagcttaaataaggacaaatcttacaaataaggacaaagggtaaccctgtgttaaagcgtgttgatggattaaaaatagaaaatagtttcagatctgttcggccataaacaattttatgcgccatgaacagatcaaacagctttcgcctattctcaagtgttggcagttgcaggtattctaattgtctccgccaccgaaagaagaagaagcgggacaaagcatcacaaaagggcgaaatgagtgacggacaaaacaacaaaaaaacaatgatcagccgcagaagaagaagaaatgaattaattgagaagaatgaccgactgatcataattaaatcagtgatcaaatgcaatttatgaagaaaatcctctcgattggtaaatcaatcggatgcataaaaatggcttgctatctatcgagtgtatgaatttctctctgcttgaaaattgtgacattaattttcgggattttgacgcgggatttacgacgtccattagcaattagcaggcaaaattttaaaaagtgtcaatttgctgttgttcctctctcttcttttctgcttcattctctcctctttctccccctccttgcttagaatttttccttttcctctctttctcttccgtctctcctccttccccaatgctatttccttccttttccacctcttcccttgtttctccatttttgctgttatccatcttcatctccattcccaccaaaatttgcttttgttgttgctgctgtactgcttgaacttcttgcttttgttgttgctgctgtactgcttgaacttcttgcttttgttgttgctgctgtactgcttgaacttcttgcttttgttgttgttgtttttgatgatgttcaactgcaactttcttttccttttcctctgcttccgctgctgctcctttttctcctcccttttcctctcttttccccccattttctcttccttctcctcccaattcgttgtttcctttttgctgttgttgatttggcgttttcttccgattgtttggcgccggcactgatggtccaccaccggaggagccagttgaatgttttgctttcgcctaaaaatgccattttacaagccataaatgccggaatgtgtaattctggcgcaaaaactcccggattgcggtccaaccactgacggtatccggacaatccgtcagtggataatcttcggaagacaatatctatcagtgacggacaattcatcagtgacggacaattcgtcagtagactgacgtttcatccaagtacatctcgtccatactttgttgacggattgtccactgacagattgtccataaccgactgattgttttactgacagattattattctggattcccactggcgcacatccagtagcgacttttgccaaaaggcccaccgcttactgtatgccaattagctacagtatattctttttataaaaccagcaggaagaaatgtgtgaaattgctcttgcagagtcggccacccatactgtattttgcagacagctacttacagtatatgtaactgttacaaaagcccatcccaattctacagtacccttcccctgctgccgccgccgtcctccattttcgctgttgttgttggtgtcggtgttgttgtgctgtcctttttgtgccgcatgaagtcgatcattctgtcctgcacaatgtccggctcggaagcagcttcatccccctcatttcgtgactctgtcgaaatggagcgaccgccgccgccgccagcagtgatccatcgctcttaaaaatgtattatcccattttaaaatatttcttttatctccgaaatgccatgctgggtcgttttataaaatccaccaattttagcaaatttttcgacaaaacatggcataactttgtttaaaggcaaagcaaacacattttacattcttggtaccattcgatagccaagctttttctctattagcctgcaaaattgcaaaaaaagttaccaaatttaacagtagttatggtagaaatagtacttattttcatacaactttttctaaagtcgaccaaatttttatttttattctgcgggctaatagagaaaaagcttggcgatcga

SEQ ID NO: 3851 - DNA, 2395 bp, Heterodera glycines
  misc_feature (10)..(11): n is a, c, g, or t
atgcctgcannggtcgcttgaaaaatttgattaaattttgaaaaattatatcgtaaagtgttcaaaaaaacaggctttttgactcttcctgaccatatatttttttgaatattcatgaaattgttttgaaatcttgcacactaatagagaatacatttacaaattagcgctatcaaatgatagtaggaattaaaatttgatcactttgaccaaatgataaatagttattttgctaaaaaattttataatttgattggttgttttaattaggcttaaagggggattaaaatataatgaatgcaattaatttgagtgacgagaaagaaattaagcaaacaatttttagaagattatttacattatcaattgcaaagaatggaatgaaatggaaatattaaaaataaaaatattaaatctttagatttttattaaaaagcttttaaacgaaaatttatatatattattatagtaaagaatatgataaaatataaaattatttgaaaattatatagaaattgaatgaaaaataaattaaattttttgacattttaagaaaatattttaaaaatctgcaactttattttttttaattcgcaaaatattaaaaaacgatttttaatatactattatttaaaaaataataatttaaattaaaaaaaattctcctaaaagagagggaattccaaaaaaaaaagtttgacattcgttgtcattgtcctaaaatttcatttatcgaccgaccgtcgatggcactgtcctttggcttaggttgggttggccctccctacccattcattgcttaagaaaaattctccagggaatttccattccgatggcttttctcctcgaggcaggaggcgccccaaagagtgccaaaaagacatttattagccgaagggaccattcactaatactctcaaaaaatgtacacaaaatttggaatggcatttaaaaaaaatcggattgataaccattcgcggcaaaaaaagagtcgctttacggcgacgccgacgcttttcccccgagcgaagtgactaggggacaaagtcttaaataaatgctaaaaagttggatttttaattgaatatagaaatattagataaatttaccatcaatataaaaaaataaaattgttttttatttgttcattaggccaaaacaaattgatttaacagggcatgatttagaaaattttcgttatttttaagggaagcgaaatttttcgattttcaaggtgaatatttaattttaagcttcgtccaagaatccctaaatttaaagtattaatatagaattcaatattatcttaaaataagataaaatcacaaaaagcaaaaggttttaaattaaaagaattacaccaattgataatatttttttaataaaaattctttatataatatttcctattgatttgccaatttgttccaattgggggcaaattttgcattaaataaaatgacattaatcggtttccatggtttcaaaaaggtgtgaatggtaccacagcacaacagctcattaattcatatttaattcatcacaaaagggtaaccgagtgaatggataccaaacaaatattcaagaattacgaaaacaaaaatggttcgatgcttgggaattgtaaaaaaaaaagtctacaaaattctttataattaaagacagtaattcatttttcagtctggtttggtgaaggttttcagtccaaataaatatttttggatttttggaaacgaatttttgatattttttcgagattttgccaaattttttaggtattttattcacttccaaaaatttttgctgacaacagaatgagtttattagcaaaaaatcttgaaatgtatttggtttgcatttgtgaagctataaattgataaagttggaatttttaaggcttaaatccattttttggtagttttttcgggtattttttaagtttgtttaagcgggagtggaacttaacaatagacaggaacccggacgaacgggactaattgtcccattttgtcaggattccctgacattttacccaaagagaaacctcggcaaacgcaaagcggaatcccgcaaatttgaaattcccgggctctagaaaattttgtacaaaaaacataggtttattgcaggctaattaggattgaattataagtaacttcaaaatttcacagattcatttcagcaattacttttttttacataatgccaagcctattttacattgccaaaatgccatgggatttcatgcctattcacattaatgccctttttttacacgtgttggacaccagcagatcctccaaaatggcattcattcatttgttttctaaaaatgcgtcggattccttttgcccaactgtcattctgctgatcattataattgaattgtcatttt

SEQ ID NO: 3852 - DNA, 2047 bp, Heterodera glycines
  misc_feature (2030)..(2030): n is a, c, g, or t
aaaaggaaaatgatgccattggcagtcgatgcatttgtggggggagatttaaatgtgaaaccacaattggaactggtgtaaaacagcagctggacagaacccatcatcactccctaatgagctcagcaatggaagcgatcaaaacagttaaccgggacttattcacatggggcaaagggaatggattaaaagtcgagctaatttttgattttttttttaattttatagttatttttttagattattttggtaaatgagaaggattgcgaccttgatcaattgttatggactgatacgagaaaaaatttggatgggttaagtgcaacattaaagtgttgtggaaggtttcggtgcaactcggctcggtaattgaaaattataataaaatcttttttttaaagctaagatttattattaaattttgaaaaattttaaaacctgaaaattggtcaacaatttgcaatgttggaaaggatcacgagaaaaaagttactaatgaaccggattattctttgaaaaaagactttgtaacattgaaagaaattttattgcgccaattcgaccaaggaaattctctgaaacttgaaagatatattggcgttttgttaatggaatacaaaactcaaaaacaaatggtagcaacggacccatgtgaggaggccaaactgaaagtgatcaaactgatgaaagatgtacagaaatcattggacaaaaaggaaaaagatggagtgaccaaaactgacaaaggcggacagaacgaactgatcaaaatggaggaaacagaagtcgaaaaccggtacacgcaatgacaaagcaaagtgatcggagatgaaaaaagactgatcacaagtcaaaatggtgatcagagtgaggaaacgaagtgaagagtttttagatcattagtctgtttgtgcactatcatcatcacttttcttttgggtggcttttctttctagcataaatttttccatttccttgaccaaatgctttaatccgattggatcaatgaaaacttttaaatttttctaaacaataggatggaatgtaaggacatgtaaatgcgccgtaaatggtttagatcatgtggttgtttatgtaaaggaatgtttaattaagtgtcatttaggcattttgtcaaaagtttatcctttacaaaattcgacaaatttatatagaccgtttcgcccacccgtataaaaaccggtacaaattttttccttataaaaaatgcctttaaatttaaatcttattataaaattaattgtttgtcatcactatttttatcacttttttgccatttttcgtcattttttaattaattaacaattttggggtttgcgcaattaaaatccgcgctaaagttattaaccaaacatttttcttgatccggtatattgaaaaaataattgtttcccatgggttgaatcgtttgccggaactttctagaaataactaattttttttattttaaaagatcgctaaaagtgtaaataatgtatataatggccaaatatttatgaaatatttaaaaaaatcttccactaataattaaatctaatatgcaaaaaaaaaaaaatttctttgatttttcttacaaaattttctgagaaaagcggtgaataagcataaaattccataaaaagacgtaactagcttacattaagcttagagtttttaattgattttaatattttttttggaaaaacatcaacttttgaggtacatttttcattttttaatgcatactcgaaaattgaaaaagatttttgtcaatgaagacaaacaattttattattgttatatagtagagttgctcggtaatcggtaattgctaaaaaaccggtaccggtactgaccggtaatgcaaaaaccggtaccggtaccggtaccaactttttccaccggtaccggtaccggtaaaaaccggtaattttccaacgtaaaaatttttggacaaaatttttcaaatacaaaatttttattcagttttcgcgcgtgtgcctgttttttatcattagaattgttcaganagtatatgtatattgag

SEQ ID NO: 3853 - DNA, 7457 bp, Heterodera glycines
tttcaattgcctgttttccgtttcgttccgttctgcttctcggttccccgatttttcggacatgctgctccaaattttcaatttttctctgtgaggtgccacacttcattatttcgttgctgccttttttgatcaggtaaccattttgtaaatcgaggtaaaagggtgtctttttaaatgtgttgcgcccaattagcatgtcatatgcacctcttttaccaatttccttatcaatcaccgccacttctgttatgattttcactccggccagttccaattcaatttttccactgccaataactggtacaaattcaccactaattccgataaccccggccacctcaggactaagcaattttattccaagtttttctgcagtgcgtaggctgcagattgacacatgtgcgccagtgtccaattgaaaccgaattattttcccgttaacgaatccgttaattttaaaagtttcatcgcaccttgtgttccattcaatgattgccaacacgctcacttttaagcccttttttactggtttggtcggtttttgttccggagatggccatctttccgtcagcggaactgagtgcgtacgagttagccttttccgattttttgagtctttcttttgtatggttttcttttccacgggataggctccctcctcaatttcatctcggggttttttacctcttctcttccccctaaagaaaatatgccatgcaaatcgaaagaatctgaagaaaattcctccaagattgaggtactgtaaggcctgagcgattgtcgacggtaacaaaatttggattataattgttagcgtaacataacagcagcatccaaaaacccaaagttggtttagactcagaataccgccacgtaaaaatgaaaacagtccgctggtcactattccacccgaaatacggtttttgtgttccgagggactattccacgaatcaactcgcgataagcgggaaatctcctgaattattttggctccttccactgtttctttgaaattttcacgcgagtaaagttccgtaaaattggccaaaactttatttttgaaaaaagggaggtttatttctgggatgtctatttttccatatcggctgatttcccttattccttctgttgaaatttggctgacatttcctgttttttgatcatatcgtattatcatgccaaaaatctccataaaaatgaatcttccattaccgcaatccacctctttagattttgtatggataattaacgtgtttgggtcgataaaaccgtgcttttgctgacggtataaataaaatgttaccggaagaaactcaaaacagtgaccattttgccagtcaaaatgtacttcgccctcataaataggaaaacacgtttttacctccattagtttttccgtgatcaatcgagccgataaaaaaggatttcccaggaaaaacctcgctaataacgatgggtttgctatagacaaggttaaagcttggtctgccattatttgcatgctcgtgcaaattttacgaattgtctccgtaaatagccgctgagtcgttatggccatttttgtgcttaaggctgtaagctgtgcagcaagctgagaactataaacaggaccaatttcggttgtttctctcgttttcctggtgccgcttcctttggctttctcgaccatttcttggaagtccgaaacaggtacggcaaacgcttggtccgacacaattagttggcccgactcggcatagcacccgggctgactatgagacgaggtgttttcaaaactcaatgcaaaatcaccactttccgtcgtccatattagacttgcatattcaccagaccattttgacaaccaaacaaaagagcaaagttgggtcttgtcgggggtccaaatcagactaatttttacgcattgacattcgcctgatttataaaagcaattagagcactctccgattggtgtattcaatccctccattccatgacgtgtaaaaacaattgtcttatacacataataattatcgatttcttccgttctccaaaacaaatttgatggccattttccccacccaatttctagggaattatttgttgccattagcgtttcgtcattaacgtataattcgcctgctggagagtccttatcaactgccattttcctgcaaattgccgtaggcactaccgaatgaaaggcacttatttcttcatatgttccaccaaaaaatcctctcctccttgaaatgcgcgttaaaatgcagctgcaggctgtagcttcggttttgtattgtacagtgtttggtcgatatatatttaatgcaaaaggaacggggacctgcgttggaacccaattagggcagatagggtcgacaggcaatgaccaaatactggtgggagcatccgggaggcatatcatgggctttgccttcacttcggatgctccgttgcttccaaatagagcaaggaaggcaattatggccaaaaatagtggactggctactcggacagctgcaacttttcccctcttgaaatgcacccgcttccctggggaatgggagcgattggattcatctccatcacttgatggacttcgatgtggttttctttggtaatttctgcctgtccacggctttctctgatccggggttggtgagcgatcgtatctccaattaggcctttccggtgagcgaccgtatctccaattaggcctttccggtgagcgatcgtttctccaattaggcctttcccaattttcgtcgcgatggttttgcctaccccatctgttgctttcgcttggttcatttctataatctcttctccatgttccctcagccgccctgtcccccctataataactttgtcggtttccactttgtcttccttctttccttactcggcaatccctcacaatgtgccctgggcgattgcagtaataacagacacgcctctcgtcggctctttttcctatgttcctttgcgtctgaatagttaatgcctcaacccttgaagagagttctgcaacagagacttggctctgttttctcgatgccaacagcaattcaaaatgctgtgccatttcgtaggcgtttgagtaatttgagggtcggcctgcctttacctcaaattgtaggtcaggggtcaaacgctccataaattcctccaaaagtctctttttaatcgttccctcgttttctcccgccattgcggttcgaagtgcttcgcttaaccgattagcgaattcatagactttttcccctggcgcctgcttacaaattgacagtgtttggcgagcgattgatttcgtattttcattctcgaatttattttttaaaaaattaaatgcatcctggagcgtggttggggctgggctcataccctccatttccccccttgcctgtcctgaaagacttatccgtaaacggctaagtttttgctcttccgtgagctggggataaagcgaaagaaggtccatgaatctttcggaccatcgagaaaaagacgaacttgggtttccgtcatatacacccgggggaattacattcattaagaaagggtcagccatcattacttccaagtcctccgtttcgcccattagtgttttttccttttcctgcccctcattattttcgtccttattttcatcatttccaatttcatgactctcccttccattgtctgcatctcttttctctccattttctgacgaattattgccctgcgcaaattgtttttgtaggtcatggtgcccgttgtcctgccaatattcatcaagtgacgaatcgcccattttttcgagctcaaggaattccactctggtttccacaacgtcaatcgaaaatttcatttccttctccaccgactcaattttctcatttatcaagtcaactaaacatttcgattcctttacctgagtatcaattttctcaaaacattcctttaagttttcagacacattagctttaagaacttcaaatttgttatgtgtctcctccagtttctcttccaatttgaaaattttctccttagtctcgaattcatccatctcttcattctcgtccaaattttgtagcgatgactcgagacggctcaattggtcctttgtggctcgttcacttccattcagagaactttcaagctttcgaaattggctgcaaactgcagcttcaaaagaacgcaaacgctcgagaatggtttggtattgagcattttcctccaccgtgaaaaaagctgggttgaagtcagatccctcgcctgacattttactgtttttccactttttttttttgaaattggcacacagcccggttaggatcacacagatcgactaactcaaataattatccgtttgatcagctaggagcacacagcttcgactagccctccgcaattagtctcttcggttgggagcacacagcttcgaccaaccctcgacagcaattcggcactcggccttgctcagaaatttgggaaaagggaactttttttttttttgctcccgggtcgtggcaccaaaaagatgttgtgttcccgacttatttcccaatcaaaagtaagactttaggtttgttaatgaaagtttatttagcaaaagtgagaaatgcaagtaaaatgggaatgagtcaaagtgagtaaaaaaaagggtaataatgcaaggaatgaattcagtttaaatagcaaaagagaaaaggggtggagtcgagagtgagctgggatggacacaaattggcttggcttgggtttacagtaaagtgtaacgattggttaggatgggagaggaaatcggtgaagagagagaagaaaagttgtacaaaataaataagtgaaaattgatcattaaattaaataaatgattttgtcaaaaggggattcaacatttaagaaactaaaaaatcagctgaaagaattagtaaaaaaacttagagaatttttttaaagtttttctaggctagaaaatccaatttagatttttttatctaaaaattctaagttttagttgaaaattcttagaaaaattttttttttgtacgagttgccattgatccaaacaaagagattaataaaaaaatatggcgggccacctctttgaagttgttgacccattcgagattcagtggacccaacaaattattgcgatgtaatcgcttcggttgtccattttttgtcggagtgtgaagccatttgaccaaagcttggccagcagttgcattgggtccatcgtcagcaattccatcggagaatagagcaccagaatcgattgaattcaattgatcaagatcagtgagaattgttggcgatgtgcgacgacgcaaattgtccaaatgatcgccatcgtcaaagcccaaatgacgaatgtttgtcgcaaaaattggccaaatttcacggataaaaacatcccaaatcggttggacatccgtatcaaatgcatacacaaacactttcaatttggtgccatttctgtcccaaattggcttgttggaacggagaaatttgatcacggaatggtcaatgtagctgaaaagggggaacaatgaagacgacgaccaaccatattaattggtttccgtataagtttgatttactcaatccaaaggaaacgaaaacggattttgtttggcagcgaatggtccgacaacggaaaatccacaaaactgccatcgatctgtacagacagtttcgcttttggtcctttgtccttgcgaattacgacacttctccaaattgtcaattcgctttttctgtcgaaatgcgcgtccaccaaaacatcgaaacggtcggaaagcaatgccattttgagtccgagttgggcatggtcaaaagatgggagaatgtccatccacacgtcaccacaaatccaactgaaacatgggaaaaaatagcaaggaaaatgaaaatttgtaatttttcaaaagaaattgctgaccgtcgattcattttggtggttcaattagcacgcttttccctttttccaattaattaatttgtgtgtcacaaaaggcaaaaaatttgttgttaacttaaaacagagagaacaattagaaaaaatgagagagcaaaaaatttgcttattttagagaaggtaaattgaaaacagcaatttctcattaaaaatttgaaattaccaaaaaattatatgtgcataatctttttgtgagaaagaggagaaaaaagggcagttttatatttttatatgaaaacattagcgtatgtttgagtaccggtggtgaaaatgaaaatgccaataatttggcgagaaaaaaatgagaaaagctacataattgataattggcagggctgcaaaaaatatgcacgaaaaatggccaaaatatgcgcataaatatgcaaataaaatcgtgaaatatggatcaaatatgcacaaaaaaacttgaaatagtgcacttgccaatgagctgctacatttcttttataaaattctctttagcaaatattgacattttttaaatcaaaaattttctcatgaaaaaaaaatttgggggaagaatttttgagaaaatttccaatgcttagtggtgtttttaaaaattttcggtcgattcttaggggtgtatttttctgaattttagggccgattcttaggggtttccgttttattgaattttttttaacaaattttccaaaatatgcaaaaaatctgaaaatatgtacaaaaaatgtcaaaatatgcatgaaatatgcaaaaaaaccctaaatatgcaaatatgcacaaaaatcccgaaatatgcaaataaaagtcccaacttttgttcgcaaacacaaaaaagaaagtgtttttcctgttatttagagcatggagaagccagaaaaaaaatgcatgttttttgcagccctgctaatatgtaaaaaaaaatcccaaatatctacttataaacttataaatctattattgtacacaccgtttcaattttggcctcccagttccaaaaagatttgcatgtgtggctcagtggtttttgtaagatagtaaagggacaaagggtggtggttcgagcccgttgtgcaacatgaatattttcatttatttttgtccaaaatattaaaaaatcacgatatttggtaattatttttgaaggtttttaccaaccaaattggtccatcttgacatcattcgaaagctcttgatgaggagaagctttttctaagcaaatgctaagcaatttgacatctcagaaaagagtagtgagagtttcaaattttcataatggtttcatgcaaaaacgggatgtttaactcaaaaaagtatttgatacgttctatgcagaatttttttctctatcgatatacaaaatttgaagaaaatctgttaacgtaaaaaaaattttcttagagagaagtaaattcgggttttctctattaacagagataaagaaatagtacgccaaaaagagagatgtttttttctctgcgctctctctttattggttcatctctcgttttttgaaacggtgtgt

SEQ ID NO: 3854 - DNA, 6304 bp, Heterodera glycines
agaaacaggcgatcagcacgtaaacaaggccgaggactgggttttgcattttcttctgtgtgttgctgggaacttttcaacaaattaccttcggcttaatgtgtttaatttgtaccaattggcgaaggtcccacgggttttgtcgattcattttgaggtgccgaaactgtcgccgttgttgtaaacggatcgtctggcgtcaaaagactgaactcacaagcattctccctggtgcactaaaaagtaaaccagaacagagagaatttttaacagatccattccgagtggattcccccccccccccctccaaacgatgccaactcacatattggacgagggcaaccccggcgaccaaaatgagcagtgccccccattgaattatggataacttccgcttcaaaataagcacggcaaagaatgccgtggtgagaattttaagttgataagtgacctaagaaattggcgttagtcaattcacaaatgccttattttaccatataagtacccgtttccaaattttcaattgccttaattagtattttgaagacaaaattaatttattaaaaacagaccaaaaagatcaacaaattctggaccagataaatgaccgccggaacaccaacttttaatgtgtccaaacaatttggcccaaagtgatggtaaagaattttgaaaaacctaaattaattgaacgaaaatgaagaaaagagaagagcagacttgcacaaatcatttgtgctgatgaagaacaaaatcaaagacacgcaaagtttgacgagctcattgaacaaaatggccacctgaaagagtatttccgcaattaaatgcattttagcaaaaaaaaaatccatttccggtttcgagaagcgcggaagtcccacgcgagtcatggcatagcgagtgaccaacacatggcaggcattctgaagcacaagcaccagcagagacacgtatttaagcagaattggacggatggactccctccctaatttgtaaggtggaaaatactacaccaaaaaattatttaaatctcactgatttggaagtgatttagtaacccatgcccttcatcctcttccgttggttgcttttcgtcatccttttccgttgaaacgacctgcatattcttcgaggacaaaaatttgattcttaagaaattaagaattcggcaaaattaattatcttaagagttttcatggttggagaacccgcttcaaagattcaatttcaactcaatccgaactggggactcgaacaaaaactcaaaaaattcattttcaggaatttgtagcattgtggtccggaaaataaattatatttttgtttcaaaatcttagtaaattagtgtgacgtaaaaatttgagataaaaacaaaagaattaaaaatttatttaaaaaacaataaataaaacatttttagcatgaaaataaattaacacagatagtcaaattgatagtaccaaattcaaaaatgaatgaatgataagtgaaatgaaagccaataaaaatggacaaattacaaataaaatataagacatagtcgaggctagaagtccaaatcacaatatttattaatcgaattaagaggcagaaattttttaaaagtcaaaataaattttaaaaaatcaaaaataaaatgctttgaaagtagaaagaaatatcaaaaattatgtatgttgagtaaaagcagggctcgcagattttaaagagcagaaaatttgtaaaagaaatgacattgtccataattgctctgacaatgagcatttttaacatcgtaattgactttttatttgggaaaaattgggctaaagcctcatgtctacgaagcttgataaaatcaattttttggcgaaagaacactggacgaattcgatgaatctttcaaagacgaaatatgtgacgctgacgaaaagtaagaaggacgtgaagcagaggaagacccgtaaatgttgaagtggcgaagaaaaatggaagaagatgagtagaggaagatgctctaaagtaaaggaaagggacaatagaaatttaaaaatggaaaaaaatagccaaaaaggcaaatgctcttcaaaagccaaaactgagagcagtccaattaccataatgacgagcaaagcaccaagtgtgaaaagtaggtttggctgaaacccgaagaactgaatagagccaagtgtggccaaaattatagccacagaagtagcgaagttcttggcgatattatccgcgtattttatgcaaacggccaccgaaagaccaccgacggcgtaccaaaacgaagtcagccaaacaacggagtcccaaccgtacataaagccatgctctctaattttggatccatcctacaaaagagtggcaatgaaagggagccaaaggacagaaagtgcgacttgaacaatggcagcaaagaaactggcaggaattgcgaagaccgacatttgtacattcttaacgaatgggggggtcattcgagcgaaaaggtgccaaccgattgatgtacaaagggaggagttgggggctaataattgccaaaagctttaccctcccccctcccttgttagaagccaaaatgactccctccccgaggacatcaattgctaaagcttacacgcatccaaagagacacaggcgcagagcccttcaaaattttttcgaaaaaaacacccgaaaaccccgaaagaccacaagcgattgacgcagcaatgaaacctgaacaatagaaaaatcagagactgaaaaatgttcgctttgttattattaggccagaacaagtcagcaaatgccaaatgaatctcaacggtttctcggcgagtcgcccgccggtgccattggtaaatttgagtaaaaaagtgagtgacccctcccattccattccatcgccccttctccccacccgtcaacacatcctgctcaattgctaagtgttttcggttctccgatttgcgaggctcttccggctgaaattgcacaaaacaaacgccaacgaagagaacgcatagcgaaacccattgggcacgagccaacgaacgattgagcaaaaggatggagaaaatggcggcagaaaagattttcaattgggagacaatctgaagaagaaacgaaccattagagggataaataaaagggtacttatgtagtttaggggacagatttcacatacatttttagattcatataaatatgttttagaaattaatggccataagggcgctactgtaaaagtggtcccttttgaaaatttttttcactttttttcatatatttttattattattttttattacaattagcattattaatcacaaaaaattataattacgatgtaataaattgacaaaagccttaaaaacagacaatcctttagccctagcattcaatcggaaaatttgttcatgcatatatgattctgccaatttcatactggtgtcatgaattctttttgttttctgcttcaactgggcccataatccttcacatttgttggtgtttttggcacaataatttgttttggaaaagtccgttgtgtgccaaaaattgtaaaatctcttcagagtttttggaaaaaagccatctcaaatttatatcgtccaatgttggaaaagcgatgagcggcagattgttggaatcattaatggaatatcttgaaactttaaccatttgctaaaattgcatgaaaaaaatcatttataaaaaaaatatatgaaaaaagtgaaaaaaattttcaaaagggaccacttttacagtagcgcctaaaaaggtatgtgaaatctgtcccctaaactacataagtaccaataaaagaaagaaaaaagaatatttccatgaaagttgcggcgttaagatgagaagcggcggtataaaaaaggttgttttggaggatgtaaagcatcgagggaagacacactttgagagtgtccctcggctggtcaaagacttgtcgtcttatcagaccaaaagccctaaaagaattccaatcaccaaccaaatcgcatatttgggagttggggtgcgatagtctcagcgagtgaatttcaaatgaaattgttttaaaacgctaaattgagtgcacccctttcaacaaaacccactcgaaaattccaccatttgaatgatggcacaccataataagacaaacagacaatttgatgacttcagtccaaaagacagccaccgttgagaaatacatggccggcacatccctaaccttaaaacggcaagggaaagttgggacggcagtcggagtaaattgtctttttactctcgaatatctaagcaatagcgcatggacggcgttctgaacagtgagccaaatgagcacagcgaattttatggaagcggactgaacgccggaagggcgttcacgacgaacttcaatgcccatctgagggagaagggaagcaaaactaaaacatcaccaagaaatttcggattttgttccaactaaagacgtttctgcaccaacttccaacaaaacttaagtcgggagaagtgaatggacgccaaatgggagacggattggatgaggggggaaaggaggggggaggggttatccgtcgggcgtttcctcaattctctgattggcaggcgataagatctcaaaagtagcgttttaccgcctcattcaaaatcgagtaattgttgatgttcgttagatggagcaaggaaatgggacgcattcccattaacataattaagcaaaagcaaaaaattagaagcaaatgaatggcaaatcaatccctttttcgtcagtggtcagcaaaagcaaaacctttgaattccaaaacaaaacatagagaacaaacatttttgatgcaaaaattcagccaattcttttcaaatttgatggaattacgactagtacatagcctattccccatgtattttattaaaaatatttttaaatgaattagtacaaaaacagcaccggtatcctccgcaaattgccgttttcttccgtcgtcccacaaatgttttttgcgctctctccacttccatctttcaaaatcggcccattcttttgcaatggcgtttcactatcatttgggaattcgtcgtcaactaaaagaagggccgtcgcatcaccacccgtcaccttggaacccatgccaaatatctttgattagcaacttcttgttagcgaagacaatcgcattgaataggaaatgatggagcaaattccagtcaaaattaatttaggaaaaagaaatttttaaaagcatttatagcgaaagaaatttgtcaaataaaaaatgttttatgaaaaaagagaatgtcttgcatgcttttcattcacaaaaacgggttattggtccgacctccgccaagtgtgtcgatgtgctcaataaaagtggtccgattaacgcgacaggcgtagctgcatttattgcccccacattttttgcactaaattttttttgttgcctactaaattttgcttttcgtcacctgatattggcatccattgcacttttgatccaagcaatcgcaaaggtccacttctgtacgactcggcaggacgagtcgccccttattgttgtagcggagtttggatttggcagagcgagtttgtactaattcgagaataagatgaattatagcgaaaaaaaatttatgtttaaatcttttctatggtaatttcaggtgctgaaaacgaatcttacatttaattaaagtacagattttacgtgaaaaaaacctataaatttttaaattcaaaataaacaggaggcaaactaaaaaatacattttaaaaagattgtgtaatcataacactggtcacgtcaaatttcaagtaacttacgtaaagtggatgttaactttaaataaatgtcagattcgttttcagcgcctaaatttaccatagaaaaaatttttaaaaaaacattttgtaagggggcacaaaaaagataagaacctgggcggccgcaaagttgaggttcaataaggaatagtcaaacggaatattggggtttttagagcattttaccagcctcaaaagagttctactttttaactgaaccaaattacaagttttgaatgtttaaaatttcacttttttggttaaaatttttttatacattttattattaccatcagaatttgacccgtccttcttggccgtacgttttctcatgctccgtcgatcggccgaaggttcggcagatgtttttggttgttgcgcagaaatgacgacagttcgcttagcgcgtgaaggttcgggcaatgtgcaacgatagcccgggttacggaaactcaaatttctcagttcgcgatgcaatgcagcagaagtgccttaaaaacgaaagtaata

SEQ ID NO: 3855 - DNA, 1266 bp, Heterodera glycines
agattgtcatataaatcatgtaatctatgatttttcctcaagtgattttcgtcaaaatttttttgatagattttcacttttttaccgttgttcaaacagtaaaaaagtgaaaaccaatcaaaaaaattttttgacgttaaatcacttgatgaaaaatcatagattagatgatttatatgacaatctgatgtcagattcgtgatcagcgccatcgataacccccgagtagttcttagaattgaaaaaaacgaccttttttgcctttttttatgggaccaatgatgtgaacgattacccatttttaaatgcctataaatttgttttataaattgatgaaaataagttttacggggtttttcgggtcgctgaccatgaatccgggctcaggtcagcgctaccgttcactacatgagctgtacagggacaaagaattgataggcttcctgtaccaagggtaccctcatgggcagatgccaatgaggatatccatccatataaattttttaattcgattttttgttcgggttcgggtcaggggtacggaattggcaaaaatggatgctgttttcgtggtcagcgaccccaaaaccccttaaaacttattttgtttaatttataaaacatatttgtaagcatttaaaaatgtgtgttaaaagtacccggtaaacttaaaaattacccagaattggaatctccgacccggaaaatccctaaatactcaatttgattgcacattttaaatacttttatatagaaaatattcgaaattgtggctgccaaagaaatgtgtgccatatgtcttcaacagtaaaaattcggaacccgcatgatcccacacaaaaccaaacttgcagatcccgctgagattgggttttttttatatttattgcaacatttgcgcatacctatgcttgaaattggcttttctgtttttttcaattataaattcaaatgtattggggaacaaaagaacttaaatttataaaaaaatttttacttatattttcattgccgaattctgcaaattttgcgttccatcgacgaaatctctaaatcgaaaaattaaatcaatacaatcattgtcatatgtttagcgagttgtatgacatttgcggtctgctgaaaatcggacatttgcggcccatttctcaaagaccatttttttcttaaccccggactcggattcgaacaaaaagtcgaaaattcaaaattttcaaaattcacttttacattggcatcagtatagaatgaccattttttgatgtt

SEQ ID NO: 3856 - DNA, 8990 bp, Heterodera glycines
  misc_feature (799)..(799): n is a, c, g, or t
cttcaatttaattgaaaaaaaaatttttctcataaatacacaagaagagaaagaaaatcttgtgttttatattttataaatactttgaaaataaaagaatgaaaaatcttgccatcaaaagaatctattcacaattatttttttgtgttatatcaaatttgctaaaatttaaaaactattatttattcgtgcttcttaaatacattgaattcagaaagttattattattacgtgttaaggaaaaatacgaaaacccattaacaaaataaaaataaaatttaattacagttaataacgctcaacaataataaattaaaaatgataataaattatacataaatatcctctgaaggaaaataaaatcccttatgggtaatcctcataatataacaaaaatttaaaactaatttaagaattgcagtaacatcaattataaccgcacgagaacaagagatttatgataatatataaatatataaaatgaatcatttaaaattttataacaagaaattagagtttgataatttaaatgtaacagatattcaaatgttcatgcgagaaataattatctgctaattaacaacaaaataaatattgcaatttgatttcaaagacaaatattttattgatataactaattcgggtttttaaaaacatatatatgaacatatttggcattttttaacacatataaatacggaacctgctaattaacgatgactctctttatgggaattgtagacatttttgaaaatattatttatacaattcgccaaaagaaatgtttattttcaccatnacctttgtcggtggctggacatttcgacaatgaccgtttcgccaatgaccgtttcgacaatgaccatttacgactatatcatatcgccaaaatttaaaatatcaaattaaatataataaaatgaatataaaaaataataaattaattaaaaaaaatattgatgaaatttaaagagaaaaatttaattaggtagttatattttttaaatttaatgaatgcattatctatcgcctattgtgtatgattattaatagttaggagtcggatttttaggttttacctatttctagattttttcaatttttaacacctattttcgcacctattttggccttttttggggtttttagcacctaaaaatccgagccctattaatagtgaagaaagaagacaaaatgagacggacctataatataaatccaaaatgaaaccatttatttaacttaatgtagtgtcctctttttacccaggcggcaatcctgaagaatggttgtccctaattttcatttttttttaattttgtgctcaaaaccagtttttaggcgtttttgagggtgctgataacggatcttaactcgggtttgcccaattccgaactccagacccgaattcgaacaaaaaaaaattgtttttttaatcaagaatagttttttcagggtaaaagcttctaattcattatcaactatttaggtgtaaaacaatgtttcaatttttaattaaaaaaaaataagcaatttgcgccgaaaattgacaaactaaagccattctcataatgctattttgaaaaaaaacgaaaaaaaaacttttttatattgatcccaaatccgcaccgtccatataattttgcagaaatttgaattttatttaaaaaaatatatttaattttattgtcgaaacggcattgtcgaaaaggtattgtcgaaacggtcattggcgaaacggtcattgtcgaaatgtccgggagccatttatttttattaatttggattaattattggttcttttttggatcacggccattgaaggttatttccattttaatgctgctgcgcatcaattggttttccaaatataaattaattgtaatattttatattttcataaatgtatgcattgtaattaattattactatgattattattacttaatattaatttcacatgatttcaattataatctttgaaaattatttcaatattcttttttttttgtcttatattttggttatattttttactattatatatatattattttgatttcttttttcaatttcattaaattatcataataacccgactgcttagaattttgttaatttgtttttcttatttaattttctttcttgtttttctagttttgttgttattcaatataattgcacattattaggttagataactaaatttttaaattgtttagaatgtttttccattttagttaattttgtgggttttagtgtataaaaatgttaaatttttagtgaacaataaaaattttgaaaaaaaatgtttcagtctcgagtcaccggaattttcagtcttgagcatatttacattgacattttttaaatttctatttgcctgttaataatattattagcgatggaaaataaggaggcctgaggctttctaaggaattttaaaaaaactctaaatttgggttctccaggaaaataaagccagaacacatatgtacacttaacagttagtatattatatttaattatttaagaagttaactatttttcatttttattttcttgtgttctattttttgttcttattatgtatttttaatgtttgtattttttatggctgttattaatttttaaaattattttatttaatataataatttatttttataattttgatactctattttttcttttatttaattatggttatggcaagatgatcatgctttctactctaatttatacataaatatttgttatcattttataaatatcaacaaaatgtacttatcgtttttatctttgttgattattatttttagtaattattatactgctttattattattatcatataaaaatagtaaaatggatatttttgtttcgttatattaaaaatattgtccgattattcttttttttttctttgctttttaataatttcgtttaaaataaactgtcaaaataatgtattggtataataaagctgtgcgattttttcatggattttatttatcaagtgttagagtgtcggtctttaattaaacaaaataataatttatttgaattaaaaatatatatatattaagtagaggatacgaagagctatagcccaatacaaaaatttattaatagattaagtttgagctaaaaacggcgccgatcaagcaaataatagctatgctttttaaataattacgaattttcacttaatcagaatttagtgttatttctatttaattccgattaatatttttgggaaaataaagaatatttatttatgttcacagcaggattgttctggtggttttatgtccagcaccattttcaatctctgttcgcgttccaattttttaaaagtcctggctctaaatcagggaattattattaatattttgttttccctgaatcttaatagtattcccaaaatttttaaaaatattttcatcatttcaaaaatcttaagagtttttcgaaatgaaggctgggtggcagtttttaggaaacgcactagcaccatttttgggcaccgtaaatattattaaggtttcaataaataaccacttatttttggttttgtttttaagtatttcgcaattgaaattaaattaattttttttggtagcaattattttctttccctttttaatttatcttttaaatctcatgttttcccaattctttcatatttctgggagaattattttcatcgtatacatttttataatatttttatttttgaattaatttcattttataaatttcactagcatttcaattacaacaataattatattattcaagaattaaattttaattttcggactattcttaaatatttgtttcatatttaactgaataaatgttttttttaattttctttagcttatgctttactcgaggtatagtttgactttttaaattagctttaattttttattctttattagttgattttgtttaattttctggctactattcttaaatatatgttcacttcgtatttattttttaatttaattaaaatcattatttttatattttcataaaactcatatttttcgtcatgtaaaatttttcgacgaaactcaggattaattaatctatgaaaaatattaaagatgcattttttgtttttatgctttctgcttgttaatattttaatgcatttctttttatttttaacttttacaaatttgatatttatataattacgagaagatcgttttaattaagtggtcgtaaacggtcgaataatttggttagacataataatctgcttttttttatttgatgcatttctctggtctatttgcgctcaaacacgagcggttatataaatttgttgttaattgaaaattatcattttgattttgtctatataattaatttttgaactttacaattttattatttgatttttttgtgtctttctttgtagtaccatttaattattaataacaaaaatttaggtatgtttaatgaaatgatattgaaatgtttttaactttcttccattaaataattgcctattaaatggtttatgtaaaagtattcaattttccatagactaaaatgattaaaaaaaagttgaattttttgttatttcttttatttgatcagcataatttttttcgtttattaattatatttttgtttttagaaacaattaatagcaattattgattacgcatatttttctcgtacgtacgataaaaattttctctactttcatggcgtcacttcatttttttactttttaaaaaaataatatttgttcttttctttagattattaagaaatttaagaaaattaccgcttaggaatatgcatttgaaaaatgatatagagtgagggatgcgcactgtgccccccagaccaaccgcaccgtctatcccggatggaacatgggagggaatggggaaagccatggccagtgactaagccccaaaatcccaacgactcattgactgtcgatatatttattcactcgttgttggatttacacgaagcgagaaaaggaataataattgaagtctgttccatcacaactaactgactaactgatcactgggggaaggagaaatgcgaagagaatgggcggagaaacattacagcgagaaaagaaacgtgtgaacggataaaatgtgattgaattgataatggccaatgggaaataattaagaaataattaaatgagggaaatgcgtcgaataacccttacaacttcccccttcccataggatcgtccccgatcctaaatgaaaaatgaaatgaaaatgaatgagacggatccaaactctcggcttcgcccttcgtctttccaatccgaacttcctcggccaagttgcgcattgaaataatgagcagcgcagtccaccttcatctcagatggatggcatgggaaatcgaagaaaagcaaccaggggtcattccggtttggggacgaaattaaaagcatgatgagaggaaagaaaaaatgggtccgagaaagtgtgaggaaaccgacgcattttaattaattttgagtttgagggaattataaaaaaggccatttaacaattcgaaataaaaggaaaataaatgaatatttggaaaataaattggacagtagagagagacaaagcagaaaatgaaattgacaaaagatggggaaaggaaaagaaggaagtccatgcgcatttgtcgttcatggctgaagtcgtacagcttggccttctttattcatctgcgcgcaccagaagttgaagcccgttcacgagtgccaccttgagaaagataagattagtatctgttctccgcccccttgactcaccagagttgttgcaccacacatttttaccgtattagctgtaaaagagctttgaccgtactgcaccgcccttggccgagatcacctgtccatccttgtcttaatagttgccggggttgttgaactgctcggtcaagtactccgggccaaccattgtcgtctccgccgtcgcttggtccaaatatcgtcgccacgtctcggtccggttgagcagcagcacgtcgccgaagatgatcattctgtggctagcctctacttatgggttcaggctcagacttacaaatgtccaagttcaagcagttcactttcactgctctcactttccacctcttcttccattcctttccgtgggcagctctaccattaagctaccgaggcacatccgccctttcttttatggatcttatcaacccccgctttccgcgttttaaccgcccagccagcttcttccttacagctccatcctcatcgggaccggtccctcggtccattagttaattgctgctggcgcggtggggcaaccatccggtgctgccaataagaaatgggcaaaatgttaaacctcgggtgggaatcgaacccactcatgcaccctttccgtgggcagctctaccattaagctaccgaggcacatccgccctttcttttatggatcttatcaacccccgctttccgcgtttttcgcccagccagcttcttccttacagctccatcctcatcgggaccggtccctcggtccattagttaattgctgctggcgcggtggggcaaccatccggtgctaccagtgagggatgcgcactgtgccccccagaccaaccgcaccgtctatcccggatggaacatgggagggaatggggaaagccatggccagtgactaagccccaaaatcccaacgactcattgactgtcgatatatttattcactcgttgttggatttacacgaagcgagaaaaggaataataattgaagtctgttccatcacaactaactgactaactgatcactgggggaaggagaaatgcgaagagaatgggcggagaaacattacagcgagaaaagaaacgtgtgaacggataaaatgtgattgaattgataatggccaatgggaaataattaagaaataattaaatgagggaaatgcgtcgaataacccttacaatagttattataaattttcagattatattcatcgccgcatataatatgttcaatttattaatttaaatatttgattttatttaattttgagaaaattcatttcatcagcccaattttttgtgtacttttgaaattttcatttgtcacttttcacattcggtaaattttatcagaatttttcagtaaatttttttgcaaattatttattaataggcattttaatatttttttctatcccttttttgtctaatttttaatttttttttgtcaatggtttttttatgtccttcaatttttatgcttaatttaagattgaaattttcctttttttgaatttaataatttttagctgcttttttgttgaaaaaaaatgtttatatttaaatattaataacatttttagctactgtttcattcactttttaaccattttatcgtcatgattcaatcaactagtttgtgcacttaatacgcatagataacagggatgggccaaattgaaaaataaaaagcgaaatgcgaaaagcgaaatttgcgaaactgaaaaatgcgaaatgaaaaaaaagcgaaatgcgaaaagccaaaatatgcgaaaagcgaaattttttctacaactttttaatagttaaaatcataaagcaaaaataattttttaaaattttattccaaatttaaaaatcaataaaacgcttttttgaggcgcgctttttccaaaaaaactttttgggaagagggggcaggcgccgccggcggggaaaaaattggaaattttgatcattataaacagtttttcactgaaaattagccaatttataggtaaaattttgaaaaattttatgggaatttaatccaattcttaggggtgtaaaagtcgcatttcgcgccaaaaagcgaaatctcattatgttaaaatagagtccggtaaaaaaaaatttccgggagcgggagcgggatcgggaatcccgtgaaaatcccgctcccgttaaaatcccgcagaaattttacgggagtcccgggcgggagcgggagtaattcgaaaatttaattaaaaactaacaaaaatatttttaatgcacaaatttgaaggaaaatcaatttattaaagaaaaaatagatagaaaaatttagtaagcagaatttgaaattaaaaaatcatatttatgggtcgaaaatcagtgttttttcaaattgcttcaaataaaaatttttaataatttatttgttgactccctttattaattttaacaattttttgcggcttattttttgaaaaaactttttggtgaccagggaggaagagggaggccggcggtgccgataggcgccgccgggaaaaatttttttcaaaattcattggtattctcgctaaaaaaaatccttcaaaaagtcaattcttaggggtgtaataatcggatttcaaggcaaaatccgattacgattatccgattccgattatggcccaaaatccgattaattgcgattccgattacgattccgatttttttttttaataattttttcccaaaaattttattcataatcaaaatcataaattttaagattgtgatgcaaaaataagtttgtccacattctcaggcaataaacgttttctcagatctgtcacaatcaacccagcggtggagaatattcccagatatttgacatttttgctaaataacaaaaaacttgattatatcggggagaattaacccggcactgctttgtgagaaaaatttaatttcagtcattatgttaaaattagattaaaacattcgtttcagaaaacattttttttcaaaattcattggtattctcgctaaaaaaattccttcaaaaggtcaattcttaggggtgtaataatcgaatttcaaggcaaaatccgattacgattatccgattccgattatggcccaaaatccgattaatagcgattctgattacgattacgattccgattttgaatttttaaaaaattaacatatggcacgtataattgaaaaatcttcataatttttt

SEQ ID NO: 3857 - DNA, 611 bp, Heterodera glycines
ggaagttaggaggccatttttgaggctttctaagaaatttaaaaaattaagtttacttatttttcattcatactttcttgcattctttttatttatctttaatgtttatattttttacggctgttataattttaaaaattattttatttaatatttataatttattttataatgttatttttttcttttatttaatcatggtcttgacgatagcgattcgacgacgatgatcatgctatctatggatattttagtttcataatatttaatcatttctgaatattattttttgtttttatgaatttcgtttaattaattttaaaatttttaatctatttatataattagagaaaattaattgtttaattaataggcagaaattatttttttcataataaacagcttttgttttttcatactccttggcatcacctcatcaccttcaaaaaaaagaatgtaagagtttttgaaaaaattagcttactttctttacgttttaaataattttcaattctttttaagagttttaatttaaaaattattttccattttattaaaatattcagattctatgtttgtgaatttatttatataatttggatgttttattt

SEQ ID NO: 3858 - DNA, 4999 bp, Heterodera glycines
aatcagtgggaattaaggccaaggcaatgccgtgctgtgccggtgccccttttttttaattgtctcggcatttatggcaaataatttgttccattttctcttaagaatccattggccaacacgtgtgcactgagctcagaaatcggaacccttccctcttccgaaagcggtgcaggtgctttaaattcaaattatacttttaaaaattaaaaaataattatgatagtgaaaataatattgtaaatcgaaaaatacatagtttattattcaaaactcaaaatgcttattagccttttaaatttaaaaattcattgggttaaataatatatgccttccaaggtcaataaataattttgaattttaatttgatttaaatgacctttgtagcaattaaaatttagaatgaatggagtccaatttttagaacggacgcggactttgccattttgcagtgctgccgcagctgtcgcacaaatgtggccgagttgggccgcgaaatgttcgcgacgggggtgaaaagccggcactgttttgaccggcacaaccgccaattctgcgcccattttgtccatcaagtgaagcagaattgatgaattaatgacataattaaaaagtaaaattacaatacataagacaatcattttaagtgatgctcgaagagtttggactcatttctaagaattaataaatttttacataaatttaattaattttaaaattattttttgtaaattaaaataaataaatttatttttggtggctatatttaagttcctttcccatttctctccaagagtggcttatgggcaacaaatgttggcaaatcggtcaattgcaacggggacggtgctccattggcatgccattgcccttccgttttgcttttcccataaaattctcttttaggcttttcgcgtgtgccgtcgcagttgtggcttttgcgaacccgagctgtaccagcagcaaaatcaaaattgcatctcaaaagtgtggaaaatgaccacaaatggcgcaccaacaacaacgaatggtgggtgctttaccatcggaaatttcagatttgcggatcccgctgttggattggaactcaaaattttgcaggacgggatcacgcgggattaatccccagaattttccaaaaaatgcgagattgcggtctgtcatctcgcaaaatcccgcgcctggctcaacatttagatgcttaattcatgctaattaattgattaattatgtttaattgcccaaaaatgcttaggcgagcgttggaagtcaaaaaaaataaaaacgacaacgccaaaacaaccgcgtccatttacattcccaaggagttcaagcagtacgatgaagcctaccaagtcggttatcgcttcgagcagaaaagcaacaacggaaagtgcaacaaggcgcagtaaggccaaattttggcgaatatttcgactgataagcggacccgaacagaatgggctatgccccccccccccctcatagaaaggggtgcgatttgccaaattcgcaaattcatttttggcatatctttacaaaaaatctcaaaatgacattttttcgtctaaatgccgatttgattgcatctccatccctccgcttcaggcactgctccttcccgaatcgttccgccgttcacacgtcggccaattcgtcctcctcctcggcttcttccttgcactgttccgcccctgcctcctttgccttccattccggtgccaacagcggtaattttgatcacttttccccattcttggggccgttggattttaatttttaaaattagccatttaagccgtggagtccgtccacgtgccttccgcttgagccgctggcaccgctaaaatcgctgacaactgccaccatcggcaccacaacatattcggcaccacggcccgagccaacaacggacgagtaaaaaaaaaagcatgacgcaaacaaaatgtttgccaaactccgttttttcgcaaattcagtccgtttcccttgccgccattgtctcccattgatccccctttggccaaccgtcgccggtcgggcacaaccataacaataacgtggaaaccgtcctcatcaacgggtggcatatgcccagaggtggtccaagaaaagtgtacattgaaatgctcgagagttaattaacaaattagggaaaataggaaaattatttttctaattagtgacgggcgaatgactttttaagttgccaattccattgccggacgaaatcatcgaggcaattctgaacaaattgtcgggtattgacgacaatggcgattacaccattggcgagtgcaaagagtgcggtgaaaaggcgcggaaagaaaaagagggagaagagagtgttggaagcatggagagtgcagagagacgagagggaagagaaaattcagcagaaaaaagtgaacaaaatggcaaggaggaagcagaagagggaagacagacagaagaaggggtggcccaactgattttggacattcttctgaaagcgttcaaatgggcggggggagagagtggggaagagagaagagaccagcagacggacagagatgagcgaaatgatcagtggaagagagcgaagtgatcagtggaagagagcgaagtgatcagtggaagagagcgaagtgatcagtggaagagagcgaagtgatcagtggaagagagcgaagtgatcagtggaagagagcgaagtgatcagtggaagagagcgaagtgatcagtggaagagagcgaagtgatcagagtaattagtggaatactgatcgaagggcgattagccatggaaatctgtcatgattaaattgttaaaaaattcatttatgaaaaaagaaattgggcatttctgtaaaatttcttttaaatatttttataaaataatatccaaaaataaataaaacaaaacgatggaatcgatgaatgaataggacctgggcagacaaaatgaatgaatgaatgcattgtgtgctgattgaacgcggcagcccattgtgtgccggcttatccaaaattaattgacagcaattaacgacagataatagcaaaacaattattattacccatcgaaatgcattcacttttcatcattttttgttttttcttcttccgttgcgtttttgcaacaaatggtaattggaaaatttccattcaattgaattttgtggcataattgaattgttacattaagaaacaaaatttgggagcgatgccgacgaaggcacttttggcaatggcacaatggcaaaggcacagcaaagtccgcgcatcaaatggacagacgaggagaaaccgacagcagacgaactgctgcaaagcacgcaactgttccgaacggcaaatgcaaaaagggtaaaaaaaatggggaagaaatgatcactgataagtgatcattgatcattggggcaatccctcagatgaaatgccaaaattaatcgccatgcattcaaacagtttcaaagcttaatgtcgtcgaatgaagagcgggcaacgagagacgaagcggcacggttgagaagtgtgaccaaagaggtggaggaaaagcttggacttgcgccatcgccggggacaaatcgccaagggccaacgacatttggcatcagtaggaaaaggggtaaaagaaggaaacgcggaaaagcacattaaaaacaattacctatattatactgaatccttattatattagtgttaattaatggaaataaaatccgtcaattaatcagctgatttgtacccttcggcaaatgaccccccggcactgttacggcgttttgttggcaccggtgaaagcgccgtagagcttaagaggtattttattagatttaaaactttaaaattggaacgtgccagaattcggtcacctccaaacgctttggtcgcttctctgctacgccagcaaagagaattgtcagcagtgcaaccaaacattatcagacccagcgttggcaccggcacttttatcggtcctttcttcgctttgaaaaatgccgacaaaaatttgggcgtttaaaaattaaacaaaaaaaaattaaatttaaataattaaataaaagaaattatagctcaacaacaacggcaacaacaacaccagcttgaatatgagcagcaaaggctggttgaacagcagcaacagttgcagacactgctccaacaattggccaccgttcagcgacagcgccaattgcagcagcagcaaatgttgatgaacagtcagaggcaaagtgggcaagccgttcagggacgaaacgagcgcctcgcgagcagagcaagcagtagcagcagcagctcttctcgggcagctaacattgaggtgggctaaccattagccgcgaaagaatccaaaaataaaacgataccctactaattagtaattactctcatgttgacagaaatttccgcctccatttgcttctcccagcttttttgggcctgctaacaacccttttcaacctccaccaccaatatctccaccatcatcatcatccgcattgttcccgggaaagtttttgccgagttcggcatcggcttttcgtctccccggcgggttgccttctccaacagctcccattttcggcggagttcagccatcagattcaaaattcgctgtccaaccgtcgccaatttcggcgccgttccgtccgatcagtagttctgtggactctgctgctgatctgtccgcacttctccaaaaattatcttggaataatcccacaaatcaaaatagcggcaattcggctaccgtagttgtgccgatccctacagtactgtcgaacgcggcgaatcgcggtggcgccgcacaatttgtggtgccaaaaccccaacaggaaaggccattggtggtcaaattggtggcagcaggcaaaagtgaacagcagtcacagcagcagaaccctaacaataacaacaacaatggtaatgacaatagttgggattactatatttaatgtctttcttactgtagattgagaattgtttttttaatatatcaaattggaattttttt

SEQ ID NO: 3859 - DNA, 2776 bp, Heterodera glycines
cgaaaaatacaccccctaagaatcgaccaaaaaaaattcggaaaaatacatccctaagaatctacctaaacattttcaaaagaaaatagacccctaagaatcgacccaaaaaatttcggaaaatacacccctaagaatcgaaccttaaatcctgaaaatttcaaaatttacttcatttctaactgcaatcagtgaataaaattttacatagagaaaaaagaaattttaataaatttctcccctacatttgaaattttttcgcccctattttcgtccttatttcgcgaattttttgcccctatttaggtccctattttgcactttttcgcccctaaaataccatctctaataataagaccaaatatcattaaaaatgactaataaaaataaattccccttatagaaaatttattctattcatttggcatattgttatttcaaaatcagtttttactctccaccgcaatccaacaattgaaattttcattttttaaattaaaatttcaaaattgtttaataatatgaaaaatgacacatacccaaaaatggaaaaaatgtggacggaatattacgacaacattttgacgaaaacttggagaaaatgtttaaattaaaggagaatgggacaaaaaaggatatgaattatcaattaaaaactgatgatcattgaaaatgtgtgggactaattagcatttaataattgattttaaatcagttttttacattttaaatggattattgttttattttttgctttttaaaatgacaaacgattttaataatatttttcattggaaaaacaattaataaaatatgtttttttaaattttttttatattacattgtttagcctttctcttcaacttctgcttcgccatgtgaaaagagaatggacggaaattagtggataaagaaagaaagaatttgtgaaagaatgaagaagcatatgtaataagtacagaaagaactataaattatctaaacatttatttaatgaattattgtaagcaaaattataaatgaatgtgaggaggaagtttgggcaccaaattaaggatttaaaatataaaaatagttttaattgtctgtaattgcaatcacctaatttaaatcatagtaaattcaattaacctgcttattttgctagatttattaccattcattctatatcaatgccacacatatgtatgttttatttgtatcattacaaggctcggtctgttcaaagacttaaaatttgatgagtttaaatagaattagatgggtctcttgacatttcgggcccaactaagccggcgggtagggtacatgtcaactcgccgacgcacgactcgccgacggactaatcttttgtttgtaacttttttctttttttaccaatttttatagaattaatgttattcggaagcactaagtgtttataaaatatcattaagcagatgttaagcgatttccaaagagttataatttttattatgcaaaacattgaaaaagatgtgaatttcatgagttttattttctaactctttggagaattatttaatcgtttaacatctgcttaatgatagtttctaaacacttaaagcttccgaataacattaattttataaaaattggtagaaaaagaaaaaagttgcgaacaaaaagattagtccgtcggcgagtcgtgcgtcggcgagttgacatgtgcccgtcaggaagttaataatttcggatattgagtccctccctaacaaaggagaggtacccaagtgaccatgggacttccgaatgaaactttcagggtaggtagattacccccccccctttgtattataaatttttttttatttttgctaaatgaagcttctggccgagatatgaagcttttcctttttgccttttcaatatcattttcaaagaatgtaaagccaatgtgagcgtcggtggcctggtggttgtgccttccatacttttttcttcttctaaagttcaattccccaaccctgtaaataattattttgtttttttttcatatccaaattagtttttaagctttttaatattaataaatttgaacataatatttttttcatttttattttatatgagagaataatttgtctattgacctattttgcttatcaggtaatctacctaccctgaaagtttcattcggaagtcccatggtcacttgggtacctctcctttgttaggaatttttcctaaacttttcccaattttcaatgttttttgggtgtacaatcaccataaaggaatgatctgatcaagttagtgcaagacttttttttaattataataaatttattttttgtcttgattttttcttttttaaacaaatcatttattaattactttatgatttcataaagaaatctgctgttttggctttattttttaaattttttcatggcaaaatatgttaatttaaaacatcaaaatcggcatcgatctgaaaactctttttaattttttttttgtttttgcagggaatgcgctcagaaggaaaagcgccgcgatgaagtggtaaaggaggaagaagaattgaagtgggactgaaaaattgtccgtttgaattgaatgaaaaggaagaaattacctcagggtttcgatcgaaaaatttaaatcagaacccagcgctctaaaatgagaaaaaattgtcattatcccaaaaaaagaacatttctgaccagaacagagatcgaagccctgcaataaaaaagaatcgctttagatttgattatttattcatacacccgaccattcacttaatgaa

SEQ ID NO: 3860 - DNA, 2738 bp, Heterodera glycines
  misc_feature (2731)..(2731): n is a, c, g, or t
ttggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgtaagggttcattaaaaatatttaatggtttcttttcaattaattgcgttaatgaaattaaaatgccattttttaaatgggtcgtttaatgtgtaaaattaaattaaatgtcggaaaattttaatcaaaagcctatagttaaaatatcataataaattcttgttccagctccaacccaacagcaatcacttgctgattccaatttgctccggggattgcttcaggcattttccaatttgctaacgcctcaggccacagcatcggggggagtgtcgccatcatcatcagcatttgtaccaccaacagtaggacaacaacagcagcaagtgccaaacattggcggcacaaataattttgggaagtcacaattcgtgggtgtaccccaaccgcagcagcaacaagtccaagcagtacaacaacaatcgcaaccgcaacaaattggacagccaaattcggctgtccaatttgttgcggtgtatgagccgtggagaatggcacaacaacagcagcaaattaatggggccaattttattactgcagcaacgagtggtgatggagcagtaccggcacaatcagcagcgggtagagagggagcacatttttctattttaattcccatcctgctgttcagttctacctcaagaagttggagcagtgggacaacttcagcaacaattcatcggctcatcacagccagtgcttcctcaactgccgcaacagcaacaacaacaagttggggcagtatctgtgcttggatggcttccgaccagagcaggcgaaaccaatgcattttctgctgatggactgttttggccgcagcaacagcaacagttgcagcaaaacaactttggcagcaacaacgacaatggcaacgacattttggtgcagcgacggacggcacaacgacgacgcgaagacggacaacaaacaaatggagaagaagcagcggaagaggaggcagaagacgggggaggagcagcggaacggggggaggcagaagaggaggagggggaagagaggaggagagaaggggacgaggggttggaggacacgggcaaatgggggaatgatgtttgacacggactgaaaattcaaaaatttaaaatatttttaatttctggcaatttttttagattttcccgtgtcatttatttattttttgtcatacatacataattattaagtaactgaaatgttcacttaaattgcaaacaaataaatcaccctccaagcccatttttctgggcaaaatgcccagcggacgaccgaccctttgggctttttgcctgcggcaattttcgctgcaaaaatgagtcatttgtcccctcacggggtggccacaaaagtttgtctccacggcttaaaatttgttgaaaaattgcgggtgccattttttgttttatttgaattcagccggcgggggtgggaaaaacggaaaaaaatatgagcagctgtcaaattctgtccatccgccaatccgccgattgatgcccgtggggcaaaactgaaaaatgaagtaaaaatggaaacctcggaggagggatggatcgcccccatcgcccccattgatcaagcaaatccaaggccaaaacaacaccatcatcatcattaagcaccaccaaatccgccccaatcaaacactttctttctgccagccgcggaccggcgattggctggcagaaggcacgggggggggggggaacgcctcgggggacgggggcggggagggcacacgcctttccgtcaccgccgccgaatgatcgatggttggcagcaaaattggctgcaccaaagtgtgggcctttgttttcagcagcaccttttccacaaattgcttttttatttttaattaaaaaaacagactttcattgccccaaaaaatgccattgaaattctccctttttctgttcattttcattgattttgtcggcacttttgctggtgccaatttggcccaacagcgaaaactttgctcaaaccgatgccatcgcctactgaagcggtctttggaacggaatgaacaggtaaaaccacatatgtatatgacactggatattgtacgaccatcacccatttttcaaccttttaaatgcttgaatttatttatttcataaaatattagtaaaacattaatgaatgacctctataacaatttattttattttctctcaggctggtacggtagaggaggtattgtaccgtaccgttgcctacagtcgccagcaattactcgcttcattaaaagaaggctccaacgacgctccggctaaatttgaacaacttcctgaacccttccaaaatatttgctggtgctatggcaaaaatctttagcaaaatttgaaattttaggaaattttttgacttcgaagactgctcaaggcaatgcgaaaaggcatttttccgccgtcggaaaagaaaaaatggccaaaaaacaatggggacggaggagaaggagaaggactcgtcaattggacgagaacagcgaatggtgttgcgcttctgtcgcgaaaacaaattaaatgggtgcaacacattttgaaatttgaatttcaanatttaaa

SEQ ID NO: 3861 - DNA, 7515 bp, Heterodera glycines
acatttttatttttaggtgaacagtgaatgtaacaaatgttgagagaaatacactaaatcggcgccttttatatagtggtatcggtgcttatcgatcggttcttgtccagcattaccagcgagtcgcattcgcccattacgaccagcatcagtccccccactggtaccgcacgattgaattttatgctcaccgcggttgttccgttctttatcagatcaaagagcgcggcttggtcgtcaccgctgcttgtcaagttgaacacatagatacaatgcgttttcccgaattggggaaaggttattccgttgctttccgacgagtttgcgaacccgaccgcctcattcatatcgttgaaagcgcgcacatatttaccatgcgggtagtccaaatcgtaaggggcctgggggtaggaacggccgttggcgatgatcgcaatttcccgcacattaaacggttgaaaattgaacgggctccgcgtgattgtgcccgagtagtcggcatttgaaacaagccccattgtgatgcggcggggaatttggtccatgaacagattggcggtaaactcgaaccggccctgactgatgaacatcgatttcatcatagttttccttactgcataacgtgcaggctttatctcaagctttcgcgcaatgtccagcgctaatccgtccattaatgacaccttcttcacatacattttgagtcccatcacctcgaaacggtaacgaggaacaacaccgccgatggcgggtgcaattagcacaaaatcgttgtcatttggccaaatttcgacatccaattcacaaaagttaatcaagtacagcggctgattgaataggtcggtatcaattttggcaataaattgggctgttttgctttcggcaaacaaatccctgcgttgaatgcagcccggccccgtctccagtgtctcgcccatatcccggtaatatcctgcagcattcaagtgcgagtcctttgctgttgttgagtaggagagttcatgtgaaaaataggttttgtaggccatcagtgcatttgcgttgaacacttcacgcccgttgatgctcattttgatgtttcggatgaatgtttgcccaatcatctggattggcgcaatgttttcgtcgtcaatggtcaggtccataagttgaccattcacattttccttccggattcggaactcggtgagcaaatagcatttggagaggtcaatgtaattctgacttgaatgaagtttgaaatggtagggggtgtcggtcagagggttgctgggaagcagttcaaacacctttgatgaaaagacactgacatttgtcggcggaatgcggaaaaagtccagcgcattggtgattgagttcacggagtcattgtcgattttatgaaatgtcatcctgctggtcgctgctaatcagtagagtccaaaggcgtccgaccgaacacgctttcttgttgtctgctttacggtgattgggggtccaccaattattgtttgatgacttggcgcacgtattcgtcttctttttatacccttctgtccagtaccaaactgcttaggcagtcctcctttgtccagcacggtgtctattcctcgctttccctcggtgaccagcgcctccttaatcggcattccctcgttcccaacgcgctccagcactcgttggccagtgctcaacgcctctgaccctactgtggtgcccacacgacgtaaaatgggcagaaagaagcgccaaagtcctcgaaacacgtcaccaacgcccgctccccgctgtgctgcaccatagcccctttgaaagggggtggagccccgaaagtagtcgaaatcgtctttttccaatccacccccgtattgcatcatcatgtaatcgtcatactgcgcaatgcttgggtcaaacacgatatgaaccatttttattcaaataaaatacaaaatgaatgacgagtgaataaatcagaaatttatcactttcttaaatatcaacacgaccatcgtcgtcccatacgcgaatggcaccagacggcctttgtccattgtgcgcagctcaatatcaatctcattgatctcccgtggcagtactcgcgcaaatattggcgagtcataaatcttctcattataatccccagggatggcaccactgatagacacaaccctgagcaacgagctcagcgtattgccgattatcatattttcggtcaatccttttgagtagaccgcaaagcttgagatgccgccccgtaaatcaaccggatactttgacagttcatttgacacaacatgttgagggttttctaagcccagaacatagcccagctgaggcgagaaggacaagtggctgataatatcattcttgaacaccactttgaaccgttccacatcatcgcgatattggattgacaccgagttgggcacaaattggagtgagtctatttcaactatgaagctgtttactggtaaatctaactcttctagagttaacgcagccgagacaggttcgtcgacggttggaagttgtttttcttttgaaggtaatccaataacagtccccgtcgtaggagaggaagtgaaagttttggtaggagcagttgttgttgttgttggctctggctgaggcggatgtgttgtagaagtgggaggaggaagtttaacagcaggcggcttaggcgatggaatctttggtgttgtagttgttgttgttgtttgaggggttggcgttgttattggttgttgtggtggagtcggtgttgtttgctttggctgtagagcaactgtcgttttaggcttaggtggcggtggcgttgctggctttgttgtaggggcgggtgttgttgttgttgttgctatttttggttcggacgtctgaggggcagatggttttggcgggacaggtgttggcttttgctgttgtgctgatggctttgcggacgactggggggccggtgttgttgttgttaccggttttacggctggaggagtcggtgttgttgttgttgttgttgttagcggtttaaccgccggaactgggggtgtcgctataggcgacgggctttttggatcaataattagtgtccctttttgtgctcgcatgtcatcgtcatcatcgctcatgtgttgctcttcgccagcattcggatcgtacaacgggggagacccgagtcgctttccgtgctcatcaaacagcacgggggattggggaggagtggtgttgttcacatctcttctgtctctcttccgtggcggtggagagccaagcggctttgtccgattccgatcggcctcctcttcatgagggagcggcaacatttttgcaccgatatggttcctcagtgtagcggcaatgaagtctctcagctgctcaaccctgttatgtgatgtcttgggcaccggcacccggatcactctcggcctgtcctcatccattgtgctgcgctgggtgaagtgaatgtcaatccattgtgcatccaatgtgccaatggttgaccatgagtatgggtagcttatgctatgcagcccacaaacccaagagccgttaaaatgcaacggctttgggagccggacccgaaatttattgggctgattgtccgggtaatccgtcacattgctaggcaaaaacacaaagaagctgttcgatgacatttttttatttcacgtaaaatttatgaaaatgtgatatgttgttatatgggtggggcttttatacaacaaattgtgactcgtgaacccattcgcgctcggggtatcctatgaacttgacaagcatctcagtggacccatccgccctctttctctttctgtacaccttttcaatacgatagctcgtctctgcatcctttcttacacgcgccaactcctgctcatagaagctgcccttgaatttctctccgcgctcatcccgtagcttgtaccgaacggggcgaaccgctttcagcacctcgtcaacctccaaaatttcgtcgccataatttggcaaatagcccttctcaaactgtcccttctctctgctcatgcgcacaaaatcgtctttgcggaagcgtgtcggtcgtcgtttttgtggtgcacggtgtgcataatcatataatcgcttccacaccctctgagcattggaaaagcccacatcaatcggacgcattccgtgggcacgtgacggggagcggttaatcccgtccacaattttctgtgctgcatccacccagttcagcgtctccgtttccgcaaaataccggtacagccgctgtttcacattacggatggcccgctcggcgaccgacgccttgaccgatgaatgcacgggttcatgattctcaatttctcgctgctcaaaaaagtccttcagcaatctgttcttaaactcggttcccttatcggagaaaatgcggtggggggccatgggcatttgatcgatgagcagcttgaatgcctccaacatctcctcggctctcttatttttgagtggcacaacaaacaggcgttttgagagcacatccaccgcgacaagcagatagcggtgaccccggttgtgtcgcgatagcgcttgaaaatcggccaaatccacctggacatcggtcatgaatcctgccgctacggtgctggcccttggaaagcgcaccctacgggggcgcatcagagtgtatgtgcggtgcccctccaaataatgctggacgtcctttttgcgtaaatgcttgatactttttcgcgcctctttccacagcgcggtaacgcccgcgaacgccgcgggcgacgatggactgttatacagcttgtcaagcgttgcgttgatcagctccattttttcggacgaaattcctttttgatttttggtgccgtccgcgtggttttgctctgtgacggtctctttggtggagccgtccatgaatacagaattgggtcctgctgaagcctttcttccaatatggccgctcctggtggtctaatggtggggcggcccgctcttctgtctattatatagcggatggccattcgcaaattggtatgcgccaacggcttgccgtttgcggtgttaattgtatttccacgaacgcccatacgatcagcgtaatggttgcatttgatgtatagccgttcaacccgctgagtcatggtcagctgatttgatggaatggcaaacagttcgcgttcttgttgtcgttgttgttgttcatcactttgtgcagatgtcgatgggcctggctcgggtgagtactgtacccttacccttctcggctgtctcactcgttttcttatctgcacctcatcatcttcatatacggggtagcgacgtttggcccccctcctaggcggaggaacaacgggcatttcttcgacgacaacagcggcagcaggaagaggttgttgctgttgtggcgcttcctcgacttttggttccctttttgggatacggtatggcatgggtctctttgttgtcggctcatgttttattttgggcgtcgggggaggcgggttatacccggcctgccttgatgtggatggtcgtggatcgagatcaacaaactctggcactctttttgccggagtggggcgaccggttttctttgatgtcgacggcggtttgaattctgactttggcttttgttgttgttctctcttgacgttaggacgcggccggggtgtaggaggcctcggctgctcaacttttacttttgcgcgaggcagtggtggaggttgataaatcatcatatactttttgcgttgcaaatcatcatcagcatcagcctcgtcctttttcaattttcttctgatggcaatcctgcgctgagcagtgtccatttcctcaatttcttccgcattgtcgggcagcacaggcaaatcgccatagtattgtgatggtgctggtagcgcgaatccattctctagcatatactcatcatcatcatcactttcgggcagtggcgccgcagctgcttccgcaaggaggtcccgcaccactagcggcggcggctgccgttgctgttgttgtatatcgtatcgccttttccgccattgctccatacgacctcctctacgagaagtcctgcccggtctcggggggcgttgtggacgaggcggaggacttgttggtggcgaaggagccccgggaccacccggaggactgggcggtggacgacgaggaggtcttccaggcggcggaggtggtggtggaggagcgggaggacggcgtggggtatcaacaacctcgccttcttcgccacctctattcatcagtacacttattcccttggtcagctcaactttggttggtctgtccgcatgttcctttctcatctgtaaataacgccggagctgctggttataatgcacatttttcgccgaaggatttgtctgtccacccctggcccggtccaggtcgtggcgaaccgcgtccaaattgaggtctcccgtctgcgagacggaggtgagaccccgataaatttcttgtggtacgagaatgaatttgtttgccatttttattaatgaatgaatgcgtgtgtgagacaattttacgagggtatttatgtgtttcgagtcacaaccgatttggccaattcaattaagacgggggttaaaaggctgcaaatagtccgccaaacccctctcctttctggatgacaagcgctcgcttagcgcccctctcgctcctcgctctgctcacgcggcgcaccgtgtccacgtagggcattagtcgtttcttctgccgagttgtcagtcggaatcgggaagcaacaatgttcaagcacacttccaccagtgacagcagctgatcagtgttcgcctttctgatcagtctcccgcatcgtttcacacattttgccttcgacagtgcacaaagccagttggcattatcttttattagttgactaactttagcttgttgttgttgttgttgttgttgtcgttgttgttgccgtttataccgctccatttttggggatgaacacaactgttccctcgtcctcctcctgctcctctttaaatatgttggtgcggaggcgaagcgccggatcagatgatgcgtgcatatcgattagcaaatagccataggggcgggcggtcgccttgcggtaggcgtcaaggaaaaaatcgagttgacgcggaaaaagctgaactccaatatttcgaatggacagcagcgagttgggcgcgcgcattagcaccaaatactgcgcagaaaggcgagccaccttgatcttccgctcaaacagattctgagtgatgaacactaccgcaaactgatggtgatgggattttttggtgaacaaatcggacagatagcgctcctctattgacagcatcagatcgtcgagaatgagcagcatcggtttgggaaggcgcctaatcagctcctcccgaatacacctcaactcccgccttttgcagtagcggaaccgccgaattcatctcaccaaaacagtacagaattgagatgggactgggtgcgatcagttcattgcactcagcaataaattttagtaggaattccgttttgcccgacgaggagggcccggaaataattataccgcacggc

SEQ ID NO: 3862 - DNA, 5599 bp, Heterodera glycines
aaaactgtacggcaagaaaatggcttcctccggcggcacgtcgccatcgtcttcaaagcgttttcccacgacggagaaattgacggagacaaataaaatggacagtaacacactgtcgccattttcggtgaagaaaaagtcaacggtgacaccagaaaagtcggcagtggcatccaattgggacggtgtcaatgacgcggaaaagaactgcggcaacccgctctaaaattgtttggatcagtaaaaatgccaaattgcggttgagattttcttaatttcctgaaaattccaacgatttccccgtccccactttcgtcccatttctgctgacctctgtcactgccgctgttttcgcgttgggcttcgtgccgagcacatgcgaccgaccgacgatagcgcacagtcgcaagtcatctttaccacaatttccgtctttattcgccatggaaaaacgtctcccaccgccggaatacatttttaggctgtcgatgtaaaagcctttaaaaagacaattatcaaaatattcggccaatgtaaaacaaatgggttgtgctttatacacacttaatatacatataattagatggctaattagataacaaaatacattcatatacaaagtgtaaaaggcgtatataaatcgatatttgattctacagtatctgtcgccaattttttcattggcgacgagaaggcgggtcaatccccgcctattgcacaaatgaacgggacgggactcaatcgaagcaaaaagaatgagggatgttcttggagaagatcggggcgagtcccgattcatcaattcattcaaaatcgatcattcctaatttttgccccttttccatccaatttctcatatgcatttctccatttcgtaccattcacattttgcccgttcctttgtcccatttttgccccatcgcatcccttcacaattcaaatctttctcatcggttggctcatcttcggccaactttgtgctcagatttcctttcagaatttctcactttttacatctgccaattcacattcaatttttgtgcgcccatttcctttgttcgcacttcgcttctagaattttctgtccgttttttgtctctctcacaatttgtccacgtgcatggccttttgcccgcccccttcgaaaattgtctatttaagcgcccccggccaaggggtcgctctcttctcttgcttccactccccttcgcttcatattcggtctgcctgtgaccaattcctccaattcccccgtcccatcgcccaattcgatcaattcgtcgcttttattcattattcgttttgctttaataaattcgtgctgaaacggcttggaggactcggaaaggagggaaaagcaccctccacactccatcacattcggcaaattctcgtgcggggccaaacggaggcgcccattcacgtcttgaccccttcctttcctggcagccctcgtcgttctcccccaatcctcccgatcccagttcctttccctttggcattggagaatccgggagttggcccggagcgtcagcgaatttcaagcagttcagactcccgcagccggagtctcgcggatcggtgtcagtctcccgccagccggagcagccgtagggacggggcgaattcccgtcgtcgacgaaaccaagcagggcagagaaggaaggaagagccgagcggtgccaaaccgtccaccgaagggcaggcccgttcgtcgccgctaatcccaccagccggagaagcgcgcatcgccggagtcagtctcccgccagccggagcatccacaggaggagacgggagtcgaaacccgtgctcatcaagtcgagagcgaacgtcacgaagttcgagcagttcagattcccgcagccggagtctcgcggttcggtctcagtctcccgccagccggagcatccgccgcaggaaacgggagtcaaaacccgtttcatcgagtcaagagcgaagagcaactcccgcccgttcggagcagctcaaagggtcggacaagcccccttcacaaccaatcttgtcgagcaactcccgcccgttcggagctgctcaaaggggtccgacaagcccttcaccaaaatcttgtcggtggtgccgttaagcaagcagcaaatcgctgtataacatccaacagtaccagttcaattttgtcacccctcccccctcccattctcgtccccctttggcgctgatcggatcggtcagcagcatcagacccatcaggacgaacggcgaaaaagggggccattccctttacggcacagcgagcggagtgagcagagagcaaaagggacgagagcggtgaagaggagcgggaaccaatcccgcctcagctgggccaagccgcacagggccaaaccccgcccgagtaaaagattggcgacaaactggtgccgttagcaggggctttctgcaaacgtcggcaaagcatcagtcgagagttttgtcgccgaggaccaacagcacaacgaagagaagctaacggcaaactggtgccgttagcaggggggtctgcaacgacatcgatcgggaccaaggactacgaattcgagaagctaacggcaaactggtgccgttagcaggggggtctgcaacgacatcgatcgggaccaaggactacgaattcgagaagctaacggcaaactggtgccgctagcaggggggtctgcaacgacatcgatcgggaccagagactacgaattcgagaagctaacggcaactggtgccgttagcaggggcaactgcagccaccaacaatcggtctatgagcgaccaatcggtctacgagcgaccaacgagcacgaattcgagaagctaacggcaaactagtgccgttagcaagggcaactacagccaccaacaatcggtctacgagcgaccaatcggtctacgagcgaccaacgagcacgaattcgagaagctaacggcaaactggtgccgttagcagggggctccagcgaaacatttcggtcgacgaacagaacaggcggaaacgaaaaatgcaacgactcgaattcgaggacgggagcgaaagcaacatggacccagcgaatgagggccatcgcaacggcgcacagcacgacgaaaatgtgcaggacggggatggtcccgtcgcttcaacgaacgaagagcaacaaaaagttgccagagtaaacgaagcaacgagaggaagcaacatggcgacaggcttggggacaaatcagcaagggatgctacccttcccatcacgcaatttgcggagtgtatccatcccggtacggacagcgcgggacagaatcgagagagcatccgggactctcgccgctcgaattgcggaggctcgagaagtgatcgaccaagaccttaccgaaggggaggcaggctaccaagcggcgcgactgttggccatggagagaggactcaaggaggcaactcaaatcttccaaggacatttcgagattggaatggcagcagcgggagcagaacccgcaggtcgccaggacttcttctacgacatactgacggcgccactgccggcggcaacgaaagagttgcagttgcgaaaccatccaacaccagctgaactgcttcaaattgcggacgagcacatcggagacttaaggacgatgcgactggcactcgaggatgaagaagaagcaatcgcgcggtctcgattgagcgggtcattcgggaccaacaacagccatccggtgggggacgacccacctccacccgaaaatcggaacatggaagaatgggagagatccttccaagtggcggccaaacgatggcaaaacgacggacaaggtgtacagcaacacaaccgcagaccaatgggacgagttgcgacacccgtcatgtcgaatttggacgggatttttcagcggcgtgccaaagtgccgtccgtcgccagcatgagagtgacgaacacagcgcgagaatggatcaatcgaaatcgagacgagatgggggcgttccccccagcaacagcccatcggccggcactgatgcaaccaaaaatcgaaaagcagcaggctcacgtgaacgacgactatcgggagcgtcagacatacccgattcgacggcatgctcgagacgagggagaacatgatcggaagcacgggagggacgaaagcacggggatgacaacattcgagaccgttcggctacaaccaccgacattttccggaaagcccgaggattggacgacattttgggcctatttcaagcgagctgtggacgacaaacccattcccgggtttgaaaaacaattgcatcttctgcgctgcttaaaggagggatcaccagcccggcgggctgtcgaagtctaccctccctccgacggcaactacccggtggtcgtgcaatttttgaaagaacgatttggcgacacggacgatttacagcgggcaattcgggcccggcttcttcatttggcaccggcaaaggacaatgtgaacagcttgacgacgatgatcgacgaatttgagcgatgcgtttgccaactcgagcagctcggggcgaacgtggacgacgactcatttgggccattgctggaagccaagttgccagtgcgagtgctcacggaattgcggatcagagaaagcatgatgggatcgaaatggtcagtgcgcgagttcaggagagcggtgacggcacaagtgcggtgcatgcgatcagctgagtcagcactggcggcaatgaaagacccggaagtacgcactgatcaccgaaccgaacgtgatcatacgggacgaggaggcaaagcaggtcgggaaccatttcaaagagcatttatggtacgggacagccaacaaacccgtgcgcagcccaacggaacacgaaaagaagagcagtgcgggacgagtgcccgtttcaccgggcgaacagtggcacgcggcaacgagaacggacacacgggcgggaatggaccccgcttcgcgcaaaatgggctccctccaagcttcgggagggggaattgttcgttttgtctggagagcggacatcggccgagtgaatgccgcgcctatccgacgccgcaggcacggaggaagcgactaattgagcaaaaacgatgcctgcgttgcctgggctctgatcacacattcgaacagtgccaacgaacggtccgatgtgacgcatgtcgaaaggacgatcatcattggcttatgtgctggaagaaccaaccgggaaaccaatcccggccctccggtgaaccctaacggaaggagaacaaccacgcgatgctgatcagtgggatggaccaacccactcacgtcactacatcacgagacgagccgaacagtcgagacatatccgagacgaatgccggggagcaacgggctttcaccgcttttggaagccgagtcccggcccagcaaatgatccgaagagtgaccgcagcagcagaagaaggcgaagatgaatgccaaacaacattgttgtttgatccaggaagccaccttgactgcgccgagactgagctaatttcaacctctcggaccgaagccgaccgaaaagcggcactaacagtttcagtttttggagggaaaaaacagcggttccgatccgcaacttatcgtttgcaactcaaaggggatcgttgggggatggg

SEQ ID NO: 3863 - DNA, 4226 bp, Heterodera glycines
ttatgtgtatttaaatttaattttaatatttttcgaaatttccaaaattccgcacgtactaggccagctcgaactgttccggcaacgtactgtttctcgaaaaaaatcgtcataactttggtcaaagtcaaccaaattacacatttttggtttcattcgatagccctaaaggttctttattcacatgcaaaatttttaaataattgatcatgttgaaaaaattctttgacaaaaagcacaaagttcgtcttcgtctttgaaaatatttggaaaataataaaataatttatagttttttttaaatgatcgaaaaaagagcacgcgaaaattttctgccaatcggacggaattaacagaaaaacaaattaaataaaatttgcttttttcaaaaaaaattcatttattgttccatttgttttccatgaattgtttgagctcaaaaattgtcgttctgagcccaccaaattcattgtgaagtgaattcatttcgctttcattttccttttcgaataaattttaattttttattatttaaaactaattattagagatcggaattttgaaaaaagcctgtacctgtacctgtattttccgattggcctgtacctgtatttcctgtacaaaagtacaggaaaatacaggtacaggaaaaatacaggctcctcgaggcctggatccaggcctgtacctgtatttttttaatttttttataaaaacgttttttattaaaaaataaacataaaaatacataaatatatttattatctattaaacaataaatattgcttaatattaaggtatttaaacttttttcttacatattttcattttcaaaaatattttaaaaatttttgaaaatttatagaaattttattcattaaattctagttaaaataaatctaaaatggtgaaatacggtataagaactcgttttaaaagaaaaaaaagacaatttctagagaaaaccgaccaaaaaatcaaaatttttcattttttgcttatttttgacataaattaaccaatttttaagaaaatttaattttagttcaatttttttgacaaaattttgctaaaaaatgtctttttcgaaaattttttcggtctttaggagtcaaaaaggccaatgtcagcgcctcagatcaccactagaaaaaatgaattaaaaaacaatttcgggaccaatgttctcaacaatcatggcctgattttttttggctattttttcatggaaaatgtacatattttccccctattttcccccgttttcctctttattgccccccgcggacgaaagaagtgttaaaaacatcgcaaatgaattctcaaaacactcgccacattagtttagaggcggtggtggttgtggtgcattgagtggtgcaatcgattcattcgttttcattttcatttcgtaaaatatggaaaaaatttgtcctccataataatcactaatcgtttttatggcgaatggcgtaagaaacgccgcggggcgattatctctattttctccattctctctctctctcaatccaggaatggagccactacacgcgcaatccgcggcatttttttccgcgattcgctaatgcgacaatttgccatccgcgtagcgcggggattttcatgtccgagctccacccctgcttcttccgagtcaatggcaactcgtacaatggcaatttgtacaataaaaaataaaataaagccttacctaagcttaagcatagcctggcctaaagtttaggcctaaacctcgtaattacggattttgtatgggttctgcgtaattggctttcaattatatacagccctgctgatctccttggcacacgcttcgatctgtaaatgcaataaaaattaccgtaattcatacgggccttattgacccaaaaaaatgatgagcatttacgattttccaggcttgaatatttagccttaacacattttccaacattggctaattaccgtccctaactaattggcttttttccctcccacttaattgggtaccatcaaaaatgccgaaggtggactttgactatttggacatgttttcacccatcttggtctgtttcgttggtatatatcattttcatttcctttttttcttgttcaggtggcatttatttttgcgctcatcctttttgtgagttctttttttcgtctggtcaataattgacctaattaggagtggacccgacaatcaattagcaattaaatagcaaaaaagccaatgaaagtcgccgaattcattaaaaagattttcttcttttggtgcacttaatcccccctcccgccataaaggaacttcgaacgaaaaaagtttaacgaaaaattcccaatacaattaaaaccacattccatggcactttcaaatttttaatttgatcattatttcccaatcccattttacagttcatctccttcacgtgcatcaattggtactgtatcacgcacaaggatgaccttacggtgttcgaaaaggtcggtgtactgtgtgatcggtcacacattctatacctaatttgatcactgatcatttttgggaaaaattagagctcgacattttgaaaaaaacatggaaagggattcctggacaaaatccaagaaaatccaggaaaaattcaggtgcctacgtatccccctgatcagtccccctcccgaaaaaattaattttttttataacacataaatctttcaagaaaaaaaatcttgaaacttgtttataagaaaattccaagaagaaaaattttcataaaatttatttgaatcactaaaacttcaaaaattttctaaaaaaaaactgcagaaaaatttctgagagttcttttttcttggatttcttataaaaaaaactttttaagatttcttgaaacgagctgctcccgaaaaatcaggttgctgaaaatggcacctggatttctgggcctggatccaggaaaaacacaggcccttgtaaaaatggcacttattttccagttcggcacccgcttgaaccttcgtcttggcccccattcaatggcagtgatcaaacgaggcggctacgcgtccacctacgcccgcgaggaggcaaagcggtcggaatgtaccggaccacaacagcaacaactgaacacgcttggggacggaaaatgccaaattagccacgcttgacaaaaatgattggcatttttttcaaaatcattttaattttgatgaaattttctatgggttttcaattaaccaaagaattttttttatgccaattaattcctcttcttttaatgcaataaatacattttgttcaattatttttgaaaatttttgtgagaagtttagaattaaaaattatttttaatgcattttttaaaaaatcatccaaaatttaaaaaaataaaataaaaataaatttcctcagtcaaatcaagcagtgaatgcttattgttggttgatttggtatattcattattatcatcatcattgcatttcttgttccgccatttttgacgccactaaatcattttgccaacgtcaaattagcgggtggggggggcattaataaaaaaatgcggttaattgttgaggaggaacaaaaagccccatttccgatccccgcttttcccgcattaatgctaacatatgccctggggtggacccaattaagcgcccatcccaaattaatgatgcttttgcatgtgattgatggaactgtcgggggaaagggcactcattcattcattgatcaccccacccaaccaaacacacaacaatggcatagtttcgatcagctaattgtttattttattaccacattgcactctctatctctctttctctccctctctctatctccgttcactctctctcctttctctctctatctcatcccctttattctgtcgggggataaacgcaaaaagggaaagtcgctaatttgcaagagtaattaagagaggggacgacggacagcgaagagcgaaggtggtccccctgtcgtcgccactctcccctcttgggctcggcttgttttcccatttgtttcgtcggtgaaaaggaggcggacgtggtactaattgattattattatgtataatgttgattggctctccgtgcgcgcccgggggcacgacggacggtccccccggatggtcaacggggacgatccggctagcggcaacacgatagctggggggagaagcatcacatcatacaagctggcgcgacttctgacaatgggcgtgggtggt

SEQ ID NO: 3864 - DNA, 1464 bp, Heterodera glycines
gtcccgcttctttgctgtttgttgtcgacttcgcctcgggcgatgccggatgcaataattgtttgatctcacaatttggctgctgttttcgcttcgctggggttgatcagcagggctatatctatctatgatcactgctgggctggacgtggagcaaaagccagtcagtcagtcaactgctagcccaaagccgacgcaaaatggtcttgatcacttatcactggtccatgctagctctgctgatcagcccccattaatatagcgcggtgatcaatgggttgatcagagctagaacaaaggcacttgtggagcaatcccggccctgcccgcttaaactagtaccaccatacatatatactacctacctactttccccttcgtcaaccaaccatcaatcagtcgtccgatcggggggactgattaacggtgattacaccattcacccctttttgcccgatttctcgggatatcgcaaccaaaaagtgtcgatcccgcgcgcattagccaatcctgctgccgatgagatgatccaccccgccgatcacctccacccacttttccgcctccagcagcaagctgtgataaatgtgatcagcagagcagcaggcccagttttgtgctgctagcgcttattttttgtcattgtgcaagcggaccccgcgcaattaaaagcaaaagcgtcgtcccatcacatttgcttttgcttatagcaccaatcggtggctgagaaatcagtcactgccattgccattgtgttcactttgttcaatttaattcggctccccccgctcattcatttcccattcgatcacctggaccagtggtgcttcccgatcagtgttctcctttgaatatgtgaatatgatcatttggttcttttgctgtacataaattatcaaccgaatactttgatcactcactttccactaattgttgagccctgatcagcaaactcactgatcatagcctcaaccgattagcatgtcctttgatcactcagactcacttcttaccagttcaattcccatgctatccggcactttatccatcgatagatcactcctccctcaaccaaccacgcagatcactcaatcattggtcctataatggagggaaattatcagccgatctctctgatcatttaaatttctattatgtccggcactttatccaccgatagatcactcctccctcaaccaaccacgcagatcactcaatcattggtcctataatggagggaaattatcagccgatctctctgatcatttaaatttctattatgtccggcactttatccatcgatagatcactcctccctcaaccaaccacgcagatcactcaatcattggtcctataatggagggaaattatcagccgatctctctgatcatttaaatttctattatgtccgggactttatccaccgatagatcactcctccctcaccaaccacgccgatcacgc

SEQ ID NO: 3865 - DNA, 3200 bp, Heterodera glycines
  misc_feature (48)..(48): n is a, c, g, or t
gatttataaaattatgtttagagacatccaagcttgggttgatcatgnataagtgcctgaaattcaaaaaaaaggtctgctttcgccaaagtctgtgacaaagttgatcatatatctgcaacgatcaggaattctatgatcagagttggtccgagcgaaagataaagaaatttcgtttttttcttaaaaaaagttggccaaatgtattccaaattttcctaaagatttgtaaaatacaattctctacttagtggattttaaaataaagaaaataggaataatcagaatgccatcctaatcaattttagcaatttgatcaattttgctaatccaatcacgtcaaatggttggcatgccaatgatcaccaggagcagcagcagcagtcggtcaaatctgttgtgcctgatcaggacagtgccgctgctgatcaccaacagcatcttaacaatgttattattgtcactcgtccccactaccgtatacgcccagtacggtcggaacggtgtggcggtgccgttggtggatgcctcggactcagtcgacggtgtcggcacgggcggcggtgatggtggctacggccgggcgccgcccggcactcaaaatgccattctgatcaatgcccgcggggttgacgcgagcgcgggtaaagcggtgtactcgccggtgttgccggccaccaatgacttgtatttgccaccgcctgaagtgccgtcaaagagcggagcgatggcaccggtgccggtgcagctgaacgggtaggccaatcaatcaattaaaacgatcggtcggtcaatcaattaaaccaatcaaccggtatttaaatcaatcactcaatcaataagccggccaatcattatttcttcggcaaacaattgatcaaactttgctcgaggcatttgaaaggtttttatgggacgggaatgccggggcttattttggcattaattaatttaatttctttggagactaatttgcctcttttttgaaattcatttgcttttcggcgctgaaatggcatggctttttacagcgctgccgactcagaccgacaaccacaaggacaaccagcgccgcaacaaccaccacaacaggaagaactggtgccagccgcttctccgccggcagaggaaagtgttgcgccaaacaatcagccggttgtaccaatgatgccagcctccgctgggcccgagccacaaaacgaacttggcacgcagcatcaaacttcgccacctccgttaccggcacgggcaccgccccaattgcatttccaaatccgcaacctgggccccaacccggagggcattcccggctttggtgccaacgagtacaagcccaacaggaagccattgccgtcagctgccaaggaacagtcgccggctggcagcgctgctgctttttcacctgctccggcaccgcctgttgtgccgctagccgttggcggttctgctaatccatgcggcactgtggcagtgccgccaccagccgttgccgtgccatcatcagcggctggtgccgaatcaacgtatggtggcggaggtgagtatgtgtgagaagctctcggcttctgatcagagcattaattggtcgctcatataggaattgttagtcatttgatcagaggatgtaggtaaaatccaaatgattgaaacaacttgactgataattggtcattttatttttccttctttctgatcaaatgcgctaatatttcggctattcagttttaagctcaatttccgatcaaatcattgttatcagataaccccaaccattcagctgagccctcagccgctgcttctgctgtcggtgccgcggcaccagcaaccgctccgccagccggtggagacggcggttccgcagagacgaatgtgccgacaacagctggtggagtaaccgcatcgtcggctgtcacaacagcagcagctgtatcatcacccataacagcggcggcaccgcaagcttcatccggtgcgccatgcccgtcttctgcagcaccgttgctgccagccggtggccctgctgagcagcaacatgtgccagtaggtgtggaggtgaagccggcaccggccacggcacagattgggcccggcattgccgctgactacggcgaagagacaaacaacggcgccgcgtcgccatcgggtgctgagccacaaccggccactgtcgtcagtccggcgccaggacaacaagcaacaacagtttgtgccggaataagtgccgctccggcagtggccgccccgtccgccgcgtacggcgcggaagaagcggtcagcggcgatgggcccgcttcttcttccgacactgtgccgccttcgacgccaacgtctccatctgctgagggcggcgctgcttcttcgtccgctccgcttaccggaaccgcttcggccgttccaccgctttccgccactacgtcgtgcccctctcctgctgctgtcggaagcgtttcccctcccgctctacacattggcggtagtgaagcagatgggccggcttcagcagcagttggtgcacctgcagttgcaccatcttcaggagctaccgcatctgcatcttccggatacagtgaagaatccgcagcttccgggagcgcttctcccgctccgtccttgggcggcatttcttccgccgctccgttttccggaagtggcgcgtccgcagcgcccggacacgaacagactgaaagtgaattcgcttccggaagcgtttcatctgttgttggagtttcttccgccgctccgtctcccggaagtgccgcgtccggatcgcccggatatgttgaagaaggagccgcttcagtttctgcttccgggcctggcgaaactggtggaccgcctcctgtaagtgctccgtcagctgccccatcatacggaagtgtttctgccgctccgcgtgccggaaatgccgcatcagtctcacccgaacatggagaagaagtagccgtttcgcaatccgtgtctgaaactacttcttccggaatttcttccgccccgacttacggaagtggggcgtccgcttcatccgctgccggaatttctcccgcggctccgtcttccggaagtgccgcgtcaatttcgcccgaatatggagaagaaattgacttttcggaatccgcttccgaaagcgcttcttctgcttcagccgcagccggcatttcgcccacggctccgtcttccggaagtgcagcgtcagtctcacc

SEQ ID NO: 3866 - DNA, 2890 bp, Heterodera glycines
  misc_feature (2875)..(2875): n is a, c, g, or t
ttgatttgttcacaacaacaaattgacagtctcacttttgattgtgggagtttggcacgaggggtaaatgcacagattagacccctatggatttatagctctgaccttgaagtctgatactacaaaacctcagaaactaagtttgaatcttgaaatctaatactttgattctgttgctcaaaatttagtcaagacctggaagccattgctaaaaatgaatgatcgatcgaatgagaataaagctaagaccttgaagtctcaaactcaattcgttgaaattccgcttttcgaccccttccctttatttctaaaagtattggcctggaaaccaaatactcaaagaaattgtgcagattttcgtaatccacctgttgatgagatgagtaccggcacaattgatggagtgcgcggcaattgggttgctgaacgggcttgaatgcactgtgtccaggtgatcaagtttgcgttgaacaggctcggtgctctgcgttcactttgatcaattgatgatgatgataatgatgacgacgatgatgatgatgatgatgatgatcagtcggtgatcagttgagttgcgcacgtcgtcgtgttacgtcggggtcaccaaaaagtttgttcgaacgcggtgtgggcgtccgaggtcaacttttactttgaacacgctagtccaaagtttattcgtggggtcggggtcggcgagtggtcgataggtaaaatgtgcacaaattcaaaagcgaataaaacaacaaatttatccggatctcaaacttgggtaattaaacctcgcccatataaatgagcgaaaaatgaatgaatgaatggggggaaaattgtacaatttacaattttacatcaatgatcgaatgaattggggggagaagagaaggcaatggtggcatgatttttgcctccccataaattgtgctgataaggtgggatgattgacaggggcttaaatatcgatgaattgacggttggcgacaatgaaatgcatgtgaaccaagtttttccggttctaatgcactttatgagtccaatcgagttttatgagtccgatcagagtttttgagtccaatcaaatatttatgagtccaatgaccctttatgagtccaatcatttttttgtaagtccaatcaaagtttatgagtccgatcaaaaatttgtgaataaagtacattgtacaattttattcaacttaggagatttttcattccacaataagatgaataaataaaaaaagttcactttgttcaatacgaccatcgttgggtaaatcatcggatgtacttcgttgatcccaatgacccaagagtgcacagtcaaggcattgaggcgacatggagagcactcaaaaatggattgcgacacttgcacggaactaactctgacatgttacccacctatcttataggactcataaatatttgattggactcataaagctcgattggactcataaaagtcagattggactcataaaaacttgattggactcataaaagggtgctagagccgtttttccaccggtaccggtaagtcgtaaaaaacagaagaggatattgttgtcgggggctttattaatgttgttgcactgcacacagcaaaagacaacagcccaaagcaaacacaaaacaatacagcccaatgccgaagataattatttatttcaaataaattaaggcgaagacaatcaataaaaactgacgacagcataaactaacaactaactaactcaaaatcacaaacaaaaatgacacaaaatcaaataacaaaacgccaaacatattttaaatcacaattatatcacatcctcgccctctaagaagcgatgtcctcagcgctttgggctcatcggtagtgcattcggcgttgaaaggggcggcaagggtgtcagcagtggaccggttcggcacgaagtcgcgttgcagagtcagatctgtaaaagcaacggacaaaacggaaatccgcccttttttctggccttaaaattccatcagtgtcagcttcttgcgcacatttgcgatcagcaattggaaaattcatgcttttgccgattttcaacaaattttcaagattggcggctgcgacatccgccaattcctccccggccttcggcgaaaaaattgtccccaattttccgaatgctttccgtcctttcacttcgtcggtgcgactcattgagcctttacttttccaaatttgtccacactttgacttttccttcgaaaatacgccggcgaacacaaccaacgcagcgaaaatagcattcaaaaaccattttggaatttccgccgatttttcctccatttttgttgcttttacgctgcaacttgacgacgaattgcgctgtcggttggacgctttccgttttggtccagcttccacgttcgttggttgtgccggtggttggttcgacaaccgcaaatcaatcaatttcttctcagcttctgaattttttcgaaaatcggcacttttcgtcgcaaaattttgttgtggcggttttcgtgcacagttggattgcttccgcgcaaagggcaacctacaatggcgagaaatgtgtcccgttttgttgcagttgtagcacacaattcggtttgtctttggcgcgaaaattttttgtggttgaaatgtcggtttctgttgaaattttggtcggtgcttgtttccagactcagccgatttcgtggccttttgcacttcttctgcgcgtactgcgagagcgacgaaactgtcgaagttcatccccatacggcgagccatttccaatcccaccgaaatttcagggttttcaagagcacgaattaagtgctttatcgcaaaatcggtgacaaagatgggcggcaaacctgggtaagcgcatttcacatcacgtanagtcgttccgcgaat

SEQ ID NO: 3867 - DNA, 2587 bp, Heterodera glycines
gcgtcaaatgcacgctctgcttttccatcattttgctttctagcgctgaaatgcgtcgactttccgtccattcttcggttgctgacgaaaattttttgaaaaattttcgaatttggttcgtcccttccgttcctttcagctcaggaagtcgttccatcgttagcacaaattccaacgcgccaatttgctgtccttcttgcttctgcggttgttccatccgatgccctttgtccgatgttttgttttggagaagttgctgcatgtcgaaatgggattagtttccctgtttgagagtcagttttgtcgaaggattttaccgaactgacaaattttgtgatttgtttcacaatttcctttcccgatgctgagatttgaagtgaagagggatttgcttttcccgttttcaaaaaaaattccgtcttgttcgtctgcttcttgattcgttttccgggtttttgttcacccctttttgtcgacagtccgttgaaatttgagggatttgtgtcccgtttttcagtcacttctatcgctatggctcgtctgttcgtgggttttactttacccgtttacaatttttagctgtccacagtcggttgattaggctcttctcttgctgggaatttgttttccctttttccgcacttgtcgagggatttacttttccctattttcaattcgaggccacgtccaatttgtttttgtccactgctgattcaccggtgccaggagcgccaagtcgtaaaaaacagaagaggatattgttgtcgggggctttattaatgttgttgcactgcacacagcaaaagacaacagcccaaagcaaacacaaaacaatacagcccaatgccgaagataattatttatttcaaataaattaaggcgaagacaatcaataaaaactgacgacagcataaactaacaactaactaactcaaaatcacaaacaaaaatgacacaaaatcaaataacaaaacgccaaacatattttaaatcacaattatatcacaaaaaccagtaattttccaacgttaaaaattttcggacaaaatttttcaaatacaaaatttttatcccgttttcgcgcgagtgcctgttttagcattagaattgttcagaagtatatgtatattcagggtgaccatgtttttttcaaattcaggataaagaacactaaaattcagatttataccccaaaattcagatttttacaaaaataagggggtcagcggccaattttccaattttgcgaaggggtccggccatgtaaattgatgaactttttttgttgctttcaacaccgcttttttcgtgctttttttcctatacttttgaggaacaaggggggtccggcggtgccgataggcgccgccggggaaattttttgtaatttttaatgcgatttgttaacagattttatccaaaaaattactaaattttgcgcttttaagccaattttttacggaaaaaatgactcgatcccaataaaatatgacgaaataaaaaaaggattgtgtttaaaatgctaaaatttggcaaaatgttctatttttataaattttccctttctctaaatttacatcaacaattttgtgctaagattccaattcttgccagtgctaatttttaccggcggtaccggtactagacaaaccggtataatgatttaaaaattgtatatatttaaccagatgttcgttagttttttaatttcaaaataaaaaatgccagttgaataatttttcagcgaaatcggatattttgcgaagacggaacgatgacctatagaattaatccgctaaattatcagctttgttgtcattggtggggcctcggcttggagaagattcgccaatgttttttggcaatttgccaatgccactgccatttgagcattcaaaaaaagaagccaagacaaataatggcaatagaaaggacaaaaaaaggacaacagtaaaaggtcattctgttggggctacgcagctgatcaatggtcacaattctgtgcttatttgtttttgcctgaaaagattgtggaaaactttgattgaaaaattttgacaaaagtttcagaaatgcttatttgttgattttttatttatctaattgaaatttaatacaaaatggtcaaattatttttttgtctcggtgccgaaacgggagggaaagaaacgacgccgactgatgccaatagccttaattttttttagaaaattctaacaaaggaggggtcggcaagtgactgccaatgccactgccatttgagcattcaaaaaaagaagccaagacaaataatggcaatagaaaggacaaaaaaaggacaacagtaaaaggtcattctgttggggctacgcagctgatcaatggtcacaattctgtgcttatttgtttttgcctgaaaagattgtggaaaactttgattgaaaaattttgacaaaagtttcagaaatgcttatttgttgattttttatttatctaattgaaatttaatacaaaatggtcaaattatttttttgtctcggtgccgaaacgggagggaaagaaacgacgccgactgatgccaatagccttaatttttttagaaaattct

SEQ ID NO: 3868 - DNA, 3088 bp, Heterodera glycines
  misc_feature (70)..(70): n is a, c, g, or t
  misc_feature (92)..(92): n is a, c, g, or t
  misc_feature (123)..(123): n is a, c, g, or t
gtaggcaattaaaaaaataactattagagaatgagcctcattaacaacaaaaaatgaatttaattactcnggattttgaaatcaataaattnaatcattaataattttcaattccattctatntaataagtcatttttgataaagaatcaatccacattcattgattgctttcgtctgcggtcacttttgacctgtcatggtattttgaggcgaccatccttaagttgttttattattattttattattattttttattaaattttatttatttttttccatccttaatttcttttgttattttttctttaaatttcttttgttattattaaattatttttctctgaccgcagaagcaactgctgccatcatacacacaacctgcggcacataatctttggggatcttcgcacccatttaaagaaggattgtaaacgcactgggcacttgccatcagcaaaatgtccatggcaaagattgtggcgaaaagcatcacagcgatggggacaatttgggatttgttcatttttaggaatatttttgcattaactttgaatacttagcttaataatttaataataataaatgattatattaatattaaattatttgacattttgattctcagattctttttattcccttcaaaatcaaaaaacagaaaatttctcaaaaatggtatcaaatcgtttcgaattttaaaactaatagacaattttaacgaaaattgttgaattataaaaaaaatttacaaaaattttaagaattcagaaaattaccagcttttgtttgtttcattttacaaatttttgccggttattttttgcgccccatttattaagggccctttccggaaatccgcgcctaaaatatttattaattagggatatgttaaaattaaattaaattgatgcttaaatacacattcttccaaaagtgtttctctcgcgctataatttcatttatatttgtttttcacattttaataaaaaataaaaagaatgatgaataaataaaattttaattaatttttttaagcatttgcttgaatggaaaagcacttttcacttttatttacgactttttgataaataatttttcttccccaaaattctaattatataaaattgaaaacaaataaacaaatgtatgtaaaaacatacgcattttatgtgtcgcctttttcgagtaaaattaattaataattaaattttttttacttattatgaaaaatattaaaggtggaggaagcaaagtggcatgccaattccttctttcggcgcgccaatcggcaccgtcgggaagaatttctttaggtgctataatatatccgattgttgaaataaggacaaaaaataaagcaaacacaaaactgaacttgataaataaagtagccaaaatgggttttatatgtttttaggcaacggatgcgttggcattggtaattgctgccattcattcattaatattaaaatatctgtgttaattttgagtccagcagcaccattcaataagcgtacaattacaattgttttccaaattgccaatttagttatgccattaaaagtttgcctccaatgcatcgtaaacaaaatgaaagaaatgccgaattgagtcagaaaacggaattatgcccaaccaaaagtcgtaaagattcctgaaaatggtgcaaaatatgcaatttaaaatgttttcagtaaattgttattgtcttacacaaaaggctccattttttatgttattttgcacctcctcttttttgtgatacaattaattaataaaaataaattttttactgatataaaatggcaattgtgataatatgagacgggcatttgtgaaagtgatgtaatttttttggataatcattttgccgtaaatttattttgctttgaaagtctatgcataaatggtgcataaattcagcaacttagcagaaaaaggggacgagcaaaccgaaaaaaccgaccgacttttatcaaaaatcagttggccattttcttaacaaaattcattaaaaattcttaaaaatttcccccggcggcgcctatcggcatcgtcggcccccccaaaaactttcttttcttaaaaaaataagcccaaaatctcaaaatttgttatttttagacaaaatcagttaaaaaatagcattaaaattataaaaaaaaatttgaacctctttcttcattacagatgcgcagaaaaaatatgcaaaagaatataatttatatccatttttataacatattaggttattaattttcaaaaaagataatattgtctattttctttctttatatattttttctattgaaagcggatttttttctttgtacaaagatacgattattgtttaaagagcattttacttatttaaatagatgacattttcatatttttttttacactttttattttttgtgtttttggtttttttttattttgagtcaatcctgagttgaacgtaacttaacccggttgactaaccctcagcagctgtgggtaacttttcaactggcacctaataaaagttcatagaattaaattaggtattgaaagagttatgaatagaaaattcaatcatctctatttgtaaggtaatttcatcatagtgatattaaaagttttgtattagtcactatttgtcactattttggactttttttaactattttggcactttttctcactattttaaaaaaaaatgttttttggcttccttttttcaattttccaaaattagtacaccattcgatagagcttcaatagctttacaatttagttcagaggtgatctttagctttttctgttaataaaaatgttttattgctttttttggaaaaatataaaaattcaaaaaaaaatcgaaaccgaaacgatataccgaacatttttcttcggtttttttcggttcggttttttcggttttttaaccgaaaccgaccgaccgagaaagttttgagtttttcggtttttttcggtttcggtttttttttcggtttttaaccgaaaccaaccgaccgaccctcttgtacggtctctagttttgatattttcaatgctaatttatgggttttgttttgttttt

SEQ ID NO: 3869 - DNA, 4492 bp, Heterodera glycines
tggtgtatttgctggtggatttcaacaccatgttgcgtcaatttggtgccgggtttgtgttcggattttgatgagcactatttagctgaccaacgatgaccctcccaatttgttcggctaacagccctatttcattgaggttttgcgggccaaccccaacacagcggttttcattgaccggagtcgaagttcttctaatgtttggatgatcgaagaagtcatcttcattttgggtatgtccaaagccaaaatttcgaaaaatttgttgggttgggcctgccctctctcccaaattttgtgtccaatccgttcggtttcgcataaaaccttgctttgtctcctcttcttcgttttcgtcaaggctagcacgttcattttgtcgcaactgtccaagtgcgctgtcattgttcgggttcaaaaggcgccgtctcatttccatcgagtccagctgctccgaattctccaaattgggatccgccaccaccacgttttggttcatcacgcctaaagttctatttggtggattctcccgaaaaaaaacatttccatctctgtcgagcaatatcccttcattttgagctcgctgtctagtcaaacgagtatgattgagtgtccgttccaagttttccatttcaaaatcgactatttgcaccccccaggtgacttgagtgtcgaaaaatttccgaatttgtctcccccagagaacttaacaaacaattggtttttgtttgttctttttaagcgtttttgtttcgtctcccccagagaacgattgttgatgttgattgtctcccccagagaacaatatcaaaagtcgaaaagtttatcgtctcccccagagatcgataaaatgccgaaatcctccaaaaatttgaaccgatgtcgttgttaccttgtgttctgtccaggagcgccaaatagtaaaacttctcgccgttcgctgcttatttgccttagattaattagggcaggggcacgggaacagtctttaattaggacaggagagattggggacaatattattattagggactttgaccaattcgttcggcttctttccaattatgccgactcagtcaattcgcaataaatgcaattgactgcacaattaaaacacaaacaagattattccacagcacacaaatatccgcaattaccacgaatcattattaaaacaaattactacaattaacgactaaaaaaaacgcaaatgaaaaagctcaacaaaaataactaaacaaaatgccaaaaataataaattaaaataatatcgaatggtcaaagtcaaaatatcactacagcaaaaacaaatgtgttattatcacacacttatcatataacttaattatacaaacatgcataaaagtacgtacatattttgaaaatttaaaaaaagtttgaaaaattcaaaaatttttacttttttgagacgaaaaagaaaaattaaatttatagaaaaataaaatttatgaaaattacagcttcatattttggtgtttattcttggtgacttgaacaaccagcaccattgccgtctgcgattagctgtagcaattcaattcgtggatgatgcatttggcacgctgttggcccatgatggccagcagacggcatttgtgtgcctgttaatttttttttaaatttccactgctaaggttaccacagttattgaattagaacccccaggggctctattttcaaccaccctcgaaagtggggttttatttcagggggctctaattcagtaaatacggtatgtaagatctgatggattttcggtcttggtccaaggtcccatggtatcgcaagaccggttctaatccaagaaattttcctgattttggatttggactttacattaaaaaattgaccaaatgagcatcaatcgaatttttcattaaaaaaaaaatttaatttcttgatcgaattcggattaaaagatgaatttcatcggattagcgtgtactttcctcattttgggttcacaaactcactcataatattctcaagctgatctatttcgaagagattttaactgttgttgcatttatgtgcccaaaataatgctttacgcactttgtaaattcgcgcgcatttttgttgcttttttttttggcatgcgaccccaaaacaggaaaatacggattaatgtgatctttgatgatcaaaatgacatcaaaaaatactcaatatattcggaaatgaaaacttcccagctgactatgaggagtgctgatcaaaaaaaaaaaaaaaatcaaaaaatatatttctcacccagccgatcagagatgaacgaaagcatgacgcgccaggcgcgcactgtttcacgtcgttgacgcccagggggaagccaatgacagacggcgtctgtcaacgcttcgccaagacagtcccaatgggcacgccttatttattcggtgatggtattaagacaatatttaataaaatttaatttaaaaaaataaatatattttcacaagaaaagcgaaaaaagaaaattttttgaaaaatgcctccatttctaataaaaaataattttctgtagaggcaatggcagcaatagatggacacttttctcgagttaaggctcgagactgcgaccaaaaaaacccgaaaattttctcaagtcgaggttcccaagcatcttggaagagggggcttatttaaatgaaaaatagggcaaatttacaaaatggcaacttttacttgactttgaactgggcatggccttggccgatcagctccaaccactgggccaatggacgttccgactccgagcattgctatcaaataaaaaatatttaaaatttatttaaaaatattgagtgcctcaggggttggtcgcaaaaatgcgtccaccacacgctgaaccagctccgtgaaatagcgttgatgacgcacaattgtcgacgcgtcagagggcgggtcgaatagacgcacgacggcagggcaggcaccttaaaatcatcgagaaaagatgtttaattacattttaaaaaagtaattaaatttgtgcacctatcatatgttcgaagacggctttgccgaaagccgccttcggtattttgagccacgattttctggaaatgaaaaaaaaattgtgaaacgcgatttcttttgtaaaactggacgatggcaaactgggcgacagcccggtttttggagtataactcctttcatattgtccgaatttaaccaatttgttatcgttcggtaaacctaaaaattctctctgcaaattttaaaaattcgttatatttcaaagaaattatggatataaatcttcggaaagtaagttttttttagtttttagtcataaattttttgaaataaaaaaaattttgagatcttgcagcttgatagagaattattcgggctaccgaatgataacagattcattcaatttggacgactatgagttatacccaaaaatcgcgctgtcgcccaattgtccccatcggattttaaagcgatttttttcgaatttgcacctgatcagcatctgttgatcatggcttaacagaataccaagatgatactgttgttgaagcttgaggcgttgcatgctggtgatcggggacgcgctacgtgaccttgagaatattttttagacaatgtttaagccacactgatatttgatatgaattaaaaagggatgaaaggcggaaaaaacactaaaaacaaattttctacattgaattttagattttaaataattttctggctttagttatgtttaaaaattggagtcagaatgaaaaattaatttggaaattgggaaaaaagtaaacattttttgaaaattgtaatttatttataaaagctcgatttttttgtctttagctttattaattttattaccttcgcagtaattggtgtgaattttcaggtgcagtaagaaggtggctgaaacatggaattttaattttattaatttttacataatttaattttttataaaatataaaagcatttttcattacttgttgctacgactttgtggtccatcagtctggcaaaaaactaaatttgttggcgacaaattgttattgttgttattattatgattattatttataaatccgttgagggagtgtttctaaaaatacataattatttaattaattcatttatttattttcttcttacctcagtcacacttggatgcattttgtgctttttggataaattcaaatttttttttatttaaaaagaaatattatttttttgtatgataacaattttttaattaaaatatttatctgaatgaatcaaaattaaatataaaattgaatataaaatctagatttatttttaattatccgtattcaaatatttccgttaattaagaataaaatcaatgtaaaaattacctaaaaatttcctctttgggtatgaaacaataaaaggttcaacattttgcttaaaaataaattttttcattgttagggtgtttataattaaaaacacaaaaaaattgggcgacacggct

SEQ ID NO: 3870 - DNA, 1512 bp, Heterodera glycines
ttttttttcataataaggactcagaatcccaaaaaatggtccctttttgaagaaattctgttaattaatttgctcccaaattttgaaaaatttacccaagcggcgcttaccgggcacctccgggaaccacttcaccctgtttcaaaaaaaaattttttttttggatggaacgcacagcaaaaaactttttattaagttttataaattttggaataaaatttacaaaaatactgatttttgaccccaaatgctgattttttgccggccaaatactggttttgaaaatttttcagttgtgagtcctgtataaaacccttggataacatgttttcatgacttaaaaaaaaatcggttttggtcggttttatgcgtcctcatctaaaaaaaaagataaatttcaggaggggggcaatgaatatacaccaccacctaatgctaatgcaaacattcgggcccccaggggacaacacaacggtgtcagccgaaggcacacaaaaacatgtattagtctcagagtcattatggtgggatgaggagagaggtacaatttggaaatgacattttcgaggcgtcgtaaaaaaataaaaacctgaaaattggaagagttctcaaaaaattaatttaatttcctttgaaatttaaatggttatttaaatggcttctagaggagttccttctcattcttataaaaagcaatggctatttattattatttgatcgaactttataagcaacaaaaaaaaattaattaaatttgtaaattgctttacatttaaaaatgagaatgatgacgtgtgtttcaacttcaaaatgatgacaaacaaacaaattgcactttgaataattaatttcccttgggggattaggggacaaaatttttttgaacaaaatttgtaaattctgaaaaaattacatttttaaataacgacaccatatatttttttcaaaaattgaattcaaacttattttaattttaaaacaattttttttatttttacaatatttaatttccaatttttatcctccgacatgtaaatgtactataaaaaaagcgagatgagatagagggggaggggatgcattaaataaaagaagtggtaattattgaaattgttttgttgcttctgcgccccgggcgatgtgtgggaattatagtgaattatgcgtttagggggaaggggggagagacagataatgtgaaattgttttgttgtccctgctctgtctagaagaaaaataatggatggatggcttatacatttcacacacttaaatttaaaatgtttaaaaaaatttaaatttttttcatttttgtggcatagcatataatggctctagtttaatttttattgccaaaaaaccgactttgttcagaaaatcctgccatgaaaatgaggccaattgtgcaaaatcagcattttttttaaatagtcagaaattttttagagagtttaattttctcttttaaatgtttaaacaaatttcgaaaaatttattaagaatggaaaataa

SEQ ID NO: 3871 - DNA, 2469 bp, Heterodera glycines
aaatcctgggaccgtccctggcccattttccgggaacatggatttttccagggcctggattttttgtacaggaaattcaggttttttcaaaatgttaaactctaaatttttgaactcctcctcccaattcaatgctccataacttggcaaagaaacaaccaataaaatgctcttatgttcattcgatagcccaaaggaaaaagcttaaaattctaaaaccagtatttttcaacaaaaaataatttttttttttttgtaaatgaaaagctaattaaaaaaccccatagggttagagttatccaaatgtccatgaatgttcaatatatgattgcactctgggccaaattatgaaacattgaagagaaaaatgtgagaatattctattaaccacttgccctaaaaattcaatttttcatagggtatgcaagcaagcctcaattttttttttcaaaaaattttccaacgcgaaagttcgtgcaggcttccgctgctgatccctcctccaacacctccggcgcccatttcctgcgcatcaattgcgttactccaatcgatgctcatcggttgaatggggctgaccggactgatcggagagctaatattttcaaaaaaataaaaaatttgttttaaaattttgtaacaaaatgtaagcctttatacattttacatagtcccggattgtgtcataaaaataaaagttaagataaaatttaaaaaaaaactgcttttccgaacatttttggcacaaatttattgttttttttttgaaactcaacgtaattttttgaaattttacaggctaatagagcacagttacttgttaagaatattaaatgataacaaatttggttcatttcgaagaaatgagacagaacatttaaccaaaaaactgggccatcgccaacttggtcctttccgacatgggacaccacacttttgtgaactcaagtaatttagacatttctcttaaaaaaatttaaataaatttatacttacgaaaattggtcatcatttgaaccgccggattcttcttcttcatttgacgacatcattcacagcaaaaaaaaaggttacagaaatcaaactgtgtcaaatccaaattttaaatgcataaaaaaaaaaatttttttttggaaaattgtactacccatcaggatatggggggctctactgcagtttgcgtgtccaatcagagaccaccctcaatttcataggccataataacttttttcttacttggacaaaacttacattcttggtacaaattgaaagtcctgtctctttcttttgtctctatgtcatcctttcaccaaacctctctaagcactacccttctctctctcctctcttcttctctctcattctctctaaagcatattataaagtaattaattgtttaaagtatttaaaaaaaaaatttaaggaaaaagcaaaaacacaaattgtaaacaattttataaacattagtatttgttattctaaattttaaaaatttcttcttgccattttttattttcttttttttgcaagttttcgtgtcataaataatctctattcaaaaaaccatcgatttagtatagttagattaattaaattttaagttttttaaatttaccctaattatgataattaattaattaaattctttaattctttaaattccaccttttcttcttacaattaatgattttttaatcaaattatgtcaattatagcagatgctgtatccaacggggggggggagtccgaatacaaatttacatatatccatctgatgagggtttatttatctctgccgaatgaggattatttttttgaggatttttaaggctgtccaattaagtccatcacaatataccgtatttattcgattagagccccgggggctctattttatttatttatttgccttttcaatttgatattttgccaacttcattacatatgtgcataatttgttgggctcaaaatgatgacaatcggtggattggatcggccgatcagcagcagtccctttttcactggcgattggttcatttgttggtggtccgtcgtggacttggccaaatcatcagaaccaatttgcttttgctatcccttttttttcttttttttgtgccacgtatccatttgtgataattaccaccaccaacatttgcttggctctagctatcaatctgttcattcattcccatttaattgggatgggtgaagcaaatgagttggggttggccattagctaaaattatttttactaaaataattagaagccctccccttgaaatataagctaagccccctattggggggggggggggggaggtgaaaaagaaaagcgtcccccctgaagggtcggggtcgttttggcgccagccaaagttttcggactataacttttttgttgttaaccaaatccaacaatcttggtatcattcgtaaacggaacatgtttagaagctaattataagc

SEQ ID NO: 3872 - DNA, 1127 bp, Heterodera glycines
ctttcgaatgataccaagatcgttagatttggttaacaacaaaaaagttatagtccgaaaacttgggctggcgccaaaacgtcggcgccaaaacgacctagtccccccctgaatgagaagctccccaaacagaagcctcggggcttacattttagaaaataaaaaatattaacaaattttcaagggttgcccactaacaaacgagcagccttttaactttcttatcagttcattgttttcattgccactttccccccgtgtttttgctgtgtccacacatttttgccaccgctcccgcacattttgctcttcttatgttggcatttttttaaataaattaaatgttttacacatttttttcaaatacagcctcccccgtccgtgtacaaactaaataatcaaactacctaattagtatcataaaatgttgccccgttttgtgtgcccattcattgtgatgtttttgctgatggctctgttcgacaacagttggaagtgcagtgccgagctgcttcctggtccttttgaagatgaaacaactgtgcgtccgaccgtgaagccgactgccaagtcgggtgccattggtggtgtgcgggtgggccagcagttgttgcttttgcccatgccgttgttcatcgcgctgtcgctggccggcaattgtaaaaaccgtatcatattttctctattaaagcacccttccccctcagaagggttcaaaaattaaagcccctgtgggctctattagaggctaattacgataattatattgataataggtatgcacctagatttgtgttcaaaatatttttcttgaaccgttttttcaaaatttcttgatgctccaatggggccctacaagcactaacgggaaaatttttcgtcaatttaattttaacagatttttttgaaaaattgcaatttttgagatttttatcaaaaaaatgagaataaatcatcataatggatgtgtattagtagcactcagaattttatttttaaattaaattgcattaaatttttgtcagattttcatgtgctgctgccgctgcaataactgctgaggtcggaacaaaacggagcttaaccaagaaatgaaaatggaaaaagaatagatcgtcgcattaatt

SEQ ID NO: 3873 - DNA, 1011 bp, Heterodera glycines
tacttacccgcttctataaacattcaaaacaaaaacagactcgtcgattcttttttttattttttatttatatttttaaaaaatttacatacttcattatacatacctaattcaattcctattgtttagaattttacaagggaaaagcgttctcttctcctaatttcgggagagagaaggagcactccgaccttaggactgatttatcagagtttctccccaaatgcgtctttcttccattttactgcttctgttactttctttctccaacctttactccacaagggcactcaaaggtcagttgtttaatcaaaaagtgacggcgattatttcattatgaaaaatggaacaatgtcccaaattcggatgcaaatttcgatggaatgaaattggccgccgttttggcactctccgggttcctttttaaatgtcttctcaccttccccgttgtgcataaattatcgatagcaaataatgacaaccgaccaaaatgatcaaatgcctttttgatgtattgaaatgccttcgcccttttagcatttgccaatttcttttctttttttgcagttaatttgctcgacacattaaacgcaacttccgaactcaattggcgcacttattcaaaccttgacgagaaggacggggtcggtcaatttcgaagttaaacttttcaactctaagccattttcttttttgcgcacttccattttctgcgctgaatgcattggttcaaatcattcgagggaataatccatgaaaatgcattctctgaaagaccttagccatggtggtcattcgagtggacggaatgagggggggggggggaggggttgagaactggtgtcatacatggagtggacaatcgattggatgagcactttcagttcagcaactgcgcagggctggacgcagcacgagcccattgatccgcttaagaaggaggaacttagaagggaaaggaagtgatctaagttaataaaaagacggatgaccggtaatgactagaattat

SEQ ID NO: 3874 - DNA, 2308 bp, Heterodera glycines
agttatataaatggattcgtttaaaagcattctaatccttaattccttcagtggttggaggagacaattttttctcgcgtcgaaaatcggaaccaccaagtgtactcaacgtgcaaccaggagccgaacttcttggtggaaaattggctgctaatccccgccatcgaacgaggcgaagcgttacgactgtatttggacttcaacttcaccatcgtcagatgtgcggcaatgccaacactgatgcggacgagcagttgcaaagaaactctgaaactgtacgcagtgcaactcgaccatggcgaaacattgcggacacagaattggcacaacgaaacgaaatggtggggaggggttacggaaaatcgacagggtgaggggagatcttactcaaaaaataatgtcaaaagaaaaactacagcaacaagttgatgcatattttaccaatttggcagggattacgtggacactttggtatcccattccaccgacaccggcgttccgtcgccgtcggacgctgagaagacgtacgctcagatcagctcgtacaccgtctcccgccattccgtccatttcgcacttcgaaacaccggtgcctgttcttccattctttcagtcaaagtttgaaaatgaacaaaatccttccctcaatctatccattgttcagatttattacaacgtttgtcccgagcagacttcgccgccccatcggttgcgtttgccccgcacggtctcttcccgagatgcccatggcgttgtcactgtgccgggccgttgtgcagacaatgcgtcgccggtggtgccgacagacagcaaaagtgagtaatcgaaatgcgttactggttgtgaattcgttgtcctttcagcggggcaccgccattcttccgccgcctctacgtcctccttttcttcgccgtcgttgtctccaccgaccgcaatttgcaagtcggacggcacgtggcaagtgttgggtccgactgagtgcgcctgtgacgcggggcacattccttcactggacaacggcatttgcaccggtgggcatccaaactcttactttggcatttttttattcgttttgtttggtttattattctcatggttttggtccatcggcaaactaaggcaaagtgcggtgacctgcatctgctggtcaattattatttcgttccaaaagcaaatttgggttggactttcaaaatttgcgtatttcggcgaaaaacgaggactgcatttgaaaaattcttccgccccagcaatctgacagattttgcgccgcttagtgcgcttttttcctgctcctttctccctcaccaaattgactggggtgttctattaggtgtatttttctttttctttttacagtattttttatatgtttttttattgttgtgtccacgttttttcatgtcccattatttgtgacggtttatttccatcggattggtcattagttttgtttcatttcctttcatcgtttgttatttgacacgcgaccgatatttgagccattcattggacttaaaggcgacaaaattcgcgccagctgatgggggacgggcagtgtttaggccattcgcttggggagggtcactcgccactttcaacactgaaaaatgaatacacccccgctccgtttttattccatcgcatttttcactcccttattcaccccctccggtagaaattgcgccaaatgtccaatctccgcactatggttaatccctctttattctctccctgccccctatcctccatcttccgatcgaattgttccatattcttcactttcataatgttgttgttgtgttggggggggcgatatcgatgagagagggatttgggagatgaaggggattatcgggtgggcttcgactcggataatgacaaatggtcggtcaacggaggcgctaaagtaagtgatgggcgcccttttcgcatcccttctcagtcagtctcagtggccacttggggattgtcggctaataatgccccggggaaaggggagacggcggacgggcccaaccgctttaattcaatttcacacaatttcgggagaagcgaagatgaaatggagagaagagaattggtttaatgaaataacgaaaaagtggaatgtaaggggaaagtgaagcaatggaaaggggccgaagggagaaaagggataagcggatgcaataaaagtgacactatttaacctttttgccaactctaaacccctacatatttgacaaacgaaatttcaaattcgttcttaattgccttcattttcctccttttttggtttttactctgtctctctcctcccgaattc

SEQ ID NO: 3875 - DNA, 2189 bp, Heterodera glycines
ctgacgagtgtcgcgtttgccccgtgcacagtcattcaaatcggtcggcgagtggagaatgcgaatgcgacaggggctaccatcggccaagcaatgacggacctgacgcaccgtgcatcaaaagtgggttggaaggaatggggatatggatcaatggtccaaagtccgttttagttgctgaaggatctttcgatcatttgtccagaatccaattgtcggtgggcagtgacggggccgaaattggcgatgggcgcaatcagagagagactttgcccgaccaacaaaagggtccgcgcttatattttgttttgacttaatatttcagtttttctgcagatgattggctctcacttctttcctccgtgtcggcttggccttgggtgttcgtttttggcattattattgccgcactttgtctgcttctcatcctcaccactcggcaacagaacaatggaagtcgtaagcaaatgagtgatttggacgtgttggacaactacaaacagggtgagaagaagggagccaatcagacattcctactgaactcttaagacacaatttcacccgactacagtcgctctttggccggtcttccaaacggcgccggagggggcgttggcattgcgggatgtttgagcgggcaaaacggcggcagtggcacatttttgagacgcaaaagtatcgttgtataacacagagtaaaagtggacttcttcggttcagtgcacactccgttgattaggggcggccctttctgttacgggacgcaccagcggaacggcgcgggcgctgccgtaatggtaaattaatggacatatcagtgtcaatttcgctgactaattcactttctgataggtccccgcttcgcacggcaacggacaccttcccctccgtgtccccttgaggtcagaaaacagccgaatgtacgtggacccaacggcgtatgctgaccccaccgaagtcttggccgaattcaccaatgaaatttgtgcttcgaacatcgaggtaaatgcaaaaacagcggtcattttctttccttccttcctctcattgttttgttatttgaactcaaaggtcactcggacaattggcaccggtgaatttggcgaagtttgctgtggtcggctgacggtggaggaccattacgggcataagcaggtggctctaagggaatgcaggcttttcgtaataaatttcaatttaagcagcaaattgttgcagtcaaaacgcttttgccgggcagtgatccgaaagcaaaagccaattttctcatggaagcatcgataatggggcagtttgagcatgaaaatgtcattcatttaataggcgttgtgacaaagaccgaaccggtacttgtcgctgtcagtttgtcaaattccatcaccactttcaggtgatgatcttgacggagtacatgttgtacgggtccttggaccagttcctgcgttccaacagcaatgggaggctgagcatttgtcagatgaccaaactgctccagggcgttgcctcgggcatgaaatacctcaacgacaaaggctatgtccatcgtgacttggctgctcgcaatgtgctggtcgacgatcggctgacctgcaaaattgcggactttggtctgtcgcgcgggttgcggaaattcgtgtcgggcaacgattgcgatggctgtgcaccattcgagcagcagggcgagtacaccacgcagcagggagggaaaataccaattaggtgagggcgggagggaaacctgacaatgacacttgccaattcaggtggacggcacccgaggcgattatgcagcacaaatacaccaccgcctccgatgtttggtcattcggtgtcgtaatgtgggaagtaagtgacacacgaatagcaaacggtccttggcattcgctgatacgcgcctttcattcccaggtcatgtcctttggcgaacgcccttattgggattggaccaaccacaaagtcatccatgaagtcgttcagaatggattccgactcccgcctcctcaagacacaccaaaaaggctctacgagatgatgctcgcttgttggcaggctgaaaggtgtttttttgcgacggggtccgagggggggggaggtcggcagccaatttgtgaaggggataaaacatgtaaaaggacgatccttttttatttatttattcgtaaaaataaaaaagtcatcagaagggcgaa

SEQ ID NO: 3876 - DNA, 2832 bp, Heterodera glycines
tcatcagaagggcgaaaaaataaacataattttatctctctagacataagaggccaacgtttgcggaccttctcgagcagctcaattcttttatcaacaatatcgactttttctacaaatatatttgattttgacttggccatttttatgaaattcctcagcaatagaaaagtgctcttcctattgagtgtgatctgaccacaaaggcccgcaatatattattttccttttctccgtccttttccaatagaatatcattttaagagaaaactttttaaagcgagttttaatgttaaaggcgcgagttttaagggcggaattttaaggtgaaaattaaatatttaagacattccttttgagaaaattagccgagttttgacccacatccctttagcgtatctcagaattcattcaaagaagtttctatttcccacaccgattcatttttcgggcggttcccttgtcagtgatttttataaaatgaattgtaaaggggtgaagaaccgagtccgctccacaaaacattaatacttttaattatttgtctaaaaaataaaacgatttccaaattattttcgaaaattttttttccgctaagaaatagtttgacaaaaattagaggtgtgtcttctctggctctttttattgtcatctcttttttttggaatcggtgtgttccgttctttcacttttatacggttttatttgtatgtatgtattccatttatatgtccaaacaaaataaataaaatttatgaataaaaattcaaagtttaactaatttatgtcgttattaattgtttcccactaagagttcttttggggcactttgatggtcacagttttcaccttaagaatcgaaaaattaccataattaaattttccgtgcctccgagtaagcagatagtccgtattctccaagttcgcgtccgatgcccgacattttgtaaccgccgaatggagccgccgggtcaaaaacatcgtagcaattcaccctgaaaataaaaggcaaattaaaacagattttttggattcctttaataattagaggcgtatttccaacgcttacatttatcaaaattaaagcaaaaaagtcaccaaacggtgccggctctgatgttattggccacatagagcgccttgtccaaatcacgtgtcattactcctgctgctaaaccataaattgtgctgttggccttttctacgaggtccttgagcccgtcgaattttataatggacatcacagggccgaatatctaagcaaaatgttatttgaatcatggggagggggaggactgaaaatgaacctcttcctgtgcaattttcatctgatcctcaacacccgcaaaaattgttggctcaacgaaaaagcctttgcccccgaactgcttgccaccggtgatcagtttggcgccctctttccttccctgaattgtcctttagtctcgagatgtttgttccaatcccacctggtcgatgtacttgaggatcttatccatttggtccccgtcaatttgtgggccttgatcggtgtccaaatggaagggattgccaagcacgcgtttctccgcaatttgctaaaagtcaaacggaataaaatcccaccaaatgttaaacttttgtttttgctgaccttcgaccgttggatgaattcgtcgtaaatttttgcgtccacaaaagtgcgcgacccggcacaacagcactgtccttggttgaagaacagaccgaaagccgcttgttgaactgccaattccatgtccgcgtcgtcgaaaatgatgaccggagacttaccgcccaattcgagtgttattctaaactcattgccggccataaaaagaattgcctgactcacccactgcgcaccttttcagatttttaccggatgcctcgcgtgacacttcgagtccgacttcggaagagccggtgaatgccactttgtccacttgcggatgctgaacgatggctctgccagcagttgggccgaagccggggacgacatttaccacgcccggagggaatccagcctgaaaagaaagcacgaattgagagtaaaaagggaattggacaaaatgaggcgctatatggaaagttaccatttttgaaaattttttcaaacttttttttggtaaatttttttttgtttaaaaagtcatgacaccaagtagtacccgggggttttagaggtcgctgatcataaatatgacaattatttgggcatattaagaaatttggcgatagttataaagtgacagatttttaattttatcaaaaacaaaaggggggacccttttgttttgcaaaatttttttgagataaaaaattgtgaatatactttctattcaccataattgtgatggtaatgcttaatatacatcattatgtgtaaataaataaaaaaaaaaaattttaccaaaaaaagtgagaaaaattttcaaaaatggtaactttccatatagcgcaccaaatgatctggaaaaggaaaaaggagggaattagagaaaaaatggggggggggggggtagtcacgaaagagtgaccccgcgaagggcacaaacttcaaactgtttaataaaagtaagagcgaaaggccccatcaaaaacacttccccccagcgagacaccacccacacaaacaaaccccaacctctctgatgagttcggctacgtacagcgccgtcaacggggtctgctcagcaggtttaagaacacatgtgttgcccaaggcaagggcaggggccaatttccacgcttgcattagaagaggaaagttccaagggatctgaaggtcgaagacaagaaaatacacattaattgtcgaatttggggtaatta

SEQ ID NO: 3877 - DNA, 5935 bp, Heterodera glycines
ccgacgtccatcccaacaaaggatggtgccaacaattgctgggccgatggcttccgcccttttggatgcatttttggagcaaaatgttcacgaggcggacccactccaacagtttctgagtggtcgtctgaaaacaaaatgcaaaatgagttttaaggaatcaattgaaaacagtgtaaaaatgtgccaaatttccgtcggtgcgccactcacttctctgtccgcatttcccaaatggattaaattcgccaccaaatgcaaagtttcgaaggtgcccaatgcgagcagttccgactgacttttgaccgacgaaagaaacgaaatgcaatcggcgaacaaattcaactccttcaccaattgcaaagactgaaagaaaaaaaaagaatcatttttatattttggatttttaagagggataaaaggcaacaaaaaaatggggaacatgacaaaatcacgccggccgaaataacgccgggacaaaatcacgccgctagaaaaattttttttatacgaaaatttcataaaatttttaaaaaatcgctgaaaatttttcaaatttttttttcttaaaattttcttataaaaaaatttttctaagatttttacttgaaaaaattctaagtttaaaaaaaatttaaatttctagcggcatgatttcggcggtggaattttggggtgctcccaaaaatgagcaattgaactattaacaaatccaaaaagtgccaaacattttcactgaatgccattgttagggacggggctttgagcaattggacgaaagtcgcgcacgcttcgcccgcgtcaaagttcgctatgcgcataaatctgaaaagccatggaattccgggggcgacaaaaaggcggagcttcactaaacctgacgatgactcggaacagttcgtcaatgctttggtcgctcaacggctgtctgacgcccttcagaccggcaaaaagaactttctgaattcgacagaatttgaaaaaggcagagaaaaagcaaaggcagcacttgaagtgtcaaaatgtgtgctcgggttgcgcacggagtgctcattttgacgcaaagcgtctccagaatggaggccaccggtgcgttgtcgcgcaaaagcacccatttgtcggtggaacaaccgctgaacaggtccaaaacggcgatgaacgaagcaactgcacgcccatcgaccactttggacagctgaaatagcagcgagcaattgggacaaatcaagaaaatggttcccaagccgtacatcggtgtgaccgatgtggtcaaaaatgcgcgaaaggagtgcggaaattgtccgactcgccacatgcacaaattcagtggagaggaaaagcgaagcgaacgaaacggacatggcactgctgcgcatcgaccgcacgaccaattcgcacagcgcgacgagaagctgaactgtttttggaaagcttaaaagtgcgatgggagcgcaatcgatgccaaaatttggcgaatttcactgagaaacctttcgttcaggccgagaaacgagtgcaaaactgtcgtgcagcagaaagacgccgtattgcaaaagacgacggttgtctgggcatttcgttgctgccttacattcgtcgcataagttttggctaaaaacagactatttttggtccttggtatccatccatcttgccgggaattagttttaattatggcactgatttttaaaataatattcaattgccaacatttacaaccttaattggtccaaagtttgccatcgaacgactcgggcacgtgccaaccgttgaaattcctcgataaccaatggcactacgctactgctggcaatcaatgcatttgtgttcattgcggtttacctaatttcgctggggattctttaaaaaaaaatttttttttatatttttggatataaaattcgtttcagaaacgtcatcattgatcagcaaaaaaacaaaacatttttaagtcaaaaattgacaaattatttctgtacatatccgaaatggtcaacaattaatccgtttccattgcgtcttcttcttcttccctttcctcatcttttgatggctttttggctcgtccattttcaattggcgtcggagtgggtggccactaaaacaagccatttcttgtagaataggaaaataaaaacgaaaagttcactcctccgatccacttacgtcgtcgtcttcgttgtccgactgcacttgtggcgttccaactgtggcatccggtaaaatttcgtcgtccaatatttcctcaacacacgacggtggcagtcgcaacatttcttcgtcctcctcaccatcctttcgaaacgccgaagaagaaggaggaaaaggagcgaaaaaagcagcggaaggcggaggaacgaaagggacgagttctttgcctgttcgaattggccttaaacggggagagacatttaaaacaaagtttagtggaccaactatttaccattgggtggctggctaataacacgcgaaatgactaagaacgattgggaaataacaaatgaaaatccggataccattgttgattccagaacttttgtttctgttttttgaactctggtccccgcctttgctatgttacgccttttcctgccacaccttccaattgggggcaatgggccgtcgcctccgtcgccgttgtgcattgagctgatcaaagagcgcagctccgggctgagttcgatgcgctgcttctgttttcgctgctcttccgtctcacaatcagcagaagaacaatattcgctgtccaattgcaattggttgtcccccaccaaacgatggcaaagattctccgttgcatttttggcactctccaaattggtttaaaacaattaaaatattgtcccaacggcacttaccgacttttccttcccctttcggtccgtggaattgccttctcctggctcctcaataattggtgcattagccgcgctttggaaaatcgactcgtcctcaaatggaagctcatcttcgtcacttgaggaaaaaggtggaaaattgaacgatttttctactttaagtgccaaacttgagcaatgtttggtaatataaattttttcagtttgtttcaaaagtgccgacccgaattggccccagtctctgatctcttcgatgatcggtcccttcctctgctgtttccattggtctccccatgccatttgagcagaagcaagcgttgtaatattcctgtggttttttaagttacaaattactgccaaattcggtcattgtcacaccgttcattggtccttccccccaccgctttcccgtgctcatccttcagccgaattccgctcaattttgtgctcatccgttcctcatatcgtcgctgcttcgctctcggctcgacgtccaacaggaaaaattcgtcgtcatcactgctggctgaccttgatgttccgatggtttggttgttttgctggtgcattctttgctcactcccagtgttctgtaaatcgattgcgaaataatcaataccaattgttaggccggaagagcagttataaaattcagtcaaaatcaaacggaccgacaatttccgtttggcgccacctgtgcccgatatatacggttgctgctgctgttgtttaaacggcgaaattccacgccggtgcgggcgttttgccgcagttgcggccccttcggcgaccgaaaatggggctttctgctggttggacaaagcaaatccactagagttgttcgatgtcgcagagttttctgacgaagcacgcaaaacagtactaccacggaaattgttgttttgggtcgttttcgttgtcactgttcgacgaatacacagcggttgaagaagggaaaagtcccaaactcataaaggaactaatttcgagcaagaggcacttgacaacgagtagaataattatggaaaacaattactttaagcaaatcccttactctatcccttaactatatactaagtcagccgaagccccgcccctatttttgaattggcggttaaatgctgttttgttgtaataggaaaaagaaacagaaaattaaaaaatataattggagattaatagagaaaggatgggtagaaaagagagtgcagtgtatgtttctctgtcggcgcggatgggaggggtagagtgggtaacgcgtgcggttgtcacgcaggattgaatgcgtgcgagtttgtttatgtgtgtgatgagtgtgtaggagtgcttgggaataaggaggtagagaagaagaggaaaacaatagagagagagatgaaaaaggaagcgagagagggtacagaatgaagagattctaaaggaaggggagagagagaggactgagagagaaagagaagaagagatagggataaagagaagataaaggagaaaaagcaagaggacaattaaagagaaagcggaagataaatagcgattgagaatggggaaatggtaacgatagaaaaagagtgggaagactgagagatgacagagagagagagagaaagagagagagagatgagaggatgggagagagacagagagagagcagggagagagaaaaagagagaagggagagagaatgagaaagcaaagagagagagagaagagaaagagctaagagagaggtgagaggatgggagagaagagagagaaaaagagagaaggaaaagataaagaaaaaaagagaaagaaagaaagagaagagagaagcagtgagaggtagagcgaagagagagagagagaaaaagtgagagggtgggagagagagcagagaaagagagaagggagagaaagaaatagagagagagagaacgagagagcgacgggatagagagagagaaagaaagcgggctaagggagagagagaaagaaatagagagaaagagaaaggtggatagagagagagcgaagagaggagaggaagaggaagagatagagagagaaaatgaaatatagagagaagagagagagagagagagctaaggggagagagaaatagtgagagaaagagaaagaaaatcgagcagtgagagagagagcaaaaagagagagagagagagagagagggagaaagcaagaaagagagagagggagagagagaaaagtggagagagagagagagagcgcagagagagagcagagagagagccaaaggatagagaaagagagagaagaagaagaagaaaagagggagaggaagagatcgagagagagagagagagagagagaaaaaagcgagcagtgagagagagagtaaagagagagagagaaagagggggaaagaaagaaagaaataaagcgagaaagatggatagagagaaagagagagagagagcaaattgagagagaaagagggagaaagagagagggagagagataaagaaatagagagagaaaggtggagagagagaaagagagatagagcgaagtgagagagagagagagagagagcaaagagagagatagagaaagagggagaaagaaagaaagagagagggagagagagaaagaaatagagagaggagacagagcgaagagagagagaagaagagaagaagaagaggacgaggaagagagagagagagagaaaaaagcgagcagtgagagatagtaaagagagagaaagagggagaaagaaagaaagaaagaaagagaaaaagagggagagggagaaagagagagagcagagagcgaagatagagagagcgaatggagagagtgagaggagagggagaaagagagagagaaagaaagagggagagagaggaagaaagaaccgcagagcggttggcgccgcgaagcggcgcccaacagctcgtactaatttgtaagtgagaggaagctccgcccttttttgcgtttttgaatttgcttggcgttatatttttagaggaagagaaaaagaaaataaaaatattatttattttgaagagattcttccaaatgataaatagagaaagcatgcatatggagag

SEQ ID NO: 3878 - DNA, 1829 bp, Heterodera glycines
aaaaattcaaaataattcatcatctgtctagcggatccgaacccatgacaaatgttaaagaggaaaaaattaatcaaattaacaaatttttgctgggattttcatttgatcaattttttctgatcatttttgacgccggagccaaaaaagccgaaaatgctctacacgataaagtggtttaaaagtgatttgaacacatacagttcggaatgttcccttgtcagtatgcgcggatgggggggggtgtagaaagttgcgggagtgggtgggaataaagaagtgaagataattagagagagataacgagagagggagacatgatggatagagagagaaaggaatgacgggtagagtgtcatatgagagaaagtgagacagaatgaaatgaaggaaaaagaaaggcagagagagcgagaaagaagatgtgagagagattgaaggagagaatgggctgagagagagtaggaatagatagagagaataaggtgagtatagaagaggggaaaggaaagtaggagaaaagaggaggcgagagagagagtgaggagatgaatatgattttaaagtaaaagaaggagggagagaagagaagaagatatagaaggaaaggtagaaaggaagagagaaaacgagaaaaagagtgagattaagagagaaagggagagaaaacgaaaagagaagagtaagaaagaaaaagagatgaaaagagagagagagattgagtcccagcgattggaatgccggtaggttgagtcccagtgattggatgcatgagaatttagtcccggtgattgaaatgcaggagaattgagtcccagtgattgaaatgctaaagggtttagtcctggcgattggaatgctggtgggttgagtcccgttggagaaaaagccaagaaaaggatgcgagggagccattcgattttatcattcataatcctacaatacaatcatactacctagcgggggatgcgccgaaggcgctgaccctgctagttttataaatatatgaatttatttaactgatgttcagggcagatctcttccgttctggaaagaaatgaagcgaaaaagaagaggcatgaggacgatggaaaattcaaaattcttttcgccaaaaaacaaaatgccagatcaatcatttcataaaaaaataaatatgaaaatggcgttttttctagggttacagaaaaattgtcaattctttgtccaaaactattaaaaattccttctttttgctccaatgctgaaatttgtctttttgaaatttttttgttgaatttgacaaaaatctttgtccaaagtattgactttttactgcctttttccaatttttcgtgccttgacgtttttgtttttatgccttttttggtaatactggagaattggtgtcccgacaaaaaataatgaaaaattttatgttacatgatgaaaaatcataggcaaaacaattatttttaaaatctgagctcggattcatgatcaccgtatttttttaccctagaaaaaatgtaaagaaaattcttaactttatttttcgtcggaacatcaattctccagtattaccccttttttaaataattggaaattaaaactgtaaattttatgttcttagttcgttgtcaagtgcctcttgctcgaaattagttcctttatgagtttgggacttttcccttcttcaaccgctgtgtattcgtcgaacagtgacaacgaaaacgaccaaaacaacaaattccgtggtagtactgttttgcgtgcttcgtcagaaaactctgcgacatcgaacaactctagtggatttgctttgtccaaccagcagaaagccccatttt

SEQ ID NO: 3879 - DNA, 1786 bp, Heterodera glycines
tttttctaaattttgcaggctaatagaggacagatagggctatcgaatgataccaagattgttggatttggttggcaaagaaaaaaattatagccaaaaccccgctggggcccaaacgtgccggggcccaactgaggtaaaccggaatgctatcccgacaaaggaaagtacttttctggagtcattttaggcgctgttgaagaatctggtgtcaaaaatctgtgattttgtctatgattttcattatgtacctttgttaatgatttttcaaaaagaaacaaaatgaacaaattatatatcaatcattttctttcgtcgaagaggaatcgattggtactaatttcagattatagcccaacaaatttggtgcaggaatggggcggaacactttattaagccggtaattagctttttggcaaaacaccgcacattcgactaacaataaagcggcccttattctttttgttgaaaaatcatgatgaaaaacataaaatgaatgatatatttttgctcttttgacgacaaattcttaaacagcgcataaagctactctagaatagaaaagtgcttccttgcccttgtcgggatcataacatttttatggggggggggggggcgacataatggataagagaacaattttgcgatttttaatatggatttttattggcgacgcaaggggaaatttgaaaaattattctgatttgtaacagattttcatctatttgactccccttctttgcgcagatatggatggaattgcacagtccaaccaaaaagaccattttttgcttaatttctttgttggcaaagtcaccgaaggggccgtagttgcggcacaaagtccgcaacgaaactctcaccatttgaatgaatttgagaagcaactgatgcgggaaaatgtgagtgtaacaaaaataacaaattccttggtatcgtaaaagtgagtagttctttgggtgaaatttgttgattcgatcaagatttttggacaaagacaattccaacggtaaatcccctttcagggtttcaaccacagtgttgctgtctgcaacaccaactttgacacggtcaatcgttcaacaattggccgccttgaggctttttatcttgcttttggagttgagggcgaaaaactgacgaaacgactttttggaggttttttttcttcatttttgggcttatctaatttttcttttcaggtcaagacaattcgcatttcgatcaagagacgcgacttgcccctcaaatcgaaccaacaacaacaaaaattttgctgaactcttcgtcgtcgtcgtcgtcgtcgtgtttttcaaaggtctccggtgatgggatgcgacccgtgactaatgtttgagtcaacatttgtatttgttacaacaaaaattccctcctctataggacaaccaatgggtcgtggaaaaaatactgaaaaaacgggtgaccgtttgtgacggtatgcgaaatgtctcctattttttgaaatgggaaggatgggactacaacttttcgtcgtgggaggaccacagcgaggagaacagcctggacttgctggtaaattaagaacgaccaattgttgatggacggagtacgtgtttcaggtcaaaaagttcgagaggcggacgaaatggcgcaaagcgatttacgaacgcgagttgcgcggggtgctcaaacgcaacaaacgctttactgttggtttttgcaaatcttacttaaattcataatttattactaaaagtataaacaatgctttttggaatatttggcattgtgtccctgttccttt

SEQ ID NO: 3880 - DNA, 3281 bp, Heterodera glycines
ggctcccggtaaattggacaccagaaaattggacactattgtacataaaataaataagttaaaaataaataaacaaaaattttaattgaaatatataatgttattattatttgtagcatcagcagcagaaagccatcatacattcataacgaaaaaagttttaattttgatggggttcctataaaaaaattttgtcagcgaacgctaaaaagcgtaaaagtgtcaaataaactaattattagtaagcaccgctttgaaggcttcaagttccgatgccaaattcccatcatcattattgtcccaccaacacatgaacacttttggcacattgttttgaagcggagtgaaaagccatttggccaccgcttgtccatccgatgccgcggcactgtcatcggccggaaattcaatgaagagatcggcgtcacataaattgacaacacgaagcgatggacaatcgttgagaattgacggcacaaatttgcgcaaacgatgaaaaacattcgcaaacaaaaacaggccacaaatatttcgtccgagcattggccaaatgttgcgcaaaatgaactccgaaatcagatcactgtccgttttgatggccaaattaattggaaaagcggcgaaaattgggcaaaaacgtcggagaaaagcgatcacattgtgatcgatgtatctgtgaaaatggatttggaaatgttgaaaataaatatatggatgagccgaagtaacaaaagtatcaatgaccgtaatatttaaatttaattttattattttaattttattttcttagtaatgcataacttaacttaaacttaatctaattaatcaatcttggttattaaaagttatcagctcaataaattccaattttttaaaaaaatctagcaaaaaatttacaaaaaagttgtaacgaaaaacttccaaaaaatttagaatgaacaattttgaccctaatttttaaaaaactctacaaaattttttgaatttaacagaataacagagaaatctttgggctatcgaatcatataaagaatgttatgaatagggaacggatttttaagcgcgaaaaagtccaaaataagtgcttaaataagggcaaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttagaaatgaagtacatttagaaattttcaggatttaagggtcgattctcaggggcgtatttttccgaaattttttgggtcgattcttaggagtgtattttttgaaaatttttaggtcaattctcaggggtgtatttttccgaaatttttttggccgattcttaggggtgtatttatcatttttattgcatttttgttaataaatttcccaaaaatcgcgaaataagaacgaaaataagcataaaacgctaaaataagtacaaaaacttattttaagggcgaacctctaaaataagcattttaagcacgaaacgccaaaataagcatttctaagttcgaataagtgcgttaaaacacaaaattttcgaacaaaaaatgtgtttttcgtgcatttctcgtcgagttaaagccgcagaaaaaataagcaaaaacttagaaatccgttccctagttatgaattaattgaattttgaacaattttcatgcattttgtctccaaattgaacagttccgaatgtccatttgcgaattttgaagtgttcgtccacataaaagtcgaaacggtggctgatcattgcaattccaaggccaagttgacgcggagagagcaaatcgaacactttgagccaacaatcggcggagataaaactgaaaaaaagaaaacaaaaattaaaattgaaaattggtattttaattaaatttaaattaaaattgaaaattggcatttaaattaaattgaaaattaaaattgaaaattggtatttaaattaaatttaaattgaaaattggcatttaaattaaattgaaaattggtatttaaattaaatttaaattgaaaattggcatttaaattaaattgaaaattggcattttaattttatttttacattgcttttgccatcttttcctccgcttcttttcggttgtcagacattttgttgatggtaaattattaacagtttttggcactttttcacttaattattcttttttagagcgatttataacaacataaaaacacatattttggggttggcacatattttacacatattttggcacttttgagaaaaatttgtaagaaaaataaaagaaaattgaaaaataacaccgctaaaaatcgactttcttgtcatttcttacagaatttacaaaaattatttttttatccgaatgctgaaagtagccaaattgagttcttaattcgtcattttattttgaaatttttagacacataaaaatcccagccctaataaccagcaacgaaatgttattttttgatataactttgctcaaaagcaactaaatttttaattcttgatatcattagataggcctaagtgctttctattagcctacaaaatttcaaaaagtttctttaagttttaagaaagttatgactaaaaatgttcaaaaaaacttggttttttgagcttctcaggtcataatttttttttaaacttaaagaatttttagaaattttgcaggatactagaaaacacttagggctatcgaaaaatatcaatattataaaatttgatccattttagacgaaattatgaataattttctgtcaaaaattttccatttgatggtttttgactaacgcccagcaccgactgaacgagcgctttggcgccgcttcgcgcgccaaccgctcttttctcatttctcccctctctctctctcccttctctctcgctttctctcctccgctctctctctctctccccctttcgctctatcaaccttctctctctctgcccctcttccccctctctcttttctcccctctctctctcccttctctctctcttctttctccgggttctctctctctctcccccccccccttttccctccccttctctatcgactttcttttctcccttctgtttctcccccttcccgccgtctctcgctccccctctatcctgtccttgtctctctccttctctctctctctcttcactctcccctttctctccatgtctccccctcttactccccccttccccctctctcgctcccttttactcgctcccatctc

SEQ ID NO: 3881 - DNA, 1382 bp, Heterodera glycines
  misc_feature (980)..(980): n is a, c, g, or t
  misc_feature (989)..(989): n is a, c, g, or t
  misc_feature (992)..(992): n is a, c, g, or t
  misc_feature (1046)..(1047): n is a, c, g, or t
  misc_feature (1064)..(1067): n is a, c, g, or t
  misc_feature (1075)..(1075): n is a, c, g, or t
  misc_feature (1079)..(1079): n is a, c, g, or t
  misc_feature (1083)..(1085): n is a, c, g, or t
  misc_feature (1129)..(1129): n is a, c, g, or t
  misc_feature (1143)..(1143): n is a, c, g, or t
  misc_feature (1149)..(1149): n is a, c, g, or t
  misc_feature (1167)..(1167): n is a, c, g, or t
  misc_feature (1171)..(1171): n is a, c, g, or t
  misc_feature (1173)..(1173): n is a, c, g, or t
  misc_feature (1182)..(1182): n is a, c, g, or t
  misc_feature (1186)..(1186): n is a, c, g, or t
  misc_feature (1188)..(1188): n is a, c, g, or t
  misc_feature (1198)..(1198): n is a, c, g, or t
  misc_feature (1202)..(1202): n is a, c, g, or t
  misc_feature (1208)..(1208): n is a, c, g, or t
  misc_feature (1214)..(1214): n is a, c, g, or t
  misc_feature (1219)..(1219): n is a, c, g, or t
  misc_feature (1232)..(1232): n is a, c, g, or t
  misc_feature (1250)..(1250): n is a, c, g, or t
  misc_feature (1255)..(1255): n is a, c, g, or t
  misc_feature (1262)..(1262): n is a, c, g, or t
  misc_feature (1264)..(1264): n is a, c, g, or t
  misc_feature (1266)..(1267): n is a, c, g, or t
  misc_feature (1276)..(1276): n is a, c, g, or t
  misc_feature (1280)..(1280): n is a, c, g, or t
  misc_feature (1284)..(1284): n is a, c, g, or t
catctctccccctcttactccccccttccccctctctcggtgtgtggggctctctcccttctcactcttcctcggctctcccatctctctctcccttctttatctcccctctctctcccctttctctctctaatctctctccccctttctttctatcaaccttctctctctccctccctctctcttctctcttccccctctctatctctccttctctctcctctttctctctctctctcccttctcttttcccctcacatttctatttctccttttctcttgctctcctcgctctctctctctctctcacttactttactctatgtctccctctctctctctcactctagctctctcattcactctctctctcattcactccctctctctcgctatatttctctctctttttctccttttttttatctgctctcctcatcccctctctctctcctccctctctttttctttctatctctccttctctctctctctctctctttcttctctctttctctctttctctctctctcctccctctctttttctttctatctctccttttttttcgttctttttctctttttctcttgctctgcccactccctctctcacttccttctttcttccgcatacattttttttgctctctctctctctcttctctctttgtcttccctcttttccctgcctcctcattctctccctcccacacgttttcatacccactctctccgcccattctcgtttaaaaatagttttttttaattaaaaaatattgatagagaattattagtcaaaaatttcgaacgcattgatcatccaattaaagataattaagtttttggcgctttccatttccgcacgcccaaaaatccgatttttaaaaatttaaaattttactatttacaattttattttttaaaaaaccaaataggataaattaaagcaaagaaatgcgttttcttccgcgggtttgnccgttcgcngcnccttttgttcgctgttcgcccgtggccgtgctgctgtgctcgtcgtgccgccgnnggtccgcggttcgtccnnnncggcgccntccncggnnncggtgggtgccgtgctcgccccctttgcttgtggcgttgccgtntcgtttgcgggcgngtcggngggcgccgtttgcttccntttngnttctgttgntggngnttgtgtttcntttngggttnctgtgnctgtnccgtttggcggcncgtcgtgttgctgccctnttgtncgcttcncngnnttggtggtnctcnttgncggcggtggggcttgaagagatcgctctcgccatcagtttgattggttctgagcttaaaggaagggcttcagggcaaaaaaaaaaacaactaaaattt

SEQ ID NO: 3882 - DNA, 3671 bp, Heterodera glycines
cgctttccatttccgcacgcccaaaaatccgatttttaaaaatttaaaattttactatttacaattttattttttaaaaaaccaaataggataaattaaagcaaagaaatgcattttcttccgcaaatttgaccattcacaacacattttgttcactgttcgcccatggccgtgctgctgtgctcgtcgtgccgccgaaggtccgcggttcgtccaaaacggcgccatccacggaaacggtgggtaccgtactcaccaccattgcatgtggcgttaccgtaacatttgcgagcaaatcggaaggcgccatttgcttccatttagattctgttgatgaagattgtgttacaattaaggttactgtaacagtaccatttgacggcacatcgtgttgctgccctattgtacgcatcacagaattagtggtactcaatgacagcggtgaggcaagagcctataaatatagaaaaaagtttgattaaaactgagctaaattcaagggcttcagggcaaaaaaaaaaacaactaaaatttgaattttaaatccgaaagcgaaataattattaaaaatttaaaaatcaggtgaaattacaatggaatggtttttcaattttttagtgaatttttatgaaattttgtaaatttttatggaaattctttttttctttgaaatttttcaccctcccacagattaaaattttgtacaatatttaatgcatttatatttttgtggattatgataaatggacaaaaatttcccatattttcattttggcataaaaacttttctgatattattgaccaaaatcatgcgccggtcagctgacatcggcaaaaaatcagcttccttccgactgttgcttgatgccttccaattcaatggcatttttgccatttttggcacggtttcaatggcggtcggcagtctcgagaacggagtctcgacaattctgtcaaattttggccatttataagggggatttttatgccatttttggaccgatttgtgccaaatcccgtcccaattgtggcccaatgttgatcagcacgaattggcggaaagtacggcggtcccgggtagcaatgaacaagaaaaaaggcgacgaacaggcacagagcgcgacgcgaagaacggcatttgacaaataatggaagtgccattacggggagggcacaaattaagagttaattaaatattcaaaaataatagttttcgatcctattaaaattgatatacagtattataatggtgttgggcgccgcagaaggaaatttttcttacagcttaatttttattaaaacaagaaaaaagaataataattttcaagtcgaaattttttgaaataaaaaatttggattccgtaaattaatttcgatttatttgatcatttaggtaaattatgtaaatattttaaaaaaattaaattaaaaataaaaatgtgtcccttccgatcatttggaaaggaaagaagccaaaacagttatgaatgtgaactgatcaatcttggagaattgatcttatatgcaacaaaagcatatgaaagtgaaattgtgtgcgcgagcggtgcacaaaataatggggggaggaaaagcgcagggagaaggcgcgctaattttgtacatccgccgggggcgggtgggatattagcatacagaaaattacatttattccttgaggcagtaattattgttgaattaacccagtgggtcgtcacaggcggtggacacttccgtttgaaattgttcataattttgatgcaaaaattttgacctaattttagtggtctaaaaaggaggacaacaaaaataataacgagaaatcttacacaaaaatccaaaattgatcagtccaacaaaaaacaaaacacattttttatgagcacgtcaatttgcaattccatttgcataatttggtcaatcacttatcagcaattcatcattcacttcttctgctgatcacttgggccgggagctgagttgagaagcctaaaaataaaaaacgaaaaataaatttgaatttttgaataagccattcgctgacccgtcaccaattgcacgctcatcatcaatatgaattagggttgcaaccccgaccgtcggggttggaaaagtcggggttcggggttgtcggggtcagcaaggtcggggtcggggttgaccaaatggttcggggtcggggtttttcgatttttgccttatgctatatagtcaaaaaactttattattttttcttaaaaatcttttattattcataataataattttatcaaatttttcctccggcgccgggcccccaaataaaaatagagggattttattcaaaaaaatgcccaaaaatttctgatcacctttcttttttttttgtttttcgaatcatcttttttttcgcggcgctctttttctaaagacttttaggagaattctattaatcacataaaaataaattaaaaaggaaacagtcaaccgggttatgtcggggttcggggtcggggcggggtcggggttgcaaccctaatatgaatgataattctgttccagggatcatctgttcgccagccaatcgcttccttctcccatttggtccatttgctttcgtctcgcgcaattggacaacggaccaacagaaaacagtagtgaaagtcagttcttttcagtgtcaattgttcccgagtcaattcgttggtaaaatcaaaggccaaaacggagtcagcaaaaggcaacggaatgcaaatgaaaacgatgaaattgacgggggaagaagcattggcaaatgcctaaaatatggggaaattgataaagaaaaatgaaagataaatgaatgcaccgttttgaattgttcaatattcgacgaccaattcttcacataatccatgtccaacccgcatttgaacacctttggcacattgctttgaagtggagtgaaaagccatttggccaccgcttgtccatctgatgccgcggcactgtcattgcatggaaattcggcgaagagatcgtcaacatcatcatcatgagcatggaatttgccaatgcataacaacggcaaatcgttgagaattgacggggcgaattgacgcaaacggtggaaaactgtgacggacaatcgcaagccatgattggtaaaaggattacgtacgacaaatgccgtctcttttatagaagaacatttatagtaaataatatttttggttattttacaaacaaaggtagcttttcttactaataaatatctagacaaaatatttaggaactaaacggaaatcaatgttaatggaattatgatggacccccggttgaacaaatttcaatggattcatttaaacaacgatggttattagaagaggggcattatgccagtgacagcctaatgcgaacacatgataattccttaaaaaagtttgatgagaacgatgagccactattggttacaaacgatatgttagagcaaattgatgttgaaggatatgtcgagacgactagaaaagatgcatattataaaaagccagaaaaaaaaaatccatttatcgtatttttctctgaaataaaatatgatcaggcattttttgcccctactaccccttacgacgcatccccccccaccttcgcgacgaccccccccccactaccactcgaccccgaccccccttacgacgaacgatgggggggggggg

SEQ ID NO: 3883 - DNA, 2923 bp, Heterodera glycines
aaatggggcggagtcgttatttaaaaaaccatcaatatgatttgatgcaaatttgtttataacttagctcaaaagcaaccaaatttttaattcatgatatcattcgatagccctaagtgttctctatcagactacaaaatttcaaaaaatttcgttaagtttcaaaaaagttatggctatggggaactcaaaaaactttgttttttaaacatctttggccctatcttttttgaaatttaacaaattttgaaattttgtagactgatagaaaacacggtacttatgtatgtattatctgtgtacagatttcaaaaaaaatttttttttgaaaatattaaaaattgaaaattgacatttttaattattttacattgcttttgccattttttcctccgcttcttttcggcggtctgacatttgttgaggtaaattattaagtgagatttcgacggatgtagaaattgttcaaaatgaatgtcagattatgatcagcgacccagaaaaccccaaaaatatgtttccacgactttttcgaacaaaacttttctcccaaaaaaggggagaccattggcagtacttgttcgaattcgggttcggggttcgaaattggtgcgaatgaatatcagaatcgtgatcagcgatctcgataacccccgagtacttctcagaatcgcaaaaaacgagcatttttgtccttttttatgagaccaatgtttccgacttttacccggatttaaattagattattagcaaaactgaaagaaattatgtggagttatgagatttctttttaaaccatggcttccaagagggcattaaaaaaaatcagttcttttaagtagggttgggcccccgacgtcggggttggaaaattcggggttcggagttgtcggggttggaagcgtcggggttcggggttggggttgccaaatcgttcggggttcggggtttttcaatttttgccttataccatatagtcaaaaaactttatattatatttttattcattttcagtgaaaatctgtaaaaaatagtcaaaatttcaaatttttcctccggcgccgggcccccaaataaaaataggtttttcgcggtgctctttttctaaagacctttaggagaaatgggttcggcggcgcgccgataggcgccgccggaaaaaatttttgaaaatttggatgggtctgttaacatcttttctccaaaaaatgataaattttttcgattttgagctgatttaaaaaaaaagaagttttttgaggggcacaggcgatgcgcgccaggcgaattttgaaatgtaaggtctattttgtaacagattttcaccaaaaaatttatgaatttcagataaattttgggtttttttcttttttttttttgtcaaaattaatctttattttctaatagtttttcaccaaaaatttatgaatttctgtgaaatttaattaaattttttatattttgtaaaaaatattttgaaaaatattaattttgtttaaaaaactatattaatcacaaaaaaattaattaaaaagaaaagtcaaccggtatcgaactcataagcaaagaattgttattgttaaagtaatcccttaactatatactaagtcagccgaagccccgcccctatttttgaattggcggttaaatgctgttttgttgtaataggaaaaagaaacagaaaattaaaaaatataattggagattaatagagaaaggatgggtagaagagagagtgcagtgtatgtttctctgtcggcgcggatgggaggggtagagtgggtaacgcgtgcggttgtcacgcaggattgaatgcgtgcgagtttgtttatgtgtgtgatgagtgtgtaggagtgcttgggaataaggaggtagagaagaagaggaaaacaatagagagagatgaaaaaggaagcgagagagtgtacagaatgaagagattctaaaggaaggggagagagagaggactgagagagaaagagaagaagagatagggataaagagaagataaaggagaaaaagcaagagaacaattaaagagaaaacggaagataaatagcgattgagaatggggaaatggtaacgatagaaaaagagtgggaagactgagagatgacagagagagaaagagagagagagagagagagagagagatgagaggatgggagagagacagagagagagagcagggagagagaaaaagagagaagggagagagaatgagaaagcaaagagagagatagagaagagaaagagctaagagagaggtgagaggatgggagagaatagagagaaaaagagagaaggaaaagataaagaaaaaaagagaaagaaagagaagagagaagcagtgagaagtagagcgaagagagagagagagaaaaagtgagagcgtggaagagagagcagagaaagagagaagggagagaaagaaatagagagagagaaagagagagcgacgggatagagagagagaaagaaagcgggctaagggagagagagaaaatgaaatatagagagaagagagagagagagagagctaaggggagagagaaatagtgagagaaagagaaagaaaatcgagcagtgagagagagagcaaagagagagagagagagaaagagggagaaagcaagaaagagagagggagagagagagaaaagtggagagagagatagagcgcagagagagagcagagagagagccaaaggatagagaaagagagagaagaagaagaagaaaagaggggagaggaagagatcgagagagagagagagagaaaaaagcgagcagtgagagagagagtaaagagagagagagaaagagggagaaagaaagaaagaaataaagagagaagatggatagagagaaagagagagagagagcaaatggagagaaaaagagggagaaagagagagggaga

SEQ ID NO: 3884 - DNA, 3030 bp, Heterodera glycines
tccgaactgaccattttccgccctgtggacgatagcgttggatcactgcaacacttcctcgagactttggagcgtgtgtgccgccaacttttgagcctcaacatgccggatgacagcccattcatgtaccaaatcatccgcagcaaactgccgtcgactgttctgtccgaactcatcaaaatggaacgtgcggcaggcattccatggggtactcctcagctcagagctggacttgccgaagttctcggagtcagagaagaggtcgaacggtgtctgcgcgaaacaaatgccgacagacaaacacgatttcggcacgaagcaaggccaaatcgacctcagcgaccagaacggcatgaaaatgcgcgagttttttccgttgctcagtccgtcagaaattctgatgacaagcgagttccgtcctgcctgttctgccctggccagcattgggcctcggagtgcaacaaagtgacagatgcagagactcgaaaacgttgccttttgcagcagaaccggtgcctcaattgcctacggaagggtcaccaattgagggagtgccggtcaaagcaagtatgccgagtgtgcaaagaacggcatcattctgcaatctgccctagtgccaaagggacatcttctgcccgttcaaagcaacagaagccctcgcccaggaacaaacagagtttcggaaacgagcgcaactcaaggccattggtgtcatccgcggttgccaatgaggctgactcaatccctgagccgaaaactgttaacacaatcatggcaattgtctccccatccgttcctcatctcgtcatgctcatggccctccgagctcctgtgttctcagaatccgcaccgaacaagcgccgtgacgcactcttcttctttgaccctggtgcgcaagtcactatggtcaagacgccattgataaggcaactgagccttccgaaactacaagacgatcagctagaggtgaatcctttccacacgcggcaacccatcaagatgaaagcgccgcaacacgttttgtgcgtccaacgagaggacggcggatacgaaactctggttgcccatcggacggactggatagtgccatcagtgcgccgtgccacattcctccagggaatgttagtgcctgtggatgaagaaccggacattctcgttggaatggcagacttttggaagtttttcaacggtgtccaacgagtctctccgcaacttttcaaagtccaaacttcgatcggttccactgtctgcggacgcgatgaaattccgtcccgcccaactgccgaccatccactgtccgttatgcccgtcactgtccatgttcctgccaatgaagacgagatgcccaatacggctgtcagcggaattcagagaaacgaatccatctctgatcttgactcgctacgacaattctgggaccttcaaaacattggcatcagagatgatccactcgaaaacgatgacgagacggcacaacaaatcttcgaccagacgactacgcgcctggcaaacggaagatacagcgtaggatggccatggaagaattttccgccggacctgccctcaaattttgccatcactcgctcaaaaaccaaagcactggcctccgttctgtccattctgatgtgcctatttctgattggcgcttcccaaaccaacgccagtagcacgaccaagccaaagcgtgggaaaggacttccaattcgttgccgtggatgcgaactgacctgcacaaaaaccggcgttgacatttcaataccgaatgggattgtcaaattcttgctatgttgtgccggtggaactcagtgcatcactcaatcaggcgttcggaaatcctttcatcgtttgcccaaggaacatcttcttttcgactacgattgcgaagcaatgtactggacgaaacggggcaacaaaagaatcgggagcgtccaatgtccaggcagagatgcgtgcgagctcatcgattgttgggtgtgcctcgaacgactggcaaatcctgattgtcgtccagatgtgaccttcggactcattggtggagcgagcttcttcactttcctcttccttttctggattctgccactgatgtgccacgtcaccatgttttggatcctacagcatcttttcaccctgctcgttcgcttattgtgttgtttttggccaagccaaaatgcaccgcagagagaagaatcccctctccttgccttccaaagtctgcctactccgcgcaggcgccaaatgggtcgcagtcgttttcgtccttttccaaaacttcaaacgacgctcctgttattgaccatctgtgcctttacttcatgtgccagggcacaagttgtctcaatcactgcctctgctgagaaatgccaaaggtccgacttcggctcggtgtgccatctcgagagctcgacaacagttactcttctcccatcgggtctgccggtacgtctactccttcgacatcccgacgagagagtccttggcacgcttgaaatcagcatgcgctcactgactttgcattgcctgccaaaatctgagcaatggcttcggtcctatcacattgagacagtttcggtaaaacggtgcccgagtcgtggaaattgtacacgcgagttctgcgatgacgtcaacaacggaaggaagacagaagttcaggagctgagcgaatggaccaagcatcccggattcaacagatgctcagcatcttgctctttttggtggtgtggatgtttaaatgccggtgccagctgcatcttctaccgtccacatgccattgctaactcgccaattgtctatgagcaaatctcctgtcccacatgggaataccgcttgcgcacttcactcaaactgtcggtcaacgcaaacttcacgaaagagccgtccgtgtcgctcacacccggcattacattccgttggaaggatttgagcatcacacctattgcctcttctgttcctccggccccaatcatggcaaacaagtttctctcggatggcaataacgtggcaatcagtgatgaaatccaaagtgaccttcaa

SEQ ID NO: 3885 - DNA, 4713 bp, Heterodera glycines
  misc_feature (4525)..(4525): n is a, c, g, or t
  misc_feature (4574)..(4574): n is a, c, g, or t
  misc_feature (4582)..(4582): n is a, c, g, or t
  misc_feature (4661)..(4661): n is a, c, g, or t
aagcgggatatttttgccgaaatcacctacgcgccgattcagttgtctattcaattcgaggggcttcgaatcgctacggaagaggacctaacaaaatgccatgccatgtccaagggtcttttcggatgctattcgtgccacactggagctcatctccatttgcaatgccacaccgactttggctccgcacttggctacgttcgtggttcggatggcacagaattcacagccctttgccacaaaacaccaaaagttttgaatgtcagcctgtcattcaaccgtgccgaggtcgacatcaattgtaccattgaatgcagtggaggacggaacccattcgtgattaatggtcatctccgctatgtgccaaaacacttccaagcacctaatgaaggaagctcatttgcctcgaaggccaaacccagcaactcatgcctaatttggtgcccagattggaacttcgacttttccgatgtcttttggtatttctttggcctccaaaatgctctacgaactgttggcatcatcactctggcccttttcatcgtctatgtccttttgcgttgcaaccctgcccttcgatcttggagagccataagccgagtcgtccttttgttccttgctctttggcctacgactgattcttctgcagcgggagggctgagccatctactcagcattcaaaattcagcaccaaagctgcagtttgaaggccattcttcggtgtcaagacgtgtgactgagactctcgacatttttgatgcacaaatcgggaccattcatctcgccaaaaaccaaaaatcgccaatggacttcgctataaaagccgtctctgtgccagtccattcaccattcctacaaattcccgaatcggccttccacattcaaacccaagcccaattccctccatttccaatggccacactgctctctttcctcgccaacacgatgaacatcgatgtcgatcgcttcggtcttgccgtcactacatccatgagccgttggaacgaggcccaggcgatcgttgagggattgcacgctcgcggctacgaactcaagacacggcatctgtacccacgtgagcgaaatgtgcgacttcacgggtctgagctgagccgaagtggtgcgagtcgtctcggtgcctacaatggaagtgcccgtggcccaactgtctccgagctgtaccgctctcgacatggcatcactcttcggcacccctctgccccatgcttgatggagcccggcgggaatgaacaccatgattttttccccatcgaaatgattcgagtcgtggcccctgaccaagtttctacaccacggggcttgtccacacgccctcttccccgcccccgcccgtctcacttcgagctctgggacagaactgaccatccgccccggtcccgagaattggtgatcaacgttatgccccatggtgattcaacgagtcgaggtgccgcggaggaataccgcatcggtgttggccgcgaactcacgatctctggccccctcgttctacgaatctatgctggtgcccttcttcttgccctattctctgttgcccttgtcgatggccaatcatctattgctggtctctgccctgctcattcttttgccctttgctcttcacggctgcacaaattttcttgccactgtccgtcgctttttggtccttccgcattcgattttgtgcaaatcgtcaacaaatttgctccgctggcttattcaccgtcttccggcagcgaacacttcgttaaaagccatgtcaaatcagctgactcacccttctctccgctctttggccgagttcaccatttgccgctatttaagccgttggttgcaaaattggggcaccattcattgccctccgactcttcaatttccgtcgccctcgttgctatgccgtcaacgcactgctcgtcgactttggctcctgttgcttcccatgttcaatcgggtactgcgtcgctttttgatccttcgtctccgcgtgtctgtactgccgatttcgtcagggcgcccgaatcatgccctccaactattggcctctgcacgaccgaccgtatgccgactatcagtcctatcgctgataatcaaatggccactggtgtgacaagccggtggatgagcattcaacaacgcgaaaaatatgaacgacgattgcttcgactaaacggcttccgcccaacgcttgtcatttgtgagccaatgagttcagccattcggcgcgaacgactccgactgaagcgacttcacatggccactccccaggaaccgagaaaacctggagcagtgtcggaggaagaaggaacagcagttgccggaccatcttcggcggggagtgtcgccaaagcgactgagaaaatggaagaaaattgaggaagagaaatttaattgatttaaattggataattttaaatattgtgattaattttattatttaatttgtgatctttgaaattgtgattttgtccctccattgaacattttgtacatttttagcattagtcactctttttgttgttgatcgctctgtccaaattgctccacctacgctttttctttctatttaaacacgcacatttctcactcctcacatcttatacagacatcttattcattttatattatatttattaaataaacttctttcttatttgggaattattttcccccttattccaccccgccctctctccctcgcgccttcccattttttcccccctttgccgtccgagccaacacaaccgccgttatgtcgaacagtccgaaaagttcaacagaattgctgaacgttttgtcaatatggaaatggcttttgtcgcatggaacattaggtgcagggggcggggagggttagcgtttttcagtggtaaaatgttcatttgtacaaccattcggcttccaattaattggccatccctactgtcctctggcttttagcataaatgaacccttgattctcgatcggaaaaactctaaatttttgttgggtccggagaatcaatcccttctaaaacttcgttaattttgaatattcccaacagccggccgcactgagacagtcagttgaggagtatgtcaccgaagaggcgaacaacggcaccaaaatatttattgacggcatttgtgatctccaccgacagaaaaaacgggcacttttctttcccattcatgaccttttcttaattgtattgtttgttacctatccgggtataatttcttgttgtttttgttgttgccttttccggttagaaattgacttgtgttttttgggtaattgcaaaaaaagttcttttaaaacaaatattaatcggttactattaaattttaaaatgtcatggaatttgaatttgtgtttgtgttggaaaaagaggtaataccgtaattcatcgattagaaagaagcccaatgggtttctgagggaaccggccactttggcgcaggccattttggcgcaagactctatatcattttgatttcacagcaaaattaataatcttggtatgattttaagtggcttgatagtgcctattaacctgcaaagtttcaaaaaatttactgagaaacaaaaaagtatggccaaaaaacctcaaaaaattgcattttcctggtcattttggcgcagcgcgccatatcttttttaaatcctaatataattttttgaaattttgcaggctaataaagaacatttagacctattgattaatatcctcaacattattttatttggtcgaattaaaaaaagttatgaatctttaaacttgtctgcgcctaaacacatggaaccaaactgaaacccatcaacactgcaacaagagatcatctaagccgtttttgaaccataatagctaaattcgaaaaattggacttttgagttttgttcaaattcgggttccggggtgcggaatcggccgaaattgatgccggattcatgatcagcgaccccggaaactcaagggaacttaaatatttttaacaccgacggattgtacactgacggattgtccactgacggattgtccactgacggattgtccgggagtctcatcggtcagcattgtgccaaacagttttattctcttggggctttttctcacacaatttgcctcggggcttttcccgttttgccttggcttgcattttccctccaaatagtcgaccacccctttggcagtcattcgctgtgctctgtccttggacgtcatattcttaaaaaaatgaataaaaatttcaaaaattttaaatggtttaacttaatttccctgtttaaaatgggcaaaatagccatagggattggaatttttaagaaaacattattattgggactccatttttaggcacaaaaaatcgcgaattaggcacctaaaaaggcagaaaaacaaatcgcaaaatatgcaaataaaattttttctttacactttttaggtagcaaaatacataaaaacattaaataggcgaaaaaaaggcaaataaatttgtttttaatcaaaaaatttggtaaagaaaaaaaagaggtgccattttttgnggtcggggtcagttcgccgcaggctgtttcgcagccaattttgaaattntataactnttttctttagtcagtaaagttagcaaatctggcatcatttaaaagctctatatgtgcttaacattttcatgtcaaatanaaaatctaagtataaaaaaagtatggcaaacggcgccgaaaagccatgaaaa

SEQ ID NO: 3886 - DNA, 905 bp, Heterodera glycines
tgtaatcagattcgctttcggcaccgttaaagccctagaatccctgtgtatatactctatccctactggaggggaaccgcccacttcggcgccggtcttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaaacctcaaaaattgactttttcttggctttttcggcgccacgtggcataacttttttatttttgaatcattcatttctatttttacatgtaaatatagagcacacatagagctttcaaatgatgctagattggctaaagctaactgacaaataaaaaagttatagcatttcaaaattttcggcgccgaaatggtccgcgccgaagtgaccccgaccctactggaggggggcggctcgaaatttggaaattcaacttttataccgactgacggcaaccaattctccacctcaaggtcctaattggtgcatttatgcaaagcaacaaacaaatatattttcatcggaaagaagcatcaaaattaacgagaaaaatgagcatcggtccattcaataatttcccggatttttcccggttcgaatgtatttttagatttagctgatcaagatctttcgattgataccaaatttgtccgaatttgaccgtttttaaagggtcaggggcccccccttttcactcaatttttcgagttttaaaccggttcaaaacccggttttttggcatttccgcaactggagacctactttttcgtgcatagctcgtcgagacgaatcgattggtatatcatttgtgccgtttttttacggggcgttgactatactacaccc

SEQ ID NO: 3887 - DNA, 6921 bp, Heterodera glycines
  misc_feature (77)..(77): n is a, c, g, or t
ttcattcattaagtgtatttttcatttgttatcaattagtaaagtgtgttcgttgtacctgcgctcattcacgtcgnccactttcatccatttgcattggtccgtggacacttcgatgaaaaatgaataacaccgatcatcgcaatcccaaagcaaaagcctggacacaaaatgagcgttttttgtgttttaatggatgggaattaagtgcctcatcgtttccacaagaaacggctggggaagttggacgaccaaagcgccgctgcccaattggtggcaagtgtacctgaaaaatagacaaacaagtggtgaataatgggtagtgtttaatttttaaagccacaaaaccatgtgtcaagaatttaaggatttataattttttttttatttttgttctgtttttaattttatttttgttctgtttttaatttttttttttcttcttaatttttttttaatttttttctagctttttttattttttaattttaaaaaattagtttttttttcttttttttccttttgttttttttttagtttttttttgtaaaaaagcaatattatttttcccaagccgacctctaatcctcctaaaatatacaaattactaacccatcgtcccagtcgtaatttttggtgtccccgttgagaagggcatttctgctacgcgacactccctcaatgacaatggcattgttggcaatagtcgcaatgttcacacgtggtactgacaatggaaaggaaggaatatatttcgaattaccttttataaaacttactctgcagtgtggttaggtagtcaatttcaaacgaatccgtgacgtaaagcgcctcaaaacgactcagttggaaagtgttgttcactgaacaatgtgtgccaacaatactaaaatgaataatggaaaccagaaaggaagttatggtcgaaatcaaaaaatgccaaaccaaaaacccaagacaaaccggatgaactttacgaccctttcatcgaaaagtaaattttgtcgtgatcgacaaacgtaatgactgtggtcaatgacgcggacccaatccatttggtcgacactgacctaacacaccaaatattaaaaaagtaaaagggaaaatgaacaaaaaaaacccaaaaatgacattcacttcaacaaaataggaataggttcgctggtcgcggtccatcagatgaagtttgatgttattgagaatgaacggccggcctaattcgatctaaaaacataaaatatatttatttcgaaaaagaaaaattgaaaatatcaccgttatcccggaattcgcttgatttatcaaatgttttgcgtaagagcgatcaattgggtcgacggaggaagcatcttcctcaccgactttgttcgacagtaaagccgtacgaagatcaccggaagtcactttggcaccgaaagagggcgtggccacattagtgccggggactaaaatgtgtgacaagtttagtctaagtacttcgagcctatacagacggtttatcggacgcgaaatttaacgccatgaaattcgctcgccatttgcctttggtattttgagtttggcacttcgtacaatattgtccgatccttggagttcaacaattctgcccaacggccagcagttcctcggagttttttcttcttcgataattactacctctccgatttttggttggtccgccaggcaacttcttggtcctttatgctcccattgtaatctgttccggagcattaacaggtactcttttttccatctggtccagaattcatccaatgtggctagagtaccttcccagcgcatctgcaattgcttctggagatttttaggttcattttcgaactccgtgtccgacgattgttcgttcctccggacatccaaactcaatatggcctttggcattatgaaatcgaccggtctcaatggctggacagcatttggtccttcatcaacgtaggtgatcggtctttgatttattgtcgcttcaacttctgcgacaaacgttctcaattggtcgtagggcaaaattcgacgcccaaggactcttttgaaggccgcctttactccagcgacttggcgttcgagaaatccattactccaaggtcttagtgatggattaaatcgccatttgattccttcgttggcaaggtgctcttcgagcggacatgtgggtgtcttcccagcttctaatgctgccgctactttagctgccagtacaaattgtgtgccgttgtcagtgatgattctttttggagttcctctcctactagtgaatcgacggaacacttgaaggaatgcctcagcgcttaagtcaagcactggttccaaataaatagccctcgtacttaggcaagtgaacaaagcaatccatgccttctgaagctcaccattaattttggtattcgttggtccaagataatcgatcccaatgctttcaaatggtgccgtccgcctcacgcggtcctcaggaagaggagacatcgtcggcaatttatatgccgggcattggatcctgcgacaacgaccgcatgctcgaatgaccttctttatgggcagtctcgctctgggtgtccaatattttcccataaattctgtcaaagtggattcaactccagaatgggcaagggactcatgtaccgactgtgcaattagtcgggttattggacaattctcaggaaggataatgggattaaccatatcttcagatgcattgctcattgcgagccgtgttgacagtcggacaagaccatctttcctcgatgtctttacaagttcttgtgattgctttttccacattggccaacatttttgtgccatttttacaagtaagatctcggcgtactggtaatcttcactgctcataggaacaccctctgaaatctcgaatattcgagtcttcctcatcttgtttattgcacggagaaaccaaaccacagtgcggcgtagtttagtccaactgctaaatcgacaagggtcaatccatggattgtcttcactcgttgttgctggcactgcaactacattgtccaattctgaactttcttgtccatcattcatggctcctgttggggtgacctcgaagtcgatcggccaacttttcattggttctcggagccatgttggtccattccaccaaagatgatgggatctcagctcttctggagtgcatcctcttgatgttcagcatcctcgccccaattagcattgccaagagttccattcttggaattgttacttcagctttccggggcttgagtctactctttgcatagagtaactgtacattggtttcttctcctttctgagaccttatgaaaagtgccgctgcataagcgtccttgctcgcgtccacaaatgcatggagttggaccatttcatcttgcagcacggatcgtctcggaaatttgaatggttcggtcttccattctctaatgacagcaaaccattctgctgtttcatcagctggtaagatttcgtcccatccaagggttctgtcccacaatcgttgtaggaacaattttgcttggagaaggcaaggtgcgaccattcccaatgggtcaaatatgcttgctaatgttttcaaaacaatgcgttttgaaatcttcccggcttcattcgtcggtgggaatccaatgctcaattcgtccttttgaatgtcccaagggatgccaagtactttagtccctggtttattaagccggtcctcttcgggaatttgctccattgctttcattgagttgcaaataaattccctcaggttcatttgtgcttcagcaaacaatgctttcccttctcgatacttctttaagacttctccagcgtctttgcatgaagtcattagattgtctacaaaggcattcccagcgaattccaacgccaagggggaagctttctccttcagatgcttctggacaactgcagccaaaataaatggcgaagaaattactccgaagggaatccgagcccaacggaagatctgtaaattgtctgtcgacaatttcttcttagggtctttcacccaaaggaatttcacaaattccctgtcttcattgtccaaagatatggcattgaaggccttttctaagtccgcccataatgcaattattgggagacggaatcttagaaggattcccacgagatcgggaatcatcacgggtcctctgaacatacactcgttcaaagatttctctccccgtgggtgtgctgaagcatcaaaaacaattcgaagtttatgagttagtactccatgatgtggcaggaagtgttcaggaaaaccctcccttctttcgccaagttcaaagaatccgagattgaactctctcgagattgactcgtggtatttgtccaataactcgggagtcttgcgcagtttttcaaggaggttgaccaatctcctatatgccatattgtaattcgatggcaaatcgggcgggaactctttccatggccatcccgaactataacgtccatcagcgagtctcttggctttcttttcgaagatttccatcgctgtgtcgtcatcattttcttttgggtcgtcttttattcctatcagttgtaggtcccaaaagttttttgcagtgtcgatgcctgtttctgcaaattcacaatcagcttttgctgacatgactgcgcaaatttgtctcgtttctccgatctcctgtgggatatcttttccacatacgataggtcccactgaagtgtaaatgcggaataagttccgatttatctgttcgcgccgctggaagaatcgccagaattcggccataccaatgagtaaatcgggttcctcatcggttatttccacgtttccggtcttccattcggctcgacggatagatttgactatccaatctgcccgataactggccatctttcaatttatataagcttaaggctcgcactacagcacttttgatcatggttacttgcgaacctgggtcaaagaagaccaaaatcctaattctctttgtaggatttcttctggagaaaattgtgacgtatttcgccattagaagcactctttttggatcagaaaccatcgtggctactgttccattttctgctgaaccaattgtcgtcatattgacttctgcatgggttctcttgaattgtgctttcggctttgtctgactggtgttccattcacggccggatttctttgtattcggacaaataactttgttatgcgctcctttgcatctcgcacaactcctatttgcccgacaatccggagctctgtgccctctgcgtaggcacagagaacacctattttgttctgcaagcattttcgttcgttgctgaacactggccacttttctgcaatcgttgacccaatgcggtccgtcgcagaagaaacatggaagttttggcttcccacgaggcgctgactccattcctcgtttatcttgtgtggctacaaaggctctggctctctcagctgattgccttcgttgctcgcgctggaacacctgtctgttttgtgtcggacctcgattcacatctcttcgtagtgatcgagagcaacgctggacctcctctcgaagtgatacgacttctgctagtccacgtctcagatctgacatctgccaatggaacccctcttctcgctccattttaatcaattcggtgagaatttgcttgggcagttttgccttgactgccatgcacatgagcgaattctcgggatgtcccaaagcatttaattggcgacatattcgttccaagttctcggagaacatctggagggagtccgggctatcttctacatttggaagattgaaaagttcggcttgcaaggcttcgacgataacttgcggattgccaaacaatcggcggagtgtttccaccatattttcgtaattttggccacctctgtagcctatcactgcacgagaggctttccctttaaggcatcccatcaaataattcattttgtcgattggctgcaggtgagcctgattgtggaccgcattctcgaaggattgccaaaatgtcggccactctaacggatcgccggagaatatcggcatccgtaattctggaagtctgatccttggtctcggcacagcaaagcactaatagggtgtttgactcacttcaaaaaataattccatacccaaaagttttttacaaccacatattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagattgaaaaccatccattgcctgccggttctcggcacagcaaagcactaatagggtgtttgactcacttcaaaaaataattcattacccaaaagttttttacaaccacttattgccaatctaatttcttgcagatttaaagctatccattgcctgcaggttctcggcacagcaaagcactaatacggtgtttgactcacttcaaaaaataattcattacccaaaagttttttacaaccacttattgccaatctaatttcttgcagatttaaagccatccattgcctgccggttctcggcacagcaaagcactaatagggtgtttgactcacttcaaaaaataattccttacattctcggcacagcaaagcactaatagggtgtttgaagcacttcaaaaaataattccttacccaaaagttttttacaacaatttatttccaatctaatttcttgcagattgaaagccatcaattgcctgccggttctcggcacagcaaagcactaatagggtgtttgactcacttcaaaaaataattccatacccaaaagtttattacaacaatttattgccaatctaatttcttgcagattgaaagccatcaattgcctgccggttctggcacagca

SEQ ID NO: 3888 - DNA, 2010 bp, Heterodera glycines
ctgaaatgttggcaagggaaagagtgagattctgaaagctgttagttacaggaggaagacaggcaagagaatcacaaccaataatgagggcatagtcgggtctgatgaagcgagaatcatcaacaaaatttattaaaactttttcttttatggtaggtaccaatagacaagaaggcctcggcttgtgcaattatggggatttggtgacccgaggcgcttatagctcgaagattggtttttctaggagagcacccaattgtctcagcaagggagataggggcagctgtgagcgttgctcccgtgtctacaagagagcggagctcaacggaattgagggaggcagagattattgcgtcaagtttcggtttatgtgggttatattgtgtgaaaatataatctcggttggacgagatcatgggataattatggtcaccgatttgtatgttaaaaagaaggggatcaaataagattgatgagaatttggaaagaaagtcagaacccaatacaacatcaaagttattttccgagacccatgagtcttcttctgtgatgagtaattttaaggagtgcgtttgagacgctatttcaatgttagttgaaatttcgccgatagtttgcaatggaaggaaagacacaccaacacataggggtttggggaaggagtaaaatttggacttttgataacatgccattcggacatgagtaaatgagatgtcagattttaggtcaattttgcagttaattaaaacagagttgactttaagttggatgactgggaaaggagggctttgagttacttgctttttgaagctacgaaatggtgttccaggaggaaaaaatatttgtaatggatagatgaacagaacaattataattgaaatgaccatgagagtgaatataaatgtaatgctaatgaaagagatgggaaaatactgttcaaaattgttaacattttcgttggataatgaagcatgtacagaggggaatagcgatataagaagaagaagggtaggcataatggactttttataagaatttctgaatatggttggttgtgagagtttgggaacaaagggacattccgctatatgatgtttgtcctttttgcagtaatggcataatgaagagggagggttaatatcagcccaaaaattactggagggaggtggaacgttgaaatgttgagagttttcacaagtttgtgaaagtatgcacggagaaattgaggaattgatttgagaaggaatatgtggatgaaaatgaactttgttttgatagatgggaaggttctttgagggggaagattgacagtcagaaatgttttgtgattttgattggaaaagagtaggaggaccatagccaaaggttaggaatttattatgaaaatcgaagagaattggtgggaatctttcaagagtttcagtccctataatgatatcacaaatatcccaaatatccaaataatcgggagcgaaatgaacatgtgcactgcacagcatatttgccatgtgtaaggagaacgggactgagcccgtgacaggtattgggatcccaacggcagtagtgatagaaacttccgaggagttaagattttgacagatgaatttgtccttaagtttaatcggagcaatggaagaagaggcagcagagtcaattaatgcaatgagaggaattgtatctgcatgggcgggaatggttgtgacaaaggatttggaatttaatggaaacatagcattgagaagcctaggggaattatttgactcaaatttgggaaggagagaaaagcgggtaattgagggaggccattgggttgggtttccttcagatgtttcacctaattcaagaacaacatgatgatttgaaaaattgggtgattgcacagagcacgtattggaaggggaaggaggaggagggggaggcggagggcgtgattgatttgtgttatttgttgtaagaccaaagaaggtttgtaataaggaaacattgttaaaatatttttccaaaacaagt

SEQ ID NO: 3889 - DNA, 3146 bp, Heterodera glycines
gggaagaaattgaacggcaaaattttgatatgagagagagagagtttgattacagtcctcgatcaaagttttggtttggggaaaggaaagagcaagatcattttcttctgcaacccaaatgtttgacagaaaagttcctaaaaattttccgaggttaatgaattgacagagtttcttgggagagggaagccacataaggatggaattgtcgtcgaggcggcaattccctgctgtatatttacaatttgggtgtcctagagatgttcggatatgatcttcggaatgatgcacaaaaatctcagtttgaaaagcgaaacaatttgtggaattgtgtgctttccaggaccagccaaggaagggataccgtttttcatagctgattggattattggagaaaaggagctccccactttggattagaattccttcggaacatgacttttcctgaaccatttgcttacattcatctaataatactgggagattttcggacgggagttgcttaatgattaaatcattccatggattggtgtactcaatcagggatttctttaccttcctgcacacccatgccttggatttttgttcgaatgggttcggttggaaaaggcgaataggttgtttgataggggtgtcagaaggagtatgctttaattttggacatggtagccaaatgggaagagaccaaattgtgccctcaacgtgtgtctgacaaaccatagggaggacttttaaggatgattgactatgagaggatgagaccaaagaagcacttagagaaagagtaatgatacaaaggataaaattaaaacgagttagaaagggagctattgaaaaatttgagctgcgcgggtgtgattcccaatttgtgacaataggagtgggggaaacaggctttggttcggattttaaagcatccgtgagatttggttgcttatcagcagagccagagcacacgagctgttctttgatttgagatggtgaggcagtaacgggttgttggacttggtcagagaatgtaagagtgttaaatgaagggtggggaccattatcagacattgaaagattttggaatgagtctgggggaagggaatcataggtgttaagggaattaatttgtcgtcctcggccataaggctggttgggatttgggtagcgattccaattccgattgtcatgatggaagggttgctgatttctccatgcacccctttgatcatgatgaaaagactgttggttccgccatgtgcctctttgatgaggttgatttcctctaccactgttatagggagggggtcgggagattggaatactgttggggttgctatgggtgaacataggaggctgagacgtccaattttgcgaatttctgttttgatttttataggcgaggatccgacattcactgattacatgaccaggctttttacaataataacatgtgggggtctggttgggagtttgctgccagtttctattttgaaatcgagggggactagggggccggaattgattagtataattgtttgggtttgggttagcggattgtgatggaccgaaggaaacccgtttttgttgtgggggtgggggttgccaggttgtgaaatttccttggagtaaatttggaggggatcgggccgaagaagaggaggacatgacattaatccaatcggggtcaactcggggtttgcgagtggccaataaattttcaacttctaaggccttaattcgggtctcttcaaaggtttgggaggcactactaccaagtcggacatggaaggaaatttcatcccgaagtttttcgagaaaagcggacttaagcatatctttgcggaatttggggtctaattcttgataagcggcattaactagggggatgaggcgctcaacaaaggtttcaaccatttctccctctttttgtctacatgaggccaatgactgcttagctaattgggacttaaagggagtatcgaggactgttttgagggcatggatggcggcttggagggttgccttacggtcagctgggaggtcctcaaaaatgtcgcgcggggtcccttctaacatcattttaaggcgaccaattttgtcaccttcctccatgcgcctacccgtggcttcgatgtagtccatgaattttctggaccaagactcaaaagtctgggaagattccccagtgaaggaattgagcccacccgatgattgattctcaaatgttaatccattaattctgtcagaagattcatcagcccagacatgggaatcatcctgctgttcttcttcaactatgacttgattgagagggggaggggttgaactgtcagtgagtccacgatttcggatgtcagaattttgggcaagattaggagtgatggaatttgaagactgagcattcaaatctacattgagagggaattgacgggatggagtttgagatttgcttctgttctgcttgttctgcttggggataggaaaagggaagtgaaatgggttcgggtcagtaagggaatcaatccgggttgccatggttgccagcccagtattaagttcctcagaaagtttaaagattgcctcatttgttgcattaatccgacgattaagatagcgaaggtttctgtttgaggcatcctcaaagccagaaacttgacttaatacattttcgaggtcactaacttttgcttggacggatgggtttctacctgagaagaggcgacggtcaatcgcgacgatatcttcgtaaggcaaattctctaagggattgaccatgataggggaagtgggatgtatcagagagggtactggacttgcgcaccgtaaagggaaagaaataaagtaaaagttaattgtgtataatcactggatatcgcacaataaccaggatttaatttgttttgctgtatttaattggggataaatctggggcggatatgaatggttcaatcagcaaaatatataaatgagacttgagtattagaaacggaaaaggcacaaatatttaattgtcttaaatcactggatactgtacttcgtaaccaggggtttacttggtttactgatttaattggggtgggacctgagctgggaggtaattggttcaatgcgcaaaaggtgttaggtgttaaaatgtgcgtaaatgtgatcaaaaa

SEQ ID NO: 3890 - DNA, 2124 bp, Heterodera glycines
atgtatgaaaatataatgtttgaatttgtacgaattaacgaattgtttttttttaaattagtacaaaaatataaaaaggatttacgaattgtttatgaattagtacgaaaaattgacgaattgtttcttaattattacaaaatataaaacgaattaacaaattgtgattgaatttgtttgaaaatgcgcagcgaatttacgaattgtgtttgaacttgtacaaaaatgagaatgaattgacgaatttatatttgaaaatttgtgcgaaaataggaacgaattggcgaattgttttgaattatatgcgaaaatatgaaacgaattggcgaaaggtgtttgaatatatacgaaaatataaaccgaattgacgaaatatatttgactctgaatttgtgctttgtgttaaaatgtaaaacaaaatgacgaattgttttgaatagatacgaaagtaaaaaccaaattaacggatgtacgaaagtgtaaaacgaattgacgaattgttttgaatttgaattatacgaaaaatagaaacaaattatttttgaatatgcacaaaactgtaaagcgaattaacaaattgttttgaatttatacaattaaatatgtacgaaatatgaagcgaattgacgaattgttttgaattgactgtatgaaaataataaccaaattgagaattatttttgaatatgtattaacatgtaaaccgaattggcgaatgtactacaatttgaaacaaattggcgaattgtcttgaatttgtacgaataacgattttttgaattagtacgagaatatgaaagaagagagagagaaagaaaaaaataattagttgttttggaattagtacaaaaatataaacgaattgactaattgtttctgaattattacaattataaacgaattaatgaattgttttgaatttgtgcgaacatgtaaaacaaattggcgaagtgacgaattgtttctgaattattataaatataaacgagttgacgaattgtttcggaatattacaaatataaatagattatgtatgattgtgcaaaaatgtgaaccgaatttacgaattgtgtttatatttataccaaaataagaatgaattgacgaatttatatctgaaaattgtgcgaaaataaagaaaaacaaccggattaatataattatttagcatttgtacgaaaaatgaacgaaacgacaaattattttgaatatatacaaaataggaacgaattggcgaattgtcttgaattcgtacaaaaaaataaaatgaaattgccgaaatatgtttgaaactgaatttgtgctaaagaacgaattgacgaagtgtgtttgaattagtgcgataaccgaattgaaaatagtgttcgcatttgtatgaagatgtgatcgacttaacgcattgtttttttttaatatgttcgaaaatgtgaatgaactgacgaattgtttttaaatatgacgaaaatttgaaatgaaattgacgaaatgtttttgaatttttttttttttaatttgtgtgaaaatatgaccgaattgttttgtaattaatgctaaaatattggacgaattggagaaaagacgagttgttttctgaattagtaagtaagtgtgaaccggattaatgattgttttgaatttgtgcacaaaatgtaaaacgaattgacaaattgtttgggtttgtgcgaaggtgttgaagtccgaaaatgtagtgcgaattggcgaatagatttgaattagtacaaaaatgtggagaaagaaaataacaaattgtttttgaattgtattgcggaaaaatgtgctaaagcatgattaaaatttgaatttgctgtaattgaacaaaacgacagtaatttgaaaaatgaagaaaaaaaaaaattaggcttaaaatttggaatttatgtgaattacaattgaattaagcattgtcttaaattgttactgatttgggtttaatgacaagctagacaaagtatattacaatcaaaattgtggtcaaactttgaatttaatgtgattgaaaacaaatggcagtgatttgagagaaagagaaaaaaaaaaattggttgaaaatatgttaaaagaattatgatcaaaatttgtttttgttttcaaaaacatgatttg

SEQ ID NO: 3891 - DNA, 876 bp, Heterodera glycines
tccggtcgagaaaaacattgtccaattttccaattgcgatcttcggttttgttggacaaaaaataaataaatgaatgaattggccttttctgcggctaatgagacggaatttgagctaattaagagaatggtggatgaatcaataggcaatggcttatttgttaacaaaaaaattttatttaaaaaggaaaaaaagattttgatggaaatgggaaaaaacgggaaaaataattttgtgccaaggacgcatattcctgttacaaatttaggcttcaaaatgaaattaaccgattctcgctattaaaaacagaattgtggaaatttaaaaaataaaaataaaataaacaaaataatacagatatttttttcggattcaattactattcattctcgagcaaccccatgattttcaggccaaatttacgggcttcaaaaaaagtaggaatggaattcagtaaattttttttattctctctactatatttacgcgacaaattttcacaaaaataatttaaaaaattctttcgccatttaacgacgcgccgcaaaaaaaaagacataaaaatgtgttaagtggtgtataatctgccggccagagcagtttaatttagtttagttgtgttttatgttcttcgtcccttttttttttgtttatgcgttcgtttctctcccctctttttttgtcatcttttcattctttccccccgcccccatttttaaacagaaaaacggactaaaaacaatttttttagtgcaatttgtgcccgcgggggacgggggacagaaatatgtgggacagacaaaaaggcgaggcgcagcatttattacattcattcatgcatcttctctggtttgttggggggggggggggggggg

SEQ ID NO: 3892 - DNA, 3183 bp, Heterodera glycines
tttgccgcgacgacggcatgtcggcacattcaaaagccgaagaagcagcagcagcaacaacaacggcatgaactccagaagcagtattagacggaggcggacgaggagcaaacaacaacaatttcgacacagcggcgctcggctgatcacatcggctgctactgctgatcagaattacaatgctttttcgcgaaatatttatgatagatgaaaacttttaaatttattattgtttgtgcatttaatttagtttttcttgccgttattttttgtttgtttgtttttcatataaaattagttttaagtatttgaattttattttcatcaggaccgattctccaggctatgaagaataacgaaaaaaaacaagaaattcccaagaatgttgattgcataaaacggataacaaaattccgacctttactttatttaagtgcatgcatagacacagcggcccaattttgggctctcagtgcaaataggtttattatttatttagtaatcagaacgccaaaactttgcaaaacttaaaattttttggggattttcccttgtaaaaataaaagagccgatctcgagttaaaaactagacagctaaaaaataaatgagttggagaggcgcgtcgacgaatttaaatcttttttgtctgcccaggagcggatgcgcgggtttctctcaaagaagcccaaagcacatcttttgttgagccattttgttcccttcgctcgcgagcacaaatttcttggccttttagatgaacagggttgtggtgaaaaatgttttctatcccattaatctggattttaaggtgatgaggcgctccattccgtttggcgccgacttgagcaactgtggaagtgtatgccggacgcagaccaaattttgcagcaattggagcaccattttgtcaacaattggctcctcgacacgggcaaaattgatgaaatgaagcaggtctgtatgtttggagggggtgattgcgttaaacttgttttattttaaaatttatatataataattcagagacaaagtgatcagagggaagagcatgatgagttcgatcaaacggaagaagaaactgacgaaatttcgcttatcaatgtcattgattgatggtgatttagcaagaagaaattggtggtcgacgggagacggacgaagaaaacaatggagaaaacaattcgattttgaatagacacagttcgataaaggtttttattcgtttttacaggaaataaaatttttttaaatttttgagcttcattaaaaactgtgttatcatttcacttgtatttatttgctttaaaaacctcaaaatacagttacagcatgcatgggattcgaacctgagaccccccttttggtgactaactcacagaccactaagacgaaaaatccagcatacttgtacttggagcccaaaattgggccgctatatatattgtttttgttcaacacatttcgggcccggaattttgaaaagtcgggaccggaattcgggattggcatcaggccgataaaggcaggcttgccagcaggatttaatctctaatattatattttcaaagcctgaaagtagtgataatgtccactgggaaaatttctaaaattggttttagcttaaattggatttgtccaaacaaaaaaaattggaagttaatagattgtgtccaaaaaataataatcaaaaatttgcgattatgagccaattcagtgtccattgcggagaatgtaattttacacgatttaaaaaaaattttgaaaatttgttgcaacgccaaaccgggattcttttgtcgtgagctgttcttatctcgcaccgcacatatcactgccacaattacccactactctccagtgatggattatccctttttcttgtagaaaaattttggcttggcggtcacataatgggaaagtacccaactattatagttaggagatttgtcatccaaagaaaatgttgggaagactggaaattgtaaaatgttgaaatttttgcttctaaaattcacataaaatttaaaaaaaaagaaagctcataagctgtaaacttcgttgttttccatgaaaatattacgaaaataacaaaattccgggtcaatatgtcgaaatcggggtcctggtctcaattgtccgggtgccggacttttttcaaaaaatgggatcgagaccctgggaaaaccccggcggtatattccgatcactcacggactctacacacatttcacatcataatcaaacaaaatagcaacgggaatcaacacaaagcattgtgggattgggatgggactaaattaaaaggccagaaattttgaaaaccatgggatttgaaataggaacgtgcccgaggcgaaagaaaaatgaagaaaactgtaaagagaggagaaaatgtgtgttagaaagaaagaggaataacagtgaagggaagagtgtaagagaacgagagaatatggacaaatgagagaatgacaaaattgtaaaaggagaagagaagcagacagaaaagaaagtcacataggatttcaaagtgatcggacagacgtacagacaaacgtccgtctggcactaatgctgatcagcgatcagtgagcactcgttcactgcgccaatcaatgcctggcctcaccgcttgctgcagctgatcagcagcggcacattagtaataggcaaatgcgcagttggtcgcaaaattgacaaatcggaatttcagtaacaaaaaaaatgttcctagattggatgaccataaaatttttctaatcttttttcaaaattttatggtgaattaataggttttcaggcggaaatgacgggggtgggagaacgaagggggggggacaactttctctgtaaaatttttgtataaattttcaaaaatcgcaaaacaaaagtgatcacaagacacggaaaaatcagcgacgtaccccaatcctcataattatgtgatatcatgatcaatcagtgctggtttaattttcctgctgctgaataataaataatttatttttatttttcattttatttatttattttttaatctcgcaaaaatccaaaaaagtgagcaaaatgcttaaacagtaatttcatgagacatgcatatactgtatgtcaaaaaagaatttaacatcacttttttatcacttaaaatacaaacagtaaaagttgggtgctactgtaagaaa

SEQ ID NO: 3893 - DNA, 4459 bp, Heterodera glycines
cttaaaatacaaacagtaaaagttggggtgctactgtaagaaattaacgaatttggctaatagggcttcgaagggaaggaccaacctgagtcccaccgtgccggttccgcatttttcaggaaaaaaatgggggagtcacattccggtaaaaagttttattcccggaaacccactctcgaagcccatgtttcgatcccgttcatttggactaccattgtacgtatcatttttgcaatcaaaaatattggatttatcattgaagtttatttttggcaaaacaaaaaaatctgttggactctgatttgtacataaatacataaataagcctaaaaagaatgcttttcgaatttgagtatgattcatttttagtgaaaatgccaaaatcctgaaattttatttgattttttgaaaaattgtgcgcataaaatacctaacccaaaattcgactccggtaggtccaagattcggaatgaacaacgacgccaaaattattaatggaaattcagaaaaaggaataaaatttttcgttgggaaatattttcatacatataactcattaagtcttttcgctcaatatggttgtagcctagtggctaagcctgcgctcattttttcctggacctggattttcctggacagtgaacaggattctgacgggtattttcttttccttggggcgggggctcttcggaaatgattcaccataatttactgggttaacatacgtttttttatacaaaaaacataaaaaaaatttggtaaagtcatcatgccgttttccccttagactcgggaatgactgaaactcatgaaaaacacactggctcttaaaaaatgaaaatctccccaaaaattattttgattaaatagaaaaagataaaatttgtttatttaaaatacaaattttgattttgtattttttcttcaaaaatttcattgcttatcctatttagctatttccaggttttttcaatggaaatttcatgaatttcaagaaaaccgtttggatttcgcacagttcatgaatttattaacccattttcgaaatttaaatccatttaattgtccctctgtcatttaatttattaatgtttgttccatccaaaattgaaaagatattttggttagaagtggttcatagagttcggcctggacctggatccaggcctggatttttcctggatcaggtccaggtcattttttgacaacctggatttttcctggacctggattttcctcgatttttgtccaggaaatccaggtccaggtcaaatgtgaaaaaaatccaggtccaggcaaaacaggaaaaaacctggattttcctggacaaaattttagaatttattttttcaagtgaccgatgttttttcaagttttcaaaaacagattaaataaatttaaaacacattcttattattaattagatatttttagatgttcccaagcaattaattgaatttttcaaacatttttttgagttttaaaatgaattttaaaaaatccaggtccagtcctggatccaggtcttgaggagcctggatttttcctggacctggatttttgtccaggaaatccaggtccaggtcgaacatggaatccaggtccaggtccatacatttttcaaaatgtcgatctctagtggttcaaactgccaatttggcacacattgttaggggaaacagatcacaatggtcatggaaatccggggcccggctttttctccccaaaattatgagctaaaattctcactggattaataattcttttaaaaaaaggcactcaaaaaattgataattagttattaattgatctgggatgcaacaaaaaaagcgcccataaaactgcacgaattatgggaattgggagggcgcaaatgtgggaccgaaaaacaccattctatcgataaatggattttaattttattttcaaaatttgctttttttcaagaaaacagctcccaaccgacgaacggggcaaactgcgatgtccaattgattgtgagtgtgaggtgggcaggggaggaggccagaacgggcaggcacatgtggtaaatgcagtttttggcatggcaaccctggccgccgtgttgcaaaattagtttttttcacttcatcccacatcccttctcttccactctttccccatccccacgtgccgcaccctttgcttgattccctctgatcgcgtttctggcactgaacacgcccattgtaaacggaataaggggagaaaattagtcagtttttctatatcaaaatttttttacattttcacttttgtatatccaccggttaagaaattgttttttttttgtttgcgcgaattgaacaaaatattacaaccgaattgggtaaaaatcgaaatggacaaaaaagaatgagcaaaaattgaaatgggccaaatggaaatgagccaaaaggaaatggtccaaaaagaaattgaaatgggcaaaaggaaatggccaaaaggaaatgggcaaaaaagaattggcaaaaataaaaaccctttttcaacgaataagccccggggtgatcatttcatacgttgcttcttcttcgtcctcctccatcccgcttgcgtttgagttgctcatttggtcccactccatcgcgttcgcagcattcgccctcgcttccgccgcaaactgcttgctcgcttcagggtgtcccatcaatctaaaagctccattttttacacttttaatttttttatttttaaaattttatttatttatttgtgaacagttccccgtataccagggacggtccgaggattttggcttggggggggggggagtaccaccgctctgggcgacaaactttttttttttttgatttttacaccacttttttgcggcgcttttttggggaacaaggaggccggcggtgtggcgccacttgggaaattttttgactttctattgtagccaaatttttcaaaaatttccccttcgtcgacaaaatctctcactttttaccgcatgcgatttaataaaaatttgtgatggattattaagtttttttctccgtaaaatttccttgtttctagattttttgaaatttctaggtttgaatttcatcttcttttttatgagaaacgacccaggggtgggggaaatggtgcacccgggtgcgtcgcgcaccccttgttgcatgtctgtttggcacacaaaaaaagtagttacccttttaagcttcttcttgcggcccctcgtgcgtcttacgagtggcagcgctctccactggtcactcgtttcggcaatctggtaaaattctattagttttgtgaaccagaatgagtccgccttaggcgacgcctgcagaaaccacccccctccccctaagctttgcataattgagcctgctaatccctgcttgtcggagatacgatgcacctaccccttcttaaaatttaagttttttccgacagacggggtctgactggcatgataagttaaaattaggggcttgactcatttttttccggtggtctaggcccgactcgttgcttttttttcactaaacgagtcgggattgtgtctttttttccggtggtctaggcccgactctttgctttttttttcactaaacgagttgggattgtgtcttttttcgctgggctggcccgactctttgctttttttcactaaacgagtcgggattgtgtctttttttcgctgggcgggcccgattcgttcatttccaaaaaaccttggtgccagctccggccattccaagctgtcaaagccatctccgacgcaacgcgtgaagtagacctcttccgccgcacggccacctagcgacaattgaagcttcgccttcaattgcgcccgggtgtatttgtgctgggccggcggttggaaatggaccgcgcctgcactgccatctctcgggtcagcggctgccgtgatctgaacccaacaaattttgggattttttacccttttttcacgcttaacattttttttttgatctccatttatacaaaataagacacttagagctatcgaatgatttgatagggtaactctggagggtgaatgtgtttttttgtgttgttgaaaaaattagtgaaatgggccaagtccaatgggccctgttacaatttttctttcccggttgtttgctttttatttaaaaaaaataaccttgcgaaactcgtcaacacaatccacgtcgtcccagaggaacttcagatggcccacctcgtgtaggcaaattcggcccggcgtcaattcatccaactgttcgccctcgtcaatgctatgtaaaaattccgcctcttcggcgcgtctttttctttgtgccagttcccgattcgttggcatttccattattaacaaaagaaaatatgaaaataacggagctaaactgaagtgtttaattggctacaacaacctaggggaacggatgcaatacgtagaaacgggtgaattgacaattaaaagaataggcatgaa

SEQ ID NO: 3894 - DNA, 1209 bp, Heterodera glycines
ggatttttaccccttttttcacgcttaacattttttttttgatctccatttatacaaaataagacacttagagctatcgaatgatttgatagggtacttctggagggtgaatgtgtttttttgtgttgttgaaaaaattagtgaaatgggccaagaccaatgagccctgttacaattttctttcccggttgtttgctttttatttaaaaaaaaataataaccttgcgaaactcgtcaacacaatccacttcgtcccagaggaacttcagatggcccacctcgtggatacaggtgcggcccggcgtcaattcatccaactgttcgccctcgtcaatggtatggaaaaattccgcctcttcggcgcgtcttttcctttgtcccagttcccgattcgttggcatttccattattcacaaaagaaaatatgatgaaaataacggagctaaactgaagtgtttaattggctacaacaacctaggggaacggatgcagatacgtagaaacgggtacaagaattgacaattaaaagaataggcatgaattcacttaagaaaatgcttaagacgcaagagttgaaaaagagttagctgtcatcagattcattttcgaatgttgtatttagctcactaagagctttcgattgattgataccattaacgtttcaaaaacaaaaaatccacttctctcgcgctcaaatgtcagcgctcaatcggcccccttcccattaaaaaaaagaattgataacgccaatgtgccaaatttaattgtcaatttcagaaaacgcagccaagaattcgtccgctgctgttccttggtgcgcgttcggttgaactgagcatttttggaggtatcgcattaattgtataaaaaataaaatttttggactgcttttcgttcacttacaaaaaaataaaacaccgtattccccacaagtatttactgaaaatttgattcaattttgttgccccattttgttcaaaagcgatcgcattatagggtcaaattttatttatccctcctcaatgacaagttggacttcatcacagcattagaattgtgacccccatttgatatagacaaatgtggtgaccaatttcattgctggcggcatccacggctcatgcaccgtcatcaccgaccatccgttcgccacggtcaaagtgcgacagcagacaataccaaagccggcgaccggacagacgctactgt

SEQ ID NO: 3895 - DNA, 9542 bp, Heterodera glycines
  misc_feature (8700)..(8700): n is a, c, g, or t
ctgctttccatgcattaattttatcaatattcaaattgtcatcccattttctttcttcttcccatagactttgaaaaataatttttgcaggtaaaaggcatggggctagccatccacatggatcaaaaatagaatttaattccttcagtactaatcttctgcttaatttttcattttcatgtattttaggaaaatttataatatacgtatctcttttaatgcaccaatttatacccagtacttttgggttttcttttaataaacgatctttttcaggtatttgattattcacttcttctgaattggaaataaattctcttatattcatttgtgcctttttgaaaagtatttttaaatttttataatttctgattgcttcagctgaattattacatccaacaaaaatattgtctacaaaagtattttgtttaacttcattagctaattcggatttttcattttctaaatggtgtcttactgttgcacctaataaaaatggagatgatattacaccgaaaggcactcttttgaaccgaaatgcgcaaagattagcttttgttattggtttattaacatctttcaaccacaaatattttacggtatctctgtcattttcttgtaattctaatgtccaaaaagctctttggatatctccccaaagtgcaattttagaaagtcttgatctcattaacagtcctggtaactcaggcatataaatagggcctctaaataataaatcattgaggcattttttgccccgtatttttgacgaagcatcatagactactcttggcttctttccggctaccaatacacaatggtgcggcaaaaaatgttcatcatatcctttaatttcgctttcttcaacaatcccttcttttaattgttctttaaaaatttcgtcgtattgtttgaggtgttcttcggatttctttaatttttcaattatgcttatcatcctacgataagctaaggtaaaatttgtaggtaattcctcttttggacctttccatggccaacttactacgtatcgcccgtcttttctgtaaattgtgtctttaaacatttttaatgctacttcatcatctttttccattgggttatcttttataccaattgtttctaaatcccaaattttttcggattcattttcaatgcattctaatcccattgaagtgagagcacataatttgtcatttccattaatttcaccacatattattgggccgaaaactgtatgtactttaaataaatcttctttaaatggttcaacttttttaaagaatctccaaaattctctcattccaattaaaatgtctggcttttcttcaattaattcaattttgccagaaattatattcgctcttttaatctttgttgttatcagatcgactcggttgacaattatttcttccatacctccttctgttgtttcgagttttattaaatattttggagaattcaaatgtgttggtttactttttcgaactgacaataattctaattctccttcgcttatctttggtggtttcaatttatcgattaattcgtctgtagccatagctatttgacttccattgtcaaaaaagactagaactgattttttcttacggtctaatccatcataactatttattcttttagacatcagtaaaacttctttttcttccaatgtattttttattgcagtagctgctaaatttgaccttggattttgcttctgattagttctattaaagggcaatcggatttctgttcggtttgcacctgttccttgaaattctctcatgcatattaatttattgtggtctccattgcagttaaaacacatttttcctgtgcaatttattttttcatgtccttttttgagacatcgatgacacctgctttgttcgtttattattttcaatcggttttcttgaccaattatttgtctacattttgatggccaatgcgctccgccacataaaaaacattttggattaattataggtggacgtgagttttgtttattatttgaatcttgcgtaaaaaagactctttgtgggtttctttcatcgtttcggttatttctcggctggttattttgccatttattattttgattaccaaactgtctaaattgcttttgattattattccaattttctctttgtgttcctgctgttttattcatccttgtgcatcttgcagcttcttctctcatgcttattatttcctctagaccttttatcaagtcttcaacattccattctcttccgctgtctttttcagcttttagtgcttctaaaattatatttctcggaaatttgttttttattgtcatcatcacataatctttatctccagcgaatcccaaattatttaattgacgcacaactctttcaacatcttctaaacaaattcttagtgaaatagcagcttcattggcctgcggtaaattcaataattcattctgtagtgcttcttttatgactttttcattaccgtaaagtcgctttagcgcatttattactaaattataattttctgctgttggttgataccctctcattgctcgggctgctttgccttttaggcttaacaataaataagtacatttttgtgcttcgggaatcggtttatcgcccatattggcttgaaatgcttgccaaaaaactggccaagacattgtgtctccataaaaatttggccatggaagtttcggataatatactggaggagtctcaactctttctctatttccaattctttgctcattttcattttgatttattttttgttggttgccttgcgcacctaattcaactgataatgtgtccgaaccatcatctgcttcatttactaaaattatttctatttcatcaattgcttctcaaatgttctattataattcctgttttcatttattggtcaaatttttaatgcgagttaatatttataaaatttttgccccacaaataaataaggttcagccccgacccctttgatgagaaaattctcggggaacgtggaataccgggagcagcaggtgcagagcgcaaaattttgtaatcgttccgaacagctcattcagtccacctttaatacaaaaacatgttctatgcctcggataaaatgttagcaattttatgttttgaagaaaaaatattttttattttaattttgattatttttattgactctcttttcagatagtcaataagaattatggtgattttacaatggtttaaatacggcaattttacataggcgggctgacagaaaattttaaattttcgtcgctaaggatgaaattagcgacactccggcggccgacaattcactttctgttccctttgaagttgcccttgtagtgattgttcatctcggcaagtccggcggcaattgtgaccaggagaatggacacggcaacattgtagtcgcgaagatgttcggccaaagcctcgacggcatctgctgcgacggttgtcagctcatgggttcgctgccattgtgatgcgccagtttttccaactttcctccaactttcgcctgattctgccgttgattgggaaaaaggaaatgccctttttttcccattttttgtccgccatttccttttttatttgttgcttaattcattggcccttgctgaaaagccgatcgcagccaattttcggccattgcgcttatttgggtttgtatgagtgtgccgatttcggcttgaatttgaggcgcattgctggttgaaggcgggcaattgaggatgctcatgtgtatctgtgatttttcgtccttttcttcaatggcaccatcatcgcttaattcgtcgatgatgctctcatccaattttttggtgttgtccatgcctttgacatggccaaaaaggatgaaaattgccaaaattgtccatttaataattcccttaagggacatttttctaacttggggttgtgacccttttaccttcaaattcaaaagcccgtcgcctcttttgacgatgtccttaccatggacatttcgctcttccttaaaaatttggcacatagtttcaaattcaatttcatttgtttctccaataatttcaaattggattgtttatgaattttctacagatttttttactgaattttcagaaatatttattttttcctcttcggaattttggtccaaattttctggattttttggtggtttgttggccctttcgatgcctttccaaaattcattaaatatgtcaaattggtcgatgatgcccccaatttctaagctcattaacgggtaaaatttcccatcaactactattcctggtccagcttgggaccacggtaatttttcaatttttaaaatttggctattcaatactttaattgattttgttcctccaaaaataacatcgtctggtttgtccattgacaaaacccaatttttattatttatatgcggtttccgctttccattcttggtgctgtatattcgcgcacctcgttcctccaggatttttacctcattttcgagttgctggaattttttccaatcgtctttaattgtcttggccacttgttcggattttattccgaatatttcggacgctaattttagcaaggaaattttgttcattattgtgaatattttatttgggttaaaatggattggagaaaaataattaaggtaaaaaataggctttttcttattccttttatatccatttaatttatcttcaatttttggttttttgtctttgtttaaatttgacaatgctttaaaaatgttgacaaatgaatcactatatttaatataaattttatggcaatctttgcctttaaattttaatgtactagcatttctattaccaattgctttttgttctttttgtaaatttgttaaatcactcttattcttaatgttcacctttttatttaatttaatcatttctgattcattttcagtccataaaatttttctctttatgaaaaatgctgattcattttcactccacaaaattttgttctttatttcattcataatgtttaattttgaattgtcacattcatgtgaccctccgaacgcaaatgtttttgaatttgcatgattaaataataaaataaaaataatattgttaattaaatttctgctaataatacggtatgcattgtaaaatggtgaaaactttataaatataaaaattattattaataaaataaacagtgctaatgttgaaaaaattaaaattattaataaattgttccaattaagtgcgaatttgagcaaatatttccaatcaattattttaatgttttcaaaattccaatcggattcgtcttcattaattttttctgtgtttatttttcgaaatttcttttcatttactggtacgtaacgaagtgtgcctttaagtttaaagtttgtttggccccctgggcattcgacaatgcaattcatgtttatgtcggccatttcaaagggtaaaatatccttttgttcatgtccattttctgaacattttgctaaaaatattggcccattttggcattttatttctgcttctgcttgaccaaattctgtttggcacacataatttagggttccacccgtgccgcaattgtaacagccgctaaaattagttggttttatgttgcattttgttccatctgtgactattacaatttttataccattaaatcttattgctaacttaactggagaatattcagtctcgcttaatatttttttaccttcttttcgaatatttaattttgcggttgtgaatggtaattttgaaaattggtgaaattggaggtgttaatccttccggtgtaaatgaaaatttactccatttaactgtaagaccaggaaacatggtcaaatctttagattttgtttcgtttccgattgttaatgttaaactcatttttaattcataatcccatccggtacatctaattaattcccaaattgtgtttgatgttggttctgcgtaagttctataaaagaaacattccgatgatgggagtgcgcatttatgaccccaaattgcgtctccttttttacagaaattgtttcctggaaaattttcataatcttccatttctggaattttttcatccattttaatgtttttacatttactttttgtacatgagcccattgttggacagcgtctttttgaaataacatttattttatatgatcgtaaccattttaaagtttgttggttacagtgtaatcgtaaaaattgtaaaattaattctaatgaacccattatttttcctttatcatcttttaatgctaatgaaactttttgtccagcgagtaatattgttaattcggttgttccactgactctacatacagaaccatttaattgtctttcacagtcttcggaagttgactgaattgatattacttcggcaccactgtgcactaaatcaggcattgtcaaacataaaaatagtaatattacaatgcttccaagtctatatagtcttctgttttttctgttttttcttttttgaattttttttctcttttttcaaattcatttaataaacttttctgtatctcatcgttaaattttttgtctaattttgggttcaagacccattttaacgccaaatatggcccataaaaacaaattttaataatccaccatatttttatgataaactttatgataaaacttgctatgcaaataataaaagaaataatacaagttaggccgattcctattagtatgagcgtttcggtcaacatacattcaggatttgccaatttttctaggcaaaataaacatttaattaatttgcatatttctattggtgggcaaataattttatttctataagattttcctttctttgtccagtaatttacggtacaatagtgttctgtaatcaatatttctttgcttaattcaaatagataattatttctaaaagtcggtgatcggcaatgacccatacaacaaatttcaaatttatttatttttgtgggtgtatttaattctattccttttgatccgcatttaatttcacaatctttgcattttaatttgactatgcttttcgttttgttattttcttttgcgtttgtaaatccaaataaatttgaactcattaataatattgtcataagtaatcctatgcctcctcttaataaataatttcttgtttttgatcttgttgtcatttgttgtgtatttttcttttgaacttcgcaaatttccttttcttttatattttcttcttttttattttcatcataactttttggttctaaggaattattcacttcaagggagtatattttgtttattggtctttctattattcttccagtcatttctttgccttttgttgtcattttaatttgtacacttcgaatagcacctttttctccatttaatttaattatttttcccattttccaggtatttctgggatgaaattcgtcctcaattaatacaatttcatctatttttggttctcgtttttcctgtgagtttggtcctttatggaaccattgtgttctgtctcttagaactaataaatattccttatgccatctttcccaaaaccactgcaaaactttgtttgttttttgccattgtctttttaaatgatctgctaatttttcgggttctggattataatcatcatcatcatcatcattgttttcctcctctttttctgtatttggcattgttaatcccaaattcaatccgggatttataaaatcaattggacgaagggctctttctccttctggttcaattgaaacatgagtaattggtctattattcattgtccattcaacctcagttgtgaatgtacgtaattcatccaactgtaagaccattttaccaagggatgctttaaaagcatctttgcaaatttttaccaatctttcggctaaagaatttgcccacggtgctaaagctggtataaatcgccatattattttatttttaaccaaataattttctaattcgtctcttgtttttccacctcttgcttcatatgctccggctacctttgcggccagtcgaaatgtctgtgcgttatcagaaataattcgttttggtgttcctcttctgcttgcaaatcgtcttaagacttgtaaaaatgaataagttgataaatcaagtactggttcgagataaacggctctcgtaattagacacgtaattaatacaatccaaaattttactgttttcccatcattttttactaaagatgggcctaaataatcaagtgctattgattcgaatggatttgaaatttttactctttcttctgggtgttgtggcattattggtaatgcaaatgatggaccattcaattttttgcatgaactgcacatttttataatctttttaacagttgctctaacatttggtgcccaaaattctgataaaaattcatttaaagtactgtcaacttttccatgttttgcttttttatgagctctccaaattaataattctataattggtgctctttttgggaatacaataggaaatttaaaagagaattccatttcacatttcttaattcttgtgtccattctaattaatccatttctatcaatgaatgtttttatagtctgttgtttttcattattttcattccacccattttgtccttgttttaaaatttctttttctgccaattcaaaatcatttgggttaataaattcgttattcgaaatttttcttanacaaaatgtttcggctgttttcccagccttttttagccaaattgcagcgaattttaagacttgcgcaaatattctaacaattttgtcccaatttttatatctttagaaaggtattatttcttctttgttttcaattatattagccatcgcaatttcactggtgatttcgtcatttttggggccttcctcaattttaaaggaaatttcatttggccataaacttatttcttcttttaaccattttgggccagtccaccacaaagaatgtaatttcaattcaattggtgtgcatcctctgcttccgacgtctgtcggatttttttctgttggtacatatctgaattctatttcttggtggctccgtatctcgtgtaatctgttttctacgaatcttggttgatcttcctttgattttacccaatataatacagcttttgaatcacaccataaatattttttatcgatttttatacttaattccttttctacgtattttatagctctaacaccaattagaacgcctaacaattccattcttggtattgttatgttgagttttcgtggccttaatctgcttcttgcatataataaattaatttttaagttgtctgcgtttgcttttaaataaacacatgcggatgcatcctttgaggcatcctttttcttttacatttgcaattaccgtccgaagataagggtaataattattatttgcggctgtcacgaacacaaatttgggatggccagggtatttgacataaaaaatgattaaaattaatgtaaaataaatttaaaaacagacttcattttctctttaattgcgtatttgtcggaaagtttgt

SEQ ID NO: 3896 - DNA, 4914 bp, Heterodera glycines
attcaaatgcacgaaatggtcgttcgttggcagtcgtgcgattctccattcaaaatctattggccgttgtccatcgctctttcattttgatcgtcttttgtgaccacgagtcgctgcagtgtgaattttggtgaaaaataaattttcgatttttgttcgaatttgggtccggggttcgaaacggatgccggattcgtgatcagtggccccaaaaacccaaggagagatgttttaagcgattttaaaatttatttattttttttgaaaaatagggggtacaaaccaaagtattcctacattttttcaaaaaatgcacccccaagaattggaaaattttcttaaaaattcttcccacaatttttttttagttaactatttcgagattttccgtcactaaaagtagcgactctactctgatgatgatgcagtgctggatggagtcggagatgggaacgaattgttcatttattagccccttttactgttgaattgagtttaattttttttttggaaaatgtgccaaaaaaattatttaaaaaattctatttatcccccctggcacataaatggagactggtatattatttttcaacctcctcagaagggggtatataattggaggccggcagattaatggagactggcatataaaaagagtatatacggtattttgcttaataaaatttatttgctttgcttgattgctgtggctttgtgtgtatacggtttagggccgaaacacacataataattaatttaaattatttaacccaaagagacaccgtactgatgaggcccggtctctttcggttaaatttgcacgtttcgcgaagtgcccacttttattgatttttatttttgcactgtcgcgaaatgcgctgcccgtcaaaatgtccctgcgtcataatgtcccagcgtcataatgtccctgcgtcataatgtcccagcgtcgaaatgtcccagcgtcataatgtccctgcgtcataatgtcccccaagccaaaatgagtcaaaatgtccccctctaaaaattagtgaaaaaactgaaaattatataattatatgccttcatacgatctgcttttaaaatttatgctttagcatcaatatagaccgtaacaaaattgaaattctccaaaaaagtcgtaagcgtaagtttttggacaacaacgacaatgagaacgaaacgacttctgagcatcatgaaccaaacgacgaaaacaatgaccgcgacgacgattttgaagaacacgccatcgtgaacttcgaactcgggaaaactcattccatattggaacgtgcactcacatgcggcttctgccctcgcgagaaccaataatggcctcgaagcaacgcacctccatttcgctgtattttttcacttatgaaacctcccccaaaaacttcaattttagaagggtctttgtcaccacccggccctttccgactttatttatgaagtcagcagaagtatcgacaaacaagtggacgcagcgagatcagctcggaacttcatacacaaacgacacaaacgctacgtgctgcaaaacgcagtcatcattcgaattttagcggacgccacatacgacaatgatgccgaaattcacgatgttatgacggctcttggtctgcaggtcaaaggatatgcaggaaaattgaaggactatgaaaattttgatgattcgaccacgcatgtcccttaaaattgttcatttcgtttttattattccttcaattaattagaaaatcccattgttgattgatttttttgttgtttacttgattttgatcaatttttaatgaacatagtatttgcgaaatcaaaaattatataattttcagttttttcactaatttttagagggggacattttgactcattttggcttgggggacatttcgacgctgggacattatgacgctgggacatttcgacgcagggacattttgacagcgcgcccgcgaaatgacatagcaccatgaaaataactgaataagaatttaaaaaaatattcattttttagaatattctctaatttcttaaatattttaaaaagaaaattcttatgtaagttctttgttgagtgttgccttaatgtgtaatatttattaatattgttgatgaaatatttaattaaattatatcagaaaataatatatatgaaagatttatatgtttaaactttcattctttaagcattctaagccaaaattactattttcaataactcgatataatttaagtgcgagtacattaaatttgatataattctcaatataattcacctctaatatattttcattttttagggtagaaaattaaaattatttttggatataattaatcaatattgtgtatttgttaaactttaatttatttatttgaaatgaaatacaattttttattgtgggttttatttattttaactattaaaaattgattatagatagttaaaagaattgaaatattaaattacatttttaatctaaattgagcaaataaataattttatcaatgttggtttaaattactgtctgtggggagcatatcaccagcataattatttttattcttagatattttaaattatatatataatttatttaaaatattttttacataatacttggtttattaatttttttaaaccttttgtatatattaacatattttaaaaaattaatttattcagctttttttaaatttattaatagataattgctgaaagaaaaatataaaatttaatttgttcttttatgtaaattttaaattactctaaaagaattaaataaagttgtttttctttgcttttttgtttttaaattaaaaaaacgcagaaaaaaaagaaaatttattattaatttttttgtcgaattgtaaatcattgaaataaaagtaatgaatttctactagagcctattggtttaatcgcataatatttaagcctccaaaaccaactttaaggaatttgttgaattattaaaaaaataacttacaaatgaattcattgaggatggagtttttcctttcaaaacacagaatatgttaccaattaataattatttattaatttgaattggcctggaccaggacaggaccgcacttttcaaaatcccgacccaaatggccgggaccggtaccgaaacttttgaaatgggaaagggacaaaatcccgggtccgaaactcccttttgccgggaaaagtgaaagattaactgattggttaaaatgccaaaaaggtgaaagatgtgaaaggtgaaaacgaaaccacgccttattagggtcatatttttacatttttttagtatttattttaaaattttcaaaatcttaattagggttcctccgcgacatgtttcggggaattacgaaagtcgtaaattgcaagtgaaataagatggaaaaatctttaaatgagtttttaagacttttttgttatggactttttctttttgtgttttttagactttttatgaaaatttcctccccgacgaaggtgttgctccccgacattttttaaatttctccagccatccccgacaaattctttcggggaatttcctccccgttccccgacattttgctccccgaggctcggggaggaaccctaatcttaatccataaatttttgagacaaaaaaaagcgacaaattattttgaattcacaaaatttttttaataaacttcatacattatgtttaaatgttaattgtgagataataaaaaattatttctcattaaataacaaatgcttagattttttctttttattaataatatctggccaattttaagaatgacttttttggtaaaaaaaatgcaacatctcactagaagtattgtggtcaagtgttgcaaactgtagtttgctgttgtgatgttcattaaggttctaacacataagcccgaattttattttatagaatttttacttaatttgctgctttaattattgttttttaaatatcccgcaggaaaacctgggaatcccggtcccgttttccgtctttttccctggcgggatttttactggaacggtaaaaaaatacggtagtcccattcgggaatatcgtcccgcacaaattcgttttccattctcgaattttttttaattgaaatttaattaattgtaaaatttaaaaattattttttctttatttttaaaatagccaaaaaatccaattaatcaatgattggtcatttttgtagaaaaaatctatttatcatctgttcgggggcggatcattattcatttttaacaataatttaacctttgtttatttctaataaattgttaattcataattttggtaaatatataaaaagcacataaacatttgttttgctatcttttatgcttttctttatttaaatcaaattcattttttcttcttaattattaataaaaacaaagttatgaatatgattcttttcaagttaatactcccttttttaattcttaaaatccaatttctttcatatccaaaaataatgactaaattttgtttgtaaagaaataaattcggtacatattttaattcacatgtaaaattacaaagtattatcttaattttcttttttgagaattttttaatttataaactttaattaatttctttatagtatttacaattgtttatattttaaaatgtttcagtttttctgtaattcactcaccgataacaggtccttttgagtactttatttactaattcatttttgttgtttatttatattttccttataaacatttgacaagtttaatatgaaaatagaaccgaataaataaaataaatttaattatttaatgcattattaaattaattatattatcaaatgaaattatttttgttttgtttattatattcggatgtaacttttaatgagcatttcaaaatatgttatttcttttaa

SEQ ID NO: 3897 - DNA, 3261 bp, Heterodera glycines
tattgttgatggatgttccttatatccccggcatgtgtatgtattatgcaatgtatccccccccccagtattgtatgtgtatgtattattcaatatgtgctttgtatgtgtatatccggtatataaaatatggcatagtaagccatcgataaaatctgacggatagactttgattttgtgtgaatttaaattttgaaacttctatagaataagagaaaaaaatcagagaagggtagaaaaccaactcaactgcgtctgagagacaactctaagaagaaaattttttagcttggcggttgtctcagacgttggcggttccgaaaaccaaaggatggacacttgctttggaaaaatataggacgttcgtgataattcggttgggggcaaatttacgattagcccgatttgtaaagcacatttggactaataattattttttgatcatgaaacacggttgtcctgacaaagacctaccccacaagtaaaatttctcgaaccgattgcacagctttttagaacaaaaactttaatgactcacaaatcaatgacaaataaatacatacatatgagaacgaatagacaatgaatgtgaatcgtattattgaaaaagcgcatgcgaatcgaatggtcttacgagcgcctcgaggcacagacgaattgagtgtccggcgaattgacagtcgcagacgaattctccggcgaattgacaggcacaggtgaaatgacagtctccgccgaatcgagaggcacagatgaaataacagtctccgacgaatgtccgcgcgctcccccgtctcagtgccactgttgggccccgtcacattgccattgtcggcgcgctcccccgtctcagtgccactgttgggccccgtttgcgcttaaattaaaaagtgttagtttaaataaataattttaagggcattgcaccattactttatcaacagaaggttgacggtggtttggtgtctgggacatgataaaaacgaatgatgaaaaagtaagatttcccttctttatatacacattttggctatggtgtggaattgcgggaccaggtcgttttggcgccgacgttttggcgccaagccaaaaatgaaaaaaaggcaggaagaaattgtaaaaattataaaaaaatgaaatttttcgttaaatataataaacttaacaaaatgaagaaatggaaacaatttatgggttcatatgataattgcgcgaaattccacggagaaattctaaaataatatgaaaatttggatttatgtggtaattgtgatcattttcattgttcgggttcaccgggatgtaattctgcaccaaattgaagaggcgctcatcagccgcttggtatttcttagctttccgcggtggctcaagtccagcaagaaatgacgcatacttcccatcggtgcccttctgctcagctctttgatagacttcgtcagaaaaattataacgatttcatcatttctaccccccccccctacatggcgtcaaaacgtcggcgccaaaacgttttggttgttttaatctattttagaaacaaaaagagaaaattaccgtgtttagtaaacaaaaatgcacattgtacacttgaaaataatatttatgagttaggaacacatatgtatatacatggtactgtagaacagcaaatatacaacaaaaaacagagacaataacatcataagacatatataatatatatatatctataacatcggtcaatcatccaattctcatcatatacgcacttcggcaactatttcttcacaaagatgttatggtccaagccggcaagcgtctgatactttgaatcctttactgaaaaggggaggatagaaatgtcatttggagattgaaacacaaaaaaccattgctcttacccggggcttgtggtgccgctttcgctggtgttgctggtgcattcttcacaaagatgttcgcatccaaaccggcaagcgtctggtactttgaatcttttactgaaaaagaggggaccacagacatgagaatttggttaaaatttgaacggtttctcttgccctgaccgagttgttgcggtgcctttgattgctgcggttttggcgctgctgctggtggtgcattcttcacaaagatgttcgcatccaaaccggcaagcgtctgatactttgaatcttttactgaaaatggggacagaaatgcatttggatggaacacaaaaacattgctctttgccctgaccgagttgttgcggtgcctttgactgctgcggttttggcgctgctggtggtgcattcttggcaaagatgttcggatccacacgggccagcgtctcatacttcggatcatgttctgaagggggacagaggacacgaattatttggttggaccatctgcagctgaacattgctcttactcggagcaaattgcgatcccccagcctttgcctgctgcggatttggatctgaaaaatgaatttggttagaacatttgctgacaatgaacattttgattgctcttactcggtgcgaatttggagccggccacctttgactggaaatcatttggcgctggttgtggtgatccggacttcacaaagatgttcgcatccaaactggccaacgtctcatactttgaatcgttctctgaaaatgggaaatgacgggtgtattcaatgttaatgatgttcaaaatccacgcaacactcactcggaacaaattgaaccccagcagcagtttgtgcaggtgacagtgccacgggtacccctccgaccattgtaaattgcgttggcggcggcggcagtgcttccccattctgctgaaaaaaagtgataatcattttgtgaaaatggtaattaattaaaaggctaattctgctgattgtgtgggtgtggcatcaaaaactggcctttttcttacagcaaccgcagcattggctgaagatgatgaacacaacagcgctgacgagcatcaacagaagatgaacgggcagcagcaaaaagacagcggagggggaggaggggaaagtcattgttgggacgacacaaataataataatgaagtgaggggggggggaaagtttgcttatatatccatttttgggcaaataacacgcaaagcaacaaaaaactgataaaaaataattatacatattgcacaaaaacatgtttgtataaggttttcggggcgccgagaacaaatacgggattcatttttgactaattcctgaacccccggactcaaattcgaacaaaaaaatcgtaaaaatttttttttttt

SEQ ID NO: 3898 - DNA, 3441 bp, Heterodera glycines
tctgctggttgtgtgggtgtggcatcaaaaactggcctttttcttacagcaaccgcagcattggctgaagatgatgaacacaacagcgctgacgagcatcaacagaagatgaacgggcagcaacaaaaaggggaaagtcattgtcgggacgacacaaataataaaaattgaataaaaataaaatttaaagaaaaataccgaaaaatgtacgctcactatgggtcaagcccagtgttagacaaaattgctcataacgccaaatagcgtaattggcgtaaatttttgcgcgctaattcaaaaattacactggtaaatgccttttttgtatttttttatttcgatcttccataactcgcttcatctccaactaaactgaacaaaattggtatctaaaaaaagattttgaaaaggggaatctttttctaagcaaatgctaagcaatttaactcatatgaaaaaagttgtgggaatttcaaattttcattacgttataacgcaggtccgaggccgctattttcaaccaaaatgcggaaacgaatcacttttttattgattctaaaagtccaaagtggttttgtactcttctaatcaaaactagtagaatttgcgaatttcgatttttacatgtgctagagacatgaaaatagtacgccaaaaagagagaaaaagaaatatgtttttatgttttgttctataactattgaactaagcgattgttttgtttaaaaaagcgattgaaaaatgcagaatttgtttctctatcggtatgcaaaatttggtgtaggtttaacgtatagaaaaaaagttagacggagaaaagtaaaagttgtttttttacataattaaaatgaagagatagtacgccaaagagaaagaaattacaaagaaaaagagaaacgacgagatagtactaggcttttctctgcacagtggagttgacccatagtgcttatatatccatttttgggcaaataacacacaaagcaacaaaaaactgataaaaaataattacacatattgcacaaaaacatgtttgtataggttttcggggtcgccgagcacaaatacgacattcattttgactaattctgaaccccggactcaaattcgaacaaaaaatcgtaaattttttttttttacaaaacacatttatgcaaaaaagcacttcaaaaagcacgaataacagcttgttcagctgtaggttttataggacgttcgtgattttaaattaaattttttgaaaaattcggttgggggcaaatttacgattagcccgatttgtaaagcacaaaaaaattgtaaattctcagagcccttggggattgggactcccgcgggattcacggttcagattgcattttttgcccactagccagtcgcgctcccgtcaatttttcaaatcccaaatgacccaatcgccggaaaacggacgttcggattaaaactcagattaggacacccagttttttttcaaaagtccacaaagacccctaaaagcacggattaaaatttcaaacacattttcgcttttatttttattcgttttaatacatacagtaagtacagaggcatacaaaaatgacaacattggaatacagtaaatggaggcatacaatatgagacaatggcatttgtaagcagtcacagcgttgaaaatggaaatcacatatacaatacgaataatatacacacaattacaaagtggcaaaatgcatatttttatcggtgaatcaatttctgccgaagtgatcattccctcggagcggctcgtcttagcttgcgggcgggcgcatcaatgagcatggcgtcggacacggcgctccgcaaatcgctccatcatcggctgcacatagttgacgaagcagttgtgcgcaccgtacgtctgcgggaggagcatgtagacgagcacggccgtcttcagcagcagatacagcccgaacggcgcgatgaagtggtcgaccagcgagaagagggcgaacgcgcaccagtaggcgagccattgggtgtcgtccgctgaaaatgggattgggatattaattaaaatcaaaaattggaaaaattttaaactcacttttgctttgcgatcggatggtcatcacgctctggtagaccgggtaacatttgactgaaaatgacaaaaattagtggaggcagtgaagacaaaaaaaaaaagccaaaaacccaccgagcacattgctcacgaagatgttgtaagagccaaacagcaggtagaacgtcaacagggcgaccacggcgaagaacagctgaatggcattgtaaaattagagcggggaatgccttccctttctttacctgctcgcggtccatcccggtctgtcgctccacagtgtcgatgatcggatggtgcaactggtcgagcatctcccgcagcaccgggcgcacatccttgaagctgctgatgggcgctgagcgtggctgaagacgtgtcggcgctggcgggtggcacttccgacgcttgcgttggcggttccatggtcgtctccggcgctgctggcggtggcacttccgacgcttgcgttggcggttccatggtcgtctccggcgctgctggtgacggcacttctgacgcttgcgttggcggttccatggtcgtctccggcgctgctggtgacggcacttctgacgcttgcgttggcggttccatggtcgtctccggcgctgctggtggcggcacttctgacgctggcgttggcggttccttggtcgtctccggcgctgctggtgacggcacttctgacgctggcgttggcggttccttggtcgtctccggcgctgctggtgacggcacttctgacgcttgcgttggcggctccttgggcgtctccggcgttgctggtggcggtggctcgtccgacatttggttgctgctcacttgtgcttgaagaattgtgcggcaagtagattaattgttgttgaagaaataatgggggaatgaaaatttagcgaatatttcgcttatttatatgcaatttttgtctcattatcgccagcaaaaactaatgtgtatataaagaggaaaggaatttctacgaattctcattccctgcttcattattcacattcatttttccatcgccaccaattgtgtgcacgcgtaatttctgaggcatgtttttttgttttgttttttgcaatttttctgattttattttatttttcattttacagaaaaccgacagttgctcacgttcaacaacagcgccattctcaacaacatcgcaccaaaatggcacgccgacgaagaaagaaggagccgcgaaaggtgtcgtacaaggtgcggttgacaacgaaagcaaaatgccaaggaaattgtgtcaatgatttccccgtttttccccctcatttcagttgtacgttcgacgggtgctgaaggaagttcatcccgggcaggaaatctcaatgcgtgcgttgaacatcatg

SEQ ID NO: 3899 - DNA, 1219 bp, Heterodera glycines
ccgggcaaggaaatctcaatgcgtgcgttgaacatcatgaactcgtgagttgcggctgttgctgaaagctcaacaacaagtaacatccgttttccccatttttttcagcttcgtcatcgatgccttggatcgcattgcaacggaggcgacgcgcatggcccactacgaccggcgcaagaccgtcacgcttcgcgacatggagttttcgtgccgactgtgcctgcccgacaccatggccaaacatgcgaaccaaaaggctcagaagacggtgaccaagttctacgctgcaaaagtgcgggaccggatgagaaggacggagatgcgacgtggcgaatttgcgatgatgcagatgggagcgctgtgagcacactcaacttttggacgaccgccggatgataccgcctatatattgttgatgattgttcctatatcccccgcatgtgtatgtattatgcaatgtatcccccccccagtattgtatgtgtatgtattattcaatatgtgctttgtatgtgtatatccggtatataaaatatggcatagtaagccatcgataaaatctgacggatagactttgattttgtgtgaatttaaattttgaaacttctatagaataagagaaaaaaatcagagaagggtagaaaaccaactcaactgcgtctgagagacaactctaagaagaaaattggggacgaaacgatcattttggagtgtatgggtgtataaattgcaatacaatagtgaataagtatattaaaatttatatattcaagcatctttcgactttttcacgaatttttagcttggcggttgtctcagacgttggcggttccgaaaaccaaaggatggacacttgctttggaaaaaatgtaggacgttcctgattttaaattttttgaaaaattcggttgggggcaaatttacgattagcccgatttgtaaagcacatttggactaataattattttttgatcatgaaacacggttgtcctgacaaagacctaccccacaagtaaaatctctcgaataaattctaaactgctacaaatgaataaaacatttattgtatcctttctttgtacatacatagataagtagggatctcggattctctcttaaacatatcttgaaaaatgaaaatatctcaaaaattgttaccgtttgggaaacatacataaatagttcacccaccacccaacagtgatgtaatggtaccgcg

SEQ ID NO: 3900 - DNA, 5183 bp, Heterodera glycines
tttttagttcatatttcaggcatttttagtccataatttatgtccatatttgggggtttttagtccatataatttcgagccctattaatgagtagagggctccaattttttgtttttatttttatttttagcacctaaaaactaaaaaaattgaaacaactattttggcattttgccaaaaatttattaacaaaaatgcaaaataaaaacgaaaaatacgccagaatggggggcggaagtttgggcaccgggaagtttgggcaccaggaagtttgggcaccagaaatttgggcaccgggaagtttgggcactaaatttaggatttaaaaaataaaattatttttaattgtctataaattgcaaccatctaatttaaaagcatagtaaatttaatcaagttacgaatagaaagtttttttaacgaatattcactcgattaagcatgcttattttgctaaactgattaccattcattctataaaatgccttacatatatatgtattatttgtatcattacaaggctcagtatgttcaagatttaaaatttataaatttaaatagtattagacgggtctcttgtcatttcgggcccaactaagacggtattcagggtctaagtccataaccagtacatgtttaattctacgtttaaacaaccgtaagaattgactaaataataagaatgccaggtttccatataaaaactttttaattttcaagaacatagaaatttttgagcacaagggttgttaaatttactaaattttaatgatttatataacattttatatatttatattgttttatttttttgaaatccctccctctggtgcccaaacttcccggtgcccaaatttctggtgcccaaacttcctggtgcccaaacttcccggtgcccaaacttcatgtcgccgggaagacaaccagtaaaaatatttacattttgccaaatttttacaaaaaaataaaaaacggttgaagatgatacgaagtccttaattaaatcatcaaaacttgacaaataactagagttgacgggaccgggaattttgacaaaaaccggggccgggacttaccgggaccagaaaagtcgggaccgggaccgcgaaaaaacccgggaccgggaccaaccgggacttttcccaagtgaaaattttttttgaaaaaaattgaaaatttaagtgcactttgttacgaaaattgccaatattcaaaaatgtacccataaaattttgtatttacgttttgggggacgagttctttttaaaaatttgttttcaggggtgttcttggaattttcggagtcccaaaattctggattttaaattttttaaatacctctttttgtggcactgttttttcaaaagattttggctacattgtgggcgagggtccggcggtgccgataggcgccggaaaattttagaagtttgagtgaaatatgttaacagaatttgccaaaaaatgaccgatattttggtaaatttgcggttttaggctgtttaagaaagacaaaataataatttttaagttgaaatattttttattaattaaatttaaataaagtaaaaagattccttttccaaaactttttctgatcacagacagcgacggttctgggcccgctggaaaaatgtctttaagccattcattcggatttttttgtctttctgtaagaaatttaccccccccccaccgatattttggtaaatttgcggttttaggctgtttaagaaagacaaaataataatttttaagttgaaatattttttattaattaatttaaataaagtaaaaaaatataaaaaatgttctatcacggtggggaattaaacccaagagacaagtaatgaaggacagaaggtatagccactacaccacataatgatataaaatcttttttccctccatttccttctcttttctcatcagacccccattcttgccagtgcttatttagtcccgccgggaccgggactggcaaaaccgggaccgggatttctgtttttccaaaaacctggaccgggacctgaaaaaaccgggaaatcccggctcggtcccggtcccgctcaactctacaaataacctttggttttttattcaaaatattttcatatttcgcaaaaattgtcaaaaatagcctttttaatgtttgaaattttttaaatttaagaaaattttttgtaaaatcccaaaaccccctagcgtacacatggaactatcgaaaatttaaaatagatatatattttttttttgttaagaaattttaccaaattcattcttcagttggtaaatttcgtcacgcttaactcccaaacttcccgcaatttctctttcaatttgaaactttttcttcgcttcatatttaaacccataaattttttcttttctcatttgatcaaatgttctgatcagttccatttttgtttctgcagtttcccgctttttcttcttaatttggcccattttttgctttaagttacaaattttgttgtggtttttgcccaattttttggcatttttttccaatccatttcttctttttacattcttaagtatataattaatttctttttttttgtaatatatttttaagaatttatattgtaattaagtcatcgtttgtatggattaaaaatttaaattctgaactctaactcggtaaacatagataaatttggtatcatttgatagagcagggtcgacttttatttattttttacgcccccataaaaataaataaaaaatttatgaggcctcaaaaaaccgaaatattgactcggttttcgcttcagcgatggtggtcaagtgagaaaatgttcaaaattttgttcagttggttgaattcgcatttttggatgtccctgttttatttcgaacattaaaataaataaatcttaataatgtataagaaaactaaacaatttaaaaaccatttttattttacaaaaaaatctttgataattttctttaatgaaaatttagtaaactgcaaaggttcgggaattaatataaagtgaacaagatagtgaatggatctcagacacgaaaacttcggtttttgaggccctctctttttgatttttttttcctatgggcgtgtaaaattaaaaatctcaagagaaatcgaccttgctctattcaataataccaaactaatataccttttccgagtgatagttcggttggttcccgtaattttcaagttgttttcaggctgagaaattacggattttataaataaaagaaaaatttgtgaggaatttttaattgcaatttgagcaaatttttgatccattccaattttggaaattaattttatttaaaaattcgctctaattcaaattcagaaaaaaaagttcactacaaaacaacacgtaaaagatcaatcccttatatcgtattacagtatgccctgctgttgttaccgtttcggtgtaatctaattcctcttgttcctttgaacaattactgtgattaacagaagaattactctgatcagcagaagaattactctgatcagcagaacaattgcaaagaccagcttgttgttgctcatcattttcattttctaatgcttctccgttccattggtcggattcaatttttggcaattttatttttattttcaatttattattgtatccatccaatgattccgttttgattttttgcgatacttttggctttatgttttccgtttcatgttcatcgcaattttcagatttaataataattttgttggcattttgttgttgataaatttcatttttaacagcaatttcttcgtttattgaaaaatttttggtgattttttgtttttttaagtttctcgaagtcgaagatttcaagtccttccataaatcttcatcaattccttcggtaatgataataaataaaatagttaataaaattattattaaaaaaatcttcataaaattatttttttgcatttttttgattcaataaaacaaattattatataataatgaatattttttgtatgttttcgcatttataacacaaaaattgattttcaacgtgaataattgcgcatgaatacaatatatttatgataaaaaaatatatttaaatcggaaataataacataaccaattatctcgaattacacctaattaattatgtgttatttttttatgcgaacttcttaaataaattaaaatcaaaattttgtaaaaaaaatttcaataataattattaggtaacatttgttaattacaagagtgtaatgagatggtggtaatataatgaaaaaacaaaatttagaaaataattccgtttcatttaataaataatcatttttctccagaaaatttaattcaacagaatgcaaatttttttgaagaaaaattaaatacccttataaaatttcaaattttttttacaacattcaaaagtgacctttatcatggacattaaatttgtccaaatattgaggcttaaacagaagagatctttccaaaactgagtctcatttcggagcggaaaattcttgaaaaatcgatagttttatgaaggaaagtcgagtaaaaaataaagaaaggaattttctgaaaattttttcggcgccgttgctaacaacttttctcattatcgaccaaattaaatattttggtatcattcgatagctcttaagttctctataagcatgcaaaatttaaaaaaatttcgtcagtttataaaaaagttatgtccaaaaaaaaaaactcaaaaattgactttttcttggctttttcggcgccgcgtgccataacttttttaattttgaatcattcatttctattttgacatgtaaatatagagcacacatagagctttcaaatgatgccagatttgctaactttaactgactaaaaaaaaagttataacatttcaaaattggcggcgccgaaacagtccgcgccgaactgaccccgacccatttaaacatgcaaaaaattttagggttatcaattttggttcaaaagcacactgaaagcagtctttcgcttttgcgaatgtaaatataaaactcgagagataaagttattgtgttgatttgtaagagaaaatgtaggctcttcccccataaaattttttttttaatttctaagtaaaaaagtcaaaatataggttttctgggtcgctgatcacgaatccgacatccatttcgaaccccgaa

SEQ ID NO: 3901 - DNA, 2110 bp, Heterodera glycines
  misc_feature (14)..(14): n is a, c, g, or t
ggatatcattaccnaatagtttgtttttttttttttcaaatgataaatgtcgacgagtagagaaaaacttcgaatagcaatttttatatcttccgagggattaatggcaactcgtacaaaaattatttttacaaaataaagcctaagcctatgtacgagtagactttgtatggtttccattatgtacaaattgtcatgactctcatttccagagcgataattcaatctttcggagtaattttctatacatagattttcgagagtttctaaaatagaataaagcattcattgaactcgatattttttatcgtacaatttattttcccttttcatacaatttatttttcgttttatttttgttattttgtaataattgaatcattcatcttccaaacacagaaaaatttattgccaggaaaataattatgcataaatttactgatttgggtgtcaatcagcgttttttttgctcacatcagtgatgaaaccgcattacattctcattaaacacaagagatatgcatcgaaaacagaattgtacatcccttcccaaccattcatttcatttcattttggacaaccaatttatttggttaataataaataaaaataaataaaaacgatttaaaaataaaataaattttcatatgtttttagataatccaagaaccaaccttaaaatgaagctcatccttcagctcaatgtcttgtttgcgtgcttttggagcggtaattatacaataataatgattgatgatcaattttaatgacttttaaatgttcgtaatttaatttttacaaaactgttttagcaaaattgctcatttgccgtgtgggactgtttggctccgttgataaaccctttgttcgtaaagagctcaattattctacgattgattgccctgcaaaagctaaattttgtgtgaaagaagtctgcttccaagatggcaaaggtagaaaatataataaacaacacacgagaaatacaatacaaattcattgaaaaagagaagtcaaattaaaagttttgaattttagtggaaaaagtatcaaaaataattacctatataataattgggaaaatttcaaaaataattataataacatggaaaatttgaaaaataattaattaataactgggaaaatttgaaaaaaattatttaaaaactgatttcaaaaatgattatttttaaagggaagatttcaaaataataaatcaataactggaaaaatttcaaaagaaaattccatttatttatcgaacaaagtacagagtttttttttaaaaaaactctccgctcttaataaattctcatttgaatggcaaaaaacccgcatttaacaaaaaataaaaataactttcatttttaattattaaatattacaaataaaacaatttttgtttgtttttttaagccgaaaactatgtgaacatttacgcatgcaccgatgttataaaagattgcaacactgatggtactagcttaatggcatacagggagtgcagactaaaaaataaaggaatcaaaaacgcgtgtaaaaatgagaaagaaaagaatgaggccgcttttgtcaaaaaatatggcagcaattaccggtgcgaacagtgccaatatggcaacgaaaatgaagacaaaggcaacgagaatttcgcgccgtacaggccagacggtatgtagaataaaaattggatgtttttttttaactaatcttttggggaataatgagaaaaattgttttcttatagcattaaaatttaatttgttgtctttaaacattttttcaacggacaaaattggtgaaaattttgtgaaatcaattttaaatataatttacaaatgtaaaaatttgaaattttgttagtgtctcttttttaattttagccgatttaattataatttagattaatgaacttttcaaaaacattaataaatttattcatttttttctttttaccgcgcctcttccgccaaagccccgagatcgcttccactggtaatatttttcttttcaattcaattttcttaattttaatttttctttttgagaattttttgattattttcattaatcttttgagaaaaaaaaacaaaaaaattaaaatttttgc

SEQ ID NO: 3902 - DNA, 862 bp, Heterodera glycines
aaccgaatccccacgccacgccaaccacttcgaaaaacaccacaaacagaagtgcaatgcccgatgctccataggaatccacctgagttgggtattttgttggttcgagagcgaaatccgtccccaggcatatttttgaaaaaaatgtaaaaatttggaaaattacaaaactaaaatttgctcaagatgttcaaatgaggaatcaaaatgtgattttaaaaagtgttaaataagtattttttagactttatttaattataattcaccagcgtaagccaatgtgccccggcataagtgaccatcggaatgccaataatgaagaagattatgcaagcaacaagaagagaaagcttaatgaaaacataaaaaaatactttaaatacttttacttttttgtgttttagtaaaagtgttggaaaagtgtcctcaagagcagtgaaaagtccttccaccatgcaaacctgtaaatttctgaaaaataaattgcaaaaatgatttttaaatgcctggctgtccagcccgagaattgtgatcatcagaaaaaacagaaatgcccaaatctgcttgaacggcaagttactggcaacctcaggatatgccaaaaaggcaagtccaacaccttaaaattaaaaacaataataataataaatgccaagtaaagccaaccgggcttcacaatttcagcgattggtttttttgcagactcggacaaatggccaagaacggaaaagatggcaaaaccggccaaaattgaagtcattccattgataacacacacgaccatcgcatcgctatgtaaataggtttttatataatttctctcatttaatattaaaagtaaaaaaacaacaaaataaaaaaa

SEQ ID NO: 3903 - DNA, 5802 bp, Heterodera glycines
  misc_feature (3429)..(3429): n is a, c, g, or t
attaattattaatatggacctgtcgtgtcggtcacttttgtgatatttggtttcagataaaatataatgcctttccctgcaccctccaaagttaagccacggatgagcaaaacaaggatcagaaaatatgggaacagagcacagaagtatacaaactttaaagtgaaaaaacaagagattttattttaataaaaagaaatttgcattttattttgtgcccaattcagtccccgtgactatcaaaaaatttactaaaataattcaaacaaaaactttttggcatttttggcaaaggtgcagaattgtggtcccgatggggaaaatgctaaaattttaaaaagccttttttctggggtagaaaaatacgctgatcacgaatctgaactcagattttgaaaatcattgattttgtctatgactttttatcaagtacttgatttttttttaatttttaatcttctgtaaaaattttcttttcaatgaatttgggataaaaaaatatgctaatcacgaatatgggctttgattttgcaagaatcttcgttttctccgtgatttttcaacagcaatcataaaaataataaatcgcagccaagcggactcgaaccgcagtcctcgtctcataagacccatagggattaataattaaatttcaaaaaatcatagaaaattaaatacttgacttttcaatagattcaatagctcattggaaagcgctttttaagctctacaacatctgtgtatgagttttttacgcccattaattttcttaaaatttttggaaaaaatctagcacttgataaaaagtcatagacaaaatcaatgattttcaaaatctgagttcagattcgtgatcagcgtatttttctaccccagaaaaaaggctttttaaaattttagtaatttttcccatcgggaccacaattctgcacctttgccgcattttttgtattcggtcacaaatcaatggcatgtgaaatgaaacggcacctttctcgcctgggtgatgcccttccacaaagcgaaatatacgacaacccatgccaaaaacatcagtccgagcaattcccattggatgccgccaatgtcgtcaattgacgcagtttgctttagcacacgacgcctgaaaaaaacaattattgggatttattggagaaaattgacactttttagagaaattccaaagaaagtctaaatgtttctccaaataatttttaaaatgaaacttttttgtgctttcctccagaatgctctaattaatttttggtgatttaaaatccaaaagccttttttgaatgccaataaaaaataagtctgttatttaaaaactacttttatttatttatttatatttttgctttttcctttaaccgcttactcccaaaattgttcaacggatgactcaatggtcagtccgtacacggacaaatttgacgaaagttgctgtatgtccgtctcattttctttccccgacacacattggccattgttccaccaattgttgcacgtttcccctttaaaacacgcaaaaataattatttatttattatttaaaaaaaattaaaacgaacatggaaatggtgaattgaaggagctgatcatgtaaaaaacggcccaagaaacaatcacacaaaaataggcaatgcacatgaacgaaatgaccacattaccaatgccaacacctggaaaggcaaaaaagtattatttaaaaaaaattataaattttattttaaaattcaatgcaaaaatttatttacctttgaaaattggacacattttccacatttccattgctcctgaaaataatttaacaaaaaatgctttaaaggcatactgtaacctacctttctgtaggtactgaccgatcgtaacttccatgatgaaaattggtacagcgccaaaagtgaagaaaagcgcataaacaacgagaaaggaacctatgagcaatttaaaagttgattaaaatatttttcgaattaaatccattaattaacctccgccatttttgtaacaaaggtacggaaagcgccaaacatttccttaacataatattttttaccgaaaaaaaatcaaaatcaattaattaattaaccgaggccaacagcgtacgcaatcatactcatcagaaaatcaaaccgtcctataaaaaatgatgaaaattaaacagattaaatttatcttctaataaaaatttaggttttcattgaaaatttttctaaaatgtagtgtattttccttgttcattttgatttttaaatattaacttttcaacagctgggttgtctgtccaaagaaatgtcaagttgtctgtacacaccgtccgaaaaaacgagatgtgtaccaataaatagagagtgccagagaaaaacattatctttttttctctaattttttgtctccttttggcgtactatctaatatttttattattaggaaaaacaacatttacttcgctatgttagcttcttttctatatgttagatcaacaggaaattttgcatatcgttagagaaaaaaattctgcatcgattaatgctgaatttatttttgttaatgctctatttcaaaagttataagaaaaacaaaattttaaagcctcataacttttctctggtacaccaaatcgcttagcatttgcttagaaaaagcttctcattatcaagagctttcgaaagataccaagattatccaatttggttggcaaaaaccttcaaaaataattcccaaatatcgtgattttttaatattttggacaaaaataaatgaaaatattcatgttgcacaacggactcgaaccaccacccgttgtccctttactatcttataaaaaccactgagccacgcatgcaaatcttttctggcacaggagctcatttcccggacgctgtgtgtaactaatggtccagcagaagccacaaatattttaaatgaataaaacttcggctctactgcagtttacgcgtcaaatcaatgaccacataggccataacttatttcttacttggtatcaattgaaagcttaaagcctatgttttttataactaattattgtgctcaagactataaacaaaaaattttccaaaatattgttgaaaaaaactgaatttcggatattctcattgtaattctttcttaatgtctttattttctcttttcttgttatagattcccgaaatttcaagcttttgtttgataccaagaatgtaagatttgactaattgtaagttagaaaaaagttgtggactaagaaaataaggatggtcactgattagacgcgtaaactcagtagagccaaaacttctgtgtaggttaataaaatcggtgtgtaagaaaattaatacatttaaattgcattttttaaatttattttttatgctttcttttccagtcaaaattccaaatagtctaaaacaaggcacgcaacctttntaaaatttaaggtaaaagaacaaattacccatccaaaaatattttcaccttaatttgtaatgcttattgttgctttaattttccagtttttagtgacaattatccattcagttaataggggtcaatgatttagtatttacataattttaatttaaaatgtaaagttcaaattatcagagtttacccgtccattggcctcggtcaactgattcggcgccatgcatgttgtgtccaaaggaataatgaacacaaatatctatcgacaaataaataaataataaatctgaggagaaatgaatgaaagagagagaagcaaatcacgaatgaacaaattgtaggaatgaatgaagggagagcaaaatgtgaagggcacggtcactatttatacactccgccggtggttagagagaaaagaaatgtaattgagaaaagtgagtctgttcgttttggcgccgacgttttgtcgccaagtcaaaaacaaaaaataacaaaacatcgagcagaaaattcaaattttaaaaaggagaaggatccatgtaaattacaccaactcgatcagatcactccttcatagtgatctggagacctaaaattcacctaactagggttcgacctatcctatttggcttttcgggtgcccacaactttaatatttgggaaggatttagaattggttgaaattgatgtcagaatcctgatcataatcctgaaaacctctattagcaaattttaactgtttttaagataaacaaattttgcaaaccaaaagagtattacataaacaaaagaagaacaagctttaaatttataagcattcgattagaaaacattctcaaatttaagctttcaaaaaatggtaatactggagaatctgggctccacccaaaaaaattatttttctgctaggaaaagtccaaccctggggtttacggggcttccgatcacgaatatgatatcagagctgcaaaaatcattgattttatcatgattttgaaaatcttagatttttcgaaattttgatgaacttgatcaaatgctgcacttttttgagtgaggcaaccatatatgatcagtagggcagcaacttttagtgaaaaaacttttttttttgctcaattgttttgaagaaaggagctcaaaaaacgcatttctgcgttaaacttttttcatttggacgtcacttttcgtcactagaaatcactattttggcgttttgtcactaaaatagttaaaaatcactattttggcgttttgtcactatttcgacattttttggaaaattactaacaaaaatgcaataaaaccaaaaaatacacccctaagaatcgacctaaaatttttcaaaatatactcctatgaaatgaaaaaaaatgttctcaaaaatttactttcttggcaaaaatttttaattttaaaaatttttttaggtaactattttggcttttttggtcttaaaaatcccagtcctactcattgaataaaaattattttggcttattttttggctgaaaattatgtcactatttttgactttttgccactatttcttcactattttgggatttttactcactattttagttaactatttcgggatttttcgtcactaaaagttgctgccctaatgatcagcactatttattaaccaatgagatggtcatagaacaattgcataaaaacataaacaatcaatatttaaatttcaaagatctattatttttaaaatcaatgttaaagtcaattatttttgcaaattatgatatcatattcgtgatcagaagcactaaaaacgccgggttcatttcttcacaaaaaaaaaattttggtggagccagattcctcccagtatttacccccaaaatataaaaattatatttcgataagtattacaacggacactcttcacattaacattatcactcattggcagtttaaattttctttattttataacaaattggtgaggaaattgaagagggttttatggaattgatttggatgtgataaatggcacaaatgttttccttcgggaatttcaaccaatcgactgttgggcaaattcttgagtttgttcgcagaatttatgcctaaacggaagaactactaatagtttatcatcaaaaacttggataaccaattgatgtgtcgaaagcgcctcggatgatcagacagggactaaatttggtttctgttcaaaattttttttggtacttttacagttctgtggctatgtatacaataaagaatttttggtcaaaccccacggtcgctttccaagtttctccatattaaattccctaattgctcccccacatctattttacaattccgaactgggaatcaacattcaaattttcggatagaaaatttaga

SEQ ID NO: 3904 - DNA, 1139 bp, Heterodera glycines
  misc_feature (19)..(19): n is a, c, g, or t
atttagaactttgtacctnttttttattaattcatgcccttctgtcctgaattggtcgaaatgggtaccgttttttaagagcaaatcattcacaaagcatttcaatttgtagtcacaataccaaaaaagtgaatgttccaacaatagtaattcttacattgggttattgaccaattcttccacttttagtcggtgagtgtccgacacgccaattgcaatgaatgctttaacgtggaaatgaatgtcctttttcttaattccacgagaaaggaacggaatgaggtaaatgccggacatcgaactggccacaagcacaacttcacgtgctccgatatgtgaagttaagttcagcaaaaaatttacattttcctcctcgtcaaaaacaaaatttgagaggtgaggcgcaacacagcaaaagccggaggccgacagaatcttaggaaaagcgacttaaacaaagggaggggaaagtgcgcacctgaagagttttccgccaaacattggcatcatttgtttggctaaatgacttctttaaaatcgtgaaaacaaacggtgcaatggcaattcgtacagttgaagtaacattaatttgtaagaccatttgttttttggtacgaactgccattgacccaccaaaacgcactcgtgcaacagcaaaatgtaaggaggcaagatggggacggagactggcggggaagaacgcaggaaacgaattgtgccgccgccattctgctgatccaataaacaaatcaatgccaataccaccagaaaagtttttggccggcccacaccattcccaattcccacccatattttctaccacctctgtaatggcctcttccgtgacattcaatccgtcagccaggcaatccaaacatttaggcaattcaatctgaaggtcgattgatttaatcgtcgtgctcaaagttgactctaatttggtgtcattgagcataacaaaaacggcacaaagctgtattttaatcatacacataaatcgggagttgagaagacagaacaagctttggtaaaaacacggcaactcataaaaacgaacattcgaatttttgaaaattgccaaatgaggaacggacaaacaatttttaggctaatttgccggtgattgttcttcacttttg

SEQ ID NO: 3905 - DNA, 1389 bp, Heterodera glycines
  misc_feature (47)..(47): n is a, c, g, or t
cgttcgcccacctgttccggtctcggcttcgtctgtttctgtctcgncttcgactctttcccctcttttctctgctgcgcgaccgtcgctgctccctttccttctctttgctcctcgaccgccttctttcgcgactccgcgaccttcgtctcgtccctccaccgtatcgttcgtcctcatagccatacaattttgcacgttcgccaaatttgctttcaatgtccttttggattggcacaggaattcgaggaaaaagcgtgccatagaaatccagctaaaaacatacgttttgataaaaaaaagtaagttatattttaggaataattagtcgccattcattgattttttcgccaaacaattcgaagacattattatttttaaaacatactaaaaaacaacaatgttaacgcaatatcctttaaaatttaaaagtggagctcaattttccctatttttgctgataaaaaatataataaacaaatctgttttaatttcgaaaactaaattttctgtccatggtaaaaatgtgagaggacgagttgctccccggcaccaattggtctaaaacttagtaggaattttgaagaataaaacgctctaaattttatttattttgagaatttctgtgcatttgccttcgaaacttttcctgttgaccttggtgagcatcatcctgacaagctgtcccatttgcattgtgtcacctcctcccgaacgtgggtcaatctctgcgtcgtcgtcctgcaaaaagtgcacatttaaacaaacaaatgctaatagcagaccaaataaggttccatccaagcccaaagatcggcaggtttttgcgtgtatcggatgtacataaagccaattcctcgcaagtaaatcgactgacgactgtttatcatggccaccaattgtttccgagtgactcgtaaagtgaagagtttgtacagcagacaaaacgctgtagagattacgcctcccgctccgacaccacggaccctaaattttgggggagggcataatggagttggcattagtgaattattatctaaatgtcacacgaaccgtccataatgattcagttcggaataaatggttaaaattactcatgaaatttagaaactatcccttctaaataatggattaatgaatacagttaataaatcttttcaaaaatgtattttgctatagaaactaaataataattttgttgcctggttttgcttgaattctgatgtaaaatcagacaatgaacatctctttaaaggatagggccaaaaggggcccattgaatgtaacctattgcttccgctcacccgccacacattcccgtcatccccgtcgttcggcgtgtgccacgctcccatggctcgagatgtttgacctgaaaaaaggaaaaat

SEQ ID NO: 3906 - DNA, 938 bp, Heterodera glycines
cactgtacgaaacggccgaggagcagcactacggtagcaacaagagtggtacagtaggaccacagaaagaggcgaaaggagtgcaaatcgcatcaataccagaggtaaaagcaaaacacaaagccaaatgctttagtggaattttgaaaaggtactaaaagcaactggactgaaccagcaggacagagaagcacttttgcaggcattgatggaagtgacggggacaattggacacgttcagcaggccatggaactgctgaaggcactcaatttctttggtaattaaaagcttggaatgtttaataattgtttgtttatttgttttgttttttgaaattgaaccggagataacggaagcgaatgatcgcattttggcagcgtacacaaaaatggaaaaatcgtttgaaagtgcgcagaaaagggaattggacgaggagggatggacattcatcagaagggcacagttcgaccagctgtgccgggaccaatgcaagcagaaaaaaaaattaataaaatgccattatttgaagatgccgaattccccgacaaagtgaaggcgaaaatggccgaatttgatggactgcacaaaagccaacgtgatgaagcggtgtggaaacgaatagaacgcatcgccagagacattccagaagtgaattcaaaatttaaattcaaaagtaattaaggagagcaattaaggaaatcgcggacaaagtggacaaaagaaagcgccaaaagattgtccgtttgcattttagcgccaaaaatcggcggcgaatgaaaaggcagcagccaaatgtcgaaatcagtgggctttctgtgctaaagcccgtcgttttggagccgtacatgttcacgccgatttacgggtcagtttttttcaaaaaattgaaaataattcactttttgcttaatctttctgtgctgggcccgctgatttt

SEQ ID NO: 3907 - DNA, 2588 bp, Heterodera glycines
cgtaattttggccccgtccgtcctcagcccgtgggttctgtccccggccgcgcccgtgccgtacattctgtccccctatgttttcggccctttcattctttcgccgatggcaatggcaccatttatcgtaaaagttaatccaatgttgttttaaatagcaatgttttcagcttactccttatgtgttgtcgccaaatgtgctcaatcctttcgctttgtcccctttaattttgagcccaacggttaccaatattaattaattaattgcgtttgctttctatcgccaattaacccaattaattaactgtctgtcattgttttaaggtgctcagtcccgacattctgtccccacagattttgggcggtggcattttgtcgcccaccgtcggctcaccggcggtgctcacagaatcggctctgatggcctccgttctttcgccaagcgttctgtcgaaaaaataaaaataacatttctattttatatattttttaaattatttttatttttttcattatttttttaatatttctctttgaattggcaaaatatttctttggttttgttattattttcgtttaccaaaatataaaattccgtcgtaaagtttaaaatgagagaaatgcgatgaaaaggagcggggaaatttttcttctgagcaaatcattttctgttttatgtttacgatgtttttgagtaataataataatgaataagaaataacataaatgaatcaaaggaataatatttaaaattataatattgtaacaataattttattttatatttaaatttaaatttgttttaataattgatcaattgagattcagaaaactttttaaatgatcttttacactttaatttatttaatacctaatcattttttgtctctttgagtgaaacaaagagataaatgaaattcgcgagaaaagaaacgcgacagattcggtaagagagaaaaactcacaaataaaaaaggaaaaaaataataaatctaattagcctattttttattaatatgaaagtaaaacgcacagaatattttgattttgcatccgaaaatgtaaattttgctcaagaaaaatgttgtgcaaattccaacgaattgtaaaacggaatgcgaaactcaatccgatggacgcactcaaaaatgcacaacgaaatgccaaatttcaatgccatttcgaatgcttagccaacagcaaattcaaattgtaaagatttccattaaattatggcaatttgcttaccaaatttatacctttttcagccaaacacgcaaataatcagcagaatgagtgaaactcgcgaatttttgcagatggacgaatgtgtcagattttgtcagggaaaaggcatcgcaaaaacggcggaggaatgccgcaaaaagtgtcagcccgtgccaatgccgacggggacggaagcacaagccaaaacggaggccattccgcagctaacattggttagccttaagaagaaatggccaaatgatcattgaattattggcagaatatgccatttgtgagcaaagtaacggaaacgcatcaatttgtgggcacattggaggattgcattgctttctgccagaagaaaggcatcggaaagtcggcggaggaatgccgtggcaaatgccaaccaattgggacaacggttgtgacgcaaattgtgcagccaaaatgagaagcggacaatgccacagaaggacagaaacgggaaagcaacaacactttgtcatctaatcaatttgcttcttttttgtccattaatcattttgatgaaatttaatcgctttttaaacgcatttaaaagaacggcgttttccaaatggcgatttgggcatttcattcattttaatcgcaccctttgaagcctttttgatgagaagcgataaagcgagtccattgcttatttattaatgcagtcattttacaaattacaaattaattttagtttttggactgctctttccccccttcccccattattttagtctcgaaatagcatcctattttatgacttcaactcacaacaaaaaaattattataattaattaattgcatttatataataataaattttctattcaaattctattcaattataacaaatgaatgcccaataaatttattggcataaattcaaatcaattgttagtattattatggaattaatgtgaaaaaaggaaaaagtcacgcaataaaaggcgaaaggattctataaataagacattaatacgaaagattaaatctaaaataagccaaagccaagcaacaaattaaatgaaaaagggaaaatgccaaagaaaaggcgaagaaacccttcaggggaatcaaatgactctttttgatacatttctatgcaccaattttggctttttaaacacttaaaacgctctctgctgatgtcattaaaataaatttacattaaaattgaatataaaattaaaattgaccgaattatttcaattaattatttggtttattttaatttttttaatattttctcttggaatgtttttgctggatgaattcttctgcttcttgcgtcgaaataagcagcttctgcggctttcattgtaccaaatcaccag

SEQ ID NO: 3908 - DNA, 2711 bp, Heterodera glycines
  misc_feature (2127)..(2127): n is a, c, g, or t
  misc_feature (2129)..(2129): n is a, c, g, or t
  misc_feature (2138)..(2139): n is a, c, g, or t
  misc_feature (2172)..(2172): n is a, c, g, or t
  misc_feature (2223)..(2223): n is a, c, g, or t
  misc_feature (2253)..(2253): n is a, c, g, or t
  misc_feature (2280)..(2280): n is a, c, g, or t
  misc_feature (2318)..(2318): n is a, c, g, or t
  misc_feature (2341)..(2341): n is a, c, g, or t
  misc_feature (2436)..(2436): n is a, c, g, or t
  misc_feature (2438)..(2438): n is a, c, g, or t
  misc_feature (2443)..(2443): n is a, c, g, or t
  misc_feature (2452)..(2453): n is a, c, g, or t
  misc_feature (2461)..(2461): n is a, c, g, or t
  misc_feature (2534)..(2534): n is a, c, g, or t
  misc_feature (2573)..(2573): n is a, c, g, or t
  misc_feature (2584)..(2584): n is a, c, g, or t
  misc_feature (2612)..(2612): n is a, c, g, or t
  misc_feature (2621)..(2622): n is a, c, g, or t
  misc_feature (2624)..(2624): n is a, c, g, or t
  misc_feature (2649)..(2649): n is a, c, g, or t
  misc_feature (2651)..(2651): n is a, c, g, or t
  misc_feature (2653)..(2654): n is a, c, g, or t
  misc_feature (2661)..(2662): n is a, c, g, or t
tccaactcaaatccgccaaatcccggggtaattgccaaagagaaaccattgaatgatatttatattttaaaaagcgatatttacttaatcatattattagtgaatttatattagctgaacatggccaattttgccgtcccaattttcatcggacacggaacgaatgaccaaaatgtgccactttcattggcgtaagtttttattgtttattttttgcatgcgaaatttgacagattttcaatggcaaatgcccttcggaggtttgaccccaatgtgaatttgcgcatttaccaaatgggccacgaaaattgtgcagccgaacttaacgaagcaattcaatttataagggaaattgtgccattggcatgagataatgataaatcaaatgccttccattcgcaattttccattgccatggcaaccaatgaatgaattggcccactttttttttaatttttggccctttaaattgaattttttttttgttctcaacaaaggccaattagtcctctcaacgtgtttcgtctgactcaattaattgatcatttatccttgttcccccaaaatgcggcttcgtcttcggctttccccgtggtcctttcgcggtgccgtccccggagtcgtttgggtcggtgccgacgaggttttctccgtgtccgatgaccacagtctctgccgctggaccgtctccaaaacggaggccaattttctgtctaatgcgttgaaagagtgcgttttgccgcctttcctcccaaaatcactcttttttcatttccggtgccattttcagctccattttccccacttctctcagtgccgcgtttcccttcgccgccgggcgttctccattttccggaggactgtcaattcgctcgggcaaaaagcaacagcgtacttccgccattcactcgtctcagtcagcagggaatgagctcattctgatgactgcctctgatggtccatcctctcattgatcagataattaattttgacttcgattatctcaggcaaaatccatctgatcactccggcggggaaaattgaacgaacaatcgaagcccaccaaggggcggccattttggcccggtggagcacttccgagcccggaggggcgggcggatttgtgagctgtgagtgaacgatgggtgggaagcgcaaacggaaaagcaaaatgttggcacaggcggagaggacggactgttgaagatgtggtcgcgaaacggaatgttacggtcgatgttggcacaacttgggaagccaatttatgcgatggattggaatgggaacggcacaaaattggtgtacagtgcgggcgaagagtgtttcatcaaacagatgaaggcacaggtaaacgcagaaagtcattaattgatcgaagagatctttttagaaaaactgccctttatcaaatagattcaattaaaatgcaatcagaatgcacccaccaaatggcgtgcccacaccggactcgtcctctgcttgagttggagtgcggtcaccgatctgatcgccagtggaggcgaggactgtcgttaccgactttgggatgggcaaggtctgattggcaaattgccaatattgagggtataacactcccgcctcttttgctgcagggcgccctctgtggtcctccgcttcccatggccatccgttgtgcagcgtcagttggagtccaagcggagagactttcgcgatcggctcctacaatttgctcagactttgcgacaaatcgggggtaaagagcgattaaccattattaataatacgaaaattttggctttatttttttttctgtcaaaattgttcaaaggcatctccgatttttctatgccaattaaatttgatcattctgtttcttgactacagtatcactgccttttccgctcattgtgccaatgcctttcagtggtcccattcccttgagcggcctgccagtggcacaatttactctttgaattggtccgccgacggtgttcaactgattggcggatgcgccaatggacaaatccttcacgcgcacgtcgttgagaggtcgtcgttgggggggcgctgtggtttttgccgtccttgtctgcctgcgttcgggcgggttgtgtgggcgcccttggcggccgtccaggcccgccncntggtcgttnnccttcggggtttgagctcggtggtcgcgcgtgntcgtctggttccgcgggtcggcgtggtgcgtttcgtcttcggcttttcctntttggtggttgcggccctctcgctttgctncgtcttcgggtctttgccggcgtttcntggctcgtttttgttttcgtttgtgcctttgtttgggntgcgccgccgcttgtcgtcctgncggtggtctcggggcccgtgtcgctggtccgtctctgcgctctgtgtgccgttttggcgtggttttctgctgcctttcttttcggggtggctttntntcccnccgttcccnnttctcggnggtgttttctgctggtgggtggctctgccgtccgtgtgttctgcttcgtgggccggtttctcggctctcttcnttttcctccctccgccgcgggcgggcccttcgctgtctnttcggtggccntttcctccgctttgctcgttcttcgggncccttcccnncnttccctaaaggatcttttcgccccncngnncggtcgnncggccccttaaggaaagaaacacacaatgttagcgggggggcgggggcg

SEQ ID NO: 3909 - DNA, 3410 bp, Heterodera glycines
agtaaagcatagaagcggcaaaatggcacaaatgattcatcagcaaattgcaaattgtaaagaaaatcagttcagttctgcatcttactgataattttgagttctattgtaaattgaacaaaagaagaccattcggtgtccatgcgccagagccctcaacgttttgggaaggaaagttgaaattgaccggtcaatggcaattgcaactgagacggcttaactcaccattaaaacttctaatcactagcgcggaaagcgtaaaggcgaaatgggcagtcatagggattttgtcatgagaggcacttaacgaaagaggacaatgccaacaaatgcccaaaattgtactttctccattgatttggtcatcacctccatttaggttgaagtcactgagttgtgtgtgaatatgtgtggcacttttgccgagcgtcgagtggcttttgtggaccaaaagggcgactgtttcttggcattagtcagctgttatgggtcagcccaaaggactgcgaagatcggatcgctgatctcctgcctgagtgccaacaatttgaccaatatgttggccgcactgcaggaaaatcagcgcctgctcgtttggacccttccgacggtggcatttttagacagggatttgcttccctccacccaaatggaactcggcaatagtgccgaattgggcaaatcggcgacgattatcgggtgggttggacaatataacatgtgtgaaaacaacaaattaacaaatggtttggtggaatattcagattcatcgggaacaccgtaactgtgcgaagatcggacagatgtttaatcgcccattatgtgccccctttcgtcgcgggactgtacgagattaaaattcaaaatatattttaaataattaacttattttatttgaaaggattcgttgtgttcagcttgcccaatgggaacaagctgttcgaatttgccgaacaacaaatgtgagaattttagggcataaaaaattgaaaaccatcgctaatcaaggaggaattcttgtgggcaactttggccggattggcatgcattgaaaagaattaccaaattgccgaaatgtgttatggacaattggaggaggtgactttcagggagcgggggggagggggaggggggtaaagaaaataaagagcatggattgattgttatcattaaatgaatctctctcaagagtccaatttcagatggagaaggttctgtttttgagtgagcttcggtcgcaaaatgtgccgcaattgcgcgacgcaaaagtggcacaattcagcggacaaaggcgcgaagcggacatgcttttggtaaacgcgggaaggaccttcgaggcactgatgctcaatctcggcacttttcgatttgataggtttggagaaagaggaattaagtgattaaaatgattaagggcgttggaattggcgacaaaaatgggcaggcatttggacacggtgctcggctatcgccagcgatatttggagctaacaggacggaaggagacagatcagcgatatttgaagcatctttcggaggtggaaattgactggacacacatttttgagaagatccaagaggacgaggcaaaggccaaccaacagaacaaatcgccgtgaaaatgacgagaaatggcatttaaaattgaacatgcgcaaaaagattcggaaataataaacaatttaaaaacgaaataaatgggaaaatgaaggggaaagggaagaggaagaccggcggaggaggacaaacacacatcagggttgttccgggttacccgaaacccgatacccgaaacccggcctttttctcgacccgaaacccgacccgatgattttgggtccggtttcgggtcgaaatacgcactgataagaatggggtctgggtgaaaattctgaggataagggaattgagaattttttttgaaacgattgtgttcaatggaatcgaaaattttgtattcgtttttgttcattattatcctttttctaaagatattttgtatgaatttcttgaatttaagcaaagcagatggctgaaaaacctgattccatttggttttatttccatcgtcctataaatggcgcaattcgctgcaaatattgcagtgccatttgatttttaaacaaattaaaaatttgtcaattgacccgaaacccggcctttttctcgacccgaaacccgatatttttctcgacccggaacaaccctgccccgcactcaaactcaccactggaagaaaacgaatagctggagtccgaggccgactcgcttccactttcgcttgtccccacttcctccactgacggcggttgtgttgcgcaacgtttctgcgccattgaacgttgctgttgaactgttgacaaaaactgacgcaatcgcttcccatccgtagccggcaaacagaagaaagagccggggaccaaagtcacgtgccggattgatcggagagccgacattctgtcaagcagaaattaccaatagacgagggagggagtgatcatgccaaagacaaacgtaccatgccaaaagaggaagtgatcagaaagatggccagcccaaagccgatcggatgcacccattttggcacttggtttcgcggatcgatcagcgcattgacgaaaaagaggagcagcgcagtgccgacaatttcatccacaaacgctgcaaaattaattaaaataattgttaaaataaaagaaaataaagagagacgataaagagaaggaggagtagagagagaaagaaaaagagggtggagagtaagtggaaagagagagggaaatgtgagacaaaggagagagaggcgagagcgagaggaaaggagaaagggagaaaaaaatagaaaatcctgaaggaaaagcatgaatgagatgagtgtggccattacattagcatttgcttcgcttacctgtgtaatgtccgatgtgttcgtccggaaaggaacagaaaattgcgcccgttccgctgggccctcccaccgttcgaatgcccgcgtcgaatttctcgaatgattctggcaaaaaaataataattttcaaaattttcgaaaaatagcaagtcaacccacacctctgtagacgtggaagcaaagggcggagccgaaaaaggcgccgacagtttggacgagggaatacagcaaaaagtgcgcaaatggcaatttgccaaggctaacgaaggcgagagacacggccgggttcaaatggccacctttggacgggggaaattggcacagaattggaaaacggtgagggcaacacatccatttagtaccgaccggatgtgtgtgatcggaaaatgcgtcagtggcaaagtattactttgaaacgagatattgtacatatatagtggaatgattataatttttacgcgtaagttgatataggaaaaacctacagtaatccattcacggt

SEQ ID NO: 3910 - DNA, 6055 bp, Heterodera glycines
tatttaagtaatttcgtttacaattgaaatatttaagtttttacttgttttgttacctaaaaagcgttaataaaattttttattgcctattagaggattttgtgcctttttaattgcctatttcgcgattttttgtgcctaaaaaaggaagccctaatgattgtgcagcgaatattttgaataataaattattaaatttaaataaaataattattttggcttttaatttgtcacttgcacttttttgtccattctcctttttccttttgctttcggcttcctttttatcttgtgttaggctttttgcttcttttccaggtaatttttcaactttgtgtttcctttttactgtcattttacagaaatttcatttggcatgactttccccaattcttataaaatcggaccatccgctagtaagggacaacgactgttttaagagatattgacatatttagaaactttttctaagctacatattgcttggtgattaaaccattaccaaaaaggttagaaacgaaaattgaaaaaactcgaaattttttatactttttcttaataactttttacattttggaaaagcttgacaaagtgcttacaatgaattacacttaattttatagaactgagaagtatttcaaattggcgttttgttgtttgtattttccagcattaacaaattaccgaaaatttccgtatcttttttcggcaagcgtcaaattcggaaagagcttgaagcgggactggatcccgcacgaaatccatccgaaatcccgcatttttaatttcgggattgcccgctggataccgaccgtcccgccaggcgcgtaaccagaaaaaaaaatttcgggaggggcaaccgtttttatgctcttcgggccagctaatttttctcaagagaaaattttcagcgccggagaaaaaaaacagggtaatagtgtactttgtaccagagatgtgccgagccagacaaaatccgattccgattaaatcgccgattccgattatggccaaaaatccgatacggttttaaaaccgattacgattatggcccaaaacccgattaattgcgattccgatttttttaaaataattttttcccaaaaattttattcataatcaaaatcataaatttaaagattgtgatgcaaaaataaaagtttgtccacattctcaggcaataaacgttttcagatctgtcacaatcaacccagcggtggagaatattcccagatatttgccatttttgctaaataacaaaaaacttgattatatcggggagaattaatccggcactgctttgtgagaaaaatttaatttcagtcattatgttaaaataagattaaaacattcgtttcagaaaacatttttttcaaaattcactggtattctcgctaaaaaaattccttcaaaaggtcaattcttaggggtgtaataattagggcgtgtaattatatggaaatccatatttttttcctggactgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatatatctcatatgcaatttaaaccaataaatttgaagaaattttacactcaattttgaaaaatttatgtccatattttgacgtttttgccatttatgtccatattttgagattttcgcaattttatgtccatattttgcgatttttggtccatattttatggccatatttcgcgattttatatccatatttttaccagccctaatgattagacagggtattgaatacgtatttcttcgagaatttgctgaaaaattttttcgttattgttagatctccgaaacatatactgatacaaataagattgtaaaggctcggggttagtgccgtggagatgacgaagaccatttttcactgcacgccaagttgcctcaatgccctgtgtgtgaacttgtgggtcttgaggatcgacaaaaaacaagcgatggttaacccaacgatgctcaaattgctgctgcaaattacgtatacccccataagcagcccatccgtcgcttataatcagagttcctggcgctacatttgcagaaatgattgggagcaaagtgttagcatcccgttttgccacaggaaacaaacggactttgttagtatttctctcgagaatgccgaaaatccagtcgtggttacggtttagcattcgtcccctgttgtacttagcacgaaaatatttagtttcatctatttctacaacacgcccaacccccccaagcagttcattagtttgaattcgatctgcccaaccctgacataaatctctcataaaattgtaaaagtccactacggtatgatcggtgttgatattcatctctctttttattgccccaaaagtggaagtcggatgttccgcccaaaaatacgcaagccgtagcacttgattcatcgacaagtgtgatttgtcgaagaatgagccaaaacgaacagaaatacgatttgatgtttcaaccccgtcacgactgcgacaacgattgcattagtctctctattattaaattttataacaattgattgaatgcgtatatacctatcgatactttggtaataagtgatcaatgacggatttaaattttattaaaaattaattagtaattttctatttctcttggtgttacgtttttaatatttaaattattatttctttttgcaatggttggtaccttatgtcaaaaggatgttcgaattaggaaaattttgattggacgcgtaaacttttgattggacgcgtaaacttttgattggacgcgtaaaagtcgattggacgcgtaaaatgcagtagagccgcgatttttaggtaagaaaaatcccagaataggtacttaaataggtaaaaaaaaatctcaaaataggtattaaataaataggtacaaaaattccaaaataggtaccaaaataggtaaataaaaatttttattaacgattttttagtggaaaaaagcaaacaaagagggaaaattttggttctacatatctctttgtaaacgaaaatttaaatatattaatattttcttagataatattgacattttaaattaaaaattttgtcaatagaaaaaataaatttttgagaaatttttccaattcttagggtgcatttttgaaaatttttttggtcgattcttatgggtatattttttgattttattgcatttttgttaagaattttttgaaaatccttaaaataggtaaccaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctagcaataaaaaataaaatataccccaaagaatcgacccaaaaattttctcaaaaaatacacccctaagaatcgatccgaaacttttcaaaaatgcactcctaagaaatgaaaaatttgtctccaaaattttttgtgtttaattactagggatgggatttctaagtttttacttattttttctgcggctttaactcaacgagaaatacacgaaaaacacattttttgtctgaaaattttgcgttttcacgcccttattcgaccttagaaatccttatttttgatgttcgcccttaaaataagtttttgcccttagtactactgtacttgttgtcttactgacagtatgaccggcttacaaaaagtgccacattgttgcactttccttttgatcaactggcagagttagggcccatagaatgagtaaattgggtgactgacgttacaaaagtgcatttcaagcccaattccttggccctaatatggcacggcatacctctttccatttgatgacacgtggcagcaaaagtttgtgcagcagccaacaggacgagagcgcattcggtgtggcattttcggcagggatgagaggcacaatttcgaacaaaagttcgagcggaaggcatttgggggccattgttgggagaagcatagttttgttatttggggtaattagtgagcaattagctgattagcattgaacaaaaaccgccgtcgtcacattggcactttgaacttggtttggcccgtttcgtctcgccagtaacagtagcagcagcagaaggaatggccgttttttttctctcctttccgtttgctttatctcttctgcgttgtctgccttttcctcttcactctctatctctatctctcaccttctctctctctctctcctttttattttctctatgccttgcgttgcgttcgtcctttcgcaatgattcggtcgcttttcgtcctcgcccgaggggttttgcgtagaactgtctcgcttttctgcttccacttctaacgtgcacacttttgtctttgcttctctgttctcgctttttctctcctgtggcaacactctctgcgttctctctctttcacttctctgtttagaatagggcagagaaatgaatccaacttttgtttttatatgtatttgtattagagatcgacattttgaaaaaagcctggacctggacctggattccatgttggacttggacctggatttcctggacaaaaatccaggaaaatccaggtccaggaaaaatccaggctcctcgagacctggatccaggcctggacctggatttttttaaactcattttaaaaatcaaaaaagtgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggacctggattttttttcacatttgacctggacctggatttcctggacaaaaatccaggaaaaatccaggttgccgaaaaatgacctggacctggatccaggaaaaatccaggcctggatccaggtccaggccgatctctagtatttatattaaaaaatcaaaaaaaaattcttggctttttaatgcgatttttccataaagaaggtttactctatagcataaaaatttttgaaaagatttttacttgtttgtagatgtaacagatgcaaaagctcacggacaaattccactgaaaataatttaaaatattaataaaataaaaaattaaattaaataattacaaaaaatgctgcgaccagtcgtagacaaatgtaccacaaattttcatcatttttctccaatgtttcattgaatttggatttttgttttcgtgacaaaacaacagcttggacgagcgcattcaaggaaagactacacaggatgagggcttaattaaatttttaaattattattattttatgaaaaattgtttttaaaagcgccaaaagcctcaaaatttggttaatatgtactgaagaagatttacccgatgaaaaataaaattaaaatttcctttatctcgatttttgggttaaaatgtg

SEQ ID NO: 3911 - DNA, 3069 bp, Heterodera glycines
tctctctctctctcttctctctctctctctctttttattttctctatgccttgcgttgcgttcgtccttcacaacgattcggtcgcttttcgtcgtaccccgaggggttttgcgtagaactgtctcgcttttctgcttccacttctaacgtgcacacttttgtctttgcttctctgttctcgctttttctctcctgtggcaacactctctgcgttctctcgcctttccttccgttgtctatctctgcgttctctatctctctcgctctctttcacttctctgtttagaatagggcagagaaatgaatccaacttttgtttttatatgtatttgtattagagatcgacattttgaaaagcctggacctggacctggacctggattccatgttggacctggacctggatttcctggacaaaaatccaggaaaatccaggtccaggaaaaatccaggctcctcgagacctggatccaggcctggacctggatttttttaaactcattttaaaaatcaaaaaagtgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggacctggattttttttcacatttgacctggacctggatttcctggacaaaaatccaaaatccaggttgtcaaaaaatgacctggacctggatccaggaaaaatccaggcctggatccaggtccaggtcgaactctaatttgtatagtttacactccgccgatggacaattaaatcctccccatttttgctcactgatcaattgctgctgcagatcaattagcgaaaagcaataaatattaaattatatttattaatttaattcaacttcttccgctgattaatgtccaagcactttcacattcattaattatgtgcaaaaaagaaacattgcaaattaagcacatttcaagcgtttccgtggtaaagcagaaaaataaataaatttttcgagaggatcgcaaaaggataaataaaactacgaacaaaaaaaataaaattgtcattttagccaaaaagggtgtgaataagttacaaacgaaaataatcatcaattacttaattaatcagatcttttttcataatagcctaaacgttgagattttatatattttagcttcgttagactcgctgacccacaaaatgtccaggccacgaaatgtccaagtctcgaatttgagttttttattattcggatgggcctaaggttaggcaacgggtaatataaaggttatattcgtattcagcgaccccgaaaaccctaaaaatcctaaattagactcattttgtttttataaattttgaaaaattttggacatttcgtgggtttttactcttttggacatttcgtggcttggacactttgtgggggcgccgttagactttgtgctttcgaatgctaccaaaaagataggggttgttcaaacatgaacaaagttattgtataaagtcaattgattggactcataagtgcactagagccgaaattttaatcatatgaactcgtggtttttgataattttcttcactttttaaaattttgtttatatatatattcagcgaaaaacatgttttctttttcttttaaagatttttcgaaaatttttaaatttaaatttgctgctcgtgtgtttttcgggtccactgcgtttcggcgctggcgtttcggcgccagcatgtttttggctataacttttttctatctaatccaaatccaacattgttgatataattcgaaagcttaacatgtttagaagctttttctaagcgattgcttcgcgattagacaattaccaaaaaagttatacatgaaaatttcgaaaagtcgaaatttttgaagttttttcttaataaaattttttacaggcttgaaaatctatccgctttttgtaaggctaatagagcatgataagagctttcgaatgataccaagattgttggatttggatcagatagaaaaaagttatagccaaaaacgagctggcgccgaaacgccagcgccgaaacgcgtgggtccccctatccattctctctctctctcatttctctccctctctcacttcatgtctcagtcaaattagtgatatataccttatgctaattatggttatatttaattacacttaattgaacctcacattttggtgttcatttatttgcgctccatttgtgccaaaataatataaaattgatgaaaacaaaaggaataaatataatattatcattagggcgtgtaattatatggaaatccatatttttttcctggattattggaggcctgaaacgcacgaaaaacatgtttttagcttggtttgaagcttctaggaaggatttctatatccatattttccatatttttccatatttcgcgatttatgtccatatttccatatttttccatattttggcattttgtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaattttggaaatgtatctcatatgcaatttcaaccaataaatttgaaagaattttacattcaattttgaaaaaattatgtccatattttgacatttttgccatttatgtccatattttcgcgatttttg

SEQ ID NO: 3912 - DNA, 951 bp, Heterodera glycines
tgaatttgttatgtgttagccttctcttttcatccctttacactgtcgctttcctcgggtgccggcgcttccaaacattttttcaaaaattcgcccaaatgcaatggcctgggaaaaaagaaataaaaaaaattttttttttaataagctaatacgtttttgtacggaatgtcctggacattgagtgatggagcaaattaaatgttcaggtcgtcaatttttagcactgtttcggggtcccggcccaacaaattacaaacttaaagaataattttgaaaaaaaagaccttctacgaattttggactcgccatcacttccttggcaatactctcgggaattggctcgccaagtagtccacgcaacacatcgtggacattcgccttctttgtgaagtcaatggccatttctaggcaatcacacgactcgctctgcacccaactctcttggcccctcgcacctaattaataataaacagtgtttacgactctgataaattaaaagcaacaaacattcaaaccccgggctgtttgattatggaggagctattcggtgccaactcgtccataaccaaacacatagaggcaaatatatgagaaaaaatgaaaaaaaatttttttttttaattttcatcccaaccacttacgaagccagtctacgtaatatccgatcctattgttgctatgggtgtaggtcgccaaaacagccttcacgcggtagctgcgctccccttcaagagagcgaatgatcggcggcacattcggggcgctgctggatacagtgatctcaaaatttcgaaaaaaaaatgaaaattttttcctttttttcttactttgggtcgatttagtttattgtagtgtttggtttggcgttttttccgctcgggtgacgcgcatgcatttggcacaatttttggtccacggggtgcgccacccgtccatttgcccatctga

SEQ ID NO: 3913 - DNA, 2675 bp, Heterodera glycines
agtcacccccccctattttccgaaaaatgacgctaataatgtccactatgcgttcacttgttggtcatcgttttatttgtctctatcactctaccctctctttcactctctccctcttccacttttcatttcactctcgctgtctcactctcccacttttaccttcactctctaatgatttctctaaccctagacacaccacacagacacacatgtgcacgcgccgttcctcgctgctgcgctgctgaccaccagcctccccccttccatacaacaaatcattaatcacccaccccctcccccacagaattccattggcaaaaacttttttttggcaaaaaagtttgtgccccccccttccatcaaaagtttcaaaaaaatttccacatatgcaaaagcttcaaaagcgacgccgcctccctcactctcagttctccaaatggaaggcagctttattatgcaccaaagcatcccgaattcccaataatgggtgtgacccatttttaaacatattgctcatttgatgtaccgactaattttctccactatatcacacattaatcattcagaaagatcatatcatatgagcttcaaattcaaaaatttttaatctcgcctaatgatctaagtagccattcacatgcaacggcaaaaaaatttcaaatttctccaatttagtggtcttctataatttaccaattaatcattttgaattacatttatttgccaaatattgtttaatgtgaaggcattgtgaaaattcccattttataaaaattttctagaattaaagctcattattttgtcggctcatcgttcaaaaactgtcgtcgtcatcgtcgtcttccgcctgttcatgtccaccaccatccgctggtacatcgtaaatcacctcacgctgcgcttgcggctccttttaaaaaaaatggtataagaaagggaagcgaagggacttgttgtgtttgtacctggtacggcggcatactgcccaaattcaccggcacgacagatggtggcatcgacgattggcggccccgacttgtccaaactgcgcgcccccagtctgaaattattttaaaatataaaaaaaaaatagtttttacccacccggccaaaattcaccacattggcatcgtttggcgacccacttggttgcgaagagttttgatttcttaatatttgtttgcttaaaattaaaaaaaaaactcactcttctgacgctgctgcaatttccgctggatgacacgatttttgagaatgcgccgcaaaagtgctccaacctgaacagcctaaagaggggagagggttgtgttcaaattgttgggggatgggtggagggggtacctgcgcgatgaacaccaagaagatgaaaagtgtgaggatgaacagcaaaatggaatgtgatgattgaatgggagagggaggagggcaaattgttgcgtttgttgtcgttgtcgtcgatgggaatggtggcgaagtcccctccctcaggtacgctgtcaaattattgacactcgcatgcaaacacaaaataggcttccagtaaacggtggggcctgaaacaattcaggccctcatcgcactgggttgcagtcaaatttaacccagtccatttgggggaaaaataaaaatgtgaaatggcctaggaccgtgggatgatcccccctccccaacatgatcaacaacatttattcatcgcttattttgttcacttctacataatagaccccccccccccccagccagcccctctccattacccatatgtttacggatttgttttggggggggggggcaaaatgtttcagttgaacaaattattcgttaatttattcaccctccccccattgccgataataacccatcgcccttctttttcctttgcaacatatcagcaaaaagaccccccgccccccttcttcattagcaaaaaaaatgatgctgttttggttctctacccttcccttcgggcacaaaatttctctctgactgtctgtctccctactctctcacccctctgtttctttcctctctcgctcactcttctcgctgtctcactctctcacttttcccttcactctcttctctttctcacgcgccgccgttcctcgctgctgcgctgctgaccaccagcctccccccttccatacaacaaatcattaatcacccaccccctcccccacagaattccattggaaaaaacttttttttggaaaaaaagtttgggcccccccttccatcataaattgaaaaaaaatttccacatatgccaaagcctcaaaagcgacgccgcctcccttactctcagacccgtgtgccacacgcgcggaaaaaccgcgagccgcctcccccctcagtctcgtacgaacccctccctcccgaacgaacccgtgccacagtcacgcggtcgagcgataaacccgcgcgcggggggacgcctcaaaggccagctgtcactttgaaagcaatcaatcatgacgacgatatctgtaaactaactactgaaagacataagctaattaacataaattgccgaagcatttaagcacatttgacattcattgtattctctttacattttcattgtaattgatttatttttcccggaagcatcgagccgacactcctccccttttcattaatgattatttaagatgcgatctctccattgatat

SEQ ID NO: 3914 - DNA, 6604 bp, Heterodera glycines
  misc_feature (6480)..(6480): n is a, c, g, or t
atttatttgttgcgatttctatttgtaatagttttgcatactcttcctgaaataaagccattacagattggaatttgaattggtatgagatggggagggaagtgggattgatcaccccaggaccccctcataaaaatggttggatttgtaagggttgggagtcccaaggcctaattcagcgcgttccactggcatgtgtgttactggtagcaccggatggtttggcatttggcctgggcggctgagggacaacccataggaaaagttagtaagggaaaagcatggaaaaatgatggccattagtgagtgcttcggcaataaaaagaaagtcctccggaggcggtaaaaaggagaaaataaaaagagtaaaaaaaaaaagagaatgccccgacagtctatgaataccctccgggatgcccttcgggatgataaatagaaaaaaatgactttcggaatgcccttcgggatgcccttttggatgagtaaatgcccattaggatgaaaatgtgaaattttgaatgcccttcgggatgaaaaaataatagaagaatgccccgggatgcccttttggatgattaaatgcccattaggatgaaaataagtgaaaattttggatacccttcgggaagacaaatacatgaaaaagaaaattcaggatgcccattaggttgaaaatctgaaaatttgaaaatgcccagtaggaagataaataagtagaaaaataaattatgaattaggaatgcccttttggatgaaaaacgagagatacccttcgggaagaaaaagagaaaaatcgaaaaaaatcaaaattagtcagtcaaaaaaaaagagattaaatgtgaaataaaagcaaaaaaaaaatgaaatacaaatataaaaaaaaatacagtaggtccttcgggaagacaaagagatgattgataaaagatatattaaagaaaaaaaaatacatagaaaattaattttaaaccatatacagtatacaaaaaaaagggggactacagtactcaaaaaaagggggaattttgccggatatgttgatgaacaaagtacgctcgcagtcagcactatcgctttggcccatctgctgagaacattgctcgcttaacgttagcaatgcattttctctcctcctctcttccccccggcgctgttttcctttgttaatcggaagatctgttgcaattcacacatcttctcacagtcatctcttcccttcttcttcttagtcttcttcccccccggcgatgatgggcggaggatggcgtcgcttggccattcatttatgagacgccaataaatatgcggatttacagcacacaattcattcctccaaaacatcattttatttgtgcatttcataaatgtctcttttattaggaattttattaatgtttccaatttaaattaatttgtttttttttcatttttagcaattcaattttcaacttctaaagccaactcttaactgcaaatccttggatattggactcggcatcggcaaccacacttccgacacaacttgacaaggaattggcaaccacattgcgcttcggcatttctctgtgagtttacagtaatgggtactgtaccaattaagtagggaggatttctcatgcctctgggacccatcttggactaaaaaaaaaaaaaaggtgaaactttttacaattcgtaaatcttggtaatcctggtagccctaaaaatttggccaaacaaaaatgccgtttacttaatgatttttggtgataattcggctttcaaattattattaatgggtcacaaatgtgcataataaataatttattttatgctttatgagttatagggatttttaactacggtaaatcgtacgtcaagtaaatgacatttattaaccttttgagcattatttcaggctctacgttttccggattctgttggactgtggattgtggactgaattagcgtttgcttggacagtttggacggacaattgcgcactgcttcggcatttttctgtttctgttcgcctgtgattgaacaaattgaacggattggacggatttctttctgcgcatcggcatttgcaaattgttattggaagcatatttaagtgagtccaattaatccatgacattcaattaattcacccagtgggggggggggggggtgattaattaattaaatggtgtgtacccatgcattttggcttcaatttgatgcatttattaaatttcaaaaatggtaaatacagtaccttttcttcgattaaatcaaatctgtgacaatcaaactaaaaattttttttctctctcttttctgtctgattaattaactgatcaaaaagtcattttgtatcaatgacatgataattttttttcatatcggtttatattgttgtttttatatttttggcgtatttctaataataatttaaagtttgttggcatgaccttaaatactgttttcttccaattttttttaatgggatcattgatcattggcatttattacttaaaaattaattgcttaaacacttaaaattgtaattcattcagacaaccggatcggttatactgtattacaattaacattgtaactcattcaggttttggcattgtgttttgctttggaatttgtcgtcgtcaaggacttgagcagcgtttggattttggatttggagtttgacgcaacagcctttgaacactttgatcttctgtggccaagggttggtcaaatcactgattattgacttaattattcaaattattcaaaataataatacaagacaagactaaacaaaataaataaataaacaaacaaataaataaacaaaagggaaagaaataaaattaaattattgcttcggcaagaaaatggattataatgatttaaatgtttgcgacaagaaactcatggatgggaagatcctcacgaaccaagcaaaattaagtgatgtagggaaagtccatgatgaagtaatacttttagaagatggggtgaaccgaaatttgagaacgattaaccgaaaagtaacaaatgtttcaaatcgagtagttgagattgctagtgatgtaaatgtaggttttaatacagtagcgaaacgggtcgacactttaggggaaatagtcacagaattagacgggaaatttagtacatggaaaaatgagatagatacgagagaacaattagagtttgatgagatgaacaaaacccaagaagcccatgggactgtacctttcccttttagaagacctccagggtctcctagactgaacattccagcaactcctcctgctaatttggcactgattcttcaaatccaagcaccaaataggggtaatgtgaatgcactcactgaagtaggcacttcgggaccacaaccagggctatttaatggtgaaattgcctcggcatttgatgaatgggaaattaaatttagggattatattgatgtttttggtacaaattggaatgaatcagagaaattgaatcgtcttaagctacatttgggaacccaaacacgaaacatttttgaaaatttgcttcaaaatgaaaggaataccctcgccaatgcattgaaaaatatcagagcaaaattggacagtcctcattttcgggaattagcctacagaaaattagcggcatgttatcaaaaggagggagagtcagtaagtgacttcattaagcgcttagttcctcttgtcaacacaacttcagctcaaattccacctgaagcgagagaagagatgatgtgtagatgtctcatagaaaaagtaagacccgaatttcagcgttctttacagcttgtaggaccacttattgggagaaaggactttcagaaactgactgcatacattcaagagttagaagtctcaattgaaagagatgtgagaaatgagagcttcggcattcacgcacttaatacaaatcctagtcaagttccacaaggcaaatttaacacatggggaccttcgaaccctaacaatattcaacttgggcacaaaacatttagaaatgaaaatcgtgatcagtcagataggagacccaatcagttttcacagaataatagatacaatcagcaaagaagggattggggcccacaaaatgatagaagatggaataacagacccgtctgtcattactgtaagaggaccggacacgtacaatacaattgcaggattagacagaatgactttaatgggcaatcggacaatcgtaatcagacacgttggcaacatcggccacaaaattcaaatagggacaattggtccacaaatgagtcaaaacaattaaaagatatggtagaagacttagcagttcaggtgcatgaaatgaaaatgaacaacaattacgcttcggcgagacaacagaacattaaagcattacaaatgattcatacaaatgaagaaatacagaaaattgaaccaagaaaaattttgaacccaaaagtatttcaagttgggagaataagcaagggaaatccaaaacattttcaagcattttaatggctattacgctcttaaacattttaacaactgcaataggcaaacaacaaattttaactgtgaataagcctatgattgccaaacacaaaagcaagcaatgctttgggagctaccaattattcaggggtgtccagcaataaggctaagggtagacaattcacccattactcaaaatcgtcagctgtttatccctaacagcattgaattttcaacaaaagcttgggcttgtaggaaaattaagaaaattgttagaaaatatacaacactaacaggagtaccaatggaagagaagtcagaaccagagaattttgatgtgtctttggatgaatgcagacaaatgatcaagcacaaaagttgcagcttcggcaatttaaaagggatcacaaatttttggcaaactgaaaataaaatagatttaactcccaggttttggctgttagggtcatttggatggaagaatgtctcaagtgaaaactgttttcttttagaaacacgaattgactcgcactttggggctaattcaattgtgactccattgagattgagcgaaactcatgactgtccatacagtaaaggttactgtattttgtctgacaaaacagttttaatttggcaaatagacactgaaaggaagtgtaattttattccaattggaaataaaaatggaaaaatgatggacaaaatttggttatctgatgatggtgagctgggtctatctttcgggaatcaaacgaatttaattgatgtgggcaattcttctcagttagcttctcaattgacttatttggctcaatcattaactcaaccatgagttttgcattttctcaatcacttagacattttgtgagttcattgaggagaatagaagatgggttgaagcctcattcttttcaaatccaacggatttggctagatttactttctctaatccattcatttatgctaaaagagcagcccaaacacttttaaaaatttggccatgcgttcctttggaccaaaaagattatgaatttagaccaaccaaacttcaaaatcaatgtttcgaattcataccaattaatttgaagacgcagggtagggaacattttgctttcattgacccaaagtcaatgataatctctccatcatcaagaaaaggttcctgtgaggaatttagaaaaattataattcaaattgaaggccaaattttagaaattgaccaaatagaaggaaaaattacttcggtaagcccaaataaactgattcatcatgaaataaaatttgggctaaacaatttgcttcctcaaatagaagcacatgcttttcacaaattggttctactaaatctgacagacataaaagatcatgcttttgtgagcaatatggtaaaattgagtcaaatgacttatcagattcatgaaaaggacaccaaaatcacagctacaatttctcaagaatgggaagaggttgaaagccaaatgatcaaagcagtgattggtgattacagaaaaatgtggttaataattatgtctctaattattaccattctgtcaattgacttagcgataagattgacaattggtttaagtgaaatttatgcagggaatgggcgcttaggcaatttattatttggtacaacaattcagaaagctgggaaaagagtaagaaaattgagggaaactaaaattcaagaagaaagagaaatctatgaagaaccaattaatcaaattagttggcctccaagaattagaagagcgggaaattcacttagaaaatctttcaccagaccttttaaaagaaataggcatggaccaaatccaacacaaatgagcactcattttgaattaaattctttgatgggacagcttgggtcgttaaataataatacaatgacagggaccacttttgtctctcttaataatttccaaatgaaatgcttagtggacacaggctcaagcacctcagttgcaccaaaagcgttagctgattacttaggtattaaaacatttanatcagaagcacatttaatgagtgcttccggtcatccagtacatgtcaaagaagctgctcgtgtgactttaaaataggaaatgaatatgtggacataattattcgtctttttgatgatgaacttt

SEQ ID NO: 3915 - DNA, 2257 bp, Heterodera glycines
ctcaaacaatgagttttgcattctctcaatcacttaggacatttgtgagttcattgaggagaatagaagatgggttgaagcctcattcttttcaaatccaacggatttggctaggtttactttttctaatccattcatttatgctaaaagagcagcccaaacgctcttgaaaatttggccatgcgttcctttggaccaaaatgattatgaatttaggccaaccaaacttcaaaatcaatgttttgaattcataccaattaatttgaagacactgaatagggaacattttgcttttattgacccaacgtcaatgatagtctctccctcgtcaagaaaaggtacctgtgaggaatttagaaaaattataattcaaattgaaggccaaattttagaaattgaccaaatagaaggaaaaattacttcggtaagcccaaataaattaaatcatcacgaagtaaaatttgggttcaacaatttgcttcctcaaatagaagcacatgcttttcacaaattagttgtattaaatctaacagacataaaagatcatgcttttgtgagcaacatggtcaaattgagtcaaatgacttatcagattcatgaaaaggacacaaaaatcacaacttcaatttctcaggaatgggaagaggttgaaagccaaatggtcaaagcagttattggtgattacagaaaaatatggttaataattatgtctctaattctcaccattttgtcaattgacttggcgataagattgacaattggtttaagtgaaatttatgcagggaatgggcgcttaggcaatttattatttggtacaacaattcagaaagctgggaaaagagtaagaaaattgagggaaactaaaattcagcaagaaggagaaatctatgaagaaccaattaatcaaattagttggcctccaagaattagaagagcgggaaattcacttagaaaatctttcaccagaccttttaaaagaaataggcatggaccaaatccaacacaaatgagcactcattttgaattaaattctttgatgggacagcttgggtctttaaataataatacaatgacagggaccactctcgtctctcttaataatttccaaatgaaatgcttagtggacacaggctcaagcacctcagttgcaccaaaagcgttagctgattacttaggtattagaacatttaaatctgaggcacatttaatgagtgcttccggtcatccagtgcatgtcaaagaagctgctcgtgttaccttaaaaataggaaatgaatatgtggacataattattcgtctttttgatgatgaactttcatggacaatgaaagattataattttattttgggatgtgatgctcttgcttcactgccgcctattacttttgactttcaaaataaatgtgtaattattacaaatcccacctcaactgtaaaaagaatttttaaaggaacatgcctcggcaattcaaatgaagtcttaaaaacggaaaatagcactatttttactgaaattgagaaagaggacagtgagtatgaattcaatgcattgatagaaaaagaaataaaaattgccattgtgacagcagcaaatttgccacttgcaaaattagtccaagaattgaatgatgtatttggttctgatgagatggaagaatcaggttcagttgcattcttctcgggttatgccaaagaaaagtacaaagaaatgttagaaaagttgaaaaggcatttgttgatttccaaaatttcgaacgaagaaataataagcaagtttgagacacaagacgatgtgaaggaaattgagacttattgtaagaatttcgaagttcgaccacgcttaacaaaagaacgaaaagtagcgaatttgtactcagaagttgcggatttgcggattgtcttcaccacagtgtcgatggcagaaaatctgattcacacagctttagacggcacaacagtcttaatctttgatgaagctactcaggggtcatgggtctgcttagcacatttagtagccagaatgccaaaattggagaaagtcttggtaactggtgaccaattgcagcttggtgttcatctgcagaaactcccgcctttgctacaatccggttttggtcttgaatcaatggttgatcagttgatcctgtctccgacagttgttcaaactcgtctaacgacttgttacagaatgcatccgacactggtgaaagcagttgcttcggcagtatatgagccaaatgagaaaaattcgaaccag

SEQ ID NO: 3916 - DNA, 7244 bp, Heterodera glycines
ttacgaccaaaaattatcaaataattagtcttattgccatatatcattgttggcatatttatacatcatttataaattatttaaaatattctttatattcatcccctataattgttcttaatataaaatgcttccgttcttagatcgcttgccagccgtcaaatggcaaaacgaagaaggcacagacaaagaaaattatgaaaaagatgaagagtttagtttatgcctaaaataattcttttaaaaaattattgttcatgatctatgtgttttaaaatatttatttgctttttttaatatacattccaccgtaaatttaaaatataaatttttttcgttgtcattttttctgataaataaaacatttttctaatatttaatttataatataaaatgtgtctttaatttcctctgaacattttttatttaattaatttaatcgttaatatgtttgtattaaaccaagaccagtcacgctaaatagaccattgatcccaaataatttatttttattgatattaatatatttatgggctaccttaaataatatatttttataataaataaaattataataatgcttttctaaaattgatttattaatgaaaattagactttataataccatttccttcagttttaatgaccacaacaatattcattatactaaattatttttaatgattttagttataatttttcttcttcataactcgatcttaaatatttaataataaagacacatttaattaaagtttttaaataaatattgaaagtaaaatggttaaaaaatattattgaaataatattatttgttttacatctgactaactattaatgtgtttctgtttctcttgccgtttgttttcgcatatttgccagatttgttgtgtgaacctctcatcatccgcctttttgaggaaggatttgaatacctcaagaccatactacgactttaatttattaatttgaaacattatgaaagtttatcttttattttgtataatttttcgaataaaatatattaatattaagattatttgtaataaagaattttttatggattatcctaaaatggagtattaaatttttttaaattatagtttaaaaactttgttttaatattaaatttagcaatttgaattattgcttttgcgattaatttggcatatttttagtttactctagatgtccgcaacttggtcggctgtcatgttctttgaaaagctttctatgtttggatttggcattttttcacttattatttaataatggcatttattttatatattttttaaatttgatgaattacttgaatttcttccaagttctttcgatttcatatatgacaaatatttttttgttagtcaatttatatatttagtttagaaagtattttgctttattaatttattgcaataaccaaagacagagaagtcaaattttaaaccatttaaacttcgatattttagtttggtaatttttcatggcgtaaattcaaatgttctatcggaaactcaatgaacacacatacaactataattaaagttggcagaaatttataaatttttatttaacctgatactatttagcaaaactattattttttgcatgtttaattatatcttttctatcataatactgttacttttaacgacctttagcgatgtttaagagtatttattagaatttgagttttaattggatcttgaaactttacttttttgtctaaatattttttatgtattatatcgtaaaatttattttattggttttgtatgctttttaaatttttttaaacccttttagggagttataatatattattttcggttccagcattgtcccgaaggaggcaacagcaatttagtggcattaggaaaatttgggaatatcatgaaatgaatctttaactaaatttcaaatgtcatattcgttaaatatattttaggtctcatttctttaagttttcttttttagaaaatcatatgtgaattttatttaaacgagttttttatttctagtgtaattttttattttcatataaaatctaaagttgtttagaattatttattcaaactacctaatacaaagaatagattaaaataaatgtttttaaatttttaaaaaattttattatcaaggaaccattaaatgcaactctttagaataagtaaatttgtgaaaaattggaggcaagaacaaaaatcttaatttttttatgagaccactttttttatttgatcgttcctcattaaaatttacctttataagatgatataaaaattttatataaaattgaacaatttttaaattttaatttaagtcatatttttaggtgtcaaactgtgataatcgaatacccacgatatttttttcgcctattattattaatggaaatttcaaaattttgattttaaatctgataccttacaataaatgaattccgatttcattttgacagttgtagctgtattacttttaaggtttaatttttataataattatgaagcttaacacggcgccggtgccagcaaaggcggcggttgaccccattgaaaattgccgtttgtgggggtgtgagccgaagtgggggaggtgtgctggggtcaccaaatcgatgtccatatcgattctcgccctccacgagccgctccaccaaccttccaacttatcgagccgttcgatgattgagttcagtgtgggattccctgaaccttctaacaacttttcaagccggtaaagacgggcgagaatgtcctctccctcatttaaagttggggaattttgccgacgtttttttttagcaaaaatttatatttttagaaaccgacttattataagtaaaaaaatcttcttgcattaaattttaaaataaaatcattattctttttacttttatcaaactaatcatttattataattttgattaaaaaaattttaaattaatttcttctgtaatttgcgatttaaatattttattttaattcatttatacccacttttctacaatttattaattttcataaactttttttcatgaatttattaaatctttcatgattatttattattatttttagagttttaattttcgcgctcttcgcgacactcccaaatttaatttttcaataatttaatttgtttttgtttataaattagtgaatcatttaaattaataatatatattttgagttaatttctttttgataaagttttatttcagttttcccatattttttaaataggatattttgatgaagtagttttattgctttttcttttttaatgtttatgaatatttttgtataattatattaactccgttttattgatggcataaattattcggacataattattttaaaattaatatacctaatttacatcaaaaaatggaaataaaaaaagattaattcattgtggacgtggtaatttattcaatataaatatgtattttaccatatttctcatatttaaaaaatataaattcatttatttttttggttaaaacttaagttaataattaatataagtaataaattctacaaattgtaagaaataacacaatgggcggacacaaactagtggggctcattgcaatggtatacggatactaaagaaataaaaatatatgaaaaaggaatatattaaagaaaaattattcaggttgtcatttttatcggtatttgatcaaaaaattcttagctacataaaatttacaaattatttctttagagaaagaatttttacaaaaattcgaatagttattagttttaaaataggaattataatacccaaaaattatagtcaatcattttttaaatgtatgattaaggaaagttaattccgtccaattgatccaccttgtttcatatccaagccttcatccttggttctatttttaaaaaataaagatttctgaatattttattttttatatttaatattttattgctttaggttttaattactttttttaacttttgctcaataaactcacttattgtatgtttcctcaggtatgtttttagctgggtcaaaaaagatactatcattttactagttattcacgtattaaaaattagccttgtgaaatgttttcttgttaatggcattttcaaagcatgttactgtacttaaggatcaattactttttagaaaaaaatattattttatttgtattactcgtatttcgttataatttttttaaattacatttatgaccgttcttttttcgatttcggatttcggccgagtgaatttttcaatatttctgcattattattaaataattttttctttgcttttttgttttttaattttcttgttggcttctagctttacgtagttcattgaagaaaaaagtttttattattagtatgctattgataaacattgttggagacacctatttaagagattttcgacaaatattttatttaatttttattttaacgtgtaaattataatttcagtgtttttttataaacataggaagaatttttgcagcatttaatacacaattgacgtaattaatattcctttacttctatagattctttaatttctttttcttattaatgcaactatcctgcataaatgttccttatttttttgaaagtgattaactaatttttttaataacttcatttttctatgataaaaagccatatatctatatatttaaaaaaaaagtctaatctttcaaagatcattttattttgataaaacttcggtgtttttaccattacggtttactattaatttacagtttttgggtgatattaaactaatataattaatataaaatatttaataatttggagaagaaaatgcaatattttttatttgatttgtataaaataatcagtcattgtgaaatttcaaattgtttcatttcagcctatttttattattttctaaattttttatatttaattttttttcaaataaattgcaatcactaatatataaaaagcctttaatatctacttttcttgacaagggggattgcgtattttttttcagctgcatcgaagtcctattttgataaatttggttaaataatcacttgtaatattttaaaaaacattcattgtataatattttagttgttccattctttggtattgttaatgaaataattaatttaattttcattgaaaattttaaataaaattatttacacgtttatatattaattttttgtaatgcattttcattcttttttcttctgtttttattagtcatatacatattctctaatcatttatgacaaattgaattgaagtaataattatttacccattgaattaattttttggcttcagtccgcaaaatttatatttatgtgattaaaaaacacattttaaattgacaaacaaactcctttatgcgaattctatcattattcttgattctatatggtcgtcctcggagctggtgctaggtcgtttcttaaattccgccagggcgtttcttaaatccgccagggcgtttcttaaatccgccaaggggtagaaaaacaaaaaatgtaagacatataaattcataactcggcttaaattcaattaaattaataattctcggtatcattcaatagctctagacgttctctaacggaatattaatttaaaaatttttttaataaaattttcaaaagttatggatttatatgttcaaaaaatcttgagtcagaatttttggccataacttttttgaaactcaatgaatttttttgaaattttaaagataaatagattaaatagtggacttgaaattctaaaaagaaaatttaattttattgcttctgaaaaaagttataagcattgaacaggctatgttttttgccagggtcatgcatatatatttatggattttaaagtccttaaaatgattattcagccaaaatgaatttatattcgatagccctaagaattctctattaaacattaaaatttcaaaaaatttcattgagtttcaaaaaacttatggccaaaaattctgactcaagattttttgaaattttctgaccataactttttgaaaattttattaaaaaaattttaaaattaatattccgttagagaacatctagagctattgaatgataccaagaattattaatttgattgaatttaagccaagttatgaatttatatgtcttacatttttcgttttcctaccccttggcggatttaagaaacgccgaatgtggcggaatttaagaaacgacccagcacgcaaaatgttttcttctacatatttctaaatttgattttttggaaatcaatgaaattcctctcccctccccctccctccgtcgtgtgttgtcccaccatttcctccgataaggaacgaccaccaccaccaaaagcggtggtggaagaaggttaagccgccttctcaccccccccccctttttgttgtcccatcttttttactcttcctcctccttttttctgtttttcacttccttccttgttcccatttgttgttcttcttcctcttccttctcctcctcttctttggtccgtccgtctttgatgaaaggatggaataattgggagcaaatggcggacggaacaaacggacgaacgaacacttttggaaggcaaggggggggcaaaaaaaagtgggggggggggggtgactaaaaaatatggaaaagcaaagcgccagagaaaggcaaaagcggtgccaactcagcgccaaatgtcagccagttcagcaggactcatttatttgccttgttttgtccgtccgttgttccgtccgtccccctcagaacgtatggttaagccgatcaaattgagtgtgtctcaaatttactgtgttttgttttatcttcttggctactgattaaatagactaaaacacatttcttgtttaaacaaatcattttgcttaattttagaaatttttggaattttttgctaaatttcggcacatactaatcccttgcacctaaaatcctctttccctagtaaaaggttcaaaaacagtgaatgatcaaaacataccaaaggttggtcttgtgcaaaatgtgcaaaatctcggcggaagaaaaaaacattagtgctgaacagtccagcgatgaatttccatcccgcgctttccgccgatgggaagcgatgtgtcgggggaggggggagtaaaaaaaaacacacatttgtttacggaaaacttcgggacattttgactgggaaaatgggtggttggagcgaaaagtgggggggggg

SEQ ID NO: 3917 - DNA, 1746 bp, Heterodera glycines
tatgtccttacatttcttactttctttacaagtgatctatttttaagctccgtaacgaagtatacaatatgccactgtaatatattttttcttttaataaatgaaacatatattgttatagttttaaaatatttattagtaaagaagaagaaatcaattaaatacgtattttataaaaaagtttttgtattatgatcttccaaaatttagattttataatttaaatatatcttttaattgacgggaaatggcttgtcgaggttatacttttatggcaaatttggcggtctctattcgttcgacataaatttccgaccttgtgatcccctctcaatttttatttatattttatttaatttgacgtttgacattctctttttaaattctgttttcatattccagtattatttttcgtgaagataaataaatccaaagagagttgatttaccttgtttttcaaaatccaaatttgatgtgcataaagagattaaagttaaatttaaacaaaaaatttcataaatttcataaattttattatttatttcatttcaaaaaaacatttctgtattaaaatggaaattttaagaatatcggttaattattcggtttatttttataagttttccatgattaaatatatttgcaatcagaactaaagatttttaagctctggattacaaatctcatgtatccgtgcgttatgcagcaagcgctataaattttttggcgattcagtgcttttacattttaatatatgttgaaattttgtaaaaataaattatgaaaaatatttaatttttgattttaaaataaattataattatattattaaaattgacaatattcatattacaataacatgaagcatataacactgttcatttgcattgtcaataaatcattaagcaaaatcaaattatgaaatataagactaaaattttgcttgaaatttaatatgaaaagaagaatttgattataaattctaattacagagttaagttaaaattaaattttaattttttatacaacgaaaatatttttaaattttttataatgttttttagttaccagacttatcgcgaatttgtcctttaacatgtacaatctggagttcaatgtataatattcttttttgtatatatgagaaggtataaatattgtttttctatttttaaaatattttaattttgctcttttcactaaaacttattatttgatctttttaaataagcaaattattattttttttaaataaactgatttttattatttatcattaagaacctagcagacagtataatttcttgaatgtgaaggaatttaggcgtgaaaatgcatgataaaatccgaaaattaactgaatatacaaattacaataatattcgataaaatctcgaaaaatattatgcaaataatatagcaaactaatgttttgttataaacttaaaaaccaaaaatatgaaaaccaaacaactacttgtcataaagattactaacaaatgagaagttaaatttaaaaaataaatattatattgcgaattgaataaatgctataataacctataaaaattttatttattaaataacacccattaagtaaaaataatatttacaatattaatatttattcaactaaacatttacattattcgagaaaaaaatttatcgtatgcaaaattaaattgattctattcatcttccattagataaaggtgattctgtaagaaaaatacaagaaaatgaaaa

SEQ ID NO: 3918 - DNA, 2415 bp, Heterodera glycines
  misc_feature (1713)..(1713): n is a, c, g, or t
ccataattagtttgagtaccccaaacggacacttgaaactatcgatttttttatttcataaatattttttcagaaaatgctctgaaacaaaaaattttcaaaattctgagtctcctattattttatttttttttcaaaattttgaagggcgggggggggggcgacataagggatataaacatgaaaatagactttttatcaaatcgagtgcatggttagtgctctatttcaaaggggatatattttttattaatgattatagattatttatttattttttctccttccatgctgtacggacgggcatttagcagaaattttactaattaaccacaaaatttattgtttattttttcggaattagagaatggcattaaacccaaatttgattacacgcggacttaagcattcttaaaagtctataatttaagccaagcggtccgccacttttgaattatgtgtgtaagtcaaatgggaacagtgaaagaaggcacatttcgtttcttaaccaatttgatttgcaaattgtgccgacaattccaaaagatgacgacagcatttattacgtggagacacaatgccataataagggaaatgaacatcaaacattcaaatcggtgacaagtggcagcattaaaattgttttgcacaaatttgcttgtaaatcgtacgacattatggcacgaaaagtgccgaaaaattggacccagcaaattgaattggtaatgtgatttatataaaattaaaaatttataaaaaaaaatagaggcaatcgcaagatttcttaattgcatttatatttttcgaaatttaattgactgatttttataattatgctaatttaataatttgttcttttgctttaaagtataaatatgcaattcgtcaaataaaagatgccaccgaattaaatgtcaatattgataatggatatgtgtacatttttgattatgaaacactggtccggacaaaccgcagatggagaaacgctgggccttcatcggtaatctttaatgtttattttaataaaatttcgttctgctatccattaacgaaagcggttttaataactcttaattgttctaatttggtaaccttgaaaagttggtatttgcgttaatttttctttatgatttttttttcgtttttgtaaaattttgcctattttaagaatgtcaatctttttgatttgaacgtggaagattatgttgcatcagattatgataaaatggaagaggaagacagaaaagaaacggaattaaataaagcaagaatggatgaaacggatgatgattgtttttactatttcaattaaatttgtatctttttcatgccttttctaaatgaataattttaggataaaatggtaaaaaaaatttaatctttggttaatatttttttttactaaaagcattggtcacattcacaaaaaaaaattgacaaataaaaaaagcttttgcttctgtggcttcatctcctacgcttgcttctgaatgttaagtgttgttttggcggccgatcagtgcctccccgttgatcaatccccgagtgcgtcacgaaccgcctaccatcatggtaaaaaaaccatgttaaatgactacgtggtcgggaggggtcggtttagtctggccgttttagtcagagggttggtttagtctggccgttttagtcagggggtcgttttagtctggttagctgttttcacccacaaanttaattactttttataaatttcttttgtttgtcaatcatatacataaacataactttaaaatgtctgtttagctacaaatcaaatggaaaactccaatcaggaaataaagacaaagcgaaacaagcagaagctggaacatgagggtgcactttatgttcttcaccaactcagtgacgatggacttcggaagtactggcgatgcgagtttttcgggcctaacgataaatgcaaaggtgtatgcaaaaataaaataaagactatttttcaaatttagggcgccttcacactgatattcatggtaatgtcctcaaaataattggaagccacacatgcgacatgagcgccgcacaagtggagtgtcagcgacgtgtgacccagctcaagcgacgtgcagttgagacgtgcgaagcgccggctactattcgtgcgcaagtattgcataacacagcaacccccgtgttggcagcttttccgaccaaagctgcgacaaaaaaggtcaacgtttgcaaatttttatgccaaaatttgatttttttttcctttgctttaagttataaaacgtgttcgtcgtgacgaagatgtaccacctgctgcaccattcagtttggaagcattggaatggccgccctcgtacagaatgtacagtcgaacagagactggcggggagaattttttgttggcagataccggcgtttttcaaa

SEQ ID NO: 3919 - DNA, 4789 bp, Heterodera glycines
  misc_feature (14)..(14): n is a, c, g, or t
tgttcgggtggacnccgataagacattatttattaaatttgtttcatttccatttattgtttgtgtctgacctttcactgtcagacacattctattgattgtatttgtgaccatttgccctcccctcttttcattcattcagtttatgatatttgtgttcacattttccaattgtctcctccgccgtcctccgacatatttatttgttattttaatttgtcttcaataaatatttatttgttcgtccattcgacatttcggggaccgaacaaattggcgacgccctacatttgagctcagcgcctatttgaataaattgctgagtgcaatttattgaatttgtctgcaaaaaaaggtcggccaggaggcaccattattttcaacaagccaaattcgtcgatccgattaatccgccaggcgcggttaatcgtggaatttctacaaaaaaaaacccagataccaatacggttgcggtttccgccaggcgcggttttattcgacacaaaaaccaagaaacctaggcggttgaggttccgccaggagcggttattcgacgaaaatggccaaccaaaacgcgacaattcaacaattgattgacacattgacgcaacagcaacaattggttcagcaattgctgacacatcaaacgcagaatttggctggacaagcaattgcgcccacaacaattccggcacttcccgacatcatggcttttgagcagaatgatgataaaagccgagtatcggaatggatctcgcgcttcaaatttgcacttgactgtgccgcgccgaatgccgccgacggaatcaaggttaaggcgctcatgaacaagcttagtgaagcagcgttcagtgagtacagccgttcggtgctgccgtcagcagtgactgattttaattttgatgcgacagtgcaaagaatggaaaagttatttgcgcgtccgcaatcggtcttcattgatcgatatgagtgcttgaaagcggtgagaagtgaaggcgaagattttcgcagcttcatcaaccgacaccgaaaattgctcgccgatttcaagttcagtgaactgaacaaagagcaattcaattgcctaatgctattaactgcattaaaatcgcacagcgattcggctcttcgtcaaaggattttggcgaagctgtcagcggacggaacaaacatcacttacgacggagttgtggaagacctgattaatttccaggcaacaattgtggaggcaaaagcaattgaagcaccgacaaattggaggaatgtgaatgccgtaaatcggccggtgaagcaaaacaacgcgccgaaaatgcaagttgccaaagtgccagagaatcggcaggcgaataagaattgctggcgttgtggagctaccgatcattggggcagcgagtgccgattcattggagcgaaatgccgaaagtgcaaattcacaggtcacattgaaaggcaatgtgaaagtgtgcagcaatggcgtttgaagaacaaaggcaagaggtttggcaacaaaagaattggccaattacaaatcggtatggtaaatccgaaaaatgacaccgattcgctgaagacgaaaattcggttcaacaaaaagccgattcaatttgcactagacactggatcggatgtgaacgtcattgatgttgactcacatgtggaggctgggagcccaccgatcgaaaagtgcactgaaattggaagagctttcgatggaacgccgattcgattcatcggaaaaggctttggcacatttgaatttggaggaattttgatcgagaatgaaccattttatgtggcaaagcgtggatcgcttaatttgttgagccgccaaacaatgggaaaatttggatttttggatggtattaagcagcggatcagcgaacatgggatcaattcatgcagagccaccaaccaatttgagaagcacatttcggaattgaggaaagaattcccgactgttttcgaagatgcacttggacattacatcaaagaaaaagcgcacctcgaattgaaaggaggagccgcgccaatttacagaaaggccagaccggtgccacatcactcaaaagacgtcatcgaacgtgaattggaccggctggagggcctcggaatcattcgaaaagtcgaacatttggattgggccgcaccaattttggtagtgaaaaaggcggatggaagtgcccgcctctgcatcgattattcaacggggttgaatgatgcattaatcgactaccagcacccgctcccaattccggaggacattttcgcgacgttaaatggaggacaattcttttcgcagattgacctcaaagacgcgtacttccaggtggaattggatgaggactcgaagaaattgtgcggactttcaacacacaaaggcaatttcgccatggaacgtttaccgttcggcgtaaaatcggcgccaagcatttttcagtctattatggacaaaatgctcgcaggcttaaattttgccacggcttatttggacgatattatcgtcgccagccgatcattctccgatcacatccagcatttgaaagatgtgttcaaccggctgcagtcatacggattccgtgtcaaaatgacgaagtgctcatttttccaggaggaaattaagtaccttggattcgtcatcgacaaaaacggacgcaggccggacgcatcaaagattaaggcaattactgaaatgcctgcgccaacgaatctttctacattgcggtcctttctgggaatggtaaaccattaccagcaatttgtgcaaaacatgcggttcgtcagaaaaccgctcgacgatttgctaaagaaggacgcagaatggatttgggccgaaaattgtcgtaaagcatttgataaattgaaggagattttgacttcaaatttgctgctgactcattacgacccgaatttggagatcatcgtttcggccgatgcatcagaacacgggatcggagcagttattgcacatcgttttcctgatggagcgatcaaggccatcgcacatgcatccaaatccctcaatgctgctgagaaaaattatgcccagattgagaaggaaggattggcattaatttttgcggtgcaaaaatttcataaaatgatttatggccgtaaatttgtccttcaaacggaccataaaccactcctggccatttttggaaacaaaaaggggatcaggcagtgcagcgccaatcgattaattcgttggtcgctgatactattggcctatgattttgaaatcgaatatttgaataccaaagattttggccacgcggatgccctttcaagattgatcgcgaaaggatccgacgacgaagatgagcgagtgatcgcttccgtcacagaagagtcggaaatggaagaccttctaaaattggccactaaaaatttgccgattaaatttcatgatttggttttggcaaccaaaaacgatgctttgctgaaaaaggtcgttcaatttgtgcaaaaaggctggccaaacgacaaagatttgagcaaagaagaggaaattgtccgattatttcaccgacggatggctgatttgtcaatcctcaaggattgtttgatgtatggcgaaagagtggtgatcccgaagattttccaaagcaaaattcttcacctctttcacaaaggccatccaggaatgaagagaatgaagcaattggcgcgtcagtatgtattttggccaaagatggaccaaaacatcgaacaatttgtgcaaaattgcgagccttgccaagctgcggcaaaggcgccggtcaaatcgaaccttcattcgtggccaaagtcaacagaaccctggcaaagaattcacatcgactacgccgggccattttatggaaaaatgttcctaattgtggtggattcgttctcaaagtatccagaagtatttgagatgaccacgtcttcggccacggcaacaattgacaaattgagatatttgttcacgcgccacggcattcctgaaacaattgtttcagacaatggaactcaattttcgagttcagaatttgccaaatttacagcagccaacggcatcacccatctcttttctgccccgtataatccgatgtcaaacggacaggcagaaagatttgtggacacatttaagcgggctttccgaaaattgaaaggggaaggaatgccgaatcaggagatcatcgaaacttttctgatcacctacaggacaactccgaacgattcgcttccaaattcggtgtccccagctgaaatgctgcttggacgaaagcccaggactacatttgatttgttgaagccgccgccatttcgaccactgatcagggatttggcgatggaagagagattcaacaaacgatttggcaccaaatcacggaaatttgaaattggtgataagatctttgcgaggcatcgatcttctgaagattggagacccggagtcatcaagggatgctctggcgtcatatttgaagtgaaattcatggacggatcaaagtcgcgattccatgcgaatcagctgcgaaaccgacaaaatatgaacaatggcgatgaagcattggcgatcttgaatgatgcctttgcattgccattgccacctgcacaggctaatgaggtgccagcagcagacccgccggcagatgaccacgaaggcaatggactcgaagaccaaggcattgtgcgatcgccactgatcgcggaccgaaatcagcgccggtatccgcatcgccaacgccgtgcacccatccgctactcgcccagctgatcagtgatcaccggacgagccaaaagggggaggtgttcgggtgggacc

SEQ ID NO: 3920 - DNA, 1519 bp, Heterodera glycines
cccccccccccccccccctgggggaccgtcctggacggcgggagggatttcgtgtaaaacacgatcctggcgggatcaaaaagcctgatttgggattttatttgtaagtcggaagagatctctggaccttttttaagagaaaagaaactacaagatatttctagtgatgctcgagaaactcgtacccgagtatcaattagataaaagtctcagatttttgggattcggtcagtctcgtgaaattccataaactccactgacacctggccatcctcctttgtcagtaaaaagatttttaaattaatttaattattaaacaaatatataaatacaggtaatataaatgtaatgcccaaatttttctcgacgtcgtgtctgccggcgtaacaagaccaaactttcgtctttttcatcttttttctcatttcaactttcactgattctatatggtcggattctgtttgatatttttcctaatttttaaaaccaattttttctctgcccactcactttttcaaaagctattcccgaattgaagtcgagaaggacgaaaagggagaagaggacggtgaccataagctgaagcgagtcggcgatgctcaaagcgaacattaagcgaaagcaaattcgggagcgaaattcgcgcacagacaaaaaaagcttaaaaatagaaaatgcacaattaaaatgaatatttaaatcaattaaataataaaataaaagacaagaccggaagtgtgaacagatggagcaacaaaagagggaatgccacgagcaattggaaggaggcgaccagttccgccttcatttgacagtcaacaggatgccaacttttggcttttcacctaaaaatctgtgcactgagtgccgtctaagattgtcaaaatcaaagaatgcaaacactccgttcttaaaaagtgaattattagcatttaatagaccgcgattaataaatcaaaaccaaattatggggaatggatcgtctagttcaagttttttggcaattatcatgttatacattgctggcaccaaaaattgctcctaattatgccgccacccttctgaaaagaattaagaaaaataaatgaatcaaaatcaaagaatgcaaacacaccgttcttaaatgtgaagcagccctgttcatcggtttacttcaattgggccccccaggctgagccccgaagggtcttggattataacgttttaatttgtcgaccaaatccaataatcttggtatttccaaaagcttaacatgtttagaagctatttctaagctcacaaagtacataaactgtatttgccttacaaaaagcataaaaatttttctagcatgccaaaaagttactaattaaaacccataaatatcgagctttcgaaattcgaataatatcaaaattgttggaattggtcgacaaagaaaaaagttatagtgctggcgccaaaacgacccccattccaaagtgtgcccccccccactctctgtcaatgtgtgcatactgtagttgatcaagtactgtga

SEQ ID NO: 3921 - DNA, 3119 bp, Heterodera glycines
  misc_feature (2257)..(2257): n is a, c, g, or t
gccctttagcactctccgctgtttgatggctattgggacagaagttccaaccgttctgctgcttgttgtactaaaaggaagttttccgtctgcttttgccttgcctaatggtcgttcacttgggatgtcgttcagtttgtgcctttcctgctccaatttctgcctcaattcctccgcttcccgtgccaatgcgtcgatttggtcgcacaaaaaaagcgcagaatacttttgcactgtttgggttttaattaggttaatttcaaatcaatgcctgatgaactcaccagggttttattgttgatagtcaccctatttgtctccaccaaaatttccccatctttactccaagtaattgtcggtgacggttcgccctttaatatagtaattttaaacaaaaatcactaatttcccaacctcaaagtgagttcggactgtgacactatagtctgaaccaagtttagagcatcataacttttttctttactgaccaaatccaacaaagttgatatcattcgaaagctcttaacaagctctatcagctccccaaaaatcgcaaagatataccgacatgtaaaaaagtttaaattaaaatatgcaaaaattctaacttttgtgcagtattaatgttgcaactttttcatgtttttcaatcgcttagaaatagcttatcaacagcttctaaacatatagggctttagaatgatgcgaaatttataaaatttggccagctgagaaaaaagttatgatactttaaacttggctcagactataacggccagactatagtgtccccaccccttatccatcaaagtgtgtgtgccctgctgtccgtctccctctccctcttccccactctcttccgccgttgatggcaatggcgaaggaaatggcggaatgacgccgctttttccagtacaaatttttaccttgtcaatgccatcaatgtattattgttttcgttccaattcccttcttacatttacaattgtttttctttcattgccattttcggccgatgaaatttctgacgacgaaacaatcgaagcgatcggacgcggtttgcccatttgggtgccacttttgacattacgaactgagcttgggggagccgatgttgagcttaatggacgatgggagagaagtcgaatcactcacaattgccactggcaattcgattatttttaaaaatgccaatggcaattcgattaattatttgaaatgccaatgaatcgtttctctctcacttcgacttgggcactgctgccgttgttctgttgttggttgtgttcggtttgaacgtgtgtttgtgcgccagtgactttttcccctttttttctcccccttttcctctgattttcgtcgtctttcgttttgtcgtccctttggtcgcttcttctgttgttgtcgttgttattgtcgttgcttttgtcgttgtcgtttccgttgttgttgcttcagttgttgttgttgttgtgctgctcaccgtttgtgttggttttgcggtggacactgaaaatggcactcttttcatcgttttcttctcttttcatcgttttcttctcttttcatcgttttcttctcttttcatcgttttcttctcttttcatccttttcttttcttcccaattaacccccttttttcctccctttttcctcctcttcctcttacccccgccctcttttgaccgaccattccatgccttccgttcttctccaaattggccaaatctctgcaggacttcgtccgccaccactttcaccgcttcccacgtctcttctgccgtgtccataatttcggcctcgggtagtaaaaatcccgtgctgtgcaaagtgttctgaggtcgaagttcgatgagaaatgagtacggaatgttcagagagcccttggcaaagtcatgagaagcgccggaagcctcgtctgaagagaaaatgctggcaaattgtaagaagacataatcactcacagagaaggtccgctccggagcccacttggtacttagtgctgtaaagccgcttcagcgcctgaacagcgcgaagcgaaagagggcgctgaattgggaaaagggttacggcggtgaaaaacgacttttgcgaagaatgttcgaattgcccccggggggggggggaggggcaggccaaaaggcgcgcaatgcagcgaatcggtcggtccgttcgccaattacccgcccctctccccaaccagtttgttcactcttccccccgtccttccacgtacccaaaagcgttcacccatcanaagcacgaccattaattagttttggtttcctcccccccaaaatcgcagacgccatccttaatccgttagaggggggggggggggtattggcgaccgactgatcggtcgctctttgatcggtcggctttctttgactcgttaaaagcagaagcatttgactgatctcccacaaaagggactccgttgttgcgaatgttcgcaatttttattatgcataaatcgcaattgacttttccttctgccagcattaatttcatttcaacaaattttgttccagttttttaattggccaattaaaaacaataattttgacttaggacaaagagaattccctcggcgtaatgaaagtgtacaccgccactttcctcgcctcctccgtctcgggcatttccctgctcgcctctcttgtactgatcgccaacatttacagcgatgttcaacaaatttggcaagagttggaccaacaaatcgctgggttccgtgccgaaactgacgacctttgggtggacatgatgaagttgggcaagaagttgcgcgtccgcgcccgccgtgacgccggctacgcgggcgcagaaagcgcacccaaagcgaatgcgcccgtcggtgttgcaccctcggcgcgtaagaacgaatctttgcacttccaaatagtttctttgttatttaagctgtttctggcactggtcccagtggaaatgcccctggcattcccccaggcggcgcttcacccccaagcgttccgccgagcattcaaacaaacggaccgggaggtgccggatgcagtaagtggtattcaccatcatcaaaaccagaaacttaaaacagacttcgtacatatctgtggcggcaatgactctagagg

SEQ ID NO: 3922 - DNA, 1152 bp, Heterodera glycines
gatggtgggtgggcgcaccagagcgaaaaagatgctgatcctctatcatcatagcttcaattgcccggctggcccgcaaggacaaccgggcccaatcggacggacgggcccaaagggacacccgggagcaaagggacagcccggacacggaggacgggacgggaaccctgggccacccggcgaatcgggtgcccctgggcctgctggccaagtgggacctcccggactgcccggagagaaagggcgtgacacagagcagcaaatcgggcgccaaggacctcgtggtccgcgcgggttgcaaggcgcagaaggaatagccggagagtccgggctaaacgccccgccgggactgcccggacccgcgggggaggcggggacgcaaggagtgccgggagtgcagggagcacaaggaaggcccggcgaggaaggaccgacgggacggccggggccagacgcagagtattgcccgtgcccacagcgatcgggctgagagaaatgggagagaaaggaaaacgaacggacgaacgaacgatcagatcatgtgccaaccaacatcaaataaaaaccgacaaataaatcacttcctttaccaaatttcccacctgaatttttgtgtaatcctccgggtaattgcgtcgtttgtgcccgtagggaatcagccaaagttgggagtacgaatggagcgtgaaaaaggccttcaccgaatgatcctcgagaaagtcgcggacggacctaatttggggaataagtcactaaacagaccgtgcagggctaggcttttgagagattggattgtgctacaaataaatgaaaacattttaaagtggcgcttaatggtccgacgaacaaatccgtattttgttgtaaaatcgaacagtttctcttaatgaccttgcttcgggctcactgaatgctgaggggccgtggtatgtctcatggcacgggtcggcactcgaaccggtggctgaacggagagaaagtgccacggaatggaaaggaaaagactcactggaccaaaaccagtcgaagttacggttgaggtccactcccgagcagcaaattcggttgaaatattgctgcctacaaaatgcgggtcgtctgttcttgcgccacattcggttcttaaaggagggggggggagatggaaggcca

SEQ ID NO: 3923 - DNA, 2092 bp, Heterodera glycines
ctctagagtctgcaatttgaaatatttattttaatctatcggatttcaataattacccgcgaaaactctttttggccgccatctcttctaaaaagtgccgcctttcttcgtcctttggcattccgtgccgttcgccgtcgccatcggtcaaagggtttttgtccgacaaaacatcggacaaaatggcaacggaaataaggaaaaaaatcgaaaataaattgacggatgccagagggcagaaaatgggaagcattaagccatcctatggaagcagaaattggcaatgattgaattggaaatgcgatcggaggagaagggattggaaggaacagcagaggatttggttattcaaaaggcatcaaaatcgaatgagacgaagccgaaaagagaagctcaaacagacaaagagcggacggacggagggggagggcaggaggggggggggacactctttgctttgctttgctttgactgaccgctgaccgtctcgcggcaattgtcttctggagaggcggtcgagagcggacaaagcagccgagggaccaataaatgacaacaaacagtggagactgaagtggacacttgagcagaaacggaacggaggacaaatgatcaaaaggagcgatcagaaggacggcgcaaaatgagcgaaagcaaatggagccacgaattgggagacaaaattggatgtacggaagtattgaaatgggataatgccactcaaccgattcagtcccccgccttcgcttttgatggcatggagctgttttttgaaatttgtttttaaaagtaagcagaggttagaaaacatctactgattgcattggaaaatataaaattataaaaaaattttttttattgaatttgcacccctaattttcatttttagtgcatattttacgactttatttgcatatttatgtgcatattttggccacttttcgtgcatattttttgcatccctgataattagaattttaatttttttttttttaattttaggattttttcgtggaaaagtacggttgtactggtgccggttgaaaacccaggtcccagtcctggtggtacagatcatcgcgataccgtcagtaccggtcccaattcttcccaaaatttccgcttcgttctttttctcctctccattttatcccctctcatcattcttttcgtcttttgaccccatcgttcgttttgtccttttcctttccctctgccgccgaactgctcgtactgctcgctgatcccaacgatgactttggcgttggaatgtccgtccttcccttttctgtccttcccatttcagtccttcccatttccgtctcttcctctgcgatcattgccaatgctttgcctccgccgatcgcttcttccttttgacccgatttgttcaggtcaaaatgaacatggcaatgcgactttgtgctctgatcagaccaaatgtactttcccaattccgtttttcttctcccaccgtttttcccatttctccgttcgttggttttgcgtttgtcgtccttttggcgccccataaaaagttctgcaccgattgaggacccgacccggtggaggcagctgagttgacggacaccctgaagatgggcacaatgggtagccaacaaccaattaattagtgtacagtcaattggtgtcaattcactccggatggtgggaaatgccatgccaaggaaagtgtccatctccttttttctaatgcaaatgtctcctgcccccccccccccaactttttcaaattctctctcatttttggcttacctcgtcgaatttcccctctcaaaatcgccactttcgcttgatgcttctgagtattaatttgcttaacatttcgttgtctttccatcagtgctttactttttctcgattggaatgtcccggaggaacgtgagaatttccttcgcattgtttcgatgaatttgctcgtctttcttccgccctcacttccgtccgtattttgtaccacacttttcaaatgtcccttttccccttccgttccccctcttcccttcaccttatccgtcgctttgggttatggttttgcacctgtaccccttgttcttccgcttcccccctt

SEQ ID NO: 3924 - DNA, 2429 bp, Heterodera glycines
gtattttaggattcctttgcttaccatcgtcggaaatctctttttcaccggtgcactgatgtccctgtaaaccatcgcttggacgagcaccaaatatcgcacaatgttccgtcggattatccgcgcctcctccgatttgccacgcaaaatcgtggcgattagcaaagcagggcttaatgggttggggaattagtaaaggaaaacctacatttttgcaataaagagttgagattagttaattagttgccaacttacgaatcgatccaacccaaatttgtgaacatttcattccatcggttaaaaactgccgagacataaaagccgagcataaaagtgattggctaaggggaaaagccaaacaaacatttggaactaagtaattaaaatgaaaagcatgctaattaacaacgcacaatgtaatcggaataagcgtggaaaaacatgcaaatgtcctcgaagagtctgaagaggaaaagcacaatgaaatgagaaaacagaaaaagaatgagcgagggaaaaagggaagccatgggactgaattggccgtagcgaagtcaatcgaaaaaacgaacatttgctggtttttcctcatcagttttctgtacgagaaggaaagggcgtagtaagtgcatagccaacagacaaactcaggccaaatggacttccaaatggagcccttccaacggagcaaaagacggaaaaagccgagaaaagtggaggaagagacggacaaagagtaagtgatggtcattagcagagggatgggagaaaccaagtcgagacaggcgagacagcgaagaatgttcgatcgaagccgggatttccgaagcgttgccgaaactgacacgggactgatcgatcagagtgctgcgaaagaatgtggcttccgtttgccaattttgccttccggtcgaccgattgatcactgatcatctctctgttcttgccgttttctgtctgttgcgcttttctcactgtttgccctgtcgatggattgtcaaagcacttcaatttgagattaattgagcataatcagaaagaaaggaccagcgaatggatgataagtgcttcaaaaaagaacggagagaaggcgaaacataagcaaatggaagaagaagaagaagaaagaagaaacattatttgacattaaaacaccgagaatcaaaaaaaagacctaaattcaaattattcttttaaattttggagggggcgggatgtgctttctctaccccatttctctctctctctttctctaccccatttctctctctctctttctctaccccatttctctctctctctttctctaccccatttctctctctctctttctctaccccatttctctctctctctttctctaccccatttctctctctctctttctctaccccatttctctctctctctttctctaccccatttctctctctctctttctctaccccatttctctctctctcaatctctaccccatttctctctctctctcttcctctctctttctctctctctctttctctccctctcttcttcttcttctcattcccctcccttttcttgaccatttttcttctccaaataatcgccccctctttttgtttggtcatttcgccgctttttattccgcctaattaagtgcgaatatgtaaataatgagtgaacttttctcatctgctccattacttcattacgcatcatcaacaaaaacagcaattaatgcaacggcaaatgctaatgctttcttcgccaatggggcaaataattggagagaaaaggaagcgaaaagcggaggaaaagcacgagtggttgctgatcagattcgaacattttgatccaaccaaaggcacttttgttggcattgatcattcgcattcaaagtgatcagatcaccgcttctttttataatcagtctcagcatacaccaaccttttgcactcggttttgttctgcttctgatcgcataccgtaccttcctgctcatctcttacagtactttccccagttcggctgctaatcttcctaattcccccctcctaattgatcgttggaccatttcaatcacttctgatccatccattcattcattatgatcactttgctgtttttcctttttgccttcgtccataagcattagcgtaaccttaacagctttttctttctgctgcttttccctttgtttttgcttttccttttctttgaccaactctctcaattaagccactcttttctcagcttcgtctctccaattggccctttaaaagggcgccccatttggacacctccgaccattcgtcgttcgtttgtctttttctgttatttcatttggtcgcttatcggtcccatcggtcggtttcacttccctcggccgtcagtgcaacagttaccattccaaacgttgtcaccgctaatgcgtgtttcatggatta

SEQ ID NO: 3925 - DNA, 3661 bp, Heterodera glycines
  misc_feature (72)..(73): n is a, c, g, or t
  misc_feature (77)..(77): n is a, c, g, or t
  misc_feature (118)..(118): n is a, c, g, or t
ttagcagatgtgtccttattctggaaaatttccggatgtttattcagctctttattgcgacaacttacattnntctntagaaaatcgtccaattacacttgtactccgacttctgccnaaatatgtttttcttggtaattggggcatttttgacttgaattaattctaagagtcaaaaaattatgtttagtttagacaaacatttctcggtaattttctaagattgaaaaatttagttttagaattttctaggcaattttcattaaaaaatgttttaaaaaaaatatcgaacaacaatcatccgcaagaaaattgcagaaaatgacacatattaaattacctttttcctcgtcaaaattgctttcaatgttgtgtgattttgagtgatttcctctctcatattttgtttggtcggtgttacttgggcgcccgccgattcggcgccgccaattctcaaatgccttaatttttgaattttgcaaattaacagaggttggccctagcgttttcgagtgacaccgatttttataaaattttgttctcgaataaagaaaattattacccgtgatgctggactagacggtgcaagactggacaactccaaactgtacggtgcccaactggactgagccgaattggacggcgctgggctggatggtgtcgaattgggcgtctccaattttctcgatgcttgactatttttgaattttaacatttctttaaacgactcttccaagttgtttgattttgagtgatttcctctcacatattttgtctggtcggtgttacttgggcgctcgccgattcggcgccgccaatttttaagtatctaaattttttcattttggaaaactaacagaggttggcccaaacgcttttgagtgacaccgactttataaaattttattctcaaagataagaaaattattacctgtggtgatgaactagacggagtaaaacttgacggctctctgctgcacggtgccgaattggacggcgctgggctggatggcgtcgaattgggcgtctcccattttctaggtgattgactatttttgaattttaacatttctttaaacgactcttccaaatgtgatatgtctaaagaaatattaaattttacagaaattctatttagaaatttttactgattttataaaatttaaacggtagcgaagtgttacttattaccattatttttactgatttgccccatcatttgcaagttttttcttctctctaattccccgcttttctttattattagttccgttctgttgaccacttcttaaaaatatttgaattaattaattgtttaaaaccaaatttattcttctagattatggtccgccccaatgtcgggatttggaaatctaaggtcgggactgagttgaccaaatgatctgagtcttttttttgctcgggttcggaaaagccgaagatctcagaaaaatttgcaaaaatgctctattctatgacatgaaatataattattattattttttttatccaaatttaccagataatgtcaaaccgcgcaagtttggactcattaacccacttttctccggcgaatcattacgaaattttttcctggattttaaacaacctccacaaaatgctccgcaattaaacaatgcaaaaaagagaaaaagcataattattattttcatagaaatcatttagcggaaatgaaaaaattatacaaattgacagcaaataataataatttgcttataaaaaattttccgcaatcaatgaatttaaataataatgaatattatagatagctatttgataaagaaattgttttatttttcatatttttatttatgcattattgacgtttattaatgaataatttatgccataattggaaaattaatgtgaattcacatgaaattttaaaaagattataataaacatatttaatttaatactaaaaattgagtaaatttaatgatttgttaattttttaatttttcctttcaggtgattaggaaaaattgtataaaatgaaaatttacttcgtaattttactatgattttgaaacctaagaaaaattatattttacatttttgacgaaactttccgaactctgtctattgtgaaaatattaggctaaactatgaatggttcgtgctacgttattttaatagttcaattcatagggctgccaattttatttaaataaattttttcctggattcattatggtacaaatagaagaaaaacaatcgttgcgccaggaatctatttaaaaagtgacttttttgtgtttgacaaaaaatggacggcttcaacacgggcatgaaccaaatgacaaacgttcttgatgctagtcaaccgtgggtggaattaatgtcgctcgatgataaagaatttgatgccgggtgcgttgagtcttgagaaacagggaaagaacccgagaacccaacttagaaggagaaagcgcaaggagagaccccccaaggccaaccggtacataacggcattccgttgagcatgagcattccgtctaaaaagtctctaagcgcggtgcgaggtgccggccatgggcgcgtcttcatccgaggacgcgggggacaaagctgtggagctgtaacgggaacctagtttcacatgtgcgaaggcaatcgagcgcacaatcagcaccacaaccaccgtcactcggtcccggggccgccaggacattgccgataccgtaactgtcagctgccgaaccatcattttggcattaatttctgtccatatgctccgcgttgacaggctgccgcagaatttcaaagaggtaagaaatggactgttcgttaatctgtattttaacccaatctacttttttcctttgtgttcgctcccgactccccacacgcttgactcagccaatttgttatgtaatttatgtaatttccccgcttaatgtacattcttcctcactccctttaattctgcgtctgataagaattggttttggcattctctcgttccatccttgcctacaaaaacattgtcaccacttactctcggctcttctctctcctatcctaacctactattcctgctttcaactttcattcccaacctttacctaactttctaaataaacctcccattaggaaaaaatttgcaaatcgtacatttcaagtgtgtaattgggatataaaatcaaatttttaatacatttttttgtgcgcattttttaaaaaaagggggtggatccggcggcgccgatcattcaatagttctaggttttctctatcagaataaattttaaatttttttataaaattataaaaaagtatggccaaaaaaatctaaccattatttttttttaatttttaagataataaatagctttctttatacttaagtaaaaaaattttaaaaaataatattctaataaagaacacttcatgctagagcatttcttttgttaaacagttaacgaaacaaatatcaattaaataaaatagtaattatttttacttcgaatttgtcatcaatgactcattcggtattgtattgattacggatttcgagagcatgcgctgatcagaagaatcacccgatgtccatttgaaatttggttgaaaatgacccaattttgaataacattgggaatgcaaatatttttgaaaggcaaaacataaagaccaacat

SEQ ID NO: 3926 - DNA, 7115 bp, Heterodera glycines
  misc_feature (3485)..(3485): n is a, c, g, or t
aaaatttgcagaattgcgattggcaaagagactgatcttgaagttctctgcgaaatgctcaatggaattgcgcaatgtgtggaggactttggagggaatgacgccattgtgacggaccaagatgtggcgaacattttctgcgtaatttaccaacaaatcgaaaactttgacaagcgacgggcggagagggaaaaggtgactttttatactgaaacaaatattttttgaaataattacgaaataagtaattaaacattagaagtgctaattgaatagttttttcgaatttattattgcctacatgttatctcgagattaacaataagtcattttgttcgtttgtgaatgaattgttttgtttagaagtctaaagaagaggagcatgacgaggaggaccaagagagattagacgaaatcatcgaactcgaaacttcggttttggcccgtgtgtcggacatcatccattaccttttcttggtacaacgatcattcgtcctttttgttgttgtaaatgtcctctttcttctcacagaccaaacgcgaggctgtcatcccccactttgacaaaatggcacaaatattcgctgcccttctcaacccgcgacgccctttccacgacagacagtggggcctttgcatatttgacgatgtcatcgaatttggaggcgaagttggcaaatggaaaacgaaatccccgccatttaattgggagttttgaccttttcagttgagtatgcgctatcagaatattttcttccaaccgatggtcactgctttggccgacaaatatcccgaggtgaaacgaatgccaataatttatcattttttagtttttgtctttttaggttaggcaggcggccgcttacggctgcggaattatgggactgaaggggggacaggtgagtaccaacgaaaaacggcaaataaacaaacatttgatcacggatttcagaattacgcgaaacattgcgcccaaatgcttcagccattaatcaatgccattgagaagaacgggtcgagaagcaccgaaggtaggcaaaggaaaagaaaaaggaacaattaaacggctagattttaaaagataagaaacatttgttcagaggacacgcgggcgacggaaaatgcgataagtgcggtggcaaaaatactcaaatacaacgcgacagaagtgaatttcaacgaggtgagcaaaaaaagggtggagaactggtggattgatggttcgtatcatcggcataatgccaatggttaaggttgtgccgcgtttcgttggttggttgcccatttggaatgacgaggaggaggtgccgtacgtgttcgacttcttctgcgatttggtcgagtctcagcacgacgcagtgcgagaggacccgtctcgtgttttccacgtaatttttcattatttgttaattacactcattaaaaagcgtctcgcttttggttttgttggcgtccctttggagtgtcgttcattcaaatggcaaaatgccttccttcccttccttcagattattctaaacgctttttcgcacggtgcttttgaggacgactcggcggaagagatgcgattggtcaaaagtcggatggtccgtttccaattgaaataaaatcgaacaaaacaaatttaaaaaatggatttagaagggaataatggcacacattcgtgccaatgaacagttgttcacgcaaattgtacaatcgctacaattgaacactcaccagcgaactgtgctggagcaaattttagcctgaggggggaaagcggtgacaagcgacggaactgatcagagtgatcaatgaaggaatgataagacggacattaacatcggacgaaacggataccaattaaattcaccctttattatgcagatgttgttttgttatcactatcgttatattaattatcaccatacaaatgcgcttttctgtttacgatcctttgcgctttgttatcgttttgaattgtgttagttgtttaactaagaattgttacaaatgtgccaatttgttatgaaaaataagttttgggggcccgacggtaccgataggcgccgccggaggaaaaatagaaattttgagtttttaacagattttcactgaaattttggggcattttacacacacgaaaatgaatcaaaatgtacttttttcaaattaaaattttttcaaatattcgcttcaaaaaaatgatatgtagggctgcaacttttagtgacgaaaaatctcaaaatagttacctaactaaaatagtgagtaaaaattccaaaatagtgacaaaatagtggcaaaaagtgcgaaatagtgacgaataaaggggggggggggtaatctacctacactgtaagtttcattcggaagtcccaccgtcacttgggtacctctcctttgttaggggtggggtgtattttttaggtcgattcttaggggtgtattttttggttttattgcatttttgttaaggaattttccaaaaaatgtcgaaatagtgaaaaaatagtgacgatacgccaaaatagtgatttctagttaccgatagtgacatcagaatcgaaaatttttaatgcagaaatgcgtttttttgagctcctttcttcaaatcaatcgagcaaaaaatttagttaaaacctaaaaatcgcagccctaatgatgtgatatgaattggagaagtaaattaattcgatcattcacaaaaaaaatggaaaacagaaaaataaagaaaattgtacactgcgaaaacgttcactgacgaaagtgtatttgaaggtttttagcaactatttcccattttagcaactatttttggggtttttaaaacctaaaaactattttgacagttttagcaactataaatataagccccaatgaccattatctaggattttcgcctcaagagactaaaaaattcagtttttttttgataaagaccaaacatggaaaatcataaatttttcaaaaaagacaaattacaattgtcgagagagaagaattaccaaattataatcagactcaatattgaaaattttctgatttcgtaatcggacattgtcaattcgtttatcagttcaatttccccgtgtttcaacttttgcttgttcatggcaatgccttttttctcctcaattttcttcttcagctgctgcacggtgttccagtcatgaacatccaattttaataagaccaattcaccaataaatatttctaaaaaattcaattaatagtaaaatttaaaaatatatgtttacgttgagtaataaagcgattgggtaatatttaatatgctaaaaatcaaaaactgcctaaatatttaaataaaattagtgcaacaaaaattttcacgatttttcaaaagctttttcttccttttttgcctaaaatctgtcactgttcatcacacaatttagctttgtccacccccgaaaaataaaaattcatagcttttttcaataattttatcaagaggcctaaagtgtgtcataatgcgtcanaatctattaataaatgggctaaagattaagcaaagaactgaccgtaagtgattattggcaatgcttggctcaccaacaggtcaagagtttttatctcgtactcagtgttcgtatagttctcgattccataattcgcgagggttacatcgcttctaagccgttttcctttgtacagcagcgtttggtcaattagtggaatgttctccagttcttggactttcctcattatgtatagaatggtgtaccatcgatgcactctcatttgtataactttaccgtttggcatttttatgtttatttcttaaaacaatttttagtaattgtttgatcatgatggaaaacataactattctttacatttaatgtatttattttatttacttttgtttgtgcatgatggcgtctaattttagcagatgtaaaaattcggtttttaagaattgggataaaagtcaactaagaaccaattagtggacacaataaagcataaccatttaccattcattacattcaatgtccttattttatgataataaattcataattgcagtaattagtagtgaatggatttcaaaaaaaatttcaaattgccatctagcatatattagttaaaaatagaataaacatttctgtacttattaaggtaccaattttacgattttatgcacttgaaaacgctttccctgtacggctttatataatatcatggaataacgaaaatcttatccccgccaaccgtcagagacatgcaattgtggcttaatttcaagtgtaatttctggccaatttgccccttcgatgtatttggctaattcttgctttaaactgtatccgtttccattcaaacaaagccttagctgatcgcgcggaatgcccactttggctttgatcatccattcaatgttgagcaaggtgtcggtgcttttaacccgcagtctgatcattttcttatttgttaaatcctttacaagaattggcatttcctcactaaatcaatcaacattttgtttaaacattatcgttttttcttctaacgaccttggcaaggcaggtcgtggtaccaggtaaaaaacgaactcattttcatgtcccccattgtgtaggaaaatttgcaattcggccttgttgagctgaatgcctcggaagaacagccgctgctctccaatcggaatgcctttcagctcccaaattttctccataatgtcttgcacattgtcagatcgtttcattgcaaatttcagcattatattgttcaaactgctgacaaatacagatatttcatgttgagtaaaagaggaagtcgtcgcttcgcttggcatttcattcgcagagaaaggcctaataaaatggaaattaattcgaaacaaggactctgtaaaaggaccagatcagcaaaaggcgtttgtggccaaatataagagcataacaagggcaaaaataagtacatcatggaaaatgtacaaaattcaaaaaaaaaacatttaatgtcttaatgttttatgaaaagagtaagaattacaaacaggctatttgatcaatcaaaaaacaattattaaattaccttttgcgcatcaatgcggcaaaactatgaggaacttcagcaattatgacaggcgttgggtgcactgcaatgctcgtagttacggcgcgcatgtttgcatcagacgagacggacactgggcgtagggcgatcccaagcggggatgtatcgtgaaggttggcctcgcttgtaccgggcatgccaaacgtgggcacatcgcgcatgctggcatctgccgcagcgggcgaaggtaatacgggcattccaaacggggacaccgcgcaggtgttggccatgctaagcgtggacacttcgtgcatgttaggattttctttagctgacgacgggcgtaagaccatcccaatcgtagacgaactctgcacgttgtagtcgcttagccttcgaccgtcctcaagctgaatgaacagcatttgctggtcgggtggaatgccttcggtttggtggataagcatcttcactttgtcaacggtttccgattcggcaacttccaattttatcattttgcgcgggactaagcttttcacaaaaatttgcattagtccatggccagtggaaaagtggcacaaaacaatggacaaaaataccaaatggtaatgcattggtgaattattatctatggaaaatgacaaatgttaaatttattatatttcttataatatattattcgtttaaattttttttatatttgccaatatgggattatttaatattgattgatttttaatattttatatcaataagaaaaatagttgacgtcattaaatggaaattatataaattcttgattaaaataatcaaaaaatgaatttaatccatatattttaattttcgagcataattaaattaaagtagcaaagcgctcgctgaattgcaaaaatgttaattgtattgtaattaaaaattttaaataattttccaagggtataaaaaagaaactgtcaaattttgatgattcgaacactcaaatttgtagatctaacagacaatgggtaagacaaaagcctgttactatcccattttattatttctagggcttccatttttaagcataaaaaatcacgaatagacacctaaaaaaggctgaaaaaataacaaaattggcattaaatagacataaaaacccctcgaataggcataaaaataggcaaaattttagtttttataacacaaaaaattaatcaaaaaacttattttggctatatttcactttttaaatgaattattaaaaattttaaagttttttttcgaataaggataactttttaacaaaaaatattatcaaaaaataaaaaaaattaaatttttggaaaaattttttcaatttttttttttttgcatttttgtaaaggatttttttaggcatgaaaacttttcaaataggcacttaaaataggcacgaaaaatgtgaaaaaggcacaaaaaattacaaaaacgaaaaaggtgcaaaaaattggccctgtcaggaatccgatcaaattagcaaaaatgtattaagaaaaataaactttaagagattgagtttagagaaaatttttcaatttctaggggctatttaaaaaaaaattcaggacgatttaggggcaggcctgtagccagaaaaaaagatttcggatgtgggaaatcgaaggtttaacaatctaaattcggcaggtcctggttgagccgacggaccaggtttaaaaaattggacgcggaccttttacccaaacactctgacccatgtcacctactcaaaattagtaataacctgtgtagttttttacaaatccgacagtaaaagatttatcggattaacgaaaatgagttgaagcagatttatccatgaaaaaagaagtgaaaaggatggccgatcatttcgtcacagatcatttcgtcactaagaaaaatttaaaaaaaaaagtttggcacattgccttaaaacaataaaataaaattctttaatatctaaacaaaagtgctagcaaaaagaaagaaataaatttgataaaagtttcaaattgctttaattgtgagatttgaaagggattttctctgaaacaaagtgattaatttagcttctcatccttaat

SEQ ID NO: 3927 - DNA, 2380 bp, Heterodera glycines
ttttgaacttatttcaatcataattaagaaacataaaactttaaaattgtatcctctaactgaaggaatgaagatcctagtatgtggaaaagctaatgtggctctaggacaggggcgtgaccaaaaaatttcaaaataaagaacatcaatgacaaaaaataagatttagggtcaaaaaaggcaatcttgcaaaattggttcgaatcagttaatatataattttttcgataaaaatgtattaaaatgttatgtttttcacatcctattatggattttaacaattcttggggaagaaattagcaaatcgtacatttcggtgaaaccgtgctgaaaaaaaagattttcaaacatttttttttgcggtgtattttttttttacaagttgttgaatggaaagtggatccggcggcgccgatagacgacgccggcaaagtttttgaaaatttgagtgctatttcatagcagattttctattaaaatcggtaaaaacatgattaaaaaatcggtaaaataaagtgcggtcatgcgggatcgaacattaaggcaccgcagaaaataaacctgctgttttcaccactaaactacaatacttcaataataaagcttattatttcttaccaaaaaagtcattcttaagggtgtaaatattttcgtctttttcgtaaaatattgctctgacgaaaacgaaacgaaaatccaaaattttaaaaccgaaaacgaaacacgaaacgaaaaacaaaattttgaaaaccgaaaccgaaacgaaaaaactttagatgacgaaaacgaaactcaaaaagtaccgaaaatttaggacgaaacgaaaacgacacgaaatttcgtccagccctggcgggggggggggggggggcaaactgaactattaccaaaaaaacaaccgccattgctatttttagtatcatatttcgccagagtcatatttttaactttaattggctaatcagtttatagctcattctttataaggcacaccgatacaataaatgggttttattatttctgcacatattacaaacaatttgcatatttgacgattctatttaaaatcatcatcaattgtgttatgccaattaacatttgtttccacacagacttcagatatgcaatgccacaagttttgcgcccactccgttgtcgtgaaccccagaaaagattggcactccgtcctccagaaaagagttgaaagggacagttttgatctcgtcaaagccaaactgtaaagtcaaagatttcaaaatggaaaagtaaaatagtgatcactgctggtcagacaactcacttttttaagccccgtctgagaggcgatggcggtggcacaggtgaacaaatgggaatagccttttgcggaagccgtttggatgagtgcacggagcataccggagcccaagccagtcctgaaaaggagcggaaagtgccgcatttgacgagcgagtgattggcattcaacacaacgttacctggcgtgtcctggacctacagccatggcctgcaattcgactaatttaatatcctcttcggggggcaacagtgcgatatgactattcacgaaagtgagaatggcgtggattcgattggcattttgagatggaaaagggccattgcgaatctcttaacaatttgctttcatcttcaatctccgccttacgttgcctaaccttctccgaattcctttttgttcggcatgcgcccaatgtctctgtagctttcgtgaatattttccaatttgaagggcgcattcaacagaactcccagtattttcccatcgttgtttttggccgcaaatgacaaatcaaactgaaaatgagggggaagagggtgaagagaagcaaagcattggagaaactaatccacgaactaactttagaacacttctcacaaatgtcgtcgaatattggtgaggtgtccgagggggtgcaaccttaaaaaatcaaaataaaaattattattggtaaaattatatcatttgtggaaaaaggaccgatgacgcgggtgatcggctcgttgaccaaaaacacttcttgcaagaatttgaacacagagtcacgttcggaagtgaactaaaagaaaagtgcgaaaatcgtctaatttgattgattaaaacaaagagaatacattcacagtttcaatgacatagtcacggttcattgtggaaaagtgagggactttaagagagcgcagcgttttgagaacgcgaggacgacgacacggaccacggagggaggcaagtaaaagcataatgatgtattgtatgtacaattgtcactggaacataaaatgaattttgttacatgcatacataggatattggttaaaaacaaatggaagaaaatgcaaaaattaactttatatagtgccagaa

SEQ ID NO: 3928 - DNA, 3784 bp, Heterodera glycines
tcttctacctaatccaaatccaacattggtgatataattcgaaagctgaacatgtttagaagctttttctaagcgatttcttcgcgatcagacaattaccaaaaaagttatacatgaaaattgcgaaaagtcgaaatttttgaagttttttcttaataaaattttttacaggcatgaaaatctatccgctttttgtaaggctaatagagcatgttaaagctttcgaatgatacaaagattgttgaatttggatgccaaagtaaaaagctatcttggaaaaacgagctggcgccgcattgcgcgcgccgaaatgcgtgggtccctaatttcgcttataaaatttgaaaaccaaaagatttccatttaggtaattccatatttaaatgctcaattctattatttctttctctactttttgttcttttcatgtcctttcccccatcattttactcctctattattattcaattcgtttgttcgatttatttattgaaaattggaaaaaaatccatgtgaaatttggtgatggcaaagatcatctgttttccgaatatatttaagggaatttgaggccaacaagagaattttctgagaaacggctctctggagggagagatggtgggtgtaattaagaaaaccaaaaaatgaattttgtttgggaacggaatggaggaaataacggaaaaaggaaaacggagaataatttggggaggggagaggggtactgcatatgtcaaattatagtaggcctcatttttcaattaacgtaatcattaggcagttaatttatattgttaataatatttaatttttttagattgacgtaattattaggcattaatattcaatttttaattgagatttattattgtatagtaaagtttcgattttttgtgccgatcaaataaggaatttcacattttgtataatattaggaaataattaaatttttaataaatttattattatagaaagtagaagggaaccgaataaaatacatagcaaaatgtgaataaaaatcacattgattaatataattttataaatgttcttgctagtttccattttatttatttttgggagcacgacaaaacgtttgccgggcgaaccttttggaccatatctttttaaaatttttggtcatttttggttgcatttgaaaaaagttacaacaaaaaatatgtggtgcaagacttatttgtcaccctgtatacgttcaaaactttgaagacatataacttttttaatagggcaaaagaaaaaatctgaaaaatttacattttataactttttattcaccaaagtgatcagatcactcattcggatggatatgaaaccctaaatggcttgaaaacgggaaattctacaaaaaaatcttatgtggttgtaaaattgtttcgtggcagacgaacacaaacttgctataaaatgcaaaatccgcatatagcaaaatttgtgttctttctgtacgtaatattcgttttccgcgaaaaattttccgtccaaccccataggaatttttttctgaaagtttcgcaatttcatgccattttagggttttcagatcaccccgaatgagtgatctgatcactttggtgaaattgattttttggtcagtataaaagttttgtaaaattatgaatttttttttcttgtcctattaaaaaaatacatgtattcaaattttgaacaaataattgaaacagagcatataataaataattaaatgaaattttgttttattttataaaatgtgccacatccacctgttcctttttctgatcatcatgatggctattgtcaatgttgcgaatggaatggactacaaatatgaaaagttgaaagaaccgttactttcaaacgaaaacattgatcagcacgaatttgaagtgatcaaagatggcataaccgaagaggaggacatggaaaaagcaatgaaaatcggcaaaacattcttttggcgagttataatacaaattgtttttacattgatggaccagggggcacaggaaaatcatttgtttaatctgctatttttcatttgtccagaggttttttaaaaaaagtgacaaatatggcttttagtggaatagctgcaacattgttaaagaacggtcgaactgttcacaaccggtttaaattaccattagatttaaatataaattcatcatcgtcgattgaaaacaattctaaagaagcaaaagaaattagagaaacggatattatcatttttgacgaggcaccaatggcacctaaatttgtaattgaaataatcgataagaaattaagagagatacataagaacaatattatttttggtgggaaaattatgattttaagtggtgacttccgtcaatgtttgccaataaaaaataaagcatcaaaaaccgaaattttagatttaacactacaaaaaagtgagttgtgggttaattttaaaatattccatttgagaaaaaatatgcgaacggaaaatgaatcacaaaattttgcaaaccaaattttggaaatagggaacggtaaaggtaatgatgaaaacggtatatgtcttccaaaaatttgtgatattgaagacaatgatttggttgatgaaatttttggtgaaataattaaaacaaatgattattcgaaattatgcagccattgtattttcaaaaattttatagttttttagttgctagaaataaaaaactagaaaatagttgctaatagctcgaaaagtagcttaacaacagtcgaaaaaaacatttttttcgtgtatttcaggctacggggagctcaagaaaaaaatagtgaaaacactataaattgcatccctagtcatcatcacaaaaacaatttttcctaatgcacctgactgcgcataacgccaagtgccattcgtgtgtcggtcgcttgggtggtgccaacattcagtttaacggccaaacgcaatttgaaatagccaagaagcagtgatatggcgaaacgatgttcagctttctgagctatttcagtcccactatggagaaacaacacacgcgagtacagtgactcacgatgacttgggcaaagcacttctgtggattttaatcagggctgcacgcaattgcggattgcggattacggaaattgcggggtttttggacccccgtaattgcggattgcgggttgcggatttttgggatttatccgcaattttgatccgtaatttgactattggattatttttcgagacgatttcttgtaagattattttttataaaatgaattttttttctatttttatttaaagaaaatatgtacatttgtttaaattcttatttctttagcaatttaaaaatgtcaaacttaaatcctggtaattggtggtattattttgagcgtcaaggcaaagcaactgctaaatgtaaagccgatggatgttcctactcaaagacattaaatgcttctctcagtacaactgtgctgacttttcacctcaaaaatcaccaccctgaactttacaaacaacgtgaatgtttcttcaccataacttgcttctaaccggattttcaattgaatgattttgcttttataaatttgctttttaatatgcttttaaattgctttaaaagatttataggattttttaaaataaaatttaaaattatttaaaaaaaattttttttttattgcggattgcggattacggaaattgcggggtttttggacacccgtaattgcggattgcggatttccgcaactgagaaaatcgccgcaattgcggattgcggatttccgtaattgtaaatccacttgcgtc

SEQ ID NO: 3929 - DNA, 1479 bp, Heterodera glycines
tcagtccctaaaattccttacgaaattggttatatttagttttttgcgattttttttaatttaattttttttttgaaatttccaaaatcccgcaattccgcacaggattcctcaaattttaaatgcgggattaatcccgcaagatcccgtcccgcaaaaatttttaattccaatcccgcagtggggtccgcaaatttgaaatttccgatctcttcatttaatatcaacaatttattattaaatataaattaaaattactgttagtgacctttttgcaaaaataaaattaatgttaaagaagggcttaaaaattagtaagtgtcaaaaaattaaaaattagaaatagaaatatccttttgcttggaaggtttttaaattttcttcattgaattataaaaaagcaattctcatagatttttgaaattataatttataaaattttcttagtcgaagtctaacaaataagtaagcttaatataaaaaacaatctgactgaccaatgtgcaattgttccgggagcgccttttcaagcagttcaaattcctttacagagccaagtgtggtcaatagacgatcttttgctaattgaatttgttgtgcagcgccagaaaaaatgcctttgaacggattcagccgtctgatcaatcgataaagtgtaaagctgtggatcagctcgttattgggctcctttctaaccattgcgatcagttcggcaaatttttctatggaatattggacattgtttgaaaaaatatgggctcttttgtattcgtttgtaaaaattcagatataattgtctgaaacttttaatttcaattagaaatttaaattaatctttgcattttttattttaaaatatattcgttaaatttgctaaacgattctaatttaaatttgagaatttaaaatctaaattttcctaataaacatactgcaaatacaggactgagcctttcccacactctcacaccgtttctttccatccctcattaataaaaaaataccaaataattaatgtagggaaatacggtaaattggcccacaaaatccttcatatccgaccaccgttttttcccgcaacatttgccacaattcttctctttgctgttccgtggcattcgtccaaaaaagactgatgttcataattgtgaatttatgaagtgtacaaaatcgttgtgccaaattgtccatttgtgcaattcttttcagtgtgacagtccatgccgaccaaaatttgttcattacgtcatttcggatttcaaattcttcactttccaaaacagtttcaataaaaaggaatagttcttcaataaaattatttaactgaacatgcacatgtatatatgtatgaaatatattaaatcatttttatccgtttatttattttgcaatttcttagggatcacaggcaaagattaagcaaggctcccaaaaatttgccgggcaaaagcccgattttttaataaaatttattctaaa

SEQ ID NO: 3930 - DNA, 1736 bp, Heterodera glycines
ttttgctgcttccaaaaaaggcagcccaaaaaattgcttgtataaatacaaatgccaatcataaaaatctaaattttatttttatataagatttgttatttaaataaaaattattggcaaattcatttaaaaacttaaagcaaccttttaagaaagacatataaaacattcttcttataacaaaaagcgtcctcgtaaatgttaactagtttttctgtaagtcatttaagaaattgcggtgggaaattgaaattgaattttaattttattttcttggtaccctctttttcaagcttcaatttgttgcctgctcttaagaattgtaaattcttatttatattaaatcaccaattccataggttaatgatgggtatttgtcgtataattgttgcgtaatttcggcatttttctcttcaaataattcgtaaatccgatctttgatcagccttttaattaagtttggatgcaaatcattcttcaaaaaaacaaccatgcgtagacggaatgtcaattcattttcccaaattgcttttttgttggcaaaaatatctgccaattttcgcaccggtacgctggtgctgatgactcactactgttaccgtaatcgtaattgccacccagtgtactgctactgtaactgttcgtctcaaaaccgtagtttccacttgtagtactaccgtaaccactcgtgtcatcatcaccatcatttacgctataccagttatcagtgtatgcgtttgcgttataccaattattatttccaggaaaattactgtcgttaccataaccataattattgtagtagtaataaggatgatagttgttgttgttatcatcgtcattattcattgagcttatttccgggctttcaccaaaaattaccgggttttcattaaaaatggtattcgtactgtgccattcttcaccaatgccattgccaaaatctaaatctttgccacccattttgccatggctttcctcagcatcatgaccttccgtagaacggtaaaaattgcggaaaaattggggaccaaaaaactgaaaaaatattttgccgcggtgtgccgatgcggcattctttcaaaaagcgcctttttgttggcagtttggggacacacaaaaaaaagtgtgccggaaatggggcggcacacaaaaagcgggacggatgccattaatggcacaagatgccaaagaataaagaaatgtattatgtgagactatgcgttttgttgagcaaccggtgaatgtgtggtggaatagcacattgttggtttaaataataacatttaaaaattctgttaatttaaaaaattatttttaatatacttttttaatttttatttgatccaatttcgtgccgctcgagaatcaaggttaatttagtgattaattttataaaaagaaaattcaattttaaaaccgcacttaatttggcattattatatgagaaaaccgattaaattcactccttaagattttggcaattcgttaagaaatgaaaaaactaaaatagaaccgggacccgggaccgggaccgggccgggaattcccggtcatacgaaggtcccggttcccggtttttcttgcggtcccggtcccggtcccgaaaaaaaatcgaggccccggccccggcttcttcaggccccagcaaatcccggtcccggatttggccaaaaaatccccgggacccgtggccatctagtaaatttgcccttggaaaaaggaacgaaaaaaaa

SEQ ID NO: 3931 - DNA, 10093 bp, Heterodera glycines
aatcaggatttttccgacaaaaaatcagcattttgtaaaattttatttaaatgaaaaaatcagcaaaaatgttttttgtggcgccctttttccaaaaaaacttttggggagaaacaaatgagttgcaaaaatcagcaaatcagcacctcaaaaaaaaaatcagtttgaccccttgaaacagcaacatgctgataaatcagcagagttgggaattatggttatgggggaggggtgaaatacgtatccctagagaccggagaagtcattctcgatattttaataaaatctcaaaaaaatttataacgaaaagtatcgaaaaacacgaaatttctcataactttttttggtgaaatatcgaaaaatatttatcgaaaacggtggtaaattggaccaataaaatcccttaccctcacacaaatgcaaaatttaaaggaagatggtaattttttaaattgaatatgccgtaaataatgttatgatattcttgtttaaatcggcaccagtggcagcctaattagtgactcattaatcagctaatgatccgtttgttatgtgttcagttggattcgtcatccgagcgcgaggaaagcactcacgggacagatttgatgttggaaaggaacaaagagagattaagctgggagaccgcagaagcattggatcaaccagctgcagcaggggataaacaggcgctgaaaaatcctcgcgggggtcagtggtgaaaaaaagggcgaggggaaaattgtgcaacagaaagttggacaattcatcacaatattggtggtgaaatcccaatggggctacaggaaataaaaatacacttgttgtgcaataattcagtgtgtatttctccaattttatagccaaaatataaaagaaaattttaaagttagtcactacataaaaaaaactcataatcatcctaatttattaatgaatttttagataccagaataattttgcgtttaaaatatttaataaaaaaacgcttttttttacaaagttttcattttttaattacttatggcttagtgtttggcaccaattttggagtgtttttcgaagttagcacttattttccatttttaccattatttagtaggacatctttttgtgatttaagcctattgagaaatgatcttgatggcagattaatcagatcagcatcatatggacctgataaatatgtcaacttttgagcattgcattgattggaaattcttcaataggtttaagtgtactggactatttgtaactgatcagaattattattttttgcatgtctactgcaaataactgatcaaaaacttagttgaatgatcatgaactctttcattttacagaatttctgtatactgttaccgtaattaccgggaatcggtgggcggcggacacggaagcgaatctgtacattgacatgcacggcacggattctgattcggaacgcctgtggctcaagcaagaggtgaggagggcgcaaatactgggcgccaaaaagctttgccaaaaattattggcattttgtctgtctccccaacagtttaccagctggcttcacagtggaccagcgggaccacgttttcggcaaaaccaatccgattcctttacctttcgtctcccgtcacggctgggcatcatcaacaggcttactgtaggccatgaacggcacggctacggtgggggagaggagttaatttttcaaaaaaaaccatgttcttatttttggcttagaaaaaaaatgtctataaactttaatctcgatgtaatgattaaatatctttttcctcttgacatatcaaaaattttactggcgatatgccagcccctaatccttcagaaatgttcagaatttatactaggatttaaaaaatatcacgctatcagcgaaatccggtcgtcaatatttctgaaaaatttaattccgtccaagcctaatttgtatcggcatatgacagttatatccatgggattactgagtccgggttactgtggattttagttgaattccatgaatttgattacataatccacctatgttcagttggtcacaccattttgatcaattttttcaaggtgccggtgtgtttattgaccgcattttggtgacggaagatgaggtggatgaagcggatgaggagacgggggcggaagcgccggaagggcaaatgccaccattcgtggagcattgtggtgactgtcgccaatttctgttcctctgcaaccggtggttcgactcgggccaagtggacggaaagttggagcggaacgtacgcctcagtgccttttacatgatcagctcaatcccggtggacggacgcgtgacgcgtgagttttcatctgatcagtgatcaaaaaggatgattttggttagaaattgatgtgatcaatgatgatcagcaataattttagttcaaaactgatctgatcaatgatcagtcaaaattaaaattttattattactaaatctaatgtgttttattttagcaaattggttatttgatcatgataattttttgttcaattcaacgggataatgacctgaaaatcttggcttttaagatcccgctctgtcttggaatagatttactgttttaattgaaaataataatcttaaataatatatttgaatttttcttggcaaaggaagtcctggttgcttaccgaacctggtcgaaagcaaatttccctgtttttttttctcaaactatgcaagattttatcttttcaggcggtcgttgggagttcgttttacacggtggcacaaccgatggtcggggcagcaccagttctcagttagccatcaccggttacggcaccgccggccagtccaccaccaatggcctgtacgactctcgaatggccaacgcaccgtccgatgcactgatgcaggtgagaggaaaaacacatgctaattagcttattatggctcaatcaacccaattaatacacagctggactttggcaacattggcgaattgttgaaagtacgcgttgagcttgatggtggcgatggcaccagccctgactatttcctgaactttgttgagttcaaggtaagttaacgggggatgcgctatgattatgatgattcgcattcagattaagattgagaattctgaacgtaatcctaatagggactttaccgactaattttaggcaaattttttgaaaaatcgggtgatgcttaagaaacttagagaaacgaaaaacaaaatgaggccacgtttggagtgttaagcccaattttgaaatatttgctcaatttccatttacaggacttggacacggatgagaattttgtggtcatgtgcggcaaatggctgcgttggcgaagtgccaagaaaggcgatcagcccttccgggaactgatcgcttttcacattggcgttgaaccgttgccatgtaacatgacgggatgggaatggggaatttatataatattgtcggcctaattaaaaagtagacgagattatctaacaaatttactgctttttaaccaaaacacttaattacttttctctaattgccagtgatcatttacgagggaaaaattcgtgcaattcactccccggtgaactgtttgattgctgaggaacttcgcttggaattgcacggaggtgagagcagtttatggatttgtatcaatttttggaaaaaatgggcggcaaaaatttgggaatttttttttgcgccatcccttcattttcaacctaatattaaataccatggcacaatgtcattctaccacagaccttggcgacactggccatgtgttggttccaatgaatgccgacaaaaacggcgtcaacccgggcggcgacggcacagacgtggaaaacgccgatgccgtccaatggacggacattccgttccgcatggaggcagtcagcgtgggccgcgttggcggtgcgcgagtgcattttttgccaaatttgacgggcgaacaaattttcgaaggactgcttacggtagctagttactgtacgtactctatgttcactttacccctttttacagctccaaaacattttcaaaaaacaaaatgtgtggccaccggcaggtgaaaattccagctttgtgttcagccaaattcggctcaccgagtccccgcacacgccataccggtagagcgtactgtagagggattactgtagtgcagaaaaatgatgataatgtgcccttaaattgttatcaatgaaaatcacatatttcttgcactttcagttatgttctaaatcgttcacagctgcacgaacgccgctgtgatcagccgggaaatttttcgttggtcaaggaattgttgacgacggaaatggaggtaaaatgttgatcagaatgggttttgctaattagatgattaattttgaagataaaactctgatctgaaaagcttatcagcatttataacatatacatattctaaatcatccgacgagaatggcattgttgatataagtctggacacctcatatttatcattaattagtcatttttgaataatccaaatgtttgtttcaaaactggtctcatcaatgatataaaataaattggatcaactcagatcaccttgatccttttggttattacagaattcgttgtttagagtaaacttgcctttacagggcagggttctgtcgcaaaaattttaaattttaatgaattttggtcattaaattctctgattccccctcagggcatttctacacgattgcgaaatcggaaaaaccagtccaaaaaaatgccaaggaaatggcttcttcaaatggctttatcggaagggtgcgtttgtagcttgttgatcacctgctggtcattttttacttaacagttcgaccattctccccgaagtttttctttgctgggaaaagcaagcgctggcaatgacaccgctggacacctcgctctcagatggcattctaagctaccaagtgagcgccattagtttttttttgcgcaatctctgatcactaaatcgcctaaaaatagaaatttgaaaaaaaaatttgggcaggccccagcaggcaccacgctgagctgattaattatacaatttttgtttgactcgttccataaaaaacgagccggggatgccaaaagagagcggttcggactggcgtttccgtttctttcttttttaaaaatttgtcttgcaattttttaactgatttaacctattacagctcaaaaacgtaatttttcttaagtcgggcatccacttaaaaaagtttcacggctgcatatttcagcttgacaatgtggccaatttggaattgttcaccaaagttcgaattttgtccgacggacaaacatttttggaggcggccaactcagtccaaattgcgcaacaaactgaaggcgccgccaacgaaatgccattcacttacgtggacaaagtgcgcatctgcgacacggccaacggtgatgaggtgaaccaattgaatgcttattcctaatttaattattttgactcatcctatcaatgagatttgttgctttttataactgtttattgatgatttcacttatttatgagattcttatttttaaacttttccggattcatagcgaggaattcatttggaatttttaaattttgacctagtcctggaaatggaactgaattggcaatgtttgtgattgtgatactcaaaaccaaaatttcccaaaacccaagacttgacctcgtgagtgggactcgaaaccgcaaaaactctaggtttttttcgagtcgagactcgagaagagcttgaactgatcctcattgctggaaacccaagacttgacctcgagactgagacttaacccgggactcaaccgtaaaaactcgagccttttctcgagtcgaggccaagaggaatttgaacatatgtccattgcttgtttgacatttgacgggaaatgaatctgtatcattcattgacactgatcaattgatgtctcgcggattgaatgagctgaattccggccaccgataatttaatcaataatcacctccgatcacactcagttgcgcttcccctctgccgattgtatgctgcaacggcactccgtctacgaattgcccgtcgtttggcctgatcgatcgccgattccaagtacgtaacaaatcgagaaattcgatcaatcaatcaaccaattaagttctgatttattccgtccgcattgccaccgggccgtccaccgaccaaacaaatccggaactaattgtccagcttaatctgtagggttttcatcatcttcattattatggtttttcaataattttttggtttgataatgttaaatcttatttcgttcatttttggttttctgataaatctatcaaaatttcaaaaaatcattttaacaaatttcactaaaagatattttgcttggacagatttggtgagcatggtgatgttggacaacgaaaactaatcagagatgaactgcaagaaactgtagcttctgatcagcagcaaaaggaaatgccaccaccactttttgcgccgaaaaccgtaacacttttttatttggtagcgcgtactgtaagtgtcactattggcttcagagttgcgctttcgagtttgaggccgtttccattggggacattcattgtgccgaagtgatggtggacactgtaccaaaggtaccaaccaattcatattaattaaacggcaccctccggtctaattactaattttaaatgtgccgcaggacacagatttttgttgggagtgcacagagatggtgatcaccgactttcggggccgttccgccccattttatgcattcaaatttgccaggtgagcttttggtcgcaatactaattatcggatgaatcattctcaccatttggtcaattaataattaattagaccaaaattaattgaaaataagcgcaaagactagttcaaattggcctaatttgccaaaatttgcttaatagtctcagtttatttatttcagtcccttctctgtccaatgccgtgcccaaattgctaacgttttaccattcactgatgcgctctaatttatttgatcggacactgatcagatcccaacagttggtaaagcaaccattgacaaaattgatcgaagcattcattcgcgcattttgtacatacatatcgtaaattatgttcataaaaaatgtccattaattatcaaattatggtcattttataaacaatccacgacaaaaaatattacaataaataaaatttagtctggcttaaaatttcataaactaaatgtgttctataagaaatatttgaattaaaaatcaatttatattttaaatgataatgcaattatttcttgttagaattgaccttatagattcaaaaaataaacctctaaaatggaaattttctcaaaaataaattccttaaattttatttattttttgctttttctcagtaactttgatttggaaaagcgatccggacggatccagagtcgggatcccgaccaaatcagagttaaaataaaaatttattggactattcttaccagtgcctttttcccggttcccgagagccctgccgggggtctgtatcgtttctacgccgactttcggcgccagcccgaattttttggttatcacttttttattgttgaccaatcctacaatcttgataacattcgaaatacatgtttagaagctgtttttaagctattatttggcgattagagacaattaccaaaaaagttataacatgaaattatcaaaagttgaaattttgaagttttttctcaataactttttatttgctagaaatgctttttgtaaagctaaaagaaaaatacccaaaatatgtaccaatatgtaaataaaattttaaaataattattttttattcttcggaaagggtgaaataagcacaaaattacataaaaatgacctatatgcttaaaccatatttaagtttttgaaaaataattttcggttaattttttttcaaaagaaatttttataaattttcaaaaatcctaaaatatgtaaaaaatgtttatgattttttgcgcgttaatttttatatgtcttacattttttttttgttttcctaccccttgtaaaacaatagaaaaatgaaaatttattcgactattcttaccggtgtttttttcccgattgccctgccgggaccgggaataaaaaatcactgctaatccaaatgtttttaattactttacgattttttgcgcatttttaaagcaaacattgatttaaaaaaatatatttattattcgtgtttagcaacgtcacttcccttccaacctggcaataaattaacaaatgaatttcatgcatatttatgagagaaatctttaaaagcaattgctttacaattaaaattttatttaaaaaatgtcaatttcgaaaatttatttccttttctgtgctctcatcgtttccttgctggtcgatgcttcgttcgcggcaagaaagaacaacaaaagtgagtgtattattatttatgctaaataattattgtcttaatttcgctccaaagttggacttaattacggttattatcgcccaaaaagtcgaaatctcgagtaattaattattgatgagagtgatagtaaattatttcaattttttttttcttttttcgacaaaacaaaagctcacaatcaacattttgtggagggcaaagaaagcgcaacaagcggagcaaatgaccaaacgaccgatgaaagtcgacgacattccgacaattcggtaggcgccgccgggaaaattttgaacatttgaatacaatttgttaacagattttcactgaaaaatgatcaaattttgcgatttttgggccattttctatgaaaaaaatagagtttttgggcgcggctgtgccgataggcgccgctgggaacagattttcaccaaaaaataagcgaaatatgcgaaagcgaaagccctgcaaggaaccgcccactaggagagagagacggacataagatagaaaagtgtgacatatggattacagaataattggtaataattaattattattatcatattcaaaatggtcaaaatttttaaggtttcatccagcggtgcgtgcctatcggcaccgccgggccaaccaaaagttgttttttttcataaaaaattggatcaaaattgcaaaactggaaaaatcgcaccgcaaaattttattgatttttctatttgaataaaattttacgaaatactgatttttgaccccaaatgataattttttgttggcaaaatgatgtgtttgaaaatttcatctggcaccactgattatctatattttttattttgaatatatcattcagcagtcatcacataagcagaacactggagaagggaaacaattaagcgatgccgaattgggaggacaaacatcagcacaaggaagcggaagaagcccaagccattctcaaatgccatcgaacaaatcgccacacatcgaagaaagagtggggcatttcaaaatattaatttttacaacttaaaaaaaaattgggcaaatgcaaatttgacatttagcgcatttttcaaaattagaaaatgcattttagctttagtggcaaaattggagaatttgaaaaaggcttttattaataaaagtttcattaaatattaatatattataccccttaataattatgagcaattttggtgaagtagttaaaaaatttattcaattacctttaatgttggaatttatataaaaatcctgcattttgtattggaatatttaataatagattttgcaatttgttgactcctctaattaaaaataaattttacaattaaaaaattaatcattgaaaaggaacctcaggcgaaggacgaaattgctgagttggaaaatcaaaagctaaagaatgaactccaagaaacgaagcaaaaattggccgagcttgagatgtatcagaacgaacagcagcggaacattgaggcaataatggggcaattagctgaaatggagagaaaattgcacgcgaaaattgatcaggtgactgactaattaatgaatttaattcaaatcggagatatgcacaatgaaaggcaatatgtattaaatatttattatcttaatcatttaattttataaaggagtcacaatctaag

SEQ ID NO: 3932 - DNA, 2361 bp, Heterodera glycines
ttaaatttatttaatttaatttattttattttattttattttaatttattttattttgatttttattttgggttaatttaatttaatttaatttaatttaattttatttaatttaatttaatttattttattttattttattttattttttattttttttatattttcagaacaattctgacgttttccagaattttcagaactgttctggtgtgtttcagaattatcagaactattcggacgcttaccagaattttcagaattattctggtctgtaacagaattatcagaactattctgaagcattccggtacaatcagaattattctgcacaaaagaattaaataaaaaaaagttttttggtgtttaaattataaaaattacatgcaaaaacacaaagcaaaacacaaggcaaaaattgtaaaaatactcgaaaatacaccttaacatattgaaacacacgttaatgtaacgaaaacacacgtgaaatgttgaaaacgcatgcaaacgtgtcgaaaatacacgtaaatgtgaagaaaacacgtgaaaaaccggaaccggtttaaagaactcacgccgaaaacacatgtaaaccggtttaaaatacatgcaaaaacacaaaatccatccggtcggtcgaaattccggacattccggatgaatttacaattgtaaacggattgtaaaccggaaggcgaaaacacaaaaaaaatcggcttttttcgacctttgccagggtataactttgttcgaatttgttgtagagctacgaaatttttttctcacccttcctctcgacgagctctacaaattgttcgcttaccgcaaaagcgtagctcttacggttcccgagaaataaggtgaaaacacacattttacaacccatttttagccaattgtaaaaagccgggttttttttattcgaacgcgattttctcgaaatttttcttctgcacaaattaaagtgcgcggttcaaaagttagtaaaaactctgagcttttgaatggtaccggtgccgaagctctacgctgaaatttttcttggccgcgaagcgattgaaataattcccccccttatctttataatttatgtataaagaaatttaattttaaatattgcgttgattcatttttctgaattatttctaattattcttgaaagcaaactaattttaactataatataatcataatattaataaagaagcatgtgatgaagcaaactaattatattttttatgtaaattaataaaattacaatattaataattttatacacataagattaggttatatatacacatttctgtaaataagggcatgttgaaattttggataaaattcaacagcctggaccttcttattttaatattattaattaaaataggttctttattattaaaaaaaaaaaattaaaatagataaatattatgagtcaaaaatagtcaacatgcgtttatataattgtatatttatataattttcaatttattaaaattattccgtgaattaagagaatatatactaacatattaaaagaattgtgctaaataataatcaaaaatatatataactctaataaattattaaattatataaatctttatgaaaataatataatatatcaacaaccagatcctcatacagaatacgttctaatagattacttataagttaatcttaattaaagtgaattttacatttaaaaatgtaaagaagtaaataataattgttttctaaaattaactttataaattgattacaaattcaacaaacaggttgcaaaattaccaaaaatatttaaattttaaaaagcgagaaaatgcatttaagtatatatattttaattgataatgatattcataagacataacaaaaaattaattgtttctataaaataaaaaaataaattttcataacaagttattttattctacttattttgacggaccttattaaatataatggagctaattaaaaacgaaccacgtcgaggtcgtaaaagcttgttaattacatttatgaatataaatagaaagctataattaaagttgaacaaatttaaaagaagtaaatctatgccagcaatttatatattaaatacaatgaatggtatcatgaaaatcaaatggaaaacatatttaaatagaagaaaatattaaaaaattaacaattattctaaacaaataagtgtaaacaaaaaacactaaatcctcattctgtgccaccggctgctgacgcaaatcgtgctgctgttgatattgcggcggaaatggccgaactggcgatggcgtaccttccgttgctgacccacaagcggcgactgcaccaacggtgtttgctgacgcagtagcggagaag

SEQ ID NO: 3933 - DNA, 4218 bp, Heterodera glycines
tgacaaaaagccaaaaaagtgaatttttactattttaagtgacgaaacgttaaaatagtgatttctagtgacgaaaaatgacgtccaaatgaaaaaattttaacgcagaaatgcgttttttgagctcctttcttcaaaacaattgagcaaaaaaaaagttttttcactagaaatcggttccctagtgatatttaaaaatcaatcaatatcccatatttcaaataaaattttgactaaacgaatttaaaaattgagaattttgacccaattgtaaagagtaaaaaagtctttactaccggtgtgcagacaatttgtccaacagtcagcaatttgtcccaacaccatccaccggaccgtccatccatcgttgcagtgccatggcacaaacaatgccactgcgcagttggtccgcaaagtcaacagccttttgcgcaaaagcgtcgaatgctgacgcaatttcatctgtcggctgttggccgatgatggcctcacgatcagcaggtccaaacaaaggctaaatttattagtcaaaattgaagacgtaaaaaattgctaacatcttgcaatgcctttgcaagagtgacaggttggtcgtccgcgttgagtccaggctgttctggtggcacatacccgtcctgatcgtcaggaatgggtgggcagtcctcgattgggtagtaaactccacgggtggcgtaccacgcggctgacgccaatcgagcggtcgacgatcccaagaagtttgcgcggaagcgtccagcgatggttgctgctttttggaattggtgatcggtgcctcggccgtaggctttacatgaaatttattgattaacctgtgtgtaagcatgctcatatgtaagagttcttccaacttagttagtttcaagcgtagtgtaactatttgttacacatagggcaaaataaattcacatgtaaggaatccttacagaataggaaaacttgcgaaatatcaaaagaacactaatttagagcttgtagagttgcatatataccttgtttgatgtaagcgttgtagaaggcttttgcaggaggccatttcaccatttcaaggcttttctcatttgaacgcgattttcttcttttccgcattacttttgcggcgtccacatgcttttaccagtccagctagttctccttccagctgctgacgcctttgctcaacctgaagacgaagatcttgctttccctttcaccaaatggccacatgtttgattattgtgttgagcttttgattagagagaggcatgccgactaagggaaaaaagcttagcaaagtggtataaaaattaagtaaaaatcatagttattttttaaaaacattttactaaaaacatgtaacctaatttacaggtaaatttattgctgacacaataaaaaagaataaatgatgaagtggggggggggtgagaagaagacccgccgggtaaaaaacctcaaagatttgaggaaaaacggcaggggtctttgctggctgggagacgggctagtgtaagcgtttaatactaatgtaaaatacacattttaccgaaatagttatgcttacactagcatatcccccagctatggctaagtggagaacaaatatatgagttataaatttgtggacggcgggcagactgtattccttcactcttacggccctaaagagggccgtttgggttagagacgcctcgctattgaggcgcctgttgatcgcaattttaattttcaaaacattcggccacccgccggccaccacccacccgcccgtcccaatggggacagccgttgggggtgacaaaacaaaaatatatgaaaaaaaagaattagtggggggtcttctccgcctcctcctcctcagccagctgcatcagcattctgacgatgctgttcttagcgtccagatgatcgacgggatgaccggttgccaacgtcagcagcgctgcgggcatccgctgtaaaacaattttttaaaacacgacatgtaagtaaagccaacagctaacagaataaactgtactagctgtaagcattttttaactgagtgagacaaaactaaccccaagggaacgaaggtgctcccgctcctcttgctgacgcaatttgtcctccgcctcttgctgatgcaatttggcggcggcctcttgctgacgcaatttggctttggcttcctcttcttgctgacgccggcgcacgatcttcccgtctaaaaaaaccgcaaaatttaaatcacagaacaaaaagcaataaccacgaaacaaaacaaaccgaagccctcgacaacttcgcagagcaccttgccgtccaagccgcgcttgtcagacaaaaccagccgcatcgtctgcttatcctgtggacaggtgcgaaggaactggtggtacttgcgcacaatgtcctgtttaaagaaataaataagataaattgaaaaaaatttgttttaaaccttgttgaggcaatgtttcacggtgcggtggcttgtctgttggcacgcaaaacacatccattttgtcgattgcggcggaaacaattcattggcacttttcgctgccgctctgagttcctctacaataattaagaaaatttataaaatatcaaaaaattggtagttgtccttaccgagcacatcccatgctgacgcaagtgggatgcacattttctcggcatagccgcgcgcatcgaaacggcgttttccccacttgaacgtgagttccttgcctgctgacgcaattgcggcaaggttttcacctgaagtcgtctttatatttaaaaaaataaataaataaatatacgccaagcagccaatgtccagcagtcctttggcttgtgcccgcgcaatttgcagcactggcagcagcaaaaaagaatgatattctcagcctgaagtccaccatcttcgcaggcggcggcgattattcctaaaaatccatttccttataattagaaaaacatagaatttggttttcaaaattagaaaacatagaatttggttttcaaatttttaaataaataaaattaaatttccaaaaaaacacctttgtcaccaggacagttgctgacgacatgggtgccgaacaagtggcagaaactgcagtacatgggcccagcttccaattccttgcgctgctgacgccgtgcatttgcagcaacctttcgctcttcctgttgcccaagccatctgtactgcgctgctgacgccgacgccgactgctgctggcgcaagtgacgacgaggaagaggatgaggtggaagaggagaattggagataagacgagagtacatatttttgatacaaaaaattaaatttttggctatatttataaaataacaaatatttttatagcttatttttagtggttggaaaattttaataattaaattttaaaaataattttacaattaaaatgaaaaacaatgtggcacttttcgctgccgctctgagttcctctacaataattaagaaaatttataaaatatcaaaaaattggtagttgtccttagcgagcacatcccatgctgacgtaagtgggatgcacattttctcggcatagccgcgtacatcgaaacggcgttttccccacttgaacgtgagttccttgcctgctggctgacgcaattgcggcaaggttctcacctgaagtcgtctttatttttcaaaaaataaataactaaatatacgccaagcagccaatgtccagcagtcctttggcttgtgcccgcgcaatttgcagcactggcagcggcaaaaaagaatgatattctcagcctgaagtccaccatcttcgcaggcggcggcgattattcctaaaaatccatttccttataattagaaaaacatagaatttgtttttcaaatttttaaatcaaataaaattaaatttccaaaaaaacacctttgtcaccaggacagttgctgacgacatgggtgccgaacaagtggcagaaactgcagtacaggggcccagcttccaattccttgcgctgctgacgccgtgcatttgcagcaacctttccctcttcctgttgcccaaccatctgtactgcgctggtgacgccgctgccgactgctgctgacgcaagtgacgacgaggaggaggaggtggaagagtagaattggagataagacaagagtacatatttttgatacaaaaaattgaatttttggctatatttataaaataacaaatatttttatagcttatttttagtgggtggaaattttta

SEQ ID NO: 3934 - DNA, 2904 bp, Heterodera glycines
  misc_feature (26)..(26): n is a, c, g, or t
  misc_feature (58)..(58): n is a, c, g, or t
tatttatactcgttataaaaatcttntaattctgatatttttcatatttttagaattntaaatgaattccatttcttgttaaatcgtctcgatagggtataatcaatgcaaaagactgacagctaaattcattatattctaaatattaaataaagaaaaatttgcatttcttattattctttttttattgcattatttatttttagtgtgttttattgaagatttaattatgcatatttcttaatatcatgattacttatcgatttaggtcttcacgtggtatgacagcaattaataaattatcaaaaatttcagttttatttaaattaattgcaagattttcattaaaaactattatgattaacttatattaataatacataattaattttcaaacatttttagggtatttaaataattttaaccttaacgacaggatcagttttttcaattagaataaccatattgacgtttcatcaacatttctcagacttcattttgatcgattagatttattaaattttaagcaaattaaaaaaaattaatttttataataatttttataactacataggtaatttatcaaaatattgatatttataaataataaaatttctaatatgggtttacaaaaagatttattttcattatttattatagtttttgcaagttacacacaccgtttcaaaaaacgagatgtgtaccaataaatagagagtgccagagaaaaacattatctttttttctctaattttttgtctccttttggcgtactatctaatattttcattattaggaaaaacaacatttacttcgctatgtttagcttcttttctatatgttagatccacaccaaattttgcgaatcgatagagaaaaggaaaatgagcaaactttcagtgttttgagtaaaaattttggcctagaaaggtattcaattcgcatttatctgaaatgtttttaattttttaggatttatggttaaaaaaaattattgcttaagcttcaaggcagaagaggtgctgaacaactgaaaaagaggcgagaggaggaaaagcgcagacggagagggcgagacaaggccgatgggccaagaaaagtgagttttttcatcaattttatatcaaaaaaattaaaaaatcattttttttgttttccagccgctacacaaccgaatcccaatgccgaaatagcaccgcagaacgaagcagggccgtcaacatctgctgcatcaacggaagaagcggtggagcctccgccaccagctccaggaccagtgccaacgccagaatggacgaggaaattttggaatttggcttctcggcaaaattcacaatttttcaaaagtgttttgtccgattttattgagataaaatcataaattttaggcacaaattttgtccccaaatgacctggacggacttgagcgatcaactgacgatttcaaagtatttttggcagagcaggaccggatgagtgcctttctctcaaagaaaccaaggccttattctactcttccactttgtgccatttgcacgacaacatcaattcattggccttttggatgagcagggtgaaaaacaaattgcctaattagcacaaatttttaatattttcaaggtgatgaagcgcttcattcggtgtggcgaagactctaacaatggtggaaatgtatgcctgacgcggaacaaattttgcaacaattggagcaccatttcgtcaacaattggctgctggacaccggaaggattgacgaattgaagcgggtttgttttttcaaaaggtttcccatttctgaattctcatttttagaattatgaagaaagggagggtgaggatgacacggataaagaagcggcggaagaaattgatgacgaatgccaaattgatgtaatttaacaaatttggattaaaggatgattttcaaaaaaaaagtgaagtaacaaaatgttttatcatttttgtttattttcagaatatttatttgtcattttacaagtcttattttgcttaaaatcaccaaaaacgtccgttaacatggatcggattcgaacctggaaccccccttttggtgactagcacatataccactgagacaaaaattcaaatctttttggaactgggaggaaaaaactgaaacggtgtgttaagttaactaaatttatactatttaaagagcttatagtggacttaagtctaaaaatttataacgatattattaataaaataaatttatgtataaagaaatttaattttaaatattgcgttgattcatttttctgaattatttctaattattcttgcaagcaaactaattttaactataatataatcataatattaataaagaagcatgtgatgaagcaaactaattatattttttatgtaaattaaatgaataaaatttcaatattaataattttatacacatatgattaggttatatatacgcatttttgtaaataaaggcatgttgaaattttggataaatttcaacggcctggaccttttattttaatattattaattaaaataggttctatattataaaaaaaaaaattaaaatagataaatattatgagtcaaaaatagtcaacatgcgtttatataattgtatatttatataattttcaatttattaaaattattccgtgaattaagagaatatatactaacatattaaaagaattgtgctaaataataatcaaaaatatatataactctaaaaaattattaaattatataaatctttatgaaaataatataatatatcaacaaccagagcctcatacagaatacgttctaatagattacttataagttaatcttaattaaagtgaattttacatttaaaaatgtaaagaagtaaataataattgttttctaaaattaactttataaatt

SEQ ID NO: 3935 - DNA, 1304 bp, Heterodera glycines
aaataataataaaataattgatttgttttatagctttttgtgctcataaatttaatgttttgtcgtgcgatggaagaaaaaacttttgtcgcagttgaaagacaaaaaccggtgccaaagccacggcgacaccacacaattggcattttagcatcagcagaaggccaactgaaaaacgaacacccggacaaagaggaagcggaaaaagcggacaaatcaaagggaaaaaatggggcggaacggagaaaaagtgtggaagaaaagcacgaaacgcaacagaaatatgggacggacgaacagcagcgtaacggggtcagttggtcattcgattgaccattaggccaattgtccattcttttgacccaatcgatcactctttggccaattgtccattgttttgaccaatcatttaattttttgacccaatcgatcactttttgaccaattgtccactcttttggccactgtgaccaatcacttactcttttgtccccaaatcgatcattttctgaaaaatatccttgacccattttacgctttctttttgaccaaccaatcattttttggcctttcatttttattctttggcctcttttaaattgtcaaaattcagacaattcgctcatcgcagcagccaacaaaaggccctttcaaacaacaaaagtgggaaataaagacaaaaaattaacattttatcacaccaaaacaaaaagaaatgcccaacggaacatcggaagaccaaaggtcgagggaaagcgattgccaatggtcggcaaatggcaagacaaagcgaatgaggacaaagagggtaagtaagagcaattaggggtattatgcgaaatcagaatcattcgtcaaattccctcgtcaattaattgactgaaaatgccctcgggggttttgaccaattgcccaatttgcattcatttgtctccacaattttctcatctgttctcatttgtccgttcctttctctctttaattaatttacaatttattcatttttcgctttttgtggcaattaattaattagttaattaattgctgtccttttttgcttctgtttgacaaaatgtcaccacaattcgttctgcgatactcagccattaaaatacgaagaaaagcttaagaagggggacgaatgaatgaatgaattgggtggaagggatgagcacatatttattcatcccatccatcgtcaaaggttttcttcagcagcggtccgactaagggaagggaagggaagaagaaagtgtgatgggacgggggggaaacggaggggcaatcgaatcgatacgcccccc

SEQ ID NO: 3936 - DNA, 2107 bp, Heterodera glycines
ccccccccctcccccgccctccctctttctctcccccgcccctttttctgtcctttcccacccttttttcgccaatcctttcacagacaaaagcaaaatattattgtatgaatcattagaataacaaattacaatatcactttaacaattaaaataaatttcacaaaaatttgaattgtttatgattatttgtttgggcaacaaaaagagtgttttttgatttgttcgatttagaaaagccccaaaaaattggcccgaactctttggaccaaaatccttcggttaactccgaccaaaaccaaacattgttggaagaactgctgcacgagtgtctgtctccgcaaacggcggaaatggcggaattgggggaacgaaatggggggacggagacggaagaggtggacaaaacagaatggaaaaatggaggaatgggaggggcaaatgagggaaatataagggccaaaataattaggatttaaatagtgtttttgccatctttcggcatttccaattagcccaatttgccccagggaaaacgcccgcgcttctctttggaccgtctcgtgccgcctcaactgttcgcttcggaatgcgctgctattactcagcagcattctgctgcaaatgtttccgcttccttttccctgaaacggcacccttctgtggaaatcgcgtgccacggcaccgtccgattgatcggagacgaagcgacggctcaagcggaggaccagcgaatggtattaagtggccgagcggttgcagatgcggccgtttgtcccggggggtccgccgacagcgactcgtccaccccaacgaccgcctccccgtcgcttaccccccgctttgacggtttctcccggacggactcaccgcggcaaagaatgggcatcagtctgctcgaacgccttgtcaaatgccaccccatttggtttttgccccacctcaatcggcacgcggttgcgcaccttttgaccgcacaacccccgggggtataaaagccgaacattccgtggggcaatccatcgcttaatcattcattgataggtgttcatcgtacgagcttccagccgtggcgttcgttcttccgttggcacttcgccaatggcaaagcgtcgcgtcgaagtgatggcactgagtgttcgcttgcccactgcggaaaacggagccgtgtccgaggcatgtgagcagcccgagttggaccattttttgatcgaagccgtggggacgggcacggcggtgcgcctcgagggatcgccgtacacgtaaaagggggcggacgcggggaattcagtgaattttggattatcaaaggttcaacagcttgcccctattgctggagcattacagcttggagggggagggcgaactgaaagtgcgattggcgttgccccaaactttggcattctctgaaagcattcaaacgctgcagggaatgtctttgatgggccaaggtgggctttctgctgattatcattatcgtatataaatgaactcgtctaattaatggggtaattaggaggttaatggaccaacaattagttaattattgaaaggcataaattataaagttcgaaatctgtttcaaacggccggtcactttacaatttttcttcgcttgtttcgaatttcaatggtcgtcaatcggaggcaatttgaccatgacccaattccctcgggcgaattgcggacagacggaacttcgctattttaagccccgagggaaaggcggagaatcggcaaaagctcaattggaacactgagcatagtttagcatcaattaaactttaaagatcggattcatttataaacaaacatttctcttctctttgatcccaaattgacttttctttcccttttttattaatttgtccccaaattgcaataaaagccatccattgtccccgctttaatgagttggtggacctgttttttcttctgctgccctcagcttagaatgcttttggcggaataaattggccaattagccaacagtttcccaaccctcctcccccattattcaaattcccttccctccccctcagatttttggacgagtcccctctcccgctgctcccccacctcctgcgcttcctcctcctcctccttc

SEQ ID NO: 3937 - DNA, 4413 bp, Heterodera glycines
tcccattttcccccacctccgccttctcccaccccttcttcgtccaccactttcctccattgcccctcctcctcggcatcaatggagcatttccctgctgaccatcatcggcaccactgctgcttctgctgcagcccttgcccctccaatcagccgcattgccatggccatggtcagtgagcattccctttcattttgttttgaatcaatctttccgctttgttcagtgcctttgcgcaaaagtcattccgtccatggccgtccgttgaacgctccgtcgtcgcggggctgcgcgtgggaaagggacggaccgccaccgccgtctccgcggagtctacgcgagaggcgcgtgggaaatggcggctttttgcgcggattattttctccgtcgccgcagcgaaaacactcgtcgacgaacagaacgacgacaagcggcagaagaaggacaatggcaaggaatgaagtgtacggaacgctgtgggaagagccggaattgaacaacggcaacaatagcagcaggtcgagcagaacggcacaaatgatcaaaaatcaaggggggatgtctgatcagccaaatttgaggaatgacactgatcagccaaattggggggactggcaccgatcggtcaaattaaaaggaatggtactgattagccaatttcgagagtatgacaattaattaatcatgggtattaaatttcgtttatttttcagcgattggcttgcccatcaacaacgcatactttttgcgcgcgaagctgaagaacaacagaaaagcggcaaatcctttttcgcccgacttaagggattcaagcggacaaattccactttttctttgggctcaaaacgcgacgacaccaatggcttatgcttcgatgacagcagcggcactttaacacaaagtgacgcccggggaaggggtggggtttgaccatcatttttaaaaatcttgccaaaaatactaaaataaatccgtctgttttttccatttgtgcctttcctctcatttcctccgcttcagtgagccccgaagtgttgcgcgcccgtcagttggcctttcggcggacgaatacggacaccggcggcggtgccatcgcttcggcgttggtccgactgaaagcactgaacgaaaggacaccgcaaaaagcagaagcgagcagcagcagaaacaatatttgcgaacggccgacgcgcaatttcaattttccgctcgcccgcgtcttaccgcagccgaggaaaacgaatgcaaacagagaaagggagggggaagagacagcactgacaatggcggaaaggcaacgaggggatgagaaagagtgcaaaacgccagcggaagagacagcgcaacagaagcaaaagtgagaacgcacttggaaccccgttgatcattaattagtgcaaccacaatgatcaacaaatcacttaattaactgtttttgattttagcaacagcacaactccgtccgagcccccgattcttttcaaaattttaaaagattgatttacgcgtattatttataatgccaaaattaaggttctgaaaaaaaattaagtttccaattagaagtttatgttgtttttttcattttttttcatcgtttagctaatttatttgttattcttaactttttgattttgcatttttataattttagttttgccattccttcggcggaagaaatttgttcgacttcatcacttcaccgtcgagccgacaacagtttttccatgaatagaaataagagcgaccttccccatatttcgctgcccatcaaccgtttgttgcaacagaaagggacaacgatggacgcctttcctatttcgggccagcatttgtcgaccacttccaaccgtttacgacaaagcaacgccatggaaggctttgagcgtcgcttgggtgatgagaatttgggttggaagaaggcgaacgacgaacaccgaaacagtacgagcacaacgaattcaagcagacgaacttcaaaaacagcgatagccgcggtgagagagaaacagcagaagccatgggaaggacaacgcattcgcaaacattaaaaggatcatttacctaaaaccaaatgaaaagcaacttaaaaaataacaaaaattgaattacggggagaaatgtgagaaatattgtgtggtttttttttgaaaaaatttaattgatccattagatgggttcgtatttatagcaattgctttcatttctcatgtcatcattctcccaaaaagaacacatgcgcgccacttgagtgagacggggtaattagagcacttctctttcagcgtcgtctttatccctttttatattttatatgggtaaagaggcgctcatttgctaacccatttccattattaactgctaacaccttttcgttttgtgtttagtgagtccattttcaggtgcgtcctcagctcaaacaaatgcaactcaatggcatttcgacaaaactccgaaaggcgcccgatgtgccgacaaaggcacacagttccgactactcattgctgggcgaaatgtttccgcaccggaaaagcagcgaccagcggaacagcggggaaattgcaaactcacaattagccacggatggcaatgtggacgaaactgcgagacacggcttaataatgggtgagtgaaagggggggggggaaactgattgattgggggcactcatcgtcaaatattgtggcaacagatgaggatgaccagcacagtttggctggcactgatttcaatgagccgtgggattccaatgcgtgggagaatctgatggatttggcacgttttggcgatggtcaggtggaggaaagtccacgcgcgtcgcaaatcggtctcttttggagtgtttaacaaaaagacaatttaattttcagaaaacgacagcttggcagtgatggagaaagcggcaaaaatggtcaattgtttgcgcactcaaatccctcattttacgaccggagaacaccggcggagtttgatgagagtgcacgggaccaactcgatgatggacatttctgggatcggctccaacaaattgagttatccgatatcaacggaagccgctaacgaacccatgagagctaacggactcaattttggccaaaatagcatcggaaaacaacaacaacaaatacgccatcatcggcccgtccctgcctgctcgtcgtctgtcgatgaactcaacgcttacaatcagccgaacaaagtcacgtccatttgtccttctctcgtccccgtctttttgtcctctcgacttcgcaatttggcacacgaacatcccggagaagaggacccagcaaaagtcatccagcgatatgttgaagagtgagtggacacggaatttacagcccaattttgggtctgatgctttttgttttaagcctttccaaggatgaccaaactcttttcgaggccgctttgcatcagttcatcgaatgcactttgctttccaaggagaaggatccgtacgtggtcattcggcgagtgcgacagttcatcaccgggtcaataaatcaccagtgttttggcgtgacgctgcgctcccattttcaggatgaagaattatttgatgaaaatcggtgaggccgatttgcatccgatcattaagcgggagagaagtcgactgaacatcgacgaattcctcaacatcgatgcgatcctcgaagaagttctggtcaagattctgttgtgtgagttttctggagccaatggggtttaaaaattagtttctaccatttatttaattatattttcgtttaccggtcggtcacattttaattttcagccaaattgaaggcccatttgtaccgtctgatgattttggagagcaccagcaacggcgagctgagaaggctgtctgagaacattgcgcaagtgcgtgcgatgagtgcggctgagttgggttttccggagggcaccgaactgccggacagcgcccgcatggaacagattagcagacagttgcgcaaaatgcagaaccattactcgccgttgaagaaagtgcagctgctgctccgcgtcctttcgttggccgtccctttggccaattcgccgtccgcttgcgcaaatgaccattcgtttcggcaacaaaaccatggccaaatgggcgaattcagtccccaaacgccgaaagcgcatcaaaacagcggcagcagcagcagttactacgcattgtctcccgcactctccgccgtcagacatcggaccaattcggccagttcctcctgcgtcgctgctgccgccctgaaacacccgccggccgacggtcgtttttcacaatttgactaattgcaaccgtcttatattctacggcttcagaattaatccgttggctcgtctatttgttggctcgcagttcgaccatcaattgcgaaatcgaggcttggtacatgtgggagcttcttccgcaacagggtccg

SEQ ID NO: 3938 - DNA, 1570 bp, Heterodera glycines
aacagcctatggtacgacgcttttttgatgaatttttcatttccaccccaaatgaatgcaatttaggggaaaattcagcatgcgcaatgagctgggcgcaaaccgagtcatcacaaaaccacaagaattctacaagcttgtccttgaccataaagtggtaaatgtctaagctgcttttttgttattaatggccaacaaaatgatggatgcatttaaggaaatttatgcaattattcctttgtctgatgatgtcatcagggtctcgtacaggacgaaaaaaaattttgtggacgagcattcgtcaagcaatattatgctcagcttgtggacaacgagtatgtgtgccttcgttcccagacaaacattccatcatcacatctctcattttataggtcgcgctaggcttaaactccttgactctatgcaacaagttcacgagacggaaggggcagaattgctttatacggtaatttgtagagataaatcatcatcacatcacgatagtgtttctttaggacacagacagcgtgattgtgaagcatcggcgcgatgtttctccacttcagactggcgaattccttggacaaatgtcggaggaatatgccggctatgccatccaatgttttgtttgcggaggtaaatagatggtggctgctggtagctttattctttaacatcattttttgtacaaggagcgaaacaatacgccttaaaaatggttgatgagcgaaccggcgaaacccgatatgtgcaaaaaatacgcggcataaccttcgatgtgcagaacagccaagcactacagttcgagcattttcgtcagaaagtgttgaactatggccgacaaggagaggcgccagccgttttccattatgacaaaattcagccaacccgcgggagtcagattgtgacacgtgagcagctcaagcgatatatgccggtctgccaaaagggaattatcaacgaggcgctggaagttcttcctttcggttttgagtgaacgcacagttgattgattggttgattgattgattcagcactccttatgtgttaaccgtttataataaaaaaataatttgttgttgttgtggatgccgattttaaagttttaactattaaaacacttcaattaagtagcacatttattgttggaaactatatttattttctcgaaaataacggtagcgaaaaaatatcatattgaaaaaaaacacatgttaattggtagaatcagggctcagttgcggtaaacatatttcaagcagttcaattggataataataacaatggtgattgcccccatgttggacaacacatggaaggaaggggaatctgagacgaacgcgatggcgagcgtacaagtgctgctctaccgttattgacaaatagccacggtaggcacaaagacgatccgcaccatgaaatgacaatgaattggccgaaatttcaatgttattcttcagatgaacagtctttagcccgagatcaccaagaaagcgtaagttttccatccgtctcttctggagcatttgcggcaaaagcgatggcatgcacccagccgtgaagcgacaca

SEQ ID NO: 3939 - DNA, 5970 bp, Heterodera glycines
agcgatatatgccggtctgccaaaagggacttttcaacgaggcgctggaagttcttcctttcggttttgaatgaacgcacaattggttgattgattgattcagcactccttatgtgttaaccgtttataataaaaaaataatttgttgttgttgtggatgccgattttaaagttttaactattaaaacacttcaattaagtagcacatttattgttggaaactatatttattttctcgaaaataacggtagcgaaaaaatatcatattgaaaaaaacacatgttaattggtagaatcagggctcagttgcggtaaacatatttcaagcagttcaattggataataataacaatggtgattgcccccatgttggacaacacatggaaggaaggggaatctgagacgaacgcgatggcgagcgtacaagtgctgctctaccgttattgacaaatagccacggtaggcacaaagacgatccgcaccatgaaatgacaatgaattggccgaaatttcaatgttattcttcagatgaacagtctttagccgaagatcaccaagaaagcgtaagttttccatccgtctcttctggagcatttgcggcaaaagcgatggcatgcacccagcgttgaagcgacacagtgccttcactaggttaagcggtcggcgcttccctcgtcttcttcttcttcgacgacgccccccgggttgtattggttgtccatcagccacaggtccagctcgtccacgatcagcagtcgattgggtaacaggttgttgctgttgttggtttgtgcgaagcgacaacgaggcgactcgcccgggcaaatcttcatgtcctttagctccacatataggggttcgctcctaaatttaagaaaaaaattaaatacagttattgctctaactcgtttaccattcgatactcccggtttccgtcttcgggtagcatgttgagaagagttccagtccggcaatcagatcaagcgttccctcaacgagcaccggcaaatcgggatgatcgtcgttggaaatgtgcacacaattatacacgcaaagaggattcgggtaatattcaccaggggcactcaaaatctcctctttaaaataggcgtacagcgcttcaacgctgtcaagtgcaagctcttgttgaaaatgctttatcgctttttgcatgaaacaacggccaggacaatataattatatttgtcgatcataaaaagcgcttgtaacttttgtgcaggtacatgtgtatgggcaaattcaaaaatgtgagccgcttaaatagtggcacaagacctcaactggtgggatagcgtggtatttgtaggattgtaagcagcaggaacaccataggctccgcccccattgttgttgttttgaaatgatagcgagtggaaaaggtcatattcattcagttccatagcgtgatgcccatttcgtgcggatccgccatcagttcccaatcggcggaaatggcggaatgcacaaatggcaagcaatatgacgacaagatcgaataggtaagtcaaagcgagcaagagacgttcaattccattggacgacaccgctggtacaacaatagctgatctgctgtttctacggtcgccgtcttcacccaacttttcggcacctgcttcaaataagaggaagttgaagcgaatgtcgcttgagttggtcagaaactggagctgtgacgaaggatcgttgaaatagtgtccaatgcggaacttgtacactcgccttcgccaaatcatgtacacatggtcagctgcaatgaaataatccgttttttgttccggcaaaaagccaacaaaattgcttctcagaacatgtgccgatgttgtgttcaacgcatcgtccgtgttattcagtgtccaccaccgctccaaatcggcaatgagcaactcattgattcggcgttcactcttgtccacaatgtacaatcgggcggcaatatgatcaaacaaaatgcggccataagcgctcaattgccgtgctatcttttgctggtgtccacgcagcacggtcacctcacccgcgtcattttgaagattgaaaattacaaaactatggccgccatgcccaaaacatgcccatggtaatgcggttgacggtatctcaattgttgtccgtcctaagctcattaaattatccacatctgtcagggcaatgttccatgtatccgggttggtgtacagccgattgatattcctctccagttcaacatgacatgcggtgtcccggttatagccgaaccaatgttgcgcaggtgaagtcttggaaatggtgcggaatgaacggtcaaaaaagtttggtgggtccacactcagctctacattaatccattcgccggaagatagatggagaacattgaaaaaaatgaaggcgatcagcaagaaataaaagaatgacgacatccttctgttctctcaatgaaagaaacaatgtggtaccttctccacttttagtcggccttttatacatggcgagccagtgtacgtacataccatttaactaaccagtccgccatcccacgcgttttgcgcaatgtttcaacaacgtcgcaaaacggggtgccggaacaacgactggccaagaaatagacacaaaaatggccgcaagcgtccgatgaagggaactgaatttgatgcatgtttacctgcacatgctgaaacttgttgagataggcggataaatcgggatttggtgccacacctaggctgtcaaagtattcaatttgcgttgcagatggcacgtaacaagccacccaatgctctccgcgtgtgccctccttgtctgtgtttacaaccatgcagtgggggtagcgccgcattcgtttctgcctctcaagaacaggcggtattttgtttgatggataaacgccaatgaacttgccgcttgtaacacgcagccttttgagcaacacgtctatttgtgctgaattcatctctctctttcactgtttaaacacttccgtcggtgctcaacactcggtcagcgttgatggaaaggacagaatcgaactcaccaagaatcaacatttcgtaaccatcctcttttataggcttttcgagttggaccttaagcgtgcaagtgccctgacggatcaactcaaacccgggcgtatcgtctagcgtggaggtcatcggaattacgaagaaagcccatccgctgaggaagcgttgcatcccaatggacactgtttttgtgtctgagtcatccagaccgagaccggcgtacatgtcgacaaaagcgcgcacaaaacgttgctgcgcatcgtcaaacgacaacaaatatggcgtgctcggaaaagcttgaccgtttgcctccgcacagatcgatcgcacgtttgcatgttcaaatttaaagggcgacaaccgtcgattgccagaataagcgtctgtagagacaaagcagcaaatcagacgacggggcaaggttgaagtgaacacgttgtgagccaactcagtcctgcctttgcccaggaaaatggagcgcatctcaatcttacgaagagggtatttggccgaggtggactccaactgacgactgattgccaggttaaggctaggcgtaacgtccacggtgcgaacataaacacgcaaatcgtgcacacgaatacggtattccttactgttttcctgcaatgttccgtccgctttcttccaaggaggtgtaagcaggaggaaagaatcgttgttacgatgaatagtgaatatcacgtcctggttgttcagcatcagtgcattttggtgtgcaagatcaaaattcagtttcaccatcgtttcgcactgttttccgttggaaaagcgcgatgcacgggcgatgaagccatcattggtgccactgtcttggccatcatcctcatctgtataataacacgccgcctcatggaaagctttgcgaatttcatgggagtagcccagctccttcattatgtaatcccgataatggtaatagatggagctgtcgaacacctcaatgcccgaaatgttgatcttcaacgagcgcacaaaactgctgccaaagttttggattacacccacgcgcttatcctccggctctgcatcactgattgaaaccattcacctgccccattcttgcgctcaatagagctgagcaagtacaagtatgttttgctcaagtcgcagtactgactgtccgaaaacaaacggaacaggtacggaccggtctgattaagtgctgacagtggcaacaactcgcggacatttgtcttattgatcgccacattcgttggcggaagagaaaacaacgaaaggctaccctcaacgccttcaacactgtctttgtcaatttttttgattacgctcattagtgttgtttggactaaaattatgcgaactgtgtgcggtaagtagacagaaaattaatttcgacacctatttatagatttttgtgtgtgggctcactataacgggcgtgcgtgcttgccaccgtgtaatttatggtgcaaatgtgagttggtctattgcctgtcttttgttgcctctcagcaaatgcattggcactgccgtcttaacccttttcaccggtctcttcctcttccttgcgggcgcaccctttccacactgtttcaatttttcggccaaattttccatcccctgctttgtgtgtgcctgaatggattccttaagtgcctttccctgcgaaagatcctccattatgcggctcccggcactcactccctcgcgtgacatcgcttttagcatgttagaagctaccggcatcaggaaccgggcaacatttttcaataggccagcaccacgctgatgccgtgtaccaacaaaatattgcatttctccccttccctcttgttgtagagcaagaagaggcgcccaattaatggtgtccgggttaaacgcgacgtgagtcatattgcgcaattgttgttgttgttgttattaaaataattttcgtctaaaatgcagtgtgacaatgctagttccccaattaaatttgacgtagcgtccaaaagcgttctgaatttctatgcaaatttcggaaatgcgtttgttttgaagtgaatgaaaaatttcattagtatatataacctcaggcacgtccgtccctcccccactggcaggtgcggccgaaacattgaccaccctaagcagaggcgccattcggtcacctatgatacactcctcaataagctttggagcataaacatacaattgtttaacaccaccagacagatctggcatatagcgtgcctgttccccatgaaacagacgagtgttgtcaaagccgagcacatatgcaagatgcttacttacatccacatgaacgacgcctgcaccggttatcagaacaaatcgttgtgcaagatcgttgaacacaaactcggcagcggttgactctttttgctgcttggcgacaagtttttcaaaacttacctcttcctccctggaaaacttcatatgttccaacatcaactttaaaatttctcctcgcgtttttgcagaggatttatgcaaaggttcattttgtgtttttttaatcagttccttcaatgcttcacctcttctcgacgtggaaaacagaagaaatgaattctgtatatggtgccctaaacaataagatgcgatcttagcttatttatttattttttccaattctgtttgggtcatgactagagatcagaattttacgaaaatgcggacccagaccagcaggactaggcacccatacggactaaaaacccataaaacccttactccgcataagtccgtactcaggaaaaatacggacccgtatacggatcagggttttttgaaaatattttttatcaagaaaaacatgctttttttactgtaatcaaattaagatttgctataaattttattacgaacatttaacaagttttgaccagaaaaaaaataaaattgcgagctaatgaaaaattaatatttgtaatttatattttgagagtgctttatttcaaaaaga

SEQ ID NO: 3940 - DNA, 1133 bp, Heterodera glycines
  misc_feature (46)..(46): n is a, c, g, or t
  misc_feature (69)..(69): n is a, c, g, or t
  misc_feature (97)..(97): n is a, c, g, or t
  misc_feature (1088)..(1088): n is a, c, g, or t
  misc_feature (1114)..(1114): n is a, c, g, or t
  misc_feature (1117)..(1117): n is a, c, g, or t
ttttttgattacgctcattagtgtgttgggactaaaattatgcganctgtgtgcggtaagtagacaganaataatttcgacacctatttatagattnttgtgtgtgggctcactataacgggcgtgcgtgcttgccaccgtgtaatttatggtgcaaatgtgagttggtctattgcttgtcttttgttgcctctcagcaaatgcattggcactgccgtcttaacccttttcaatggtctcttcctctttcttgtgggagcaccctttccacactgtttcaatttttcggccaaattttccatcccctgctttgtgtgtgcctgaatggattccttaagtgcctttccctgcgaaagatcctccattatgcggctcccggcactcactccttcgcgtgacatcgcttttagcatgttagaagctaccggcatcaggaaccgggcaacatttttcaataggccagcaccacgctgatgccgtgtaccaacaaaatattgcatttctccccttccctcttgttgtagagcaagaagaggcgcccaattaatggtgtccgggttaaacgcgacgtgagtcatattgcgcaattgttgttgttgttgttgttgttattaaaataattttcgtttaaaatgcagtgtgacaatgctagttccccaattaaatttgacgtagcgtccaaaagcgttctgaatttctatgcaaatttcggaaatgcgtttgttttgaagtgaatgaaaaatttcattagtatatataacctcaggcacgtccgtccctcccccactggcgggtgcggccgacacatttaccaccctaagcaaaggggccattcggtcacctataatacactcctcaataagctttggtgcataaacatacaactgtttaacaccaccagacagatccggcatatagcgcgcctgttctccatgaaataggcgaatgttgtcaaagccaagcacatatgcaagatgcttacttacatccacatgcaggacgcccgcaccggttttcatgacgaacccgttgtgcagatcgttgaacacaaattcggcagcggtttgctcgggtttctgcttagcgancagtttttcaagcttacttcctcctnccncggaaacttcatatgt

SEQ ID NO: 3941 - DNA, 1254 bp, Heterodera glycines
tttttcattttattgccctacgagaattttatcaaagccataaaaggcaataaaagaaaatgatgaacaaatgaatgaatgatgtgattttgtgaaattgcatttgactacattttttgtcggcggaagtcggaaatttggggaaaaaggaaatggaaaattggaatggtgaattttgatagaccgaaaaaagtgaattattgagagaaattaaagggggggggggtaattatggaaattaccaccaaaaaagagagagtcagaaaaagaatggaaccaaatattttcttttttttgcttctcttcctaaattgtctctcgctttgtaattcattatcaatttgactctttctcttccccccccccccctctctcactctctctctctcgttctctctctctctttctttctttctccctcgctctctccttctcttccttttcccttctatctttccatccttccctcccctttttctcttttctctatactctttctttcctccccttttactctaatttcttcctcttctttttccctgtactatctctcctcccccgcctttttgtcactaaattcacaactatttctcaaggtcactttcatcagaaaaactctgaaaacaaacaaaaacattggcgcaaggacagcagacagacacctcccaaaataacccaaagcggcgaaattgggccaaaagtcgccgatagtcccgccgacgcaccgacacttcccctccccccccccaattgcttttgttgttttagcgtaatgccaacccccgcaagtttaaatgtctcgccactttccttccgtcccgtctttccgtccgtctgtctatgcttttttattttttgctatccaccgcctttattcatcctcaaataatgaaaggaatgaatgaatggttcgtttcccctttctcttatcgtctgtctgtcctcccccccttaagtgccaaccccattaaagacaataaatacaacaattacatacatttggcggtaatcacgcgtgctctccccccattttttcttttttttctccgtctgtcccgagaaagaaaaatgtgatttttatttccgccggggaaaaagcccgccgccggctatgggtgggaaaaaagggaaggcgaatttcgccaccccgcgtcacttttggagaaggaccaaattccccatcgtcgaaaaaagtaaaagataggatcaccgcctcgggggggggggggggggtggggttgattgtttgtttct

SEQ ID NO: 3942 - DNA, 2451 bp, Heterodera glycines
ttcgagcaaatcgagaatattaattgcacgttttgtacattatgatggttttgtttttgtttttggatcaacgtaccgttaactttggtacaatacgccgcctaattggattatttaatttccgtcgtcgtcatcactgaccgtactcagtttatgagcccatcacataattcgttaggacacaaccctcccccccccccattactcaccttaaataatctttccgatcccccagcgaaaccaaaagttaaaaaaacacttaattaccaaattatcccctcccctttgtgttgctggtatttgctgatgagacagacaagcgccacaattcgctgtctttccctgaatttcgcttgccatttggctgattgagacggcgcggactcagccggcgacgacacaaagggattattggcacagaaagtgaccaaaacactcactttaacgcgtttaaatttgaggattgttttgttgggagagacttttgaaagtaaacgattgcggaatttgtaggggataaaagtcagtcatttggtctttgaaggagcaaacacacggattaagggggggggggggggagcaaaaacagttgcgcaaaggatgacacagcggacaaagccgatcggcatgtttgcttgcatacatttgaatttgttgccaatttatcaaagccgatcagcgggggatttgttcgcactttgaaattgtttccaaactttgcacggcggactttgctttgttctgacccgcaattgccccccccccccgcccaatttttgttctgttccatggccacccaccacttggacgcgcactgtgcagctctgttgctgctcctcctgctcctcttccaccagcttttcgtcctccgccacttccatcgcttctgccgctcttttcatttgtctcttcacaaccattcggtgggggttcttcttcaattggttctggtcctgcttcaacttcgtgtcttcctcctcctcccaatcgtccgctttttcttcgcccatctgattttttcgggcaaactcttccgacgacgatgatgaagcggaaaaagaagaagaagaagcgacgtactgaagcgatggcggagagtcgccgatgcccgcggacattggaaattgggcggaggcggaacagacggacggagaggcaagaaggaacacggacagactgagcagcaacaacatgggcagcaagttcagggaggacagagtgcgggcgagcgacggtagtcgacggcattgacacgaggggcacgggaagagcggttggaacagtgccaaattcgaatcgaagtcgacggagcttgaggacgaagcgaagtggtcaaacattgtctgcaataggaagaaatataaaattgcacctttgaatttgcgataaattagtcacttttgtccgtccgttcgttttttgaatccgttcgtttgttctttcgcttggccaaatgaattaattgtcgtcgttcgtcctttcctttgtcttttctctgtgaatgctgataatttgagtgagctgttggccgggcttgttgaggtttggcggcgattgccttttgcgtaacgtttgaggagaaatgtgccgccgctgtttttgcgcggctttttaaaatacctctcgggggagggggcagacggaaggagggaggggaggggagtgaatgggaggggaggagagggggaagggggaggggagggagggacacgcccacttccttttgagagtgacgagtggagggaaagagagagagagagaaagagagagagagagagagagagagagcgagagagagagagcgagagagagagagagagagagagatcggaagaaaaacgaggaaaagtgagagcagcaagagaagagggtgtttctgtgtctctgtccattttcgtgaaaaaagccgaagagcgggaggcggggggcgggggacagaagggacattcgatgggttaattttctgtccgcctccgtccgtccgccgatcccttttcttcttcatcctccgccgattttgccgccagccgccgccgccaatgtccgcgcgttgtgcatgagcgattcgtccgtcccctcagggtcagcagaaactgactcattaaattttttcagtgccttttcatcatcattcaattttggacagtcagttatgccttttgactctaatgcccagaagcggacgacgtctgactccggctgaatgtgtgctgattgaatgattgtgcaggctagcgaattcccggggttcaaggcaattgccatttcttcgtccccataaatccgttccgaaaactgtctggatttcgaaaattcccggtcgaatttccctacgatccagaataaaacgcccagaattcacgaactccgattatgatttttgcttcaaaaaagctcggtataggcccttcctgatcatcaccactgcaaaaattcgtttggatctcttgt

SEQ ID NO: 3943 - DNA, 1920 bp, Heterodera glycines
aagagagagagagagagaagggaaaaaagtcttgagtgagtgtctgtggccgagcacaaggttcgtaacgggttaaatgtgaattgggcaggcattacaatacaaaaaatgtacaaatcgccacagcaccggccattcattgaggcgccaaaacacactttggctttggcgctgggccggcacatgccatctccggaggaaagtgcctttttaagctaatgaataattgagtccgctgcactttggcattactggggaaatggagtcgaactggaattaatgggcaattaatgcgcttttggcattgactatttttgcaaaacttttatatccattttcgatgatttgttcaatataaggccaccattgggccattaatcgtgcattttaaatcaaataatgaatatttttgtgtgcacaagttgcattaataataataataaaataataatatggcttaatgaatgtgtttgtagtaaataaggttctgctgtagtacggtaggagaagccgtaattggtgtaataataacaataaataataatcataataataatgaactgactgcgcaatggactcaataaaaaggttaattaaatgatttggtttgggccgttaagcggaagcctcggacatttcgactacaaaaacttccatgtttatttgccacataataattaatccctggacattctttcgcttgtgcattccgcctccacacattccttcgccgtctctcacaatgttttcgcaattccctcctcaaattcagaaaatttttgcccacccttggcccaattggccgttttgtcgttgtttttaaagtcagggcgatggatggccaaatttcgaaaatgctttttgaaattggaatcccccccaatggctttcggttgaatttcacagataaaaaagggcaaaatgaataaaagggcagtaaaaaaaagaagcagaaattcctttctgcgttcttttgtccctccatttccaataatttttcatttttattgccttttaatttcattttcctccctttgcttttcctctcccatttttgtctttctttgtcccttctccgaccgatcatttcgattttgttcattttattccttttttagtcattttagctattcggagcacaaagcacaaagcaataatgtcagctcgtaaaattgaatttgcttaattatttttgtgtgtgagcgtaaatcagtgagaaattctgtcgcttataaattcgacaaatttttacaatgagatggatttattcaaaataaataaggaatttgaaaatgaaatagtgaaaaattatcttaaataatagcattctcaaaattttcacatattattttttaaattctcatattatcgaatttactcaatgtcgaaaacgcagtaaagtagtgaaagtttttgcaatagttcagtgtccaaattacacagtgcacaaaaattcggtgccgctttttgctcttttttttttgtcgttggtatttcatttgaccattcgcttttaatggcgttgcgtttttgcgaattatgtaattcatagttcgtcggatgactcatcaattctccggtggaaaaacagaaaaataaaagcacggggaaaatgaaaagctttccgcaccgaaatgccaaactttgccaagtccgccgctctaaattcttttccctcgtccgaaaatatttcttcacattttctcatttaaaaatgtaagaaatttgatattttatacgactcgccgagaaaaacaattcttaatttgtttgagtgtcttttccggccaatgaacgccaaaaatggcatattttttgtacttttcacaccaaaaaataattcacacgacacaaaaggaaaaagagaaaaagaaaaagaaggggcaagagaatggacacgtcactcggcagcaaaacaag

SEQ ID NO: 3944 - DNA, 2088 bp, Heterodera glycines
cttaccgtacgccgcgcgaatgtctagtagtaaaacttcccgctacagtaccccctctcccccccatttggcacgtcaaatgccaattcattcgcttaaacaaaatccccccccccctaaatctcccgccctatcggtgcccttttaatttgtccactcattaaaagttgcaatttaaagaaatgattactaatggcactttgcaaaggcaaaaacaaattgggggtggggattttgtgtggcattcgtcggcatttggcatggcttacgtattatgacgacgcggacagtttattgttttgcactttttaactttgcttgcaattgaccttttggcctcgttccgccacgctaatccagcagtgtttgtccacgggggcgcctttggacttttccgccggagggggcgccaattcgaagccaatttttggtccgatggaatgtcggattgcattgctgaaattcaccaaaccaagctcaatgttaattatgcggaaagtatcaactttggactgaaattttcggtccaaggaaacgccgaggaaaactttcgcgacctaacacagtcaatctttttgatgtttaaaaatacaaatacgtcgtgtcttctcccaaattatcaatccaatcccacccctactgatcaaatccattctgtcccggtaccccattgatcactccaatcacttcaagttcttcactgatcagtccaattcctcgtgatcagtctactcagtcccccccccccccactgacaatttcacaatgtgtcgccgtctctccactgttcgtccggccacacagatcagcagcgcttggccagcagcaatcagcaacaaataaacgggacaaagaacattgatgccgcttcctcgaaccattttgtttgtttatttgtgtttttggtcactgataccgtttcaaagcaaaggaatgcctttgggggagagattaatgaggggagaatttgatgaggtatttagagggggaggggagggaatttggggtgttctttgaatctattaggacgtggtggtgaggtggttcccccaacactgataataataataataataatggcaaaaaagaagcgatgatgacgaaacattggagagatgatgaaaaggacgaaaaaatggtcaaatcgacattttaagatatcggtctaatgatctagggttgctccccgacccctcggggggcaaaatgtcgggggccagggacctcggggggcgacatctcggggatcggggcggggaggagctcaattgtcggggatcggggaccccgatcggggaatggccaaatttttttaacccaaaaaaaccattttttctttttaactgctcgtaaatcttctttttttcactttgatcatctgatttcgttagcgccagtaagagtgagtccaagttggcctttaaacctggggtttccatttgttcttatttataagaatattctgattttggggggggggggtatcgactaaaattattctgatttttaaatatacttataattttgaaattttatataaaatttgatcgaataaattggaaaaataactgattggaaaaatgttgctaaatgttcatatttttgacactaaaatcttattttggacttggtgtttatattttgaaaaattttcaatggaagccctgttttaaaaatacgtagaaaggagtggggttaaacagaaatttttgcgaacccgtctcaacatcgaatttgaccatcattttttgcggcgctctttttcagaaaaacttttggggaacaaaggggtgatgagggcggtggtgttaggagccgcgaggaaatttttttttgaaaatttgaaatttgttaacagattttaaataaaaataccaatttttgcaattttgggacattttttgcaaaaaaaaattgaattttggggaggcgggggtggcgaaagaaggtgtcgaaaagttttttggaatttttaataattaatattaagaaaattgtttaaaatttcataaatttttaacctttccccccttcgctgttgaattaatttcttgtatttttacaacggcttggagtcctcaattcccc

SEQ ID NO: 3945 - DNA, 3024 bp, Heterodera glycines
tgctgctgcctgcgtcttttgcggttgcagatttttgccggtctttgggcgtttcccccccccccccccccccattttctttgtttgttttttggttccaaattggggacgaatgacgaacagcagaaaaataataatatacaaatgcgacgaaataaataaataattgacaaacgatggaatatttatttctttttggaagcattcccttattaaacaaagtgcacgggcaaagagactcattcatttcctattttaacaaatattttttataatataataaatgacaaagggtggtccatcgtaaaaatccaacgcatcagcagaatttgcaggaaaaggaggccaaacattggaaaaacagataaaattagagaaaacataaagcattaatcagcaaaaaacaactgccgaaaagccataaattaatacagagaaaattgggcatatttttgcaaattatgctccacaaattcagcaccaaaaaatatcacttttgcagaagagggtccccgaaaaaaggggggggggagggtcattgatcacgaatctgacatcaattttgacgaatctcccctaagccgaattcgaacaaaagttaaaattcaaaactttcgttatttcgattttttgttcagattaaaattgggtattcataattagtcaaaattggtgtcagattcatgatcaaaatcatgacttattattagggtcgcgacttttagtgacgaaaaatctcgaaatagttaactaaaatagtgagtaaaaatgccaaaatagtgacacatagggggccaggacgttttcgcgtggccgttttcgcgtggggtacgttttcgcgtgagtgcctattaggactgaaattggtcggatgtgtgccgaacatacatttcgacctatttcgaatcccaaacccgatttcaaacaatttttcgcttttatttactcaaaagcgtcctcatttttatgcttgcaaagattaacaacttcaagtattgacaacgtgaatgagacacagaatccgaccatcggcatcacgacatttctttaatttttttctttttccggggcggaggactcttcttttcacatacctatccaagagattaacccattggaaagtcttaactgttttgttcaattttttgccgtacaaaagtaatgccccaaacattttacgcacaaataactcaattttatatagaaaaaattctgtaataggggttggaaattattgaattaagcaccagaagtaaaacgggagtgaaaaaattttccaaactttaaaaaagtaaaaaattcgcttatgtgcaatcacgcgaaaacgaccccgaccgacacaatagtggcaaaaagtccgaattagtgacaaatagtgacataattttcagccaaaaattgagcaaaaataatttttattcactatttgcagttgtaaatgagtaggactgggatttttaagaaaaagtttttaaaattaaaatttttgccaagaaagtaaagttttgagaaaattttttcatttcataggagtatattttgaaaaatttaggtcgattcttaggggtgtattttttggttttattgctgcatttttgttaaggaattttccaaaaaatgccgaaatatgtacacggcagggatgggccgaggtttcgcttttcgcatttcgcctttcgcattattcgcattttttggcgtttcgcatttcgcttttcgcatttcgctttttggcgcgaaaagcgacttttacacccctaagaattggattaaattcccataaaatttttcaaaattttacctataaattggctaattttcagtgaaaacctgtttataaatgatcaaaatttccaatttttttccccggcggcgcctatcggcaccgccgcgccccccaaactcctattttttcttagaaaatggcccaaaatcgcaaaatttggtaatttgatgaaaaactgttctcagtggcgcgccaaaactcttatttctcattagaaaaatgataaaaatcacaaaatttgatcattttttagtgaaaatctgtcaacaaattttaatcaaattttcaaaaattttcccggcggcgcctgccccctcttcccaaaaagttttttttggaaaaaacgcgcctcaaaaaagcgttttattgatttttaaatttggaataaaattttaaaagatttttgctttatgattttaactattaaaaagttgtagaaaaaatttcgcttttcgcatttcgcttttcgcattttcgcatatttcagtttcgcaaatttcgcttttcgcatttcgctttttatttttcaatttggcccatccctggtacacggcgagtcaattttgggctccaagcgcaaataagttggacttttcgtcggagtggtctgtgagttagtcaccaaaagggggtctcaggttcaaacccactgcatgttgtgtgttcttttcaacttattcttttaaagaaaaaagacgaattatttttttattgtaaaagttttcgtgtcaaaaaaaattatattcaaaaagcgtttgttacgtacagcatcgataattttgtgtaatttttttagcttataacttggtcaatactagaacaaataaaatcattttatgctcattttgaagggaaaattctgaagaatatttctaagttagtcaaaagtttaaaaaaattgtttattggcaaataaatgattcatgtgttattttatatgtcagagacatggaaatagtatgcccaaatgagagaaaaagaaaaaactttgtcctgggtcaaaaattttttcctagggtcagatttccttgaaattttgcataggccaatattttgacctcctctagcgattccaagtttattttgtgaaagttaagtttttaactcgagatcggctcttctattttatcaatggaaaattccacaaaaattttaaattttgcaaagttttggcgttctgattactaaataaaaaataaacttatttgcactgggagaccaaaattgactcgccgtgt

SEQ ID NO: 3946 - DNA, 2253 bp, Heterodera glycines
gaaaattaggactgatgggaagtgtttagaaaaaatctgtcaaattaaatgattaactgtctttggtttgccccctaatccgaaaaaatttttcaatgttattcgaaaatttttatttgtatccgctatttaaacttactgtttccgaagtgttcgcgttgttaatccccgcatttttcaacaacgaattgacaatctccgcatatttgtgctgagcatctgcctggaaatgataatataaaataaataatgatttttgagttttttgttggccaaagtttaataatttggcaattcaggcattttcaattggtaaagcaaacaaacagttcaccttcggcatccctttgactttttcccaggcgtcgaatttggcacgcgccacaaattcgagcatttttggacgatcgccccgaacgtcgccttcatttgcctggaaaattgaaaattatcgtttttaaacgaaattttttgccctcttaaaagcaggaaaatttgactatacaattcaacctgtttgaacaaagcgtacagctccaatttggtgtcgttgtccggctcgtccttcagctgtttcatgtccttttgcgccttctcaaatgcttcggttgaaaaacaaaagcgactaaaaataaaatagacaaaaataaattaatagaatcgtatttactcgcctaaaaaatggaagtgcgacttttgtgaacggtccgtttttcaaaaattttgacgacaaattgttaaagagcatttttagcttaaaatttttaaatgatgcttttaacattttacaataggaaatcagagttcgattttgatctggatatagatcttagctttttcttgatccagatacacctgggtttgagttttccggaaatttttgcacagaataaaacacaagttaaattgaaatccttgcaggcctaaaaacaaacctaacattttttagtttcattatttttggcgaaatgttttaaaaaggcaaaaatttgaaaaagataattatggggacggggacttcaattttttttaaaggcacctaaaatagtaatgaaaaagtcgaaaaaagcacagaaaaatttaaaaaaaaaatggcaaaaattgacgctttacgaaaaaaattctatcaaaataataaaaaagaaatatttattatcaaaaataacaaatcaaatacatttcaatgttttctgaggtgatattcttgtggacacggaaaattcatacaaaaactcaaaaagaagacctcattcactttttctttccatcctccgcactttttccaccaaattttccacgcgctttctctcaatttcatttcgccaatttccgtcttttttgaaatttgagccgacaataaacgcatccgcccctttgaacaaattcacattgttcacttcgatgcccgatccaatcagaacgggaagtgtgcatttggagcgcacttctgtccataaaaatgatttgttaaattgccgagaattttcaatttctaacacaccgtccaattcgtcgggacacgccgcttcacccgtggcggcaccgcttaagatcacaccgtcggcgaggaaaagttcagccgcacgagcagtttccgcgacactgacatcggcggtgatcgcatgggaactgacaaattttgaaatttaaaaaatgcaattaaaatggaatttttaaattgaccaatgctttttcttaatgtccgtcacgaccgctatttggtcggcgccaattgcgcgtcggtaacggagcaattcgccggcacatccgtccatccaaccctcatctgctacgtggccaaacacgaacgattcagcgcggacgaaatcgaattcttataggatacaatgaaattcatgggccgtaaaattgggaatgccctaattttggcttcaattttaaaatttgtgattcacccgccgcctgagcgaccgccagcgccgcgcggttggcaccggccaaaatttgcacccccaaaagcatctttgggcgacgattggcgcccaaagtgtgtgcacacgccgcgcagaggcgtgccattgtcgcgcacacttcgggcccatggtcaattcctttttggtagggcaagtcgtgcatattctccacaatcactccgtcctgcaataaccagtaaaatagattatgattgtctaccaagatagtctcaattccgacgcctcttaaattttgaacgacgaaacactaagatgctaattattgttttcatcaaatgtgcttacaattccgcactcg

SEQ ID NO: 3947 - DNA, 2933 bp, Heterodera glycines
gctccaagtacaattatgctggatttttcgtcttagtggtctgtgagttagtcaccaaaaagggggtctcaggttcaaatcttctttgtgtttgtgtataaatttcattttttaaagcaaataaataaaaaaaataataaaaacagaacgccaaaagaacaaatacaaacaataaaaggtaaacattttattttacccttgattttatgaattttttttagcttataactttttcaataatagaccaaataaaaccattttatgctcattttgaagggaaaattctgaagaatatttcttaattagtcaaaagtttaaaaaaattgtttattggcaaaaaaatgcttcatgtgttattttatatgttagagacatggaaatagtgcgtcaaaatgagagaaaaagaaaaaactttgtcctagttgaaaaattttttcctagggtcagatttccttgaaattttgcataggccaatattttgacctcctctagcgattccaagttattttgtgaaagttaagtttttaactcgagatcggctcttctattttatcaatggaaaattccacaaaaattttaaattttgcaaagttttggcgttctgattactaaataaaaataaacttatttgcactgggagcccaaaattgaatcgccatgtttaaaatttaaacatcactccagcgcactgatttacccgggcaatgcgggtacatgaatcatgccgaagagcaacggatgttggcgcatttgaagagcacgtgaaaaggaggagagtattggaatggaggacattttgggaaactttaattaaagaatgaaaaaggtagcagcagcagcacacagtcacacacagcagaacctattcccttcctacacatacatatcctttcattttctttttcttatcagcaaaacaacaaaaggtgataatttgaatcggcgtctgtcgccgggtactgctcgagaatcctgtgctaggcctagagagtcccacgactcgggaaatatgtagtcggaggactgactatacatatgcaactttgcagattccaatccaatcgaaactaagacttttgccggattatttccttttcataaggcatttatactttaggcactcagagttttgcattgtgaaatttcaaatttcacaacatatgataattggcattatgtttttttgaaaaagtgttttttaaattctatcaaatttaaaattgtttcctttgccttttctaccactctttaattgcctgcgattgatttttgattgtcgtttatggaagagttcacatttttttccatccattcctttacaaaaattggagggaattctcttcctatttatgtcatgtcgcaaaagaatatgcatggaatggtactgctgttgtatgggcccatattttttgagattgatgggatggaattggagaataaaaatgagcacaagaaaaggaaggaaaggtgaaggccttccatcgtgtgatctttggtcttttccatcagctcacaaatattcgagtggaaaggaggggggggggaaggggtaacaacgattcatttttggtgtgcaatcgcattgaaaggagagaaagtggaaaaatgaaaatggcaccgccccgtcccctttcacatatttgatgggtgtgtatattcttaatttgttatttgcatggttttatttatggaatttcatttttctggttcttttttatttcatttcattttaaagaacttggtaaattaccttttgtttgttcgaatttcttgaatttgatgtttcgctttattctgactgacagtgtccgactagtcagctcaatttgcgctaaaaatcggatttttctgtgagaatttaagcctcatttgcactttcacatttttctctcccatacataaataattatgcccagtctaacctccacaatttttagtccgaccaaattttccactcattttgcgtccaaaacattccatccaaaaatgaccatttctgcgaccgctgacgttgacaagctccaggatgcggccaaccgaatgcgcatttcgtccattgagcagacgtgcgccgccaactcgggccacccgaccagcagttgcagcgcagcggaaattgtggccactctgttctttgccgaaatgcgttatgacgtgaaggacccgcgcagcgcatccgccgaccgtttcattctgtccaaggtttgcaaaaagtcgcgggaactcgctgatcgcgcgaaattcggttgtgtccggcacgggtcgtacgactatttttattggaattgggtattccagttagtggatgccattatcggggagtgatttaatattccaattcgttgcttctactatatttccacaattcggactttcctccaatattcccatcccacatcaattggccatacaatttcaatttccagggtcacgcttgcccaattctgtacgccgcttgggaagaggcgggcctgctcagccgtgaccaagtgctctccctgcgcaagattgactccgacattgaaggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcagcaggtgaactcaaaatccacggatagaggagacgtagtcaaagcctgggaacctacgggaaaatattttttcatgaccgttagtttctgttgaaactacatttaaaaattaatcataatttgacataagccggaatcgggattgcatggtttaggagaaataaaaaaaattttgttgtttttttttctaatttaatgttggggcaacgaatatttgtcccttttcagcatttg

SEQ ID NO: 3948 - DNA, 1732 bp, Heterodera glycines
ttttgaatgcttacgccaatgccaagtaaactcagggacagtatttttccttttcctgaattactgattgattgtgagccgaaattcctccttttccttcctgctgctggggagcaggacaaaacgtcgtcggggcataatgtcgacgcaaaaatttttaattagaaaaaaaattaaaattttttatttacctagtctaattcgaaatttttttctaaaataaaatcttataaagaaaacaagggaaaaaatgtccccgttttttttcttaaaacttgagcagattttattttcattaacacttagattttcaaaaaaagacaaatatttttttaaaatttttcttggactttttaaacaacattttttcatcgactttttggggtgtgcccttccccctggactggtattttaacacaatcccattgaatttatattggcgttaaggaacgtgactggcaaacccacggcaatcatcgccaaaacgctcaagggcaagggcattgacggcgttgccgacctgaacaaccagcacgggaagccggtgtcgaaggacaaggcggagcccatccgggcattgctcaaaagtgacaagccggcaaattggaccatcccggcaccgattcgggacgcaccggcggtcgacttaggcatcggtgccatcgcaatgagtgcaccgccgcagtacaaaatgggcgaaaaggtggccactcgacaggcgtacggaaacgccttgctgaagctggcggaggccaacaaacgcgtcattgccttagacgggtgggacagataataggcacctaccgaatttaaatggatttaaataaaaaaaaatcctttttgatgtgtcaattcaatttttaattgttttttccgtttagtgacatctccaactccaccttctccaacctggtgcaaaagaagctacccgagcagtttgtccagtgttacattgctgagcagaacatggtcggtgttggagttggcatggcgtgccgtgggcgtgtgcttccgcatgtcaggtgggcagaaagaagccttttggattgccaaatggccaagaagacaaactgctgttatattaaggggattttaaaaacaattaaaaatttttttgttacactgaatttacaacagaaaaaaaaccaccgggtttttgccaaaatttttattaaatttgccccctattttatgcattttacttttttagcacttttgccgccttcttcacccgtgccggtgaccaaattcgcatgggcgccgtgtccttcacaaatgtcaaattcaccggctctcactgcggcgtttccatcggcgaggacgggtaaactgctgctggcagagcacttggaaaaaaagggaattgcttcaatttctgttttgtttcagtcccagtcaaatggccctcgaggacttggcgctgttcagcgctttgcccgccagtgtcgtcctctacccatccgacgcggtgtcggccgaacgtgcgactgagttggccgccaattacacgggcatcacttacacgcgcgtctctcgacccgccaccccagtgctctacacaagtgacgagaagttcgagctgggcaagtgcaaggtgggcagcgatgggaggctagaaaattttcaaaaatgtttttgaattttaaatagggtttcataaataattttgtagtcgtcactaatttcgttagaatttcaatttaatggggtggtcggtgtcggtttatgtaaa

SEQ ID NO: 3949 - DNA, 2173 bp, Heterodera glycines
  misc_feature (2146)..(2146): n is a, c, g, or t
agattctcatgcaaaaaaaaacaaagttcaaacgcccgctgcaatgggtgtggcgaggcgagattgggcagtctcatcaattagcgcgctaattatccccataaataagtgcactcagtcgcttaacagtgggcgtcagcagtcgaggcggtccagaggggaggggggggtatttggatggcatttgaggggcatactgtagtcatgggctaattgtaagtttttccttttttcaaaattttaaatgttgtcctcttaaatgagtgtgtacattttgcaggattttgtcggagtgcgttcaaacggtcaaatgctgaaggtgtgctgcagggagtggaaaaataaattattgggaaaatttaaagaattttggcacaccattccaatcactgtttttgttttatgtttgcattgtctcttttttagttgaacttagagagagagagaaaatgggacagagtgggagagggagaaagagcaaagggagagggaggcagtgagagagagacagagagaaaggaacagacagtgcaagagagagaaaacgaaggtagagacagtgcgggagagagagagagaaagcaaaggggaggcagtgagagagagagaaagtaaaaagacagacagtgagggagagagagtgtgtagggagaggcagtgagagaaaaataaatgaacaggcagtaagagaaaaagttaaggggagagacagtgcgagagagacagagaggaaggaacaggcagcgcaagagagaaaagggaagagagacaaagacatagggtttttcgattttgctcctactgtatgcacgcggcggaggacaccgaaaagggcacacagttcaaacaaatttcttttattccgccaaataaatatttgttcttcttttcttttttcttttctccgcataattaccaaatggaattgtttttttttgaagagtcgaactttgaaaaagcttggacttggttttctgaataaagcgccaggccaaggaaaaccagggaacttcaggcctgggcccaagttagggcaacctcttttttgataagattttctttgccccccttggataaatagtttagagggaatttgccatttattagcagcaaattcactgcctacaataattaacaaattgttcatttcttcagatttgcatcactcacaatcagcctttacttatggaagaaaaaagcgcagtaagttttgtttcttgtctatcgcccagaatttggaccgtatttcggcactttttaacgccctaatttcgtgccgtccatcaaaacggagagagcgaactgtgcagaagtttgatttatggggctgagatggtcggtcacggggcttttgcttggcggggaataagcccctcccttctcccccagtaacgagtcattgggggtcgactgggcgccaaccaactgagcgcctgaccggtttttggggtataactcatttcatagttgcccgaattgagtgaatttaatatcattcgaaagctttaagtgtcctctattagcctgcaaaatttcgttaagtttcaataaagttctggccaacaataaattaattcaattcgggcaactatggaatgccgtgctggcgcccaggcgttaatttaacaaaaaaaattgctactttttgaatttttttttgactactctgaaaatttttatgaagagcgaaatgacgcatgccaaaagcactcatttttagtaatgctgcatttttctgagccaaattggctgagtttttctttgtttcgccatgggagggcggggcgttctccgccactgacctcaacgccgtccatctccgcgtttagttttcaatcgactcattcatttgtacattcccttttctttattagttttttatataataaaaactcatttttcatgaacaaaaaatttctgcaagaggtccacccataaatggctgagtgtgccaaaaaatgcaaagttcaaattccgaccgaattggtcgctgaattggtcgctgttctccgttttgatgcccgttgggccatcgtccgcgtttcagcggcctttgacattttggtttttaaaaaacaaaatgcttttataattgccaaaacagttgcgcaattcatccctttaaaagtattttattttctctaanttttagcagacggatctgaacagtggg

SEQ ID NO: 3950 - DNA, 967 bp, Heterodera glycines
  misc_feature (48)..(48): n is a, c, g, or t
  misc_feature (54)..(54): n is a, c, g, or t
  misc_feature (64)..(65): n is a, c, g, or t
  misc_feature (87)..(87): n is a, c, g, or t
  misc_feature (94)..(94): n is a, c, g, or t
  misc_feature (101)..(101): n is a, c, g, or t
  misc_feature (107)..(107): n is a, c, g, or t
  misc_feature (114)..(114): n is a, c, g, or t
  misc_feature (116)..(116): n is a, c, g, or t
  misc_feature (119)..(119): n is a, c, g, or t
  misc_feature (121)..(121): n is a, c, g, or t
  misc_feature (126)..(126): n is a, c, g, or t
  misc_feature (128)..(128): n is a, c, g, or t
  misc_feature (136)..(136): n is a, c, g, or t
  misc_feature (140)..(140): n is a, c, g, or t
  misc_feature (142)..(142): n is a, c, g, or t
  misc_feature (145)..(145): n is a, c, g, or t
  misc_feature (154)..(154): n is a, c, g, or t
  misc_feature (157)..(157): n is a, c, g, or t
  misc_feature (160)..(160): n is a, c, g, or t
  misc_feature (163)..(163): n is a, c, g, or t
  misc_feature (166)..(166): n is a, c, g, or t
  misc_feature (170)..(170): n is a, c, g, or t
  misc_feature (176)..(176): n is a, c, g, or t
  misc_feature (184)..(184): n is a, c, g, or t
  misc_feature (186)..(186): n is a, c, g, or t
  misc_feature (190)..(190): n is a, c, g, or t
  misc_feature (196)..(196): n is a, c, g, or t
  misc_feature (202)..(202): n is a, c, g, or t
  misc_feature (210)..(210): n is a, c, g, or t
  misc_feature (217)..(217): n is a, c, g, or t
  misc_feature (228)..(228): n is a, c, g, or t
  misc_feature (237)..(237): n is a, c, g, or t
  misc_feature (244)..(244): n is a, c, g, or t
  misc_feature (253)..(253): n is a, c, g, or t
  misc_feature (260)..(260): n is a, c, g, or t
cactaaaaatattttatttttaatttttttgaaacttccctgggttcntatgtntatgtgtgtnngggaagggctcttataagggantaaaaanaagaatngaaatnaaaaagnanagnangggangnattgattnatgnanagnaatgttaanagnggnagnttntgtngtgggnaaatagtngntganattganaaaaanttggaaanggagggntaaatatttgnaaagatttnaaatttnttaaatggnatttttnattttgttttttaattgaaacgcatttttaccataatttggcccggctcgttcactcaacacatttttgtccgggtgggcattgaatgtgaaacagttgccataagtcgggtccacatacaatgagaagtcctcctccaccgaacattccctcccattgaaactgcatcttaaaaataaatattaaataaaaatattttaattatatttaatgaaaattaactatcaaaagtacataaagggtcagtgattattattagtgttaaatttccgtcatataatcacaaataatcatttgattgttcgtgcattgtttacttggtgatgaactcgcgcttactgtagcccatctgactctgttcgtattcactcatttgtgagacagcaaacacgagattctcgacagcttttgaacgaattgcgatcggatcatacacaccctttaaaatttaattaaaattaatcattcaaagcagtgaagtgaaaataaattgtaaaaggaaaaaactcgtagagggaggagggaggttggatatttatttttaagtttgcattttcaataaagggcaaaaaaaattgaaaatttaaattacagttgttccctgaatctaccgtatttgctctttttatcccccgtccccattaatcccgccgtccccaattatcccccccccccttttctgaggtgtttgaaaaataatccccccg

SEQ ID NO: 3951 - DNA, 4756 bp, Heterodera glycines
gcatagacaaagaggtcgtgttttattcagtccatcttgcccattttcttccctaaactatttaaattaaaataattagataattagataatggaataatttacatttatttacaataaaaatatttaatcaaaaaatttttaaaatgtttataatataaaagttcatttaaatggattttatttgcactttcaatgcttgacatccaagcttgcttgcactgcaatcgcagaatgagaacaccgcaagaagtccctggtaaaaatttaattacgactgataatgagactaatcaatctaaatatttggaatatggcatttttaattagttaaaataaaaaaacaattattattattattattattatttcacttcgtattttgtgtaaagacgtcgtcgtgtcgtcggctcgtataaatagccatttttgtcggcaccgcgacgacgacgcaaatgacgagcatttgaaacggatgaagccaaatccatggcgatatcataggcggacaacttcaaatttaaattcagatttcaatgatttatcctgtctaccgtatctccaacagtagtcatttcacgggccaacgaatttttgtacgggtttaaattgcatacggttaccaaaaatagaaatataacattaatgttttaaagtagatcgtatttttaaatccttagaatctaccaatatggaaaatgtgaaaaatttcatcaaaaaaatttgccaaaaaataagcaatttttttaaagacatttgcgctcatgcccaaaatctgattcaaaactaattttttttcaagccatgatagtctaaacagcattagttaagaaaacacagtcttttagtttattaggagcattaattctgctgtttgaataattcataatttttcaaaatgtaattaactatcaaattatcagacacaatcactttcgaccactatataatgctatttagttcaccagggattgagaaaactaggtttgaacccgattttagacattgacgcaaatgtggggtaaccgcttttagatagattttgtagcaaaatttgaattagaactggagtccgtttgtgtgcccttgaacagctttgatccctgactgagccagttttaaaaaaacgaactgatgggaatgcaatattttcaaatttcaattccacgccgacaatgatgtcgttgcgccaaaagcgcttcacaatttgcacggcttggccagcgaatgcaacaaagcagcacatgaacaacagaagccagaggaagcggcggagacggccccgagacgtataggcacggggaatgccatgggcgctgcattttgggtgggacagattaggaaataattgaagtgcttgctcgagaatcccgattttaaaactaatgtttggccctaatcccgactcaggaattttttcagttaatgggagcactaattactcgaaatgattagggtttgcagttaacggatgttaaataatgaaatatggctagaaaactacgaccaaaaatcacaaaaatggaacataaaattgcgaaaatatggaaaactatttaaaatgaagtccaatatttcttcaaatgcattaattttaattaaaatctattaaatggctaagttcggttttaaaactcattttagatgtaaaaaacaaaagctaaactttattatgtaaaaagcaagtaaaaaaatataaattttccattaaaatttaattattttctttaattggctggtacataaaaatcaaaagcctcatggtaagcaaaaagttaaatttagattcaaaaaccaaactaaaaaaaaattattcacgttctaaatgcacaaaaatctttattttaaattctccatccgtaataaatagttaatgtgttaaatttaaatgttgagaattatgtggcgctgttcatgttgaaatttgttagcagatggcttggcctaaaatggttaattcgaagtgccgaaaatttagccccatctcccgcccccctccaaaagaccacaaaatgaggggctaaattctctccgatatgcggatcagtgatttgatttactctcattggttttgcctggtgttggccgcaaagtccccaaaagtggtctccaactcggcatgaaaatcgcttttgcccgtcgccgtcctttgcattcgccgactttcctgcgaacacagcgaacgccgtgacgtctttcggcgatggcattggcaaaaggtggaatcttttttcattgctcaaaataaaaataaaatataattaaaacttacaaattatactcttgaataattaagtattggatgtttttccaattagtttttaaattttattttaatgtttaaatggttatttgataaaattactcccttttgagagtagtaattttgtgcactcattcaaactaaaacagatggataacttcctgcattttcagcaagacataaattaaagtgctttttcctttctttgtttgtcaagcaattttcctctggacaaattaagtaataataataatcgtcaaacggacaaatggacaaaagtgaaaccccaaaaagacatggcagtaattaagcccgatctcggcttttctgatgctgcacaattcccatccttggttttgtcaaaacttaaatgtaaagaagaaatgatagtagaaaaaagaagaataaatgtacatgactgactaaatatcgaaggtgtaatttttaaataaatgatgatatttggttatggtcgtctgatcgtccgtcacaaatcatcaaatccaatgaaagtgatcggatgctatggaaacaatcacaactaagcaaagtactgaaaaatgattgtttgcatctaataattattcaaattactagcagttggaagttttccaaaaatgcgtcttgtttcgtctccagcagttgcaaaagttcgttagtcgttttggtcactttgtctttgtctgtttggtcaatcgttttggtcactttgtctttgtgcacattttccatctctttgatcaaagccttaatgtccgttatttttgacacaatgtccaaatattcgatgccaattgtttgcacagcaattaaaacggtgtgacaaattgcgtcgatagaatggacaaatttgttgatctttgactcattaaaatatagcagaacaagcacatgactaacatcagtgataagctccgacagatgatggctgacgagccatttcacctgatcagtcaatggccgtgccatctcagccaaattattcagtttttccttaatttattagatctatatgtatggactaaaaaaattcaaaatattgactaaaaaccgccaaaaaagatcgagaccgaaaatatccccgaaagttgagacagagagcctaaaaaaccgagaaattcttcgactcgagtgagagccgagaatctcgagcagccctaatgaattctctcactcacctccatccccgcttcgtctgttattttgcagtactgtctgatgttctccaacgctgtgccaaattggcaaaaaaatgcgattggaatgagcgcatccaattccttccaatcgcttaaggcatcttttttgttgcgcatttcttccgttaaaatgcttagttttgctttcacaacgaatgccttcgcaatgttttccatcatttgttgcttttccttcttctcccccatctttttcatctgtgcctcggcttttccttgcgcactttcgatgattgactgatcacaaaatgcgctgccatttttctctttcaaaaatttcagaatttcgttcattttttccaacgatttattcgccccattttcattggcacccttttcattttcaattcttgtcaacataatttcgatgacaaaagtgttgaactcttcacgaagtcccaaaattattcctcgaattttgggcatttcgtccagctgtttttcgctgttgcctttaagtccaaactgatcggtgcccttactcagctgtttacagaagccaatggcacggtgtgccgggagtgcaattcgccggttgaataccatttcaattgtatgtatcggctttccccaggcatggatgtgcgggtacggtactaaatttgcagccattaccgtgcctgggggttttggcataaaattccattattctttcgaccatttattcatttttcgaaggattttttttagacaaaaccgtaattagaataagtggtcaatttatgtaattacccaatttataaaattggagaatattttgctcaaaatttgccaattctttttccaaattaattagttcgctgacgtcaactgttgatgagttttctgagaattaataaatagagaaagaataaaatagtttatatgcgttttgtttttcaagaaaaacacctcatttcctagaataaatgtcaaatttcttggtgtttaaggggcaacagaaatttggacaccggaaagattctgcagaatatttagcatttaaaaaaatttaaatatatataaaaaatacctctaatctcaaagcaaaaattttaatcaaattagatttaaaattttaagcgaattatacactcaattaaaaggttaattttcctggactcattacacttctttatggatcaatgtcaaaatatattattttatatcatttttatgcccttaaataaaattggactttctcgatattttcgttccatataagccgggtattcgagtctcaatccaagcggaaactaatgcaagtctaaccctacgttaaacagctgaagaaatga

SEQ ID NO: 3952 - DNA, 2446 bp, Heterodera glycines
cattttcattcttgtcaacatatttcgatgacaaaagtgttgactcttcacgaagtcccaaaatattccctcgaattttggcatttcgtccagctgtttttcgctgttgcctttaagtccaaactgatcggtgcccttactcagatgtttacagaagccaatggcacggtgtgccgggagtgcaattcgccggttgaataccatttcaattgtatgtatcggctttccccaggcatggatgtgcgggtacggaactaaatttgcagccattaccgtgcctgggggttttggcataaaattccattattctttcgaccatttattcatttttcgaaggattttttttagacaaaaccgtataaccaatcaatcaatcccttttaatcaaatatttaatttgctcgcattaaattgttccccagattaaggctaatttttttttggcataattatggaaaaatccttctcaaaattgggataaatggtcaatttatgtaattacccaatttataaaattggagaatattttgctcaaaatttgccaattctttttccaaattaattagttcgccgacgtcaactgttgatgagttttctgagaattaataaatagagaaagaattttaatagttaaaatagtttatatgcgttttgtttttcaagaaaaaacagctcatttccaagaataaatgtcaaatttcttggtgttcgaggggcaacagaaatttggacaccggaaagattcggcacaatatttagcatttaaaaaaatttaaatatataaaaaatacctctaatctcaaagcaaaaattttaatcaaattagatttaaaattttaagcgaattatacactcaattaaaaggttaattttcctggactcattacaattctttatggatcaatgtcaaaatatattattttatatcatttttatgcccttaaataaaattggactttctcgatatttcggttccatataagccgggtattcgagtctcaatccaagcggaaactaatgcaagtctaaccctacgttaaacagttgaagaattgactaaataacaagatttacaggttccatatttaaaaagccagtttgggtcatatagtaatgaaaacacagcaaaattttcaattttaaattaatgtcgtagtgcccgatttctgctgccctaacttaatgtcgcctcttttcctatgtataaaataaatttcattttttgtacgcaaaaatctgctgatttcattcttataaacacaaacaaactcacgagttacaattggcttagtttcgatgttggaaatcacttcttcgcagtttttaacccatcgatggaattcgaccgaaacggacaaatcaaaacaaataaaaaattggataaaaacaaataaaaatgatggaataaattttttcatctaaaaagttaaagcgatgcgtgaaaaggattttacccgggtcaatgaatggtccgggtttttcaaaattcaattctttactcatgagaaggataaagggcatacgctcagaataaagatttcactagtaaaaaaaacaacagaatttaatgctttcataaaaacgaagtttaaaatcgactttttcattctctgtttttaaagaagacaaaatgaagttgacggtgccgattttgggtgcccaaatgccttacagttattggaaaaattataaaaataaaaaataaataaacttataatgataaatgtgaatgctaaaaagcaaaatccataatttattatttgacacgtgaaaaaatgctttttatgaatatattcataaataattttgtaaaaataaagaaaaagaatttgattaaagaaaatttgtgaatattaaaagctaaatccataatttattatttgacatatggaaaaagtgcttttttatgaatatattcataaataatattgtaataaattttaaaaaacaaaaaaaaattgtgaataaaaaaaaagcataaatccatcaacccgactgtcaacggagagagaaaaaatagaactataggaatggtagtcataaaaggacacacatccgccggtggtactcgaacttgttgctgttctgcttacttatgggagtgttatttgaccaccttcttataggtcgggcccaattagtaaaggttcggcaaaatggtagacctgggagggaatcgaaccctcggtcctctgctggtgcggcgatcggtttccaacccaaaccaattgcccatccctctgaagggtaaaagacgtatgaatttagataatggaaaaaggcggacagattttgcacataaagggagagagagagagaggtggggatgggaaaaagagagagatacacagagagagtgaaagagagagagagagagtgaaagagagggatggagaggagaagagagactgatagagaatagacagacaagagagagagatggagg

SEQ ID NO: 3953 - DNA, 2046 bp, Heterodera glycines
  misc_feature (58)..(58): n is a, c, g, or t
  misc_feature (1285)..(1286): n is a, c, g, or t
  misc_feature (1292)..(1292): n is a, c, g, or t
acaaactcacgagttacaattggcttagtttcgatgctttaaaggacttcttcgcagnttttaacccatcgatggaatcttaccgaaacggacaaatcaaaacaaataaaaaattggataaaaacaaataaaaatgatggaataaattttttcatctaaaaagttaaagcgatgcgtgaaaaggattttacccgggtcaatgaatggtccgggtttttcaaaattcaattttttactcatgagaagggataaagggcatacgctcagaataaagatttcactagtaaaaaaaaaacaacagaatttaatgctttcataaaaacgaagtttaaaatcgactttttcattctctgtttttaaagaagacaaaatgaagttgacggtgccgattttgggtgcccaaataccttacagttattggaaaaattataaaaataaaaaataaataaaattataatgataaatgtgaatgctaaaaagcaaaatccataatttattatttgacacgtgaaaaaatgctttttatgaatatattcataaataattttgtaaaaataaagaaaaagaatttgattaaagaaaatttgtgaatattaaaagcaaaatccataatttattatttgacatatggaaaaagtgcttttttatgaatatattcataaataatattgtaataaatttaaaaaaacaaaaaaaaaattgtgaataaaaaaaaagcataaatccatcaacccgactgtcaacggagagagaaaaaatagaactataggaatggtagtgataaaaggacacacatccgccggtggtactcgaacttgttgctgttctgcttacttatgggagtgttatttgaccaccttcttataggtcgggcccaattagtaaaggttcggcaaaatggtagacctgggagggaatcgaaccctcggtcctctgctggtgcggcgatcggtttccaacccaaaccaattgcccatccctctgaagggtaaaagacgtatgaatttagatacctaatggaaaaaggcggacagatttggcacataaagggagagagagagaggtggggatgggaaaaagagagagatagagagagagagtgaaagagagagagagagagagagtgaaagagagggatggagaggagaagagagactgatagagaatagagagacaagagagagagagggagggagagagagagaggagagaaaggtggggatgggaaaaggctgattaacaaattattaaggaagaaaatttaatagaggagaaaaaagagagnnaattgngggtgggactaacatcgcaattgggaaaagtcaaaaagcggggtgggggggggggggcaccaaaagagaaaaatcaaaggcttatccttttctcagcaccttttgtcgtttccttcaagcaccaagcgcgcggtcgtgttgggcagcagcggtagctcatccaacatggagaggacaacgtcaacagtttgcgcttgacgtcctgcaacttctccagcgcggtctcgaaccgagctcgccacgcatgtgcggcctccgagcggggacggagaagttcaagccaaaggagaagacaatgtcggcagtgccgcacttggggatcccagagagagcgagcagcgagtctgccgacgcaaagagatgcaagtggagaggacaggcggggagcgaatctcgacgaaatccgacttgattgagggatatcgggctgaggatatggttgaggtgaattgaggaaagaagcgctggtgcgggtgaaagcagccataatgcggcgcctggccaacccgccacgggggaaagtttgaaactatgtgccactgagctgaatcctttgaattttgtgaaagcatacattatgccattattaaatgcattagttcacgaaattttatctgttttcaactattatttctgattttgttcttcatggtgtcatgccattattttacaaatcgtaaaaattgatgattccatcataaaaatattatataaaaatattctactcaatgatccatttaaagaaataatttta

SEQ ID NO: 3954 - DNA, 1194 bp, Heterodera glycines
  misc_feature (79)..(79): n is a, c, g, or t
taaaacgaaaattcaatctcaataatttttatttattcgccaaaatcaatcaaaagaaaaaaaaatactcgccataccntatgtccttcggattctaatgtctcggattattaaatgagaaaaaaaaatttcaaaaagaggctaccacctatttacattaaaacttcaaaatccagcgacatttgaattcattagcctttgccacaacatgaacagcaggcttttgccaagcgctaaaaggaataaaaatatgtacatcttatattggtcaatgttgttctgattataccggcggtcgactaaaatttgcgatcacttcattgacgatctgcgacatttccgcaattgattttttttgatcaaggtaaatacctcggaacacaacaacaaagaccaccgccaagatgaaggtgatcacaaaaattgtcttcagacagccaatgtaacattcttagaaaaggagtgaaattaaattatttttataacttaaaattcatgttgatttcaataaaatttcgacaagcatttcatttactggtcctgaacaaaaaaaaaaactttcggaaaattctaataatacgcttcttagggaaggtgttttatacgacttttaaatcaaaaaatttcacgtaacaaacgtaaaaagcataagagctaaaaataaacgtcacatatgtgtcagcgcataaaattaccccggaaaaatgatttaaaaaaaaatttcaggggggtaacaaaaaggagaaccgttaaatttaatatttttataatctattaaattcgcgctgatttcaataaaatttcatatattattaacaaatcacatttgacaagtgtatacacttactttgagaaattgaaaaattaagacgtcgccaggacatcacaaaaaacagcagctgctgcaatgataaaaaattggattttatgtatagaaatgtaaaaataaatggaattgaaaccattcagtgatttactgaacccattaaaaaaaaggatatgaattggatttatacgattgagaaaaatgaaaagtaggtaatataaataaataagacacatttgttgaggcattcatttatcatttaatcattctcctcctcctccgtgttcttcttcgccatcggccagcaaacaattggcctcattttcggggcggacaccagcaacagttcgttgccttgtgccaaaagt

SEQ ID NO: 3955 - DNA, 2096 bp, Heterodera glycines
cgaacataaaagtgaattttgaaaaattggaattttcgactttttgttcgaattcgggtccggggttcaaaataggccaaaataaatgccgtattcgtgatctgcgaccacaaaaactgctaaaaaagggggggggggcaccatcggcagtattaccgctttttctgttaataaaaatgttttattgctttttttgggaaaagataaaaaaattcaaaaaaaccgaaaccgaaacggtataccgaaaatttttcttcggtttttttcggttttttaatcgaaaccgttcgaccgagaattttttgagtttttcggtttcggtttttttttcggtttttaaccgaaaccgttcgaccgaccctcttgtccggtctctatttttaattagctccaaaaaatctcacaaatttttttttttttgaatgatgtgtttggttggctccatattcctttattcgatgtatcgcctcgattcaattctttttggtataattgcacagatattgtctaaaaatgaccaaatttaaggattataaattatgccagaatagtcaatttttatcggtgtttttgtctaaatccagggtttctatttcaaaattttcaaaataagaataaaggccaaaaaataagattttagggtcaaaaataagaacattttgcaaaattgcttcaaatgtttttacattttattcgatcaaaaatgtattctattattatatttttcataaatttcagtgcattcgggatcactaaatcagatttttaacattttttgcggcacatttccaaaaaacttggtgaatgtgcgaggggagaggtccagtggtgccgattggcgccgcaagcggaaaatttttaagactttatataaattttgttagaaattagccaaatttttttagaaatttcccttttttaggtgaaaataaggcactaccccaaaaccagaacatttcttagaaataacaacatacaatagaaaaaccctgtattatttggaaaaaaaataaaatcaaaagaaaacgtcaaccggtgtcgaagtcataacaaaaagtattgttaatgttgaagcactaaccactcaaccacaaatattttataaaatataagcaaatttactttatttcataaaaatttgtaaaagatggttaaaaaaattcaaaattgtataaatttttgcctttaattccacgaatatgccattcttaggggtgtgtttttcacccccgcgggggtgaaggtcgcgggggcgggggttgcggtggtcagagtcacgggggcgggggcgggggtgagccccaaaaacctgtcccgcccccggggacgggggcggggtccgaaccctactttactttgcccatctctcccaatttaaatttgaaattttctttagttttttcctaaaatttggtgcgtcccaaaatctcgccgccgattttttttaaattaacaaacttagaaattttcgaaaactttttttctaataaaatgcaaaaaaaaaatcttagaaaaattaagagaattttaaggaaaaaatcttagaaaatagcgcaggtagaagcaaaaatttatatgcaaatacaatgaataaaaaatacaaaatcattttttatttaaaagtctaattttttttctagaaatcaaaaaattgattgaaatttgttttaatattttccatttaaattaattttttaaagacatattttaatttttgattttataaaaaaactgttgtttttctctattttcattgtccaattccaggccaaaagctgacaagcgcagaagagcacatgaattgtatgtataggttaaaaaaatgaaattgttaccattcatcaataaaataagaattatcaattaatttttatttgcgatatttttctaaatgattgacgaaaagtaaaagatttaacttttttgttttgtgattaaaatcagtttcagggggttttcgagggtgctgattactaatctgaacttgggtttgcctaatttcgaacctcggacccgaatttgaacaaaaagttgaatttttttttcaaaatatacgttaaaacctgtcaaatttttagcgcaaattgtgccttttt

SEQ ID NO: 3956 - DNA, 2966 bp, Heterodera glycines
  misc_feature (2900)..(2900): n is a, c, g, or t
tgaaaatttagcgcaccacaatatttcaatccactttatcattctcgtgaatgagtcgcctgatcagactttgctcaaaaaaggggcggaaaaaagtcttgactcacacatgcaaacccaccttatagttaatttacatgcttgcttatcttttggtcctcaacaaaaaacttacatttttaaatcgtgatcctttgatttatattcgagcgtgctcatagcaccttcattttaggctccaattttgaatatactcgtgttttttttaatttttcggtactgtcgaaatcaatctctgtcgaattcacaatttttctgatactgtcgaactcagttattgtcgaattcactcgttgtcgaaatcactcactgccgaaatcacatagcaacgttgtgtctcaatgcaaattttttagcaatcctgaataatggttgtgcctaatttaactttttttttggcttaaaatcagtttcagtgggttttcgagggtgctgaatacgaatctgaactcggatttgcctaattccgaacctcggacccgaatttgaacaaaaagttgaatttttttttcaaaatatacgttaaaacctgtcaaatttttagcgcaaattgtgccttttttatcaaattagcaattaaaacattgttttacatcaaaataatttgttatatgaattagaaactttacccaaaaaaatgcattactgaaaaaaatattcaactttttgttcgagttagggtccggggttcggaattgggcaaattctagttcaaatccctaacctgcaccgtagaaaactcataaaaactggttttgggtccaaaatttaaaaataatataaaaattagggaacacatattctgcaggatgccaaagacaaaaaaaaaaggtttgaaaaactcttttgttcaagttttaacggaaaaaaatttgttttttgtatgcttaaagcgccaaacattgattgtcattcatcattagggttgtaaattatatggattaacatattttttttgcgcatatgctatgaagaaaggggctcaaaaatagcatttctgcattaaaattttttgatttggtgaaggtttttagtccatataaatccatattttgggggttttcgggaataaaagcatatttcgccatttttgcgtttttagtccatattttggccatttttagcaaatttttacaagaaaaatgcaaaaaagcgaaaaatacacccctaaagatcgacttttttggaaatttttaaaaaatacaccccctaaaaaggagatttttttttcgaaatttcggaattttttaggtatttttttcgcttccgaaaatttttactggcaacagaatgagattattacaaaaattttgagacgtatttggtttgcaattgtgaagctagaatttaataaaaattttcatttttatgtttttaaattcattttttggttgtttattgtattttttaagtttatttaagcaaatattgaatatatataccttttttggaatttttgagggtttaaaacatagattttggcagtgtttagtccatattttggtccatatttggccattttcgagctttttagtccatatttcgggcttttttagtccatattttatgtccatatttagcgttttttaatccatataatttacaaccctattcatcatttatcgcttggaaatgattgatactcgtatgtatgagaagtaaaatttgtatgagaaacaaaaccacaatcaataagtatataaatacgcagataaaatgacggtttttggaatgcttaaatgaaaaatatgaacataaaataaaacaaaaaagggcgaaaagaattttcaacgaagaaatcaataaattttaggcgaaaatttttttaaaaaccgtcaaaaccataaaatattttaaaaatataaagtcagtttgagtcctgggaagttcgagccccgaattcgaattgaatctctgaaatgtaggctggattcgtgattagcgacacccaaaaacctaaaaaaaggtattctatccaattcttcaaaattgtaattttttcgaaaaaattatgggcgacaaaccatataaaagccgatttttctcatcactgccaattttttaggtgcattaattatgtcacaatcaccgcaaatggcgactttcagcggtctgacagcaaatatttaccacgaaaaacagaagaggcaactttgcctgctccacacactgaacaaccttttccaacgtgaagaatttgtacgggatgaattggacgaaatttgtgaaaggtaaacgtcaaatgaacgcattaaaatggcacttattcattctaatggacgcgattttgttcataagcattgtgtctacttaggcccgtacccaaaattttttttttttgctccgggtcaaaatttttttgtccagtgtaagtgagctaaatttttcgcgctgtagaattcccccccccccccgcttctttcccactttgacttttttagatttaaactcagaaaattttttatgaattttttgaaattttacggggtgcttacaatttttcgccccaattttccaatctgcgcaaaaaaaattaattatgtaattaaaaagagtgttttctgaatactaataaaataatggaataatacacaaattatcgaaaaaatttatttttatttatttttctttttttttattatgatgaatgactatttttttaactaaaaagtttcggggtaaacccaactcatccaaacccaactcatccatagcacgatacgagtcgtcgccgtggcatttaatgctacgactaggaccgtacaaccaaaaaatactacgactaagaccgtacaaccaaaatatgccacggctgagaccgcataatcaaaaatgcaggngcgttctagaacatttttcggggggggggaccgacccaagacttttttttttttttttttgctatt

SEQ ID NO: 3957 - DNA, 2800 bp, Heterodera glycines
  misc_feature (2724)..(2724): n is a, c, g, or t
  misc_feature (2760)..(2760): n is a, c, g, or t
  misc_feature (2781)..(2781): n is a, c, g, or t
ctagtctaatctactcaaaccggttcagaattcaataaaaataacattcacggtgcgaaaaatggggtttgacaagtttattgggggaaaaaaagactttacaaaataatacccctgggagaagggagtgggaaacatgatttcaaaattttcaatgttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaatgttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaattttttctagtttaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaatgttttctagtctaatattctcagggcggttcagtattctttagtgatatcgttctcgaggtaaaaaatgtggtatgataggtttcttggggaagaaaagtctattcagtataatatctttgccccccccccctggatacgcccttgagaaaatgccatgccacgaccacataagcagaaaatgccatgcacgacgatgactcgcagcgttatggatgagttgggtctatggatgagttgggtttggatgagttgggggtgactcaaatacgttgtcatgaatctgcaatcagattttgcgtctttttgtgatatatcgtaacgatgctaaaaaaaagtgatagataaaaatatacaaaaattaagcgttttttatagctttcaagcgagaaagtgtgtttaaccggcggcagaggttgcattatgacgcaaaaaaaaaacgctgcgtttgcgtaaaagagaaaagcattagtatatggcaattactttggcatccgtcttataaattggcttgctgaattgtatttttcaaaaatcatatttgtaggacccaaattatagttttggccccaattagattttattttggtaaaaaacttggcaaatttgtgaacaagcaagtattgggttcaaatactcttacagcacatcctccgacttcaccgccttgccttgggttctggccatcactgggccggtaagccgggcgaatgtgcaggtcggggacttcatgatccctttcgagtggcgccacgtgcctgccaggattgatggactcttgggatgggtgaacgaagaggaggcccggatcagggaggggaacggcgctggcattatggagctggtcgccattttccagcaccgatttgtatatttttgggttcctgtgtttaattagtttaattggaaatttaagctgtacatccatccgtatcgggacgcaaatggtcgtgtcagccgtctgttcgcaaatcttttgttgattcgacgcggcctcaacaccatcagctatttgcccgccgtgcccgcccaagagacccaatattatgatgcgcttgtggccgcaagcagtcataacaatccaatgccattcattaattttgtgtcagcaatgatacaaaatcacaattggtaaatgtattgtttttgaacagaaattactttaaagcataatttaaaaaatttaaattatatttctaaaataattttgaattttgtaacagttactaaagcgggtccaatgcaaaaaacttgaaaatattgccgtcgaagatgtttattgattttgcgtagaaatgggaccgggaggttgtgatgggaagggtgcgaatttggttgagcacttccgccgcccaaaaaagtcttcaaaccaaacaatctttttcacaaaatgaggttctattgcagttttcacaaccagcaaaaaataatctgccaactattttttggtcataattcttccataaacaaaaaaaaactttttgggattttataggctaatagaaaattcttagagctatcaaatatacaactatagtcgtatacactgcattagaaccaaaaacaacaaatatttgaaatatggtaagtaatataattatataaaacttaaaatatggaaagtaatataaataaataagacacatttgttgaggcatttataatcatttaatcattctcctcctcctccatgttcttcttggtcatcggccagcaaacaattggcctcattttcggggcggacaaccagcaacagttcgttgccttgtgccaaaagtgtgttgatgtagtggacaatgccatttcatttgctgtgctgatcagtgttggggcggccaatttggagtccaaattgtaataagtgggcccaaattgtttggtggtaaactgaacatgatgcaaaaatgaagggagtaaaggtcaatttcaaatggatgtccgagcaaatttttccctttttatcgcaaaaattttttcccatcaaaatttttttttgaaaaaaattaattataaaaaacaagaaaaaatcttgcgaaaatgttttggtaaaaaaagatttatgctttagtttagggttcggaccccgtgngcggggtgacttttcgcggaggcgggggattgcggnggtcagagtcgcgggggcggngggcgagggtgagaaattt

SEQ ID NO: 3958 - DNA, 1290 bp, Heterodera glycines
tgttgataaaaatgttattttccttatttcaatttaacgttgtcgcagaattgattttgcgtagaaatgggaccgggaaggttgtgagggggagtgaaggatgcgaaatttggttgattgtgagcacgcccccctcccaaaaaaagtttccaaatcaaaaaatctttttcgcaaaatgcggttccattgcagttttcacgaccagcaggaaaataattaggcaactattttttggtcataatttttctataaaaccaaataaaatttttttttggataggctaaattaaaatagtaaataaaatgaaaaaaatcggtaaaataaagtgcgggcatatgggaccgaacccataactttattttttccgggaccaatgttctttaacattgccggttttgggtcacatgcctaaatttggcaaaaaacttacaacttcggtcactctgttcgctctttaattttgcaaatttcagactaattagcggatcaataacagctcgaacttcagactgaaaattgtaaaaaaaaattattatattattaaaaatgatcaaatgccatttattacatattcggcaataagaattttacgcgtagcaatgctggtggctttgggccgcaacaattcagccattttgcggtttcgtttatgcacttaaaaacagaagaatgaatataaaaatcggttgtatcattcgatcgccctaagtgtcctctattagtctgcaaaattccaaaaaaaattgtcaattttgaacaaacttatagccaaaaataagtgaaatcctgatttctgatgttcttttggccataaatttgttagaaattgacaaaaatttttgaaactttgcagtctaatagaggacacttagtgcaatcgaatgataccaacaagattgtatttggttaagaatgaaagaaagttatggccaaaaacgtgctggggcccaactgatagagttcgtcaaaaactactttttaatatataaaaacagaatgctaatacatgtcaaaaaagaattttaagcatgaaaaattttgtgtacactgtacaattcaacaaacagtaagtatcccattataaatgaagtaccaaaaatattttgcttaaagatattatggctgtttataagtcactcacctctcagcatttttgtagtttgtacgtgaaatataactgcttaaaagcaacaaaatataataaacgagcaacaatttttgacagatatatattataaattaagtgcatcatgactttgtatgaacgttgacaaaaggtgtgttcgtaat

SEQ ID NO: 3959 - DNA, 6706 bp, Heterodera glycines
tttttttaaattttctgtttggaattttatttttaaatttttccgggtaggggggggggtaataatgtgcacccaaattttgatactgtattattctgtaattttaaagttttttcaataaaaaatttcaggtgctttccttcactttgtcccagtggaaaatctccaagtcgaccattctgcagcccacccacaaccaccagcatctgctggttgccggcaatgagttggcgcccgactgtgtgaggcgccaaacaattttaaatttaaaaatgagaattttttttaaaattaatttcttggcgtatcgtcgttcattttatttcagatttatatgtttcacattgcctcacaattgcttgttcgcacattctcttcatctgaccagaaacaagtttatacataattagtcattaattaaaaataattaagaaatcaaaaaattaattttaatggaaattattttaataaaaaaaacaattttagcatttaaacaacataatttaagaatcccgatttgaattcaattcgctctttaaaccaatactcttttttttaaataaatttaaaaaactaataaatttttcaattttgaggaattattttgtttataataataaatactaataatattatgaatttgaaaaaattttaatgcatttaaaaatccgatttaaaaatttaaattaaatctttaattattaaaactagctctttattttttctttttttaaaaatattattagtaaatcttttaaaataattaatttccccccaaaggtcacttcgttgtgcgcatcgaaatggcgcgacggcggcgacacggttcagcaacacaaccaacaccatttctttgtcagcacatcagcagacggagcagttcgagtgtggagcttcacacaggtggaaaaatgtggaatttcataattaaatattaatttatttttaaaatttcaaatgggcaacaactaaattattaattaattggcgcataattattttgttcgtttttctgtaaaaagaaaaaaatctcaaaaagtttggctggagagaaatcctgcttctaatataggttattttaaaagccacatttgccatttacaaattgacattaaaaagaattttgccaattttcaaaattgccgagaaaattgggtgtcaaaaattgttgtttttttttgaggcttcggttgtgaatttttaaaaagtcataaaaattcaatgaattaacggatccggatgcggttttttgaattcaatgtagcataaaggcttgtctaaaatacaggcactggtgttgaacatcgaactcttgcttaaatcaggtttataacacgggaaacccggttttggccattttaacccaaaccgatccatgattttttctcgcattattttaaaattggcaacaatctttttaatgtcattttgttgtagataaatatggcttttaactaatataattagcagctttctctccagccagggtataattaattcatttctaattagttaattaactattaatatttaattaataaactaataatattttaattaattaggcgcaatgtttgaaaacgctgcacgcctgcagcgcgcgcattctgtgctccgtgctcagcagtgacgaccaatggattgcggtcggcagcgcggattcgtgtgcacgcgtgctgctgctggacagcgggcaggtgacgcgcacattcaaagagcacacaggtggaatttaaaaataaagaaaaatagttatttaattagtaattaaaattcattaaaaattaattaattaattaaattttacatatattttcaaagcaataaaattattaaattttaatttaaatattacaaagtaaaaatattgattttatataaatgttttgacttaattaattttataattattttatttaaattaaaatacaaaaataaataaaaataaaatttgcccataggccctgtggtcggtttgcaactgtcttctgacaacactcttctcgtcaccggttccggcgaatttgtcgtcatggtaaggccataattagctatacttttattattatttttttacaaatttcttaaggtttgggacattgaaaaaggcgaaattgttgtccgattacaaggtgtttattgtctagaattaaatttcactatttaattaatttaattacttcaccaattagttggctaattatccaattatactttttttcattatttagttaattaattagtggtaatttaactaagcaattgcatttttaaattcattaatcaattacattattgtttaattaattagttcattaattagttggctaattaattcattacttttttcaatcgcttttttaagggctgatggcaccggtcacttgcttggcattgacaaggtgttctaattaaattacaccccatttaaattttatttttttctccttttcaaaaattaatgatttacattttaaatttaaaattaaaaattcttttaagcaatgacgcctttctggccgttgcatgcgaggacgagacgctgcgcgtcttctctcttgtttctgcgcaagagctgcacgaactaaccgggcatgagtgagtacgcacgcaacacaatgcgtgcgcgcatattttatgcgcaaaaaatcccaatttttctagcaatttttgaaatttgatcataaaaatttccaatttaattttgtgttctatcgcaataaatgccattttttggcattctgcctctgttgcactttatcatcacattcgcatgcacctaggtcacgcatcaacgcgttggttgcgtccggcgacgactgcaagctgttcgcgggcacgcgcgggcgcgtcattgtctacgacatacacaacggccagctgctggaggtgctgcagtgcgcgctggagcgccaaccggtaggcatttattggtcgtgcagaaatttcaaaaaaaaaagttttaaaaaattttgtaggtctcctctgtgcggattagtgatgatgattcgttcgtgctggtcgcatgcggcgatcgcatgtgaaaattaaattaaattttttatctttaatatataaatttaaaatttataaaaataattttaaaagattaacgataaataatattttaaaatttaaattaattagaaaaataaaataaaagttatattaataataatattattaaaatgaattatggctaaattaaaattctgcataatttaatttaaaataataataactgttttcctaattaaatataattaattaccactaattgctttttataaaaatgatattaaaaacaatttttcatttaaaataaataaaacaaatagtattaaaatgaaaaaaattaaattaaattaaagttctattaaataacaataattattttttcctaattaataataattaccgctaattgcctctaagtcacatgtgggcgctggacagcattgagcgcgacgtcgccgcggtgcagcagcacaaaatggcggccgtgacggtggcgccgccggagtcgccgtcctccgcggaaccagcggcggcggaggcggaacaaaccgcgacggggggcggcaccgcgttgacaagcgtttcatgtgtgcaaattgcaccggacgaaaaggtggcacgcgaaagcaattaagaaattaattgatgcttgatttcatggtcgagaaatttctcgaggattatttggtgtctcggtatcgagacgcgtgggtttttctcaattttgagagtgcttttagaggaagcagctcgttccaccaccctctccctgaaattaaaaaaaacttaaacttagaaatttttcattaaaaaaatcttagaatattttttataagaaagtttgaagaaatttttttttttgacatatttgttttgaagaatgtagcagcgattcatcaataatgctgaaaaattttcaaaaaaatttttataaaaatttttctgagatttttcttgaaatttcggttaagaaacggcgacgggcggggagggggcataacgctatttacgactcttgaaaccaattattgatcacacttctgtgtgtgtgtgtttgtcagtctcgagatcaattatggtcacgagactcgattttttgaaaaagtttcaatttgatcaaaatccccgcgcgcatttcagagtgccggctgcgggacggcggatggcatcgtggcattttgggacttggacgtgtgccaatgcatgtggacaagcaatgcgcagcgcaacggtgccgtgagcgcgctgtgcttcagttccgactcctttctgttgctcagcggcagtgaacagggtgaacagcttgccaaggctgggaccaatatatctgatcactgatcaggccttgaagctttctttatgcagggattggatcgaaaatttttccaaatcagaacatcggccccaaaaatcagatttaggggtaaaaaatcagaacattttgcaaattaatgtagtatcaaatttcgtatttttggtctcccattatcgatcgatcttaaacaattttcttaaggaaattagcaaatcataaattttagtgcattcgggataaaaaaaatcagatttttaacaattttttgcggtgcgtttttccaaaaaacttttgggaagtgcgaggggggagatggtccggtggcgccggccgataggcacctccgagaaaattttgtaatttttaatgcgatttgttaacagattttgtccaaaaatgaccaaaatttgccacaaattctttattttcttgtaaaatagtgacattatgccataaaatttcaaatttctgaagaattttaagaaatcagaacaaaattgggtcactaccctccagctcaaaacatttttcagcaattttctggaaatttttttttgaaaacaattcgtaattcatcaaaatttcggaaaattgctagaaacattaaaaaaaaatttttccttgaaatttattgtgaaaaaattactaagatttaaattttctaaaatttaaaatattttttgcttagttgtgtggtcgggtctgattgtttactagacttgtccctaatcactttggtccattgggtctgatcaactcactcataggcattgtgcctgatcacctgaatggccagaccccgctttgatcattcaaactcggggactgatcagtacgcgccgataacatttttaaggtgccgtctcgttgtgggagaccaacaacggacaattgctgaagcaggtccaattgcatgccgaagcggttgtggcgttgtgcacatttgcggatgggtagaaaatttaaaatttgatttcgaaattttttgaattttgaaatttttagggttcgtgtgctgagctgcgattcgtcggacaatgcttatctgtggagtttggcatcgcttgacgaatcttctggcggaaaacggatggaagtgggcaaaagatggaaatactttaaaaatgaaactaaaaattagagaccgacctggacatggatccaggcctggatttttcctggatccaggtccaggccatttttcggcaacctggatttttcctggacttggattttcctggatttttgtccaggaaatcaaggtccaggtcaaatgtggaaaaaaaaatccaggtccaggctttttcaaaatgtcgatctctactaaaaatgtataaataaataatatttaaattaataataaaaaaatttaataaatatctaattaaaattgaaaaaagaaattatatttattcttcttttataattaatttttatttatttgaaaaaaatattaattaaacaaatgaaatatataataaaattccagaaactatctaatagcaaaataaaattaaattaacaatattttattaattaaaaaaaaattcataattcaaaaattttaaataaaaaaaatcttctaaatttcatatacaaaattgttgtaaaataaaataaaatatcaaaagaagattcaaaaatacaacgaaaatcaatttagttgaatatttgagtaattaatcgtcatgttttataacgaataatgccaattaatttaatttaattgaattgaattaattaattctttcatatttatttaaataattaaattttttaaaaagaattaaatccaaatttcaattttaacaattttcttagctgatcgcctccattgcgttcatgcatccgccactgtatgtgcgactgtcggataccgtactcatcgcgcagcatggcgccaacccgcgggagttcgttgcgatacccacaaaatctgaacaaaattcaaatgcaaattttcttttttttctccagaatgaatgtttggtcagtgtccggcgatcggctgtttacgcgatcgaaggtctttttgttttccaatgcaaaattttaccccgtagtgcgtcgacatttgcggaccaaatgtctgggttgaattttcgaataaagaaaaaaatacgaatgcattttcaataaattttaatacatcaaaattaaattaatgaaggtagctcatacaagtctacttttgcatttttttcttttttcttgatgggagagattggctagaataagatatttctaacctataattgaactgtgataaaaaaatttgctttattttataaaagtcttcaagaattttataccaaggaaagttttggtgtttcacttccatgctttggtagaccaagagcttaaatttttatc

SEQ ID NO: 3960 - DNA, 2022 bp, Heterodera glycines
ttttacacttcgaattttccagccaatgcccgtcatttctttgtgtacagaaaatttgaaaatttgcgaatttccattttttttttgatttacggactttttaccccaaattttccaattttaattgccatttttggggaatattttttttttgcccatttagtcgaaatttttaggggaaaagtagtatttgtattttctgttggaaatttttgattttgcttattggtacctcctccaaggtctacgcacctaaattttccaaacaaatttgcgctaaatttttcaaaatccacaaaaaaatttcaaaattttcccttcgccgagccccctatttcccaaaaaaattcaaaaaagcacactgcaaaaaaagagtgacatgaaaagcaaaaaaaaaaaaaaaaattatcttcgcccgagggcgtaccccctccaagccgaaattctggcacattttaaacgattttttcaaaatttattttcaacaaaataatttttccaaattttcccgggctaattgttgttgtaataggtccaccacaacgaggccatcctttgctatggcgtcaatcggtgcggcactgtgctgtgcaccggctcacaagacttgtcactgaaagtgtggcagatggacagtggcggactgcttattcaggtggtgccaacaaattttgtagcgccaaaaaattaaaaatttgcgattgtcctctgatcatctgatcaatcaattttcagtcgagagttattgggcttatttgagttgatcgtaatcgaagtgatcagagcagtttaacatttgccgaaacgcggaattgatccctttattcagggctggtattcaaggacgtccttggaatttgactctcttccttggaaataaaaaatgtccaagtaaaacatgtccttggatgccaaggacgtccttcctttactcattttcagcacgtttaaaattatggcacaaaaaagactgaaaaaactttttaatttttttttcttaaaaaattgtaaaaaaaaaaaatcagaaaaacaaacgaattatcccgaagccgagaccgtgaaagacaaagaattttcctagtcgagactcaagatttaattcatgattcgatatcagactgaaagccccggggagattctagagatttgagactgtgaacagcttgggacccgcgaaaagagactgatctatgcttatagacttgacttggagactgaaaagccggggctcttctaaacgaggccgagtttttctcccattcccgacaaaaatttttcaattttcttcgagttttttttctagttaaaggatttaaaaaattttttgagcgtcgagactttcgaacatcatcatcacccattttgtgtgttgtacaggtgctggtcggccatgaggaagtgcccagttgctgctgcgtcagcgaggacgcgctcaccgcgtgcagcggggcgcttgaccgccagctgatcatgtgggacgtgcagaccggcgctgcactgttcacgctgcgtcggccggccgtgttgcgcttcctcgagatcagcctggacagcaccgtggtgtgctcaagtaggggattttttgaaaaatttttcaattaatttttttacgattttctaggcggcgaagatggctgggtcgaggcatggcattgcaattccggccgactgttaagtgccttcaacacacacagacaggtgggacgggatgggactacggtgtggggggggggggaggacctttaaccgacggaccggattagacactgttaagtatttttctgagacaatacccttttgagtaataatattacagtattgaacataatcagttactgaataccatttggagcaatattacgatattaaaaactgttattagttcttctaatatattgtaattggagttatatacggtattagtcattatactgaatattggcaaaaattgggggacccacgcgtttcggcgccagcccagcttttaaactataacttttttctttgtcaaccaaatctaat

SEQ ID NO: 3961 - DNA, 2427 bp, Heterodera glycines
  misc_feature (2393)..(2393): n is a, c, g, or t
tttatatagaaattatttatttattttaaatatttttatgctttttttcattttttgtttatttttatgtttttaaatttaattagactttccgtttacaattttttcacaacctttacacaaaactgctttttctattatttttatatcgttttttgcgatttaattattttttggcatttttttgcaattttttatgtttaaattaataatttttcaaaatgtttttcagatttgccttcacaacacaccagccaatttgcattccacttctgccagccggtacgaacgcgtcacaatgccatcgccgtcgtcgtcgtccaaaaatcagccggaggcccaagcgagggcaccgccggcacgcggcggtgccggcggcgggtcattcgcattggaactcagtgccacaaccaccggagcagcaagtgaacaaattggggaggagagggagaagcaatagaaatggcatttttgaaatgattagaattccattcccgagtgatctgaaagttttcggcgggattagttaacggacaattgtttgggattaatataatggattctctaaagtgattaaagaaagaatgtctttcgaatgattaaaattgattaagtctgatctaaaagatttgaatgatctgaatctaatttcagacaaactgttagaattttgagtgatttgtggaattaaaactttttttattagaatgggtttccgagtgatcggaagcctttttcataaatgatcaattatatagaacacttcttggggtaattaaacagaatttttggatttcggcaatcagaaacactttggttaattaattttttgtttttaattaggctattagcaaacatttaaatcattgccccctttcaaaggcgacgacgggcccgaaccgatgggcgacagaattccgcccgcaaacggtgcagacaaagagccggtgacaagtcgggtaagcgcatgcacatatggggaaattgcaaattttcaaaaaattaaatttaaaaataaaatttttaaaataaattttggcatttttttcgcgcgcaggcgtccgaagtcgaagcgcacgcgaaccgactgcgcgcggtggcggagcaagagcagaaacggcaagcggaacaacaggcactatgccaaaaaaaaaagaatttttaatttaaaaattcaaaaaaatttcaggcgacaaattccgccatcgccgcccctgcggaacgcgacgcggcgaccgcgtcagcgaccgccgcgcagtcgccggacgccgccgcctccaccgctcaacagtcgcagaaggagcggcggacgcggcgctccaaactttgtacaataatgtgatcggtggttggtcaccgcctgggccggcgagcgacggtgcgcacgattacggtattggtgcaacagcgacgcggcccgataccgtaaccatgaaagtgatttgtacagttcatactgtgtatatttttgttatgtttcatatacggtatcttttttttatttcagtaaacgtacagaaggaactttctattttttgtttttgggaagttgttggttttaatgggaccacttcttttttgaaattattgaacagaatttatccaacaatttttaggtaaaattggttaaccgtttacggggtgaagaatttgaaaatataaataaagcgatcaccaatgtgggaaatattaaaaagcggtggaaaatgccaccataacatggtgttcaaattggcattccatgggttgtaaatgttcaattgggcatctaatttgccaattaatgtcttaattactagagtgctcagttttcagcacaaaggaatcaccgattaagcactcactgtaaacagaaccaaattttctaaaaataagcatgaaaaaagcacaaaaaaggcaaaatcagcacaaaaaaaattgaaaaaagcataaaattaagagataagttggccaattaatgcttctgcctattactaattgagttccattcattgtcctatcttctttattttattttgccaaagatcggcgcaaaggatcggtcggttttttcggaaaaaagtcgaaagcccaaaaattttgtcggttttttttgataaatattcgaataaaaaagtcgaaaaccctaaaaaaaccgaccgctctgatctcaagcttttttcaatcccaaatgatcagttcttcgatcacttttattcccccaaatgctcgtcaaaatgttctcaggctcacttcattatcatgttattttattaaaaaaaaagtttaagccaaaaaaggaaataatgaaatgttaaataacgaataaatgggacaaaaattcagcagcagtgctctcgagaccaaggccgaacttgactggattttcaattacggaaatccgtaaaccgccnttccttgggtctaaaaatgccgtaattacggaat

SEQ ID NO: 3962 - DNA, 6659 bp, Heterodera glycines
  misc_feature (48)..(48): n is a, c, g, or t
  misc_feature (56)..(56): n is a, c, g, or t
  misc_feature (79)..(79): n is a, c, g, or t
  misc_feature (137)..(137): n is a, c, g, or t
  misc_feature (142)..(142): n is a, c, g, or t
  misc_feature (192)..(192): n is a, c, g, or t
  misc_feature (6499)..(6499): n is a, c, g, or t
ttgcacacgaattcaaagtttttgttgattttttcgctatgcgttccngttctgcncatcgtaagggtaattgcgctgnttaagtatacctactttttccaccaattttctttcttatcttcgtagcggtagacctntaatntaattatttcttaatttttatgaaataaagagaactatgaaggaaaaaanaattaaattacgattgcatgtgcagccgtaccggccttaatccaatcgctttcggccgcacttacgtcgtaaacaccaaatattgttttctccgatgccgcacctccttaatgtgcaaaacaaattttgggttaagcttgaaaaaccaacctaaaaaatactgtagtgttgccgttacttgcgcaagtgtatatttttcgcgaagagaaacccaagtgtgtccatcattaaactgatcttccactatatctgactaaaattaatgaatttttaatttttcaattcaaaattttactgctaagcactcagccccatccttatttaggtgatttgccataatgtgcccggcttcgtggtgtgctactcttcggcgaacagccatctgatttagtaattattttgcattaattaaaataacattcatacatccaccaaagcaggcacagcatcttgctgagccgttgcacagaaattcaacgcacttaattaattaattttatttatcaattaataaaaatttttacacaagcagtaaaatgaagacggcgctcatttcggcgttaaatgattatcatatttgttctatccgagtaattacttatatagtgcatccaatccttaccatttgggtggtcttgtttatttagcctttctagaatgcattaatattcctctcttcttctaactttttactgcattatttagtttatttcatttttattaactcagctccctttcaataacaatttttcattaaacaaattaaattgaatccgatgactggctaacttgttggccttattatttgctttgctcttttaaaaattatttaattttttaattcattttgttataggttgaaatgatgaaaaataataataattcttactttagttttcactttattttaaataatttatattaaatatatttatttagcatctgttttaaatttctttatatttaatatttttaagtaaaatttaaccgattttcggttttttaaagcaggggaacggtaccggggctgaaaaagagcggcgttctcaaaaacatcccatgtgttccgctatgtttaaaaatccaattttttgtcattcacaactaaattttcaaaaaaatttccccaagccgcctaacggcaccaccggacccataccccccccccccaagtttcaaaagtttgaaaaaaatgtgtcacgatattgctgtcaaagttaaatatcactgaataatttttcaaccaaatacacacaaatatatttgtttacttcgcatttaactttttaaattgatttaaaattttaaaatttaaccctattaaaaatattaattctattattttttcaaaaaatttctgcttcaattagaattttttatgaaatttttttcatctttaaattctccagaaaactttctcacggaaaaagtcccgattggtcccggcccgatctcgaccagggatgggcaaaacttcgagcttcgtgctttcaaagtaataaaacaccactaatgattggcttatggtatactttaatttaaatatcattattaactttttgtttattaatcttcattacatgggtggtcagtgggttgtgcttttggatccattcctcatttttttcgttggatcagttccactccaagtagttgtttttgtttaattttcaaaaattaacatttaaaatatgacgaaattataatatttttaatatataggtccaaaatttacatcttttcaaccggcgacgcctactcccccccccccccaatttttcttaaaaataggctcaaaatcgtatttaagataatccgttactcccaatattaaaagatatgtggttaaacttatgccataaaacgtatatagttttgcatccatttggaagaactgagtttttaatttaaaatatttttattaaatgaatgtgtaaatatgtatatgtttttatttatgctggacaaggaacatagttattacctaaatttttcaataatatttttaaaaatattaattctgtggtgtgatacatttattaataggtttggaagttaaaaattattttttgcaataaattaaaaaatttgccacaaaataaaacattttgattgtttttttttgctttcttaattaaggaaacactttttaaaatatgaaaggttgataaattataaattttaaacgcaatatttgaacacgctttttatatattttttgttcctttccaataacgagccattaggaagagaaagcttttacagcccattgtttgcctacgaacagcgcaagcaatggcggcgatgtatgtgatctgatcggctctgatcagcaaatggatgccaaaaaaggtactgtggtcagagtttgatcgatctgatcggcaaaggatgaactttggaaatattttggcatttaaaattgaaaaataatgattttttatgaaaacaaaaaatttattttatatatttaaaattatgttttttcattaaatttcattattttagtttagtaaattatgatattattatatccattattatttttatttttgtatattatcgcgcaaattgaaaaaattggatcatcagaaaagaaaaaattagagcaaaaaacatttgaagaaatatttggagaaaaatgggaagaaaatgaagaaaaactacgaaatgataagaaaaaaaagaaataattatctatatatttgaaaaatttttaaaataaaagagaaaataaagcaaaaagaaaaaacattcaacaaaagaatgggataaaattgatagtaaaataacaaaaacttagagacgaatctcatttatattagaaatgattaaagaacttggtcttcaaaaacgcaaatagtacaaatcaaaaattcattgatatgacaaatgaatataagctaatgggaaagtattcgtaaaagaaaggaaccaaaattatgccgaactttgtaagaaaatcggagtaagctttggaacaatgttggggtggaagaattcaattgaatattaattcgaaaaaatagatgagaaagaaaaaatgaaaaaaattttattggacccaataaaatgatgatggtaaattggccatggaaaagggaggaaaaaaaagtaaaatgcctcttttaatgttaaatggcctaaaatgtgcaatgaatgaataaaaagttttttttgcagaaaaaatggattgggacgtaagtttttagtattatcttttaacttttcagatgaacaaaaattaatatgctttttgttatatttttttcgtaagcctatttttaattattttgtatgttactaaagcaatcagaattttaaattttagttttataggtttttaaaaattaattaatgataatgaaactttgcttttaaacagttaaagaaggctacatttatgcattttaatttttttgatttttcccatgaaaatttttatttaaaatttatgtgtttttgcgttttttgtttgtcgcaaaaaaatgatgaaacaaatactttacttaacttaattaggtattactaattttttgaaaaaatataatataatatttttaacttaattaaattgaaatatattttttttaatttttcatcaccgttgtttggtaaaatcttttatttttttcttattttgatgtttatttagtaatattatttgtaaatatataaaataattattctctgagcagtgtctttcacttgttgtttctacatttattaattaattggaatctaattttaatatttaatttttaagttaaataatttttttgcttggactttttttgtttgtttttttctaaaatttttaaaacggatttatttaaataccagtataatatttcatagataattgtattgataaaagtcaataaaacaatacagataaaaatatatcttttaataaagttaaagtaattttgaattgataaatgatgattacccatcacaaatagtacattataattattttgatgtagtttttttaaagcatatagttattgttttaaaataatatccggaataaaaatattttataataaagattgtttttttcttattgtttgtcttttccaatatatttttttaaataataaaattattttgtaaatacccgtaatgataccatataaattcataacttagctccaattctaccaaatatttcatgctatcatacaatagccttaattattcactatcagaatataaattttaaaattcataaaatttcaaaaaatcataagccagaattttttgtccaaaaaattttggaaacacaataaaatttcctgaaattttaaaggcaaatacagaattcttagagctatctaacttataaataattttggataaattgcattttaaagactaaattttaaatgtttataattatatatgcattaccattgcaaaaagcatagcatattcaatgctttataacttttttgtaattaagcaaaaaataaagaaaattatattcaaaaaaaaaacaattaattctatgaaatgatactacgaaatattaatttggttgaatttgagccaagttatgaatttatatatattacccattttttttcttcaaacccattggcggatttaggaaaagcgcatgcgtggcggtttttaggaaatgcaccagcaccacatatttgtacataaatttgacatcactgataatgaccttttttgcttttcaaatcggaattttgattcaaaagtttttgctcataagaaagttacaattttgtataaagcatgtgccaaattgatatatgaagggcgttcaaatgataccagatcgttagatttggttgaaaattaaaaaagttacagcccaatgggctggcgccaaaacgaccaagtcctctttgaacaatgacattttgtaaaatattaataaatgtttcaaatttgacacatttcactggtaaaattatattgaatttttccatccctttttaagacacttcgccaaaaataacgattaaaaattaatacaggaaatacaggcttttaaggcctgtacctgtacctgtattccaaaaatggcctgcacctgtattttctgtacaaaagtacaggaaaatacaggtacaggaaaaatccaggttgccgaaaaatggcctgtaacaaggttttattaataaattaaattaaatttataataaagtaaatcttttaaataaagttttttaatatttctccaaaacaacttttaaaaaaccataagcaaacctttccgccatttaatcaaatgcacttttatttttgtaattatgcttcttaatttataaagaaaatgggcattttaatttaagttgttctttgaatccggttgttttctctgaaatcaataaccaattatcgtgaatttaagaaaaactttttaacaaagaatcaaataaacggagtcttacattaatataaaataatggagaatcaaatatataaattatgcatgtcatattttgaaataaaagaaaaaataaaagttatcataaaataccgtacaattaaattgaaatttatattttaaagagacaaaaaatataaataattatgctattaaaattaaatgagtaattacaaaatagtaataaatgagaaaattcaaataataaattaatgattgcaaatccagctttataaataatcccatgcatcaatcacataatgaaacgagaaaaatcaggttgagaaaaaaaacttatactagtaaattgaatgttaaaaaaatttgaacaaatttggtatcattacgggtatttacaaaataattttattatttaaagaaataaaagcaaagtttcattatcattaattaatttttaaaaacctataaaactaacaatcaaaattccaaacaccaaaacaacggacgtcagaaatgcagcagccatttattcggaatttaaatctacaaaaattttgagagaaggaaaagccaaaaagatgaaaaatgacgaaaaagttggatgaacaaaaatgacggttcgctgctgcacatctgtcccaaaatcttccaatcttttcttattcattattcttcactaaattgcattttcaatttacgcaccattttccacaacatttaaatataattgaattgaacgccgggggcggcgttaagcagagagcagagaatattatgcggcgattttcgactctctttcctctccattctctctctcgctcgctcgttcatttctctttctctagtgcttccgccaccaatgttgccattttcctcacccccgcccattaactcaactgctctgatcagatttaaggngagagatttgggatttgagtcagttgttgatcacttcacctttttgatcactcaccaatttcccttggcttttctttaacttctggtcaataaagtgtagaaaaaggggggcagccttttgggggagggatgcgcctttccgcatctcaggctctgcctg

SEQ ID NO: 3963 - DNA, 856 bp, Heterodera glycines
aagaaatgggatataccaaataaatcgattggatttgttgaaaatgagacaggataaagtgattgtaatagattattcgatatgtgtagtaattgatcggagcatattatggcacatctttttatactgttcaattttaccataaatatataaagatacggtaaccttcaatatcccaaggcctgaattggtccttgaaggcaaagacattctttatggcattatttggtgcaaaatctattaataaatcgcacaaaaaatccattttttttccagcggcgcctatagacggcaccggggtggttaacgatttcgtcagtaaacgatttcgttagtgaacaatttcgtcagtgaatttcgtcagtgaacgaattcgtcagcgaatgatttcgtcagtgatgtgtttgggaataatatatcatgcagtattttaatatcagtattattaataaaggaccaataaataataatatataatttcctacgtatatataccatgcagttattcttatgaaggcattttttaaaagggcaagaactaataattttggagtatgtgttcccttgtccggggttgtccacgataattgtatcgctatctcataacaaatttcatgccttctctaaatggagatgtcagcatagtttgcattagcatatcatctatctatattacttataaacataaatgtaatatgtagagtcaatcatttgaagcactctcaacaataacgtctctggattgatttaagaagtcaaatgtagcagaggaaaaatatgcaatctctccgttggcatagagtattcattggaaaacttttcccgtctcgaggaaggaagcgagtacggaaatgcc

SEQ ID NO: 3964 - DNA, 2295 bp, Heterodera glycines
cggataatagccctaaaattgagttaacaaacaaatttaaatttgaggtgacatctgatggctctgtaccatttgcattcggacccctcggcctgttccaagtgcaaaacgccctcccatcactcctccgcccattggcattctgctcccgcggggccttccccgagttgaagtcgtaccgcgcagagattggcccgcggtgactgctccgccgcggctgccccgtccgcggcccctcggctggtgcagttcgcctcggccccgtcgacccccgcgagacggcaattccggataatcttcatcgttcgggtcgtccaacagcacacggtcatcctggtgcaaaattttgtcctcttcttcatcatcgcttggttcttctgcgtttgccattggttcgtctgcgaattgctggtgtttctccatctctttctaaacaatgatttggtcgttgtgccttttaacttttatttttcctccgatttgcctcgatcagttgcaattgtcctttgtctttggcaggttgaggctgaggccataaatttgttgtcgaaagcgaagttgcggccatctttctgttcacaataatgcgctgaattcccctttgggttggcagatgatcatcagttttttcatccatttgttcctttactatttcggtaggaaattctgtttccattttggcattgtcttcgagtggcgacgtaaatgacgaagatggcgtttttcgttttagtgatgggcgcccaacttttggtgctaaaatgaattatttttacagaaaatttcgggagggaattcgaagacttagtttttttaaatcttttttgtttataaggaattggttccttcagtgccgaaaacacctcaagaattcaaggaattgctatttgttaaacgtctaaaatatttagattaaaaaaaaattttgtttttcaaccatcaaaaagtattcatttgctcacccgtcgtcggcgcttcgttcggctccgtctccccttcggcgtgcatcttcgcccccggtttcaacacgtcccacactttgtgcgatttcattgccgccgttctgcgctgccgactcgcaatgttcaactccggcgcctgttgctcctcttgccccgaatcctcctcatccgacccttcggaagtgctcgtctttcgctttttaatattctcacgactaatccccggaggcattttctcttaatagtaatagctgaactgaaatagttaaatgataaaacattcaaatccttcaagataaagcagtgaaaagataaacttggactttgggaaaggacaaacaataaaattcaccagttttatcgaaaataaaaagcatggcaaagaaagaaacgtagtataaaataaaccattataatgtgcgctataaagcatatgctgcaaatatgtggacaacatcttataaggcggttatgcccgtaagtgtttggttggggtttctaacaaaataaaattctttcttctcaactaaaccatttgagggtatcattttgtttgtcggttgaaacggaatgagaattatcgagcagttcggtgcctggagtttgctgtttggcgctaaattgtgacatgaggggaaacccctccccagtgaaggtcgacctttgttttgggtattctgtctgcttctccttgatcctgtaaaataattttccgcaagataaaattaaaagtttgaaagtataagttttttgaactcagggaggtcgtccggggcgggtcgttcccagaattttggcttggacggtacacagccacagaagactaatatatatatatatatatccactcgaactgtaagtcggaaaatgcatgtgttatataccattggatagagcaagatcgatttctattatgaatttataatttatagaatattatacattaataaaaatttatttagttgtatggcggatgggaagcccacctacaataatggaggggtgaccgcataacacaagttacgagaagaaaatgacccaagaaatgcgtgaggaacagtataaacattgttgaatagccttatggttgtaccgatggctgattcggagctgtaatagaaaaactcgtataagcgcttgtaaagcgaaaacttttctcaggggcgttcaagtttttgtaaaaaggcattttctattgttatttcgtcgactgaggagaaaaatctaaaaatgtctgctctttcctatttgaggcgcttaaacaaaagtgcaaaaatcagaaatatgatatttcctatgatatttaaaaaaatattaggtttatatattttaa

SEQ ID NO: 3965 - DNA, 5041 bp, Heterodera glycines
atttagtaatattatacattaattaaaatttattcatttttatgttggatttgaaccccacctccaaaaatgcgaatttaaccaactgacaccaattttaagtgaaaatacagccaaaatttcgatttttgaggccctatagctttttggtttctttctatatgcccgtaaaattaaaaattcataatagaaatcgaccttgctctatccaatggtatataacaccaggtggttcccttgtcagtcttaattatttcaaacaaaaattacggataaaagagggcgggggagctgtccccggggagggtacgacatttttacctttaccttcaccctaaacaccaattaccaggctaattagtgttcttttatttatgatgttctatggcaaatgttctaattatatttcattagaatcaatgataaataaaagcaacactaattgttttacgattttgtatcccccaaatgtgtttttgtttccgttcacctgtggtatctgtagcgatgaggcgcatcgcactgtaattagagcgggacttgattactcattttgacaagtgtttagaaaggtgacccacgtcgagtggggaagggtggtggagtgacaaacaaaccataactccctgctggcagcatcccctgttgaactcttcacaaggctccatgccgtccgtgtgcttcacatgaagataagcgcattggtccttgcctttgctgcaacacatcctcaagtagtagtcgcaaacgggcatttggtgtgcttttaacgtggagtggggcccatgtgagcagttgtcatcgatgttccgacattgtccgcgcatcaaacttcaacatggaaaaagtttaaaaatagttagccaacacccgtcgcttacaatggacagacttttttagccgaatgttccgtcgactcctcgtgctcatattcacagaaaaccccattaagacaattccctgtttccaaaaattggaagcaatctttggagccctgatagacacgttgtccagttttaagaatgattagactccgattgtggtgtaaacgctttcgagtgccgggatgtcgagcgtcgacagtttctctcgtgttcggttggaggttattcttgtcgtgtacaatcggagggggaggaatggaattatcactcgccgcagaacttttcgtcgtaaatgaaacggtttgctgctgctgtatcattttggccatcaaatcagtgctgacccacacattgcttgtgcgcatgccatatcctagcctgctgctactcgaagccggcacaacttcatggtttgtgtccagtggaagtttaagtgacatcagtttcaaaagtttgtgttgttcatgctgttccttttgctccacaccattttgtgtgaacactttcttctgaatgtcagggtaagttcgtccatcttctgcctgaggccgttcgcaattcggggccaaatcctcatccctgacgagcccattgaacagcatcaatatccgccagttgcggcccatttcggggtgttcgccgtcgctgtcattgtccgtgggcaccaaacggagactttcctgtgaattttcactgcaacccgactctttgctgtttggtgattcgtcggctgcagatgaatttaggtttatcctacaatgtgttacaacaaccggcttcctggtcgacttcagtagaactttgtcccgaaagtggacgatttctgggcgctgtgtccaattcaattcgaagttctcccgaggtgctgaatctttcaaacatgtatttaattaaaattaaatccacccttcttcgttggtaatttgttcaagaaatcgctttcttgacctgctgagcggcgctccattgcctttcgatgtgaaaccattcgcatgcccagtatggaacgttttgctgaacctttccgatgtggttatttgatgtgtgccattgagcggatgacgagttggatctgacaaaacaaaagggaaatagaagtgaataggatcatgaccaataatgactacctaattttaaattgaaaaacaagacaacaaagactaatattaataggaataatcagttacagttgttaatatttgctgcgatcaaactgctgatattttgcgtaattggaggaggcggaacgcttaaattgaagaactgagggttcatatgaggatgtgcatgttgaggttgaaggtagtaagccggatgatggtgatgaggaaccggcggaaagaaaactcgctaaagaacagggatcacaaaaatcaacaccaaatgaatttacagccgaattcaaaggttgaggaagttgtggtggcggaggtgggggaatgcaaaaattcggcatgaagtggttggcgtgattgttgaacattttaaactaaccaactaaacttagattaacaaaattaggcaataacggctaaaatcaaccgcaaaattttaataataagacacaaaaacaaggcatcttttatttgttaacaatgggaagctgtgcaacttttcttgtttctcggtattcgcttcccggcactttcattatttcggaattctccggtaaaagccgttcgccgttttggctccggccaatcactactcccaattcagcttcagcgattgtgagcaaataagaagtgtgcgcctcgccatagcccaaaacacgagccaaaatgatgtcaccaggttgaacaaatttgtgcagttccacctgataatgagagtaattggagtgtgcctttgccccccgagggggtggtattaataccttatcgcgctctttatcacgtatgtcctccttgcgcaaagtcgagttaaattcgttggcgaggggtgtgtcttctacacagataattgcacattttgcaaatgttgtcgtaatacgctcaaccttttacgacatgtattcaatagaattcagagtcggaccacagaaccagtgagtttcttgtaaaaaaaactaaagtcccctcctcatatttttgttggtaaatcgatatgctaagtaatacaaaatcgaaattagaactatgtatattaaaatttcaaattcacccttgcagtgactatctttccctgtgacggcagcacattgcttctctcgtcaatgttgcgtctcacttcgacaatgtttgtctcggtgtcttgctttgaaaaaataattggaaaaatgctttacattaataggtagtaccgaatctctaagtgaataaacgtgcaaaaatcctgcaagagaagcacatattgaaccatgaaattcataacagccatttcccgcatgatatccacttgagactgaaaataattgttcacctaaagaaaagcgaatcacaactttttaaattttttacactaaccaggaacacaagttcttttctcatgacttccattaaaatctacaacagaaaatccaggcaaagagtcaagaaatgaagtcgacatttccattttgggtgggtatcgcttcctttaattgtcccataaaaaataaataagtttttaagggcccaaactcaaaattgctcagatttaaaacggcttaaaacgatgagaaaaatgcaaattaggagcgcaaaagatactattctttttagaataaatttaggccatttaagacttttttcatggttattaaagtaacgattcagtccccatcgaaggtggacacttcagtacaaatttttattgcatttttttctttattttaggccattcaaatcgattccgaacatttttgagttggaccctatgactagggctgggatttttatgtgctaaaaatcctgaaatatgtaataaaatatgtgctaaaaaaccccaaaatatgtgctaaaaaccaaaaaaaaggcctaaatatgtgttaaaaaatgcaaaaatttgtgctaaaaattgaaaaaaccaagtgtatttacgcaaaaaaaatcatatttaatatcagtctttatcaattttcgcccgaccgccagtcaaaattttggcgatatcaatcaatttgtaaagtcccggattaatttttccatcagttgaataagttccttccgggaactttgaaatccagtgacgatttaacacagcgtttgatttgcctgctttaggcatttaaatatataaagaaattttctaaatgcttaagaaacgtaaagtagtcaatttttagggtgcattttcagattttcttgtatttttcttacgatttttttcaaaaatgccaaaatatgtgctaaaaaatccaaaatagcccaaatatgtgctatatgtttttatgtgccaaaacgccaaaatatgtgtttttatgtttttataagtcgctctaaaacaaaaattgttcggagaaaatgctatttttgggcttctctcgccataactaagccgcaaaaaaaatatgttaaaacataaaaatcccagccctacctatgaccaatattttccaaaaataaaagatatggaagtttaaactttaaagtgaaaattttcagtttttaattacgcaatccgcgaccgtgggatttttctgtcctccccgctccaaactgattttttttagtttaagttttaatttttatttgaaatgacttcaataataaaattagaagcattgtccggtgttcaagatgatggtcctttgtgttacctattgcaggtatttttgcattgctttgtttttgtcgtcatttacgcatacacaagttgctttcattttgggtcgaccaagtgtattttttgctcgattgtggctgggatgagcaattcgatttggcgtacattgaagctataaaaatgcggataccgcaaataaatgctgtgcttctcagttacggagatgttccccacatcggtgctttgccttatctgttcaaaaatgggctgaattgtcccgtttatgcgacggttggtggtcatctccatatttaattcctttttagtatataaaaatcccgtatgttctcaggttcctgtttacaaaatgggccaactttttctctacgattggataaatggccatatgactggaaaggatttctcgctgttcaatttcgacgacatcgatt

SEQ ID NO: 3966 - DNA, 742 bp, Heterodera glycines
tttatgccacctgtctgacttcttttcatgatttaattgaattttaaatatttttctataatcatagatattttgtcaaatttatgattaaaagtcatcagatgttaaaataaatatcatattcgtgatcagcgaagttggaaaccccaaatacgtattttagaattttttgagggggggcgacataacccgggaagtaccggtaagtattagtaaatgataagctaattgtaaggtcattgacacggctggacgagtgcttgagattgctcatttgttggaccaactttggcaaaagtttgttttgttttgtggtactatacagtgacattcgttttggtgttaagcaaagaagcggggctgatgacctacaatttggtcatgatgagtgcagttgcatcgtccgtcattgaatcggccaagtcacaagtcgaatggatgtccgacaaaattttacgcattttcgagactggacgacacaacccttttcagtttaaacatgtcaaattctgccatacattaaccgacctgaatagagttcgctcacctaaggtacataatcagagacatcccttttatctttgatattatccatttcattaaggttgttttggtcagtgggttggacatggagagcggtttttcgagagaactctttttggagtggtgcaccgacaccaaaaacatggtaattgtctcagagtgtggcttacgagaaattttgtggttaattattactttt

SEQ ID NO: 3967 - DNA, 1365 bp, Heterodera glycines
  misc_feature (78)..(78): n is a, c, g, or t
aaaaggagagacatttaaaacgggtgcacttttgacggtctgtttttgattttaaatatgcattattaaaacgaaacncaatcaattcgttattagttatataaaatcacgatgtttacaaaagttaaatttcacaaaagaatgtttttacaaatatgggactcatataaaaaaaatgtacttaaccgaaaaatttgaaattttgctggctgttaagtcttatcttaaggtaattttatctgcaaaattaagcatttgttaattacgaactaaagaaaattgatttttcaaacttacaaatagaggatgttatatgacttcttagaaattagtgcatttttgttaaaaataatacttatttaggaattggaaggccaaatttgcttatcaccgacgcatttaactcactctatacgcaaccgaagcaaaagcagcgggacgaaaatttggtgtccaaacttctcgccacagttcgggacgggggcgacgtaatgatagtgagttggagggggtgaggggcagaaatgggacataaagtgattggaatcacattttgttaacaaggcaacattccgagctctgactaagaaattacatataaacgatataccattggatagagcagggtcgacttctagtgtgaatttttaattttagcggtgcattttgcctgcttcaaaagttagaaggcctcaaaaattgaaattttggctgtgtttttacataaaattggtggctcagttggttaaattcctaattttgggagtccgtgttcgaatccaacgtaaaaataaataaatttaattacatttttagcaaataaaaaatttagaaaatacattacagtggtggaaaaaagtcttgacccaagatgataaaatttgtagaattttaaatttcgactggaaatttagctggttattttttgtttatgtatatttatttaccccgatatatgggcctttcatataccacaaaatcatttcattccgctttatcattctcgtgaataagtctcctaatcagaccttgctcaaaaaaggggcggaaaaaagtcttgactcaaacttgaaaaactatttaatagtttacccaaaaatctgaaaaaattcctatttatataacttttgatattgatcaaaaaaggcttttacaccaacttgatcagatcactccttcatggtgatcaggaaagtcaaaaatggcttgaaattgggaaaattttagaaaaaaattcctagggggctggaaaaatttttctgaaattttttgattgggctaccagaaagagcacaaaattctctaccgaattgccttttgaatggtgggtctacgacttgtagatagaaagttatacttggattg

SEQ ID NO: 3968 - DNA, 516 bp, Heterodera glycines
ctctctgctctctctcattatctctgaaaccggtttaatcttagaatgcctttaaaccaataaatttttttagtttaccgcccaacgtaaaagagaaacttcgcgacttcaattttattccaatgacgccagcacctccaccgatggggttggtggtggggggaggcgtcaaaaattttgtagttttgggtgcacacaaattccgctgcccgttagctcggatcgggcaacctctctttccaaagacgggtataccagtttacaaggacataaggggaaagttccattaaattcaaggacatttaaaaattttgtcatatgcaatgaaaatgattaaattttacccaaatggtttatatttttcgccggaatgaagttttgattaattttgatgaccatattttacttttcacaacacttcttgcgggcgcttttcgaagactttctgggaatggggggggggggggggaaagctgtaataggtttttcataatagaaaatttttaacgctatttg

SEQ ID NO: 3969 - DNA, 1782 bp, Heterodera glycines
  misc_feature (12)..(12): n is a, c, g, or t
tgaaataaaaanaatgaatttgaagaggtaaaatcaataatgatcttatcaattagcaattaaattttaaaaaattaaaaaattatttcagaaaaataaatctttttatattcaaatcggaaacggagtgcccaaaaaagacaaaaatgatgatgaatgtgcctgagaaacatttcggaaaatgaaagatgcacatactcatgaccttgattgttaattaaatgatttttctgttctttctcgtcaatttcatagtcagatttaatggaaggggcaattaaaaataacattaaaacttttatttatttattatgcataagtaatttaatgcagaaatttatgtaaatttattatttgctaaaaatgagaattgcttaactatcattcgatcagtaattattattcaaaaagtggatgtatagtcaacaagaataattatttttattaaatataataatacaattttaatttatattaatttataatgaaaattatttaaaaagtaaaacatatttccttgattttttataaatttgtagaattaaaaaatgcaaacttattattattttttaatttgtttgtcgtgcttcttggccaacaaaattgaacggaacaattcagacgacgaagaagattattggcctaacgaaactgtagaaagctacatagacgacactgacagtgtggtaaagtaagttaattttttcgtagcaggacggttcagtgccaggacggagagaggagagagagagagtgagaatgaaagataatagtaaaaaaagagagagacaaagtgataaggagaaagagcgagagggtgaaataaggaaagagagagagagggaaagagaaaagagagagtagggaaaaaagagagagagataaaatggaaagagagagagagagaaaaagtgaaagagagagtgagaaagtcaaaaagaaaaagagagaggagagagagagaatgaaagagagtatttaaaaaagagagagacaaagtgagagggagagagataaccgaaagagagagagagagagatagaaagaatgaaagggcgaatgcgacaaaagagagagaaagagagagataaaatgaaaaaagagagagagagggaaaaagtgaaagagagagtgagaaaaaaagagagagagataaagagcgacaaaaacaaaagcgtgagagagatacagaaaaattgagggaaagagcgaatgagagcgttagagtgagacaaagtgagaggaagatcgaattcagcaaaactagactgactgttgagacaatgcgatgaaaactttcttttttggggtaattgggggatgggttaaaagcgggcacatcaggggaattaagaaaacaaaagaaaatgaatgagaaaaaatacgcgaaaaatgatgaattttgggttttctcattccaatctttttcttaatataaatatttgttcttttcttgtgtttataaattccctaatctctaagctttctagtgataccaataattgatggtcatttttttatattggactaattaaaagtgaatttttagattatgaattttcgacttttttcgagtccagatacgacaaatcgaaacgcatgttatattcgtgatcatcaacccagaaaatcccacaagacattaaaggcgtgataacaccttactatgaccgaagtttcatataatttagcacaaattttggttgaaaagcaccaaattggggggaggcaattaaaaggaaggaaaaaggcgaaatggaaggaagatgattatgatgaatt

SEQ ID NO: 3970 - DNA, 5441 bp, Heterodera glycines
gggtaaaattaaaattattatttaataattgataacaattgaagggaaatgagagggatataatattagatataaatttattaaattattatgagtgaaaaaataaaataatagaaaaaattgttattttaaattcaaaattggttaacaggaaaaaagctaaattcatataacaatgtaaatgcataaacaaacaaatgaagttccataaaaaacaacttaattaggtaattaagaagataaaattttaaaaattggacagtattaaaaaactatatcataatttctgcttcactgaacaaaaaataccttcttattaattgaaaatttggatatttttaaactaaaacctcaaagcaaaaatttcaacatatctcttaagattttgctcaaattttccgcttccgtttataaaataaccaacaaaactctcatggagagacgatatctgtcccatatgccgccgcacccataaaacattgagtcagttggctctagaaatattcaaataaagacaaaatgccgaaaattatggacatcacgatatttggtgcctcccatccggtgagcctctacatttgcgccccgaactaattttgggatttcattgaaataaaaaatgaatttgaagaggtaaaatcaataatgatcttatcaattagcaattaaattttaaaaaatttaaaattaatttcagaaaaagaaatctttttatattcaaatcggaaacggagtgcccaaaaaagacaaaaatgatgatgaatgtgcctgagaaacatttcggaacaaaagggataggttgtggcacagatgaacggcataaatgtgaaaaatgtgacggacgacggaaagagcaacagaatggaaatggtcggtggacacgacacttttgaattggaaaacccgaccgtgtgtcagtctgctcatcagcagggaaaggtttcgctagcatatataaatccgttctctgctcatcactcataaagcaaatgcacataatggcgccagagggacaaaagagaaaagaaaaaaaatatgagatttttaggaagggatgaagagagaaaatttcatggatttttaaaaaatttagtaatttataaagaaacaaacagttttataacagatttaattgttcgtcatctcgattctcgctgttccttattttgcgttgtgtcagttcctctccacacctccaaatagttgtttttttttctaatttgcaaaattattttcttttttacttgtaaattttgaaatttataaggtaaatggcatttctaaaaagaattaatttaaatttgatgaaaaagttgatcatttttgaacgaaaatgaaagatgcacatactcatgaccttgattgttaattaaatgatttttctgttctttctcgtcaatttcatagtcagatttaatggaaggggcaattaaaaataacattaaaacttttatttatttattatgcataagtaatttaatgcagaaatttatgtaaatttattatttgctaaaaatgagaattgcttaactatcattcgatcagtaattattattcaaaaagtggatgtatagtcaacaagaataattatttttattaaatataataatacaattttaatttatattaatttataatgaaaattatttaaaaagtaaaacatatttccttgattttttataaatttgtagaattaaaaaatgcaaacttattattattttttaatttgtttgtcgtgcttcttggccaacaaaattgaacggaacaattcagacgacgaagaagattattggcctaacgaaactgtagaaagctacatagacgacactgacagtgtggtaaagtgagttaattttttcgtagcaggacggttcagtgccagaaaggagagaggagagagagagtgagaatgaaagataatagtaaaaaaagagagagacaaagtgataaggagaaagagcgagagggtgaaataaggaaagagagagagagggaaagagaaaagagagagtagggaaaaaagagagagagataaaatggaaagagagagagagagaaaaagtgaaagagagagtgagaaagtcagaaagaaaaagagagaggagagagagagaatgaaagaatgaaagggcgaatgcgacaaaagagagagaaagagagagataaaatgaaaaaagagagagagggaaaaagtgaaagagagagtgagaaaaaaaagagagagagagataaagagcgacaaaaacaaaagcgtgagagagatacagaaaaattgagggaaagagcgaatgagagagttagacaaagagagaggaagagatagagaaaggagaagagataacagagagatagaaagagagcgggataaaaacgaaatagagagggaaagagtgaaagagcgacagggtgagataaggaaagagagagagagggaaagagaaaagatagaatagaaaaactctctgatctttctcattatctctgaaaccggtttaatcttagaatgcctttaaaccaataaatttttttagtttaccgccaaacgtaaaagagaaacttcgcgacttcaattttattccaatgacgccagcacctccaccgatggggttggtagtggggggggcgtcaaaaattttgtagttttgggtgcacacaaattccgctgcccgttagctcggatcgtgcaacctctctttccaaggacgggtataccagtttacaaggacataaggggaaagttccattaaattcaaggacatttaaaaattttgtcatatgcaatgaaaatgattaaattttacccaaatggtttatatttttcgccggaatgaagttttgattaattttgatgaccatattttacttttcacaacacttcttgcgggcgcttttcgacgactttctgggaatggggggggggggaaactgtaataggtttttcataattgataatttttaacgctttttgggtgtctttggaatcaaatcattgcccaaaagcgattagagaattttgtatttatattttgcaatttaagaagaatttttttcaccgttggagttatggttgccatttccattctctttggaattattatttttctgatatacaaaaaaaggaacaccaacggcacgcataccgaagcgccagcagatgaatttgaaatggaaactttagtctgatatcaatttttcgagatattttacttgatgaaattgctttgtctttttcagcattaatattcaaataaagcgaaacaaaatagaaaaaatcaggatgaagaaagcacagtaccaggcttttcacggtttctacttcaagcaaatttctcgtatcagtccattgcgcaccgctaagcgaaaaaacccgttctacaaatgcattggagactgggatggcgaacactttgctaatgagcacatacaaattcggaagttgagcctaaaaaaatttaaaaaaataattctaactaaaaattgccattcaccctaaaaattcgcttccatttctcttcaattgaaattccaagaaaagaactgtatcgaaatatggccaaaaaattgaaaaaaaacaaaaaatcaatttggccgagattaatcaggatgaagaaagcagtgaccgaacatagtgagcaccttgtcttccgcgttgtgttcgtctcccgccttgggttcaaccacagaaaaatcggtgagtgcagagcagcaataggcgctgaagagacggagcagtgcggacacaatgcaggaagtggcattggccaacgactcggcacaatttgccgagaagagcatgtcaatggcagcgaccaaatccaacggttgggtattgttgatgaaggtggtgatcattcttgaacaaaataaatttgtttcatttaacaatgaaagtaagaaaattaaaaaaccccgaagggtacggcgattttttcaatgtttcgcaaaaagtgccaattatttcggcattcattgtcggataggccggaaacgatcttaaaatggcaaaaattattcaatttaaagttcgatctgttgatatttgcagccataatttctttcaaaaggaatccttgtcgagtattttgaaaaaatagtgaaattttaaacaaattgtatagccaaaacccgaaatattcatagataccgaagtgagtcccgtctgaaccatttccgtcttaataattaagagccgattttgtctcaaatattattggaccatttttagagttcaagtgccaaggcggggggtcaatgtaattactattttgactttatttaaaatatttttcattaatcattcgctgatggggtggacgggattcaaaaaaacaatttgaattttataggagcaaaaattaatttaaaagcgattaattctgggccaaaaaacgcgcaccaattggcacatcgcggacgcgaaatcgtcgcagccgtacattttcagcgcgaagtcccacgagggtattttgccctcattatgcgcaattgcttcgggcgtcagcagatcaaggaacactttctgcagaatctcttcgctggtgttgtgcgctacgcaagtgaactccaaccggcgcggctcttccggagtgccgcgcgaccaactgaacgtgaaaattgaacaaatcattggccggtggaataaatgccaatttatgatcacttttgacactgatcagttaaaacagtggaaggatatatagacactaatggaaatttggacgctggaaaattggacaatattggatataaaaattaaaaataaataaacaaaaattttggtttggctaaaatatttttattttaatctgcacatacttatgtttttataagcgtattattaatccatttatcctacacaaatttatttttcaacttaattccaggatttattttaggaatttggtgtccgattttccggtgtccaattttcctttggtgtccaaaattccggctgtgtccaattttctagtgtccaatttaccgatccccagcagctcaatttgctcgaagccttcatatcatagcagctcagaattctgtgcgcggctgttctgtttgctctccgtttcttcaaaaattgaaatgctaataagcagcccaaattaatgattatattaaagtgtcaactgagtgattttgttgagcctaagtgatcgcaatcatttttgaaggatgggataacagaaaagtgtttctttggaccatggtccaatccagacactttttcgtagtgttaaattttagaaaatatgagtttcctcaaatatttaattctcagctcgggaatgcttaattggctatgcattatatttactaaaatttgcataatcgccacgtggatttttgtctctattcacactatcattatgttttcaaatttttttatggaaaaacattgacaaaagcttactagcctgcctgtatgaaaaaaataatcattt

SEQ ID NO: 3971 - DNA, 1190 bp, Heterodera glycines
gaacgacaaaaaagtatcttagaaattttgaatttagtagcacgaataaaaattctacaaatttactattaataaatattaataaaaaataattctaaattcattaaacatgatctagtccagtagctgcgagttaattaaaaataatatttctatttatacaataaattgacaaaaaaatatttaaaataataatttttcaaaaaaaaataaaaatgagaaatttaataaaataatttaataaaaatataacatcatgttttaaaggttacacgctgataattacttacaaatttgtagaaatttaatactttggcaaatattaaaagaagaaaataaaatatttatctgaaaatttaagagggattttaattttgcataaaagaaaagttacataattattaagtgccttaaagataaaacaagatcccagcgatcaggacttacttgtcatgtgtaagaaggtttacgacgtgaaatgaaaatgcgctttagaaaataaaaggtttacaaattctcggaaagcaaaaataatatattatttgaatgatattaattatgtaaaaaaaaatactgagaatatttgaaaaattgtatctataaacagcagacgtataaacgaattaaaagataattaaaataaaattacaaaatgtgaagatatatttgatattataataaatactccagacggatacacgagtctattttattgattggcaaggcaaggaaaaaaattcaatttattttgttttaccaaacaatcggttttcatatattaataaatattaataaaaaataattctaaattcattaaacatgatctagtccagtagctgcgagttgctttaaaataatatttctatttatacaataaattgacaaaaaaatatttaaaataataattaaaaaaaaataaaaatgagaaatttaataaaataatttaataaaaatataacatcatgttttaaaggttacacgctgattaaataacataaatcttcaaataaatatacacaccaatcagcatatatcgccttacactaatatagccatttaattaatttatcaaaacaaaaattttgtccccccaacatggaacagtaaaaaataatttgaataactggaatacaatgactgaagaggaataaaaaagttatgtgtgaaaataattttattcttgaaataat

SEQ ID NO: 3972 - DNA, 1937 bp, Heterodera glycines
ttccgtgcctacctggtgcctatcgatatctgcgagaaattttatgaaatttaatgcgatttggtaacagattttgtctaaaattgaccaaatgacgcagtttttgactcaatttctacaggattattaagaaaagccgcgccgccgggaaaatttcacaaattttgaatgaaatttgcgatgaaaaatgagttaactttaatttaatttatttaaaaatatttggcattctgtcttagaaaaattttcaaaaaaatcaataaaatcccgcataatcccgcacaaaaaatcaaatttgcggatcccgctgcgggattggaactcaaaattctttgcgggacgggatcccgcgggattaatcccgcaaatcccgcattttccaaaaaatgcgggattgcggactgggatcccgcaaaatcccgcgcgggatcccgtcccgcgccgggctctattttggtcacttcgtgggtttttactcttttggacatttcgtggcttggacaattcgtggcttggatatttcgtgggggcgccggtgcagagaaaagcctagtactatctcgtcgtttctctttttctttgtaatttctcccactttggcgtactatctctcatttaatggcttttttgcagtgttaattttgatcagtgttcggtctttgaaccggctatatgacatttcgccaactgacatttcgccaactcagccaaaatcagacattttgccaactgacatctcaccaactttacatctcgccaactgacatctcgccaacctgacgttttgccaactcagccaaaaacattcatttcgccaactcagccaaaatctgacgtttcgccaactaatttcgccaactagtcgaaaattgaattttaactatataatgatattaaatttattataaaagtgcttcaagcaaagaaatcttcataaaatatataaaatatcaataaaaaaacaataatatgaaaatgtttaaaatcaattttcatcggcctcagtttcttcaccactctctgaatttccacggacgtgaagtccctccgcaaagccttgcatcacgatcccgagcaggtgcaaggcgtttgtcaatccttcttccgattcaaagtcggcctcgtcaaggatccgcaccacattttgttctttgatgacgtaccgttgtcgtcgtttagtgcttttctggagctgttctgcgcgtccgatgtccaactgtttgttgatgtccttcgtgaatgcagcaatgaagtcgctcaatgatggatgatggttgagctcacgctgaaaataccaaaaaataatgttttccgatgaaattttttactgcaaattgtccatgcgcggcttccatgccgttgttcgttcgctcaattgccatttgagccctggtgtatacattccaaaacgagatcgggaaacgtggaggacagacgatgtcttgttcccagcgtggaataagctgcaagctgctttcttctgacaatggaatggttggagttgaaggttgtggcgaatgcagtccgaattgtattggtccactgcctgtcattatggatgcctgggaaatactgaacgctaaaattgaaaaatttcataaatttcatgacagaataggtgcatttacgagttgtgcttcgagtgcacgcagaagaaagtgtccgacatcagcatgcggttcaaatgcctccgccccgcgatcaatctcgaattgagtggtgccaatgtaggttttggcaaaatacgccagccatccttgaactccaagcggtgccacgctgacaatagttgaaaaagcgcgccgaacgtaaagtggcggaatgagtgccaaagagagaacagatctgattttgaaaaaacaaataaatacacataagctaatgaaagacacctgaatgttttgtgaacggatttcctttgaaccggtgcttcgttg

SEQ ID NO: 3973 - DNA, 2839 bp, Heterodera glycines
  misc_feature (2775)..(2775): n is a, c, g, or t
ttttaaaattattttatttttatttaatttatttgcaaagctcatctttgtctgtgtcccaacgctgcaagttgccggtgattgatcatctgttgacgagtcttcgtcaatcacaacgcgcaccagcttaaaaaaaattttttttaatttcaaaaaaatttaaaaaaaaattgtgcatttcattcgtatttttcacttctgacttccccccccctcccgatcgatccgttaaatttatacttacacgtttgttttcggtggacgtgaaattggaatgcgactcgcgcaaaacggacgaaggtagacttgccttgctatggctgaaaatcaggacgacatcagattgtccagtcctcatattacggctgtcataaatgaggacggactcatcattcttcattaaaagacctgacggaatttgtatgttcagtgggtcggcacagttgacaccaccaacgatttgttctttgttctaaatattgtatcattattttctctgaattttttctacctgttcgtcatttggtcgagcgcttcattggtgccgagcaattctaagacttcatcgtcaatgtcagtccgaatttgtgcacggagttgacatggtttcgtttttggcttctccttgatcaggcgcttcatctgatttcgtttcgtctctgcatcaaaacgcgatggtgcacaaccatggtgatgttcttttgggcccaaaatgcctgtcaccaaaccgttgtcttccaattttgctgtcgcaggacaattacgctgttcgcacctaaaccagctgccatcttttctgattttcagaaagcgaaagcctgaaaaataaataaataaataatcaaaaaactattaacaccttggtgccaaagacaaagcgctccccggattgtttcgccacgttggaattgaacaggctcacagttttcttcatcatcgcttgcagcgacgtccaaatcattcctggttgaagtgtcttccatttgttgttctgcgtctgtcctctcagcattcagtacgctgtcttcatttgttggaattcggggtcttttaattggcttttgcagactctcaagtatttcgcgtacagttggcatttcttgctagaatctgaattacgctagaaacgaaattataaaaaagtgaaaggaattcttaagctttgattgatccaaaaatggttggaatgaacaaatatgaaaaaagttagtacataagaaatgatgatggtcactgattggacgtgtaaactggaatagggctgtatttgatattaacacagcattttttttactctttttactttttttctttaatttttttaactatttggcgaaatgtcagttggcgaaatgtcagattttggcttagtaggcgaaatgaatgtttttggctgagttggcgaaatgaatgtttttggttgagttggcgaaatgaatgtttttggctgagttggcaaaatgtcagttggcgagatgtcagttggcgagatgtcaagttggcgaaatgtcggtacacctttcgtcactaaacttttcgtcactgaaataaaataaataatttttaaaggaaaaaattagaattttaaagttatatacctacatatctaattatttgaaaaaatatcagtctaataggtatttaactttctgattcgtaggccgattaatttattttagaaatgggaataacctttaaccctcccccgttgtttttatggttatttgtgggttacttcaaaactagggttgggcccccaccccgaaccccgacatttttggccatttttcggggttaaccccgacccgaactccgacgcttccaaccattctttgcataatttgttaacaaattaaacccaaattttcaaaaacttttcctttcgttgaaatttaaaaccaattttgcatgactaaataaatcatgaaaattaataatatttcaagaaatttttgacaaaatatcgaagtaaaacaaaaatttatcggaaattcataaattttttagtaaaaatatcttagaaaatagagcttaaatttcaaaattcacccggcggcgcctatcggcatcgccggcctcccaaaaacccaaaatttttcctaaaaattagctccaaaatcacaaaatgtggacaatttttggacaaaattcttttaacaaatttactcatttcaaaaattttcccggcggcacctatcggcaccgccggactacatcccccacccctcttgtaaaatttttgagcctcggttttcgttttccgaattctgaaaatttttggggcctcggaatgcatgttataaaatgccaaagtggatgcactttttttaaaagagttagttgttaaaaaaattaaattttttttattacttcaaatgctcatattttaaaaaattatattcaaataggctgtatttcatgcggttttagatttcgattaaattatattattcttaaattgtatgtttattatatttatataaaattttttattttagcttttttattagttatttaaaattcattaaataatttattttgtaataataatatattttctcgtttctttgacggagcgctttcgtctaccatttgcaagtttttacaaattattttaaatgctatttaaataattgttattttctcagttagaatttgcatcaaataagcggtactttctgcgcttgattaaattttgttatttcttttacatgattatgcttataattttctatttaaattatttcttatttatgggttttagtgtatttatgnttgaaattaattattttactctcatgttccgtagcccctgtgatgaaaaaagaattttcgattt

SEQ ID NO: 3974 - DNA, 3580 bp, Heterodera glycines
ataataaatcaatagggtcttacataaataaaggaagacacaataattagagagtggggaaaatggagaggaaaagaaatagacacatgcaaagggaaaatgaatgcatttgtgtacttttatctcggggttgaccacccgaacaatcagccataacttgcttcattccccactaaactgaacaaatttggtatctaaaaaagtttttgaaaaccagaattttatcaaaatggatgcctcccgattcgagatcaaccttaaatattaccaataaaaagatcgatttggaatgtcatttttcttttgaaaccttatcgtaatggtccaatcgattaatttctccctttttgctcagataataaatcctattgttgcatttttgcttataaaaaggaagaaactgacccgaataaatttaccaagtgtatgacattgtgctcaaactcaaagaaaagcgacacgaagtcaactcgctgttttatggttgattgtcttagaggttttaatgtttagttttccttaatacactaactcaaaaatgaattcaggaagactgtcgagaaaaaggaagaaactgaagttcaacagtccgattgagcccaatctggaagtgattgtatgcacattagttgagcggactactagtggaagcgaaaatccaagcgagaaatttatcaagtcgagcagcagcgtaagaaaaagtgaaaactcatttgtgtaattcttttactgtttagaactgaatcaatatggcgaaaaacaatatcaacattaaccgtggcgttcaagaccctttttatcgttacaaaatgcctcgcattttggcaaaagttgaaggcaagggcaacggaataaagactgttattgcgaacatgcccgaaattgcaaaggcactgtcccgtccaccgacctgtatgttaaagaaactggttcccctgtatagtatgagtcgtgttgctttcccttgaccacaatttttctgaccaatttaagcctctcgatctaaaccaataatataggcattacaaacaaacaaaaaaagttcgggtcaaaagcgttagttgaataaactcccaaggagtgaagttaagactatgcatttaatgcgtttagatccgacaaaatattttggctgtgagctgggagcgcagactaactttgacctgaagaatgagcgttatattgtcaatggggaacacgatgccaacaaactccaggatattttagacggatttatcagaaaatttgtgctttgtccgagctgtgacaacccggagactgtgctggtatgtatatttactaggcaaaacatataatttttgtttagaccgtaaagcgtcaagtgatcaatggaaagtgtaaggcttgtggacacgcttttattgtggatccaaaacagaagctgtcgacattcattctgaaaaatccaccgcctcctgacaacatagagagcgaaaaggaagtgaaaagcgacggcggattgccagctgaggagagtaacgatgtaccagtagtcgacaactcgggtggctgtgatgccgggtcgaacggcgaagatgacgaggattgggcgcctgaacccgttgaagacgaggaaaaactttcgggacaaatcggcaaattggtcattgacaaggacttggacaaatctgtggatgagcgccttgacttgttgcatcagttcttcctcaaggcggtcaagaacaacacgattcaggtatagtctaccataattatacaaataaataaaattgtataactttcttaattaactatttaataataaaattcgtttaggacagcaagatgatgttaaacgaagctgaacgtctggaacttaaatcgaaggcaccgctgttgctggccgatgttttgttcgacaccaatgtcatcactcagatcaaacaacatcgcaatctgctgctccgcttttgcttgaaggacgagaaggctagttcttgttcaaaggagcttaattaaaccatttctccaattttaggcgcagcgcatccttttgggaggcattgaacaacttgtgcaaaacaacaaggacattctcatgtcgaagactgcccacatcataaaagcgctttatgacaacgacatttgcgaggaggacgtcattttagcttgggggagcaaggcgagtcttttctttgttgggctatattttttagtaattgttaattgagtgtaaaaatgatcttcgtatttagccgagcaagaaatttgcggataaggaagtggtgaaagagatgatcaaagttgcccagcccgtgcttaaatggctcaaggaggcggaagaagggtcggacgagtcggaggacgacgatttggacgttgcatttgacgatcgaagccgcaacattgggatgacagtggaggtggaaaagggagcaaaggatggggtcacccgtgtacagaacggccaaattgcaaccaatggcaaaatggacgatgggaatgcagacgacattgacattgacaatatctgattgtgagtggcatggcgcggtggacggtaattcagtgatgttgcaagaatttgtgatcgtatgccgaagactttcacccaccccttttgttcattgcgataccaccacatttttgttcgcttttatcgtaaatgtttttttttaatttactcgcatcggattttttcgaaattagatggggttttttcttgatttgatgataatttcatgacaaatatttttgctagtgatttaatttatttactttaatttgctttcataaatttgtttgtgctataagcatccattaaagtgatgcctttgtcgacattcgttcaaatgcttcgcaaatactgctgctgcaaggggacttcttcgatggattacgcaagattagttaccgacggcggacaaacggacgaatacacagcggcgaataggtgatttggtggcaatggtaaaggcgtgatagattgaattggtttatattttcatgaagcaatggcgcaactgcctttagtggaagtttacggcccgggatttcagagagcggctcagttggccattcccggagcagggaggaggaagaggaggagttgatgaacaaaatcctggacagaacccagcaagtgggtgtttttttaaatttgtctattaaaatttgggtcaaacttcggctcaagtacagtttatgcgtccaatcgacttttatgcgtccaatcaatttttatgcgtccaatcaatttttttgtctaatttcagtgcatttacaattttccgtcattgactaatctatttttacaaaatttctcaatagttcaaactatacggggtaatttaatctcatttcttccaaaatatgctgaaatatttttgcgtttccgtggtatcttctgaacatgtactgaaacaaatatgtcggcagcatttcctcatttgaaccacgtaagtgtcggtcagcagtaatatagctagtcgaaacatagcaaccggagtttgaagaatggagaaaaaatgccggctggctgctttttgccaacgaacggagagaaaaagcggctagtattggtttttgccgacaaatgggagagagaaaggccggctgt

SEQ ID NO: 3975 - DNA, 2030 bp, Heterodera glycines
aaatgtgatcacggaatagtcattgtaactgaagaaatattaaaatgctttaatataaacaaaaaatgtttgaaattactaaatctgaaggtccttaaatcggattttgttgggcagcggacggtcggggaacggaaattccacaaaagtgccgtcgatccgcacagataatttcggctttgggtcctttgtccttgtcaattctgatcattctccaaattgccaattcgctttttccatcaaaatgtttgtccaccaaaacatcgaaacggtcggaaagcaatgccattttgaggccgagttgaggacggtcaaaagatgggagaatgtccatccacacgtcgctacaaagccaactgaaacatggaaaaaattgcatggaaaatgaaaatttgtaatttttaaaaattttccttaccgtctgttcattttttgctgcaattttagagcacacttttcctttcaataagtactgaattaggtaataattgtcctgcaaataaaaaagtcacaaaaaaagacacaaaaagcacgaaaaatatacgcgtagatggagtgaaaaactccatatttttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgcttcataattctcgagcttccgtctcatcgatttcctaaaaaagaagagaagcgatttcagaatacgcgcagatggagtgaaaaactccatatttttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgcttcataattctcgagcttccgtctcatcgatttcctaaaaaagaagagaagcgatttcagaatacgcgcagatggagtgaaaaactccatatttttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgcttcataattctcgagcttccctctcatcgatttcctaaaaaagaagagaagcgatttcagaatacgcgcagatggagtgaaaaactccatatttttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgcttcataattctcgagcttccctctcatcgatttcctaaaaaagaagagaagcgatttcagaatacgcgcagatggagtgaaaaactccatatttttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgcttcataattctcgagcttccctctcatcgatttcctaaaaaagaagagaagcgatttcagaatacgcgcagatggagtgaaaaactccatattcttcgcgttacattataaaaagcgtctgtctctctgcttttaaggttgaatcggcccatttatgcatggggttatataaacgaggaacgaaatgtgcaatgatatataaaattagtactgaaatatcgaattcaatttaatattatac

SEQ ID NO: 3976 - DNA, 1354 bp, Heterodera glycines
cggcccatttatgcatggggttatataaaacgaggaccgaaatgtgcaatgatatataaaattagtactgaaatatcgaattcaattaattattatacaaaattgctggtcattacgcttcataattctcgagcttccctctcatcgatttcctaaaaaagaagagaagcgatttcagaatacgcgcagatggagtgaaaaactccatatttttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgcttcataattctcgagcttccctctcatcgatttcctaaaaaagaagagaagcgatttcagaatacgcgcagatggagtgaaaaactccatattcttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgcttcataattctcgagcttccctctcatcgatttcctaaaaaagaagagaagcgatttcagaatacgcgcagatggagtgaaaaactccatattcttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgctttataattctcgagcttccctctcatcgatttcctaaaaaagaagagaagcgatttcagaatacgcgcagatggagtgaaaaactccatatttttcgcgttacattataaaaagcgtctgtctctctgcttttaaggttgaatcggcccatttatgcatggggttatataaaacgaggaacgaaatgtgcaatgatatataaaattagtactgaaataaaaattagtactgaaatatcgaattcaattaattattatacaaaattgctggtcattacgcttcataattctcgagcttccctctcatcgatttcctaaaaaagaagagaagtgatttcagaatacgcgcagatggaatgaaaaactccatattcttcgcgttacattataaaaagcgtctgtctctctaatgttaaggttgaatcggcccatttatgcatggggttatat

SEQ ID NO: 3977 - DNA, 2528 bp, Heterodera glycines
  misc_feature (75)..(75): n is a, c, g, or t
gacctttccaaaaacataatgaaaataaacaagcctatgattttttaaatgctttgcaatcatagaaaaatgttngattattattgtttacttaataaagtacatagaaattgaaaaactcaccatagaagagttaatctgttatagaaaaaaattgagaaattattagtgaaattaagatttctcttaacagggtaggcgaaaaggactgcaatttgttaaaaatattaatacagtttagttccccgtttttagcatagtcgtttagatgtgatcccagtgcaattaagaaagtaggtatgaaagcttgggaaaattttgttgtttaaaacagagcaaatagagcggtgtgcgaggaaatgcttatcgtttaaagtgggtattgaagaaaaatcgacaaaaaatttaatgagctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttaaccggaaataatgaaaggtgtgtgcttgatcagactttatcttctctatttgttactatcgattgcttatagaaaattgcataagatttatacaattaataaaattacaaaaaaaaattgtttatttaattgaccttttccaaaacataatgaaaataaacaagcctatgattttttaaatgctttgcaatcatagaaaaatgtttgattattattgtttacttaataaagtacatagaaattgaaaaactcaccatagaagagttaatctgttatagaagaaaattgagaaattattagtgaaattaagatttctcttaacagggtaggcgaaaagggcggcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgagctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttaaccggaaataatgaaaggtgtgtgtttgatcagcacttatcttctctatttgttacactatcgattgcttatagaaaattgcataagatttatacaattaataaaattacaaaaaaaaattgtttatttaattgaccttttccaaaacataatgaaaataaacaagcctatgattttttaaatgctttgcaatcatagaaaaatgtttgattattattgtttacttaataaagtacatagaaattgaaaaactcaccatagaagagttaatctgttatagaagaaaattgagaaattattagtgaaattaagatttctcttaacagggtaggcgaaaagggcggcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgagctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttaaccggaaataatgaaaggtgtgtgcttgatcagactttatcttctctatttgttactatcgattgcttatagaaaattgcataagatttatacaattaataaaattacaaaaaaaaattgtttatttaattgaccttttccaaaacataatgaaaataaacaagcctatgattttttaaatgctttgcaatcatagaaaaatgtttgataattattgtttacttaataaagtacatagaaattgaaaaactcaccatagaagagataatctgttatagaagaaaattgagaaattattagtgaaattaagatttctcttaacagggtaggcgaaaaggactgcaatttgttaaaaatattaatacagtttagttccccgtttttagcatagtcgtttagatgtgatcccagtgcaattaagaaagtaggtattaatgcttgggaaaattttgttgtttaaaacagagcaaatagagcggtgtgcgaggaaatgcttatcgtttaaagtgggtattgaagaaaatcgacaaaaaatttaatgcgctccaattgca

SEQ ID NO: 3978 - DNA, 5455 bp, Heterodera glycines
agaggtacaacagtgattagaagaggtacaacagtgattagaagaggtacaacagtgattagaagaggtacaacagtgaatgaaagaggtacaacagttattagagaggtacaacagtgattagaagaggtacatcagtgattaaaagtggtacaaaagtaaatggaagaggtacaacagtgattagaagaggtacaacagtgattagaagaggtacaacagtgatagaagaggtacaacagtgaattgaagaggtacaacagttattagagaggtacaacagtgattagaagaggtacaacagtgattagaagaggtacaacagtgattagaagaggtacaacagtgaattgaagaggtacaacagttattagagaggtacaacagtgattagaagaggtacatcagtgattaaaagtggtacaacagtgattagaagaggtacaaaattgttagaagaggtacaaaagtgattagaagaggtacaactgtgagtagaagtggtacaacattgttaggagaggtacaatattgtttaaaattaaataaataaggaaacgtttttattaaaagttaaaaatagagtgcattttaatttaaaaattttttaataataaaatactcttttattaattaaaaacaaccttggaaattattaattgaatatttatttaatttgaaattaaatgaatttttttttacaaattcaaaaataaataatgaaattctttaatttaaaaaaaataaatttaaataatttaaaagaaatcttcaaaaattaattaaaaacattgtaaaataagccaaaaatacaaagaaaaataatgttacaccgtccggattcgaacctgctgccccccccctcagaacatgtcccagaatccccaatcacacagggattctgagggcttaacgatgtcaaacgtaaaatctgatcacgtattcgtgatcagcggcccaaatattttgaacattataaaaccaaataaacctcataaaattctcccgattttttgctatttttaaagctttaattcacttaaattgagcagtccttcattgagttatgaattttcaaattttaacccaaatttccaaggaccaaaaaaattaaaaatattttcgaatttttaaaaaattccaaaaaatctgaaacttaaaataaacatcatatttgtgctcaggaccctaatttaccccagaaaaatatttttgacccccattttcaacccaaaaaaaaatttcgaaaatttctagggggcctagctcgaaaatttttgaaaatttccggcaatatggcacaccattcgatagagcttaaaaaactctacaattttgccctaaggagttttttcgataaaaccaacccctaacgagttatggacccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctagctcgaaaaattttcaaaattttcgaaattttaaaacttggttggatagcctttcaaatactacacatttttgctcagaaacaatttttcggtcaaagcaacccctggcgagttattcgcctggtactgaagtgtacattttgagcacacttcagttagccaagcgtgcaggccagggggtggctctaataaaaaaataaaaaataccagcatgtagaggacagttgtggggagtgccctcacagcgggcactttttgattcgggttttagaaaaaaagttaggggccctaaactgcaagaaaaagtgagaaatcggtccccgggactcagtcgtccgcgctgaatttttctctatagttttcccggatgctcctcaaaaagttgtaagacccttccactactttcagacccgtcccattagccgttaagctcaaattagtttttgaaacgaaactccttgtcaatataacgtatatattaactccgccgccacgccatggagttcgaatgtgcgaactttcttcatgacaaacgcctgctccacacaggagtatctttccccctcataaacgaacggcgaaaagaagaagttactaaatggatcgttcgatccttgaaatgccattaggtaatggccatcagttagcgaaatcttcttcatatctcccagatcaaaattaacgaacgccgcagcgtatgacatttgtgcttagtaaaagaaacgattaattagaaaaatatgttcacttttttttttttaaccataaaaatagtatctgagctgacacaggagtgaggtaagtgatcagtttcaagagtatgattataatatttattagataatgattgatgagttcctcagaactgataaaagagagataagcaataaacagtcccgcgggacttattgtttaacaaatttaaaaattacgaaagcctgtccaatttctgttggcattttcaagctgaaacgacttctcgagaccggtccacatacttaaaatacagtatgattaaaagaaaagaaaaatgattgaatttggctatcccaggtgattagtcctcagaaaagttaccaaaatgcttctttttcctgggattttcacggagattatgttttgagcaaagatttctatttagttctttttcttttacctgattattggactgtgaagagggtgagggattaggggtgagtgcaggtgcgttttctattaatactgtgttatcagagatattttgataggaatcatgagaatagccaggtacattggtctgttctcttgattctaattcctttagtgcttgttcttcatctttttgaagatttttcgtggtgcaagggggtcctgagtactcaaaatactttttaatttgattaatgtgtacaattcttgggtttgtttgaggagatgtgcagctgacgattgtgataaggacaccattaatctcaatgactcgataaagtcccttccagggtaattgaaatttcttggatgttttgacttttcctgcgtaattgcgtaataggaccctatctcctatttggacggtctgatttcgtactaacttgtcatattgtacttttgaccgtaactgagcttctttaatgaccgccgcagcggattcccaagcttttctaagagacttaactaatttctgctttacattgtcaacctcagtgatattttcgggttcggtgttgggattcaaaatttgctcaatgcaaaatattgggtctcgcccaaagaccaaaaagaagggggtctcctttgtggaagagtgaattgatgtgttatagcagaagttggcacattcaagaaattcatcaaaatctggttcttcacttgaaatatatttcgcaagtatattgtgaaatgtcctaaaagatcgctcaactactgcattgccttggctccaatggggaatagcataacatttattaatatagagaagcgaacagaaggacttaaaaaaatcagaggtaaatgccgtggcattatcagttaaaagactcgtacagcctccaaactttaaatagcagtgtttaaaaaatgctagtgctattgtttgagatttagcatcagggacaggtacagagattacatatttggtaaatgtgcaaattatgttaaggatatgtttgttacctttctgcgtgaggggaagaggacctgccaaatcaagtgcaatttgagcgaagagagtattttttggtggcatttgcatttctgcacgatatgaaggattgggtgaatgtcttagttgacatgtgatgcattgtctggtccaattggttatatcacggtgcatcatcggccaataaaactttctacatttccctaatgtctttttgatattcatgtgaccaccatttatttgtgaagtatgaaaagcttcaaaaattagtggtcgaagagaaagcggaatgtacattcgagcattttgatctggtaagtgttggtataatatgcctgaggaaagactcaaattttccgctcttgatgcaatatcttccttttcaacttctgtggtcccctcagggaatgaaccaaaatttacaaattcaattaatttcctaacctcagaatcgtcattttgttctttccgaacatcaatggcgaatgtttttccttctatatcacgagcagtgatggttaaaagagaatgctcatgaaccattcttggcttcatattcagcgcaagacagacgggaaaatttgctatgtcttccaattcagccaaatctctaatggcaatctcttgggttctttcatgtgggtaccgtgacaaaccgtcagctaaaagattctgcttccccgctacatgaattattttaatattgtaattctgtaactcaattaaccaacgcgcaaggtgtggatgcgcttctgcctttttaagtaggaaggcgaggggtttatgatcacaatgtaattcaatttctgtcagaaaaatatagggtttgaaatttcgcagagcaaaaattattgctcccaattccgcttgtacagcaggccatttgcgttcagatgctgacagcgttctgctgcaataagcaataacttcatatgcttccgccaactcattccactgcatgagtgccccaccttggccaacattagaggcatctgtgaatatgtgaaagggtttatcataattgggaaacaccaatattggtttctcactcaaaattctttttacttcattgaaggccgcagcctgttctgtaccccactcgaaattgctctcctttttagttagtctggtcaatggttctacgattgtagaaaaattagggacatgtttacgaaagaatgaagccattcctactacgtgtttcacttctcgaatggtttttgggtctggaagatttttaattatttccactttgcttagactaggagtgtagccaacagcattgactaagtatccgagaaaattcatggtcgccgcagcgaatgtgcatttcttagggcttaattttaagttgaatctcctaaatctttcaaagacacttctcaaagcattgagatgctcaccaaaattatcatcccttgtgtataccaatatatcatcgacatatgcgattacacaatcgtccaaacctgtgaggacatgcgccatgcatctggcaaacgcactggttgcatttcttagaccaaaaggaagattaaccatctggaaaattttattttcagtaattaagccacattttctggaagccctttctgttagtcttatttggaggtatccacttgacaggtccaaacttgaatagtaacggcaattacctattcgttccataattgtttccaatctaggaagtggataatggtcccggacagtcacttcggtaagtttacggaagtcgatacat

SEQ ID NO: 3979 - DNA, 3230 bp, Heterodera glycines
  misc_feature (20)..(20): n is a, c, g, or t
ctcgactctcgtgctggacncaaaagggatgctttcgtcggtccgccggtccgtggggggaagtgaactcccgccgttctcgcatgcttctgccaccgtccatcagatcaaaattgccataaaacatcaaagaaattggggaaatgatctgtaaaaatccaaatttatgggacgaatggacgtgaaagagagaaggggttgatgcgcgtggattgatctcccccgagtagccgaatggaaataatgattcgtttggctgggaggggcgacttaaatgtccggggggggggaggctcgcctcctcctgctccgccccctcccctgtcgctcgcttttgacttccccgcgagcgattggctgtcttttttgtgtctgcccaccagggacgtagggaaattgtctccctctctccatttcggctctctggcccccgttaatgaattagcagcgcagatcgcccccaaaatgacaacggtcaatgggggaggggcaaacaaaggtgagatgcgatgtcggggtgtccaaagcaggcggcaaaaaaggctaatgatggtgaagtacaagtaaatggcacaaatgatgagggagaatgctccctctgaaaaattgttcggatctcctttggcagtcgtttgtggcgtttcagtcagtcgttgaggcccaagtgccacgaaatctgtcccggttgtaacgcttattttttctccattagtccatcgatcaaacgtggcgggggagatctctcccctcgaatcttttgcttcagtctttccgatcagtattacaagcagaattgtggccatcagagcccggtagagacgaaaatgggggttaaatttgataaaaaggaaaagtgccacaaatccgatcgctgctgctcccgctgccattagcatccattgccaactgctgagaaggtttagcagcgggaatgggtcaatctgccagtcgggaaaattaaaggtgatcccgggctcaattttccctccgctcgaatcccgccgatgaaatccaaattgctgctccttagggaggaagatcagctctccctttaaccgaaaagtcgtggtgccagcggggcacttcactttgcattccgtgaatatttctgcacggtcgaagggaatcgcctcccttgttgagtcatttccgccgcagtgaagggcaaacagtgtcccatcagcgcacttgactttggccaaagcagtgccgtgatccgtgcggcatgttgcgttgaatgttgcgcccgatgtgcatctgtagcacccactgagtgtgggtgaggacacccaacattttgtattgctgtactcgctgatcagctccaggccattgagttggatatgtacctgaacgggtgaatactgaaattcagctcggatcgaagagccgtgattgtgaaggtgcaatcgtgccacgtccaatggcaatcgttgttccgggttgttcaacacccgtccaatgtcgaggtctctgcagtgacagtgtaccgtgccattgtcgtgatcgggggcgcatttttggcacgccccaatggagagttggcatttgtcgaaaccccgtgctgtctcttcgtcggggcagtgcaggtctgacggcatgggtctccccatggccacagctcgtccatcggtgacgaaatgtgctgaaagtgccggcattggcgggagagaggtgggtatgactgagatggtcatgtttccccacggctccgatactcccgggtgtagtgtcagtcgttgtgagtcaatttggccgttgttggtttccaattccacccaagcgctgatctgcatgtcccattcgagacacgtgaactcctcgaagactgtggtcgttgttggcaccgcagcccatcggtagaagaggcatgaagccgagggcagcccacacgaattctgccaaaaactggtgctgcgcatacagaatgaatgccccggccgatgattgagggcaataagttcgggaatcgtctcccggttgcgaatggcactgcatgtgtttccgcgacacgatcctgccgatgggcatcgcttcacggctgtcgttgagatggagtaggaacgcagccaactttccgtttttggcacacacatcatcgtgattgaggcgaggcgaagtcggacggctccgagcagctcgtcctgttgggttcgaatgacgaatgagttcgtctgatccgatggcagtagtgctagcactgtcgccgctgttcccgcgcatttcagtccttccgccgatcttgagcagtcctccgatcgaaccattacggagatgggcttggtagccattgtggtgccgaagacgatcagaagagggagaagtgaagccgccgctactcccgtcctggccccatggccccgttcgggatgctgccatgcctgggccattgctcgagctcttctgccgagttgtagtcgccgctgtaactcccgtatttctgcccgcgcaacttttgctccctttcgcattttgccctcgattcattccgctgttggttgtgggagccgtcgtccggttgcccaattgatgaatttgacggggtagctgactcccaaggcaattgctcgggagaaaagcgttgctcccgaccagaatcgggagaccaatgagcaacagcagccgaaaacggctagcacaagtgccgccccaaaaccgaagagggtggatgcccaccgcgggtggcacgttgggttggcgagctgctcccaacagaaggagcagttgatgagttcacattcctctctcgctgggcaccgctgagtgacattgaaaggggggcccaacccccaccaacactgaccgctgcatgagtagccatgaatcagtatctcagccggtagttcgtagctgatcattgtcgctgttggcacagttgcccagcatccgtccgggcagcaaatttcgactttctctagccgctgaccgctgctggtcttcacgccgcgtttcgtgcattccatgtggcacggcagcatcgtcgtgcgcatgtccgggtccgattgttccgacggtggtagcgatgggggtgggttgacacccccatgccaaagttgggcagataagtgccatcattaccgccaaggtgaccagggggaatttgctctcccttttttcgaccttccgatgctcaggtgaccaaattctccgtggcttgcgattccgctgtgattttcgtcgttcacctccctgccctgctcaacccctccgacaatttgttcgttccgctg

SEQ ID NO: 3980 - DNA, 3667 bp, Heterodera glycines
gagtctggcaaacgctgccagtcgaacgcttaaaacgaggcccatcagctccattctggggattgtgaacgtccccgaagccttctttggcttaagtcgggatttggccatgatgagacgggagagaatgctcccgtccactccttctgatcggagatatgctgcagcggcatatgcgttttccgatgcgtcggtgaacacgtgcagctggcaagattcggccccgtccgctcgggcgactctggggatagtgatgaattccccgtcccaacttgccataattctgttccattctcgcgcatcgtccgcgtccagcggggcatcccagctgtgtgtggactcccacaatcgttggaagaattgcttggctgggagagttgccggcgcaagcagtcccagtgggtcaaacagtcgggcaatagtcttcagcaccgcccgccttgaactgtggcctccggcaccggcgggagtcactcccggaaagaccatccgaattgagtctttctccgcgtcccattcgagtcccagcatcttcgccgtcgttttgcccagggcgtccgcctctgaaaagctgctgttcaggttttgatcatttgtcaggaactcgcgcaggttcattttcgcttccgtgaacattcgtttggcttcccgagccttttgcgatgcttcttcgactgtgtccgccggtatgagcacattgtcgacgtatgtgtccctgatgagctgctccgcaaaatccgagccgtacttgcgtaggtggtgccgcaccaccgcagccaagcagaacgggctgggcgttaagccgaacgccaatcgccgaaatcggtagggcaccaaatttgccgtcgttagcggcccgagtgggtcgcgcacccacaaaaacttgcacacttctcgatcggcttcttcgattccaaccatcagaaatgctttctccacatcggcaatcacgggcacttggcatgcccgaaaacggataagcattccggccaggtccggcagccaaaccggccctctcaacaaacaatcgttgagggaagggactcccttggcgtgtgcactcgcatcgtagacgactctcagcttcttcggcgtgatcaccgcttgatgagggatgaaatattcgcattttcccgtgccgatcgttgcttcctcaatcacgcccattcgggactgctcttcgatcacttgctggtactgcttgaggatttccggtgtcctctgaagccgttgcagcagcccgatcagccttcgataggccacagcgtagttgttagggagttcggggtgctcctccctccatggtaaacgaatattgtaccgcccgtcgtcttgctgtcgcactgactgctcaaattggatgatcgccgcactgtccgcgtcctgtgttgggtcgtctcgaattccgatcgcttcgactgaccaaaattgctcgatcgccttgaccgatggcatttgatcccgttcgtcttccccgcatggcggaattgcgaagactgatgagtcgggaggaactcccgtggacacttgaaattgttctccgcagatcactgtgccgaatactgtgtcgatcagataagtgccttcgtcggtcttccggaatgctcgcacgaaatcccaaaaacgtcgaattccgatcagcagctgcggttgaactgtgtccgttgtcgttctaatctgctcgggagccactcccgggagcacaaattccgtcttgatgggagtacagatggtcgggacttccgacaactcgatgctctcccattcgccatccgtccgcttgattttggctttgtatctccccgatggcactttcactttcttcccgccaaagacttgaatggtgagcgtttcgctttcggacttctcaagacccagctgtctgatgagttccgtgtccacataatccccgtgactggcggggtcgagcagcagggtggtctgacattcacccttttcatcatccgccgctaccaccacctggcaaatcatcaaatatgccgggagttgctgaccgactgtcgtgaaggtccttggttcttggtgcggggagggactctcccctctgccttccattcctgaattggcggcgaatgttcgctcctctgtcggctccattctttgaatgaccatggtcctgtttgcccgcggctcttccgctttcgcctgaatttgaggttcatcctttttccctccttcccaacaaatcagccaatgatggtctggtcgctggcactttcggcaaggatgcgctcgggtgcactgcgaagccgtgtggtccgaccccaagcacttcaggcaccggcgttgctcgatcagtctccgccgtttggcttgggccgacccatatttgatgcagcggctcggctggtggcctgcttgtccacacagcgagcaaccactcccgccttgtcccattcgtcgtgattccgtttggcgggagttgctcccgggcggtagaaaacccgatcgcggaggtgtgtgcacactcccatgatttccggcccccaccgtaccatgtcgttcgggagggttctcccttatcatgaatgctcgattgaatccttgtcccgtccgtgcatttcgtccgcctcggtctgcctctgatcgctgctcatgtcggcgttcgggttccttcattgctgcgagcgccgattgggcggccctcatgcatttgacttgtgccgcgactgcttttcggaactccctcaccgtccatttcgctcccatcatgctctcccgaatcctcagctcagtcaggatgctcactgggagtttggcttccaacagcggaccgaatgactcgtcgtccacgttggctcccagctgctcgagttggcacactcccctctcgaactcgtcgatcattgccgtcagactggccacgttgtctttagctggtggcaaatgcagcagctgagcacgaattgctcgttgcaaatcgttggtgtcgccgaatcgctccttcagcagttgtaccacaactgggtaatttccatccgacggtgggtacacctccaccgctcttcgcgccggcgatccttcttttaggcaccgcagcagatgaagctgcttttcgaatcccgggattggtttgtcgtccaccgcccgttggaagtaggcccaaaaggtggtccaatcctccggtttcccggaaaacgtcggtggctgcaatcgaaccgtttcgaaagtcgtcaatgtgtctgctcgagtttccgaacgatggtgatgtgagggagctgctccctgagttcggaggcgttcccgactgggatgctcctcccttcgaatacgggcatgatgggatgcccgagggaatgcttgtccctggtcattgagcgtaagtcgctcaaatcgttgctgctcggcttgcagcggttgctgagcttgtggctgctgttgcgccgggggttcgttctctccccctcggttccttgccatccattccctgaccgggttgttcacccgaacactggccactgatggggtatttgagcggcgttggatgagcgcagccatgtttggcatgacgggtgcggccacccggttggcttgttcgaatctttgtggcgcttggacaacttgtccagcctggaaccgcgcctaggcatccctgaacgatgtctcccactctggcatgcttcgtcttgccatggtgcgtgggagc

SEQ ID NO: 3981 - DNA, 2051 bp, Heterodera glycines
  misc_feature (145)..(145): n is a, c, g, or t
  misc_feature (197)..(197): n is a, c, g, or t
cctcggtgtcgactgatctgcttcgatcgggagatgctctgctccctttcttcgtctcaaaatgtttgcctcatcgcctgcagatcacggaaaaggctcagcgcaaattggagcagtcggcaggagttggatgctcccgcagtgncagatacttcgtcgaaggctggcaagggggcggccacgaaatcatacaaganatcctgccgctcctcgggtgccgcacccgctttctgctattcccttatcgaaatgcccttcaaaaatccgagtgacctgtccaagtccccgttccattgccatcagccgcgcggcgtgctcgggcgcttcgcccctcgtgaaatccgagtccatcagctcccgcgcttctgcgattcgcgacgagagtgtgtcagccgctctctcaatccgatctcgggccgacctcaccgtcattgctccgctgcgcaaattcttcgatgccgcgggtgtaacacccgtttggcttgtccccaggccttgcgcgtccatccctttctttgttttggtctgctgcgccgcattcgctcgttccccgtcctgtcggtcggaggggagatccccctgatttccgttcccgtttgccgcttcctcatcgagcggttcgttgttccgttccattttcgtttcgctctggttagtccgaggtgtagcgggaggtgctcccggttgctggtccttgttcgtggcagaaggccccctgctaacggcaccaactttgtttgccgttagcacaattcgtttgttgtgttggtcctcgtcgaccgattgtgttgttggtcctcggcgaccgaagtgttgttgcttggttccccctgctaacggcaccaactttgtttgccgttagcacaaatcgatgtgcttgttggtcctcggcgaccacaactcgttgctgttccttgatgtgcagtgggaggtgccccctgctaacggcaccaactttgtttgtggcaaaaactctctgccgatttggccgggagtttctcccttccttctgctccaatccactcctcaaaattcggtctcttttctctctctctctctctcttcgctgccgttcggtcccttcccaagggggtggaatggagagaagggtgggaggcaaacaagaagtgggctgttgtttgaataacggcaccaccgactcaatttgggggagaagccggtgctcccaggttcaactgcctaagtccgagcactcctgtcagcacttccggcgtgccaactcctgtccgatcgttgcgctcgggagtttcactcccgttttccctctcgctgtccgattcgctgtccaatcactgggggtgattggaaaaggagagaggtggggttcgagtgggcactcctgagagttggagtcccgtttgacttgctgaatcgctccgaaatgcccaggcaaaggggccggagaagaaggtgagttgcgaatcgggagtcggctcccttttgaccacccgcccaaattgatgaacacaaatgacagaaaaatagtttattaacggagcgctcaaacttgggtaattaaaccgtgggaggggggtgggcaaaaaagtgacaaacggcaaaaatgaggagtaaaagtggatgccgtgattgagtggtgaggtgagagattaagaccaaaaggaacaattttttctccctggaggggagtgagacataaaaatgaacgaatgaatgatgtgacggacaaattagtgatgaaaaaggggggggatggtgattggtaaatattttcagtagtgacccctgtacttttgtcgccccttttggcgctaaattcaaatttgaattttcgcgtcgatactcggtgggtggagggacgcttgctggggacgtggattgtgccatagggagaggagggattgtaaatcaattaaattgagtaaagacagaaacgggtttattcctcggcatataaaaatattaacatttaattaattaaatttttatttagcattagaatgattatgttttttcactttgtcctcttagaaggctactcggcaaaaacgcattgtgtcaaacaggtttat

SEQ ID NO: 3982 - DNA, 4696 bp, Heterodera glycines
  misc_feature (16)..(16): n is a, c, g, or t
  misc_feature (560)..(560): n is a, c, g, or t
caaaataattaaattntgtttttataataaatatacataattgattttccttttattattttttggacaaactctgttacagatctatccaaattttcaaaaaaatgtttaaaatagtgagaaaacgccaaaatagtgaaatacagtttcatatgcatattgtattttcgtaaaaatgatgacctaaaatcttaaaattcagttttgccactttttgacagtcaaataaattttcgtttttcatacatccgtaggccctaagaatttctgaaaaaaataattatcatactttttaccattttatcatatcaaagcataacaccaattacataattgatagtgaatttgtgggcaagaaaaaagtaaaataagtacaacatacaaccgcatatacatacatatacaataatagtgaaatggcaatatttcgggatcacaaacactttgcatcaattaattaattaattccatcattcactttattctgattccgagccctcggcgcatgggaatcgtcgagaagtctgaaaaaaggacaaaaaattgaaacgaaaatctgnggcgctatttgcaaagagcaaaccttttgaaattttttttcactttttttggtcaattttttttttgtttttttatgcagaatttgtttttttaacatggaacgtattgcatactatttaataaactgaaaaaaacattttaaaagaaaatttagcgctagttaaaaattcacaaattttgagttttatcaaaaaccaaaggggggaccctattgttttgcaaaatttttttgagataaaaaatcgtgatattttttattcgccataattatgctgttaatacttaatattcatcattatgagtcaaaaaaacaaaaattatgcaaaagtaaaaaaaatttcaaaaacggccacttttaaagtagcgccaaaatgtcgatctctaatctgtagcagttaaaaaatggcatcaactcacttcgcattcggtctgttcagatgttgtatttacacaatcggatgatgagttcagttcaaagagcgcatgtttcacaaagcgtccaaccgttttgttctcatatttgggacgtttgtcggcgtcttcgaattttttcaattttcccatatattctttaattcgcttctaaagtactttcaattttcttcatgaaaataataaagacaatatagaaaacttgccagttctgctgacagatcggcatcttcatttgggtcaagacctttgcatcgcaagagaacccaataaagtgaatttattgaaaataatgaagccaactcaattcgtgctttttctaacagagaaagctgaaaaaatacaaatggaggatagcagaccgaagtttattataattagcagggctgcaaaaaacatgcaaatgcatatttttttcctggcttctccatgctctaaatagcagaaaaacactttcttttttatgtttgagtataaaaatcgggacttttatttgcatatttttgcatatttcgggatttttgtgcatatttgcatatttaggggttttcctgcatatttcatgcatattttgacattttttgtacatattttcagattttttgcatattttgccattttttggaaaatttgttaaaaaaaatcaataaaacggaaacccctaagaatcggccctaaaaaattcagaaaaatacacccctaagaatcgaccgaaaatttttaaaaacaccactaagcattggaaattttctcaaaaattcttcccccaaatttttttttttcatgagaaaatgtttgatttaaaaaatgtcaatatttgctaaagaggattttataaaagaaatgtagcagctcattggcaagtgcactatttcacgaagcgggtcaactccgtcccgccaactccgtcccgccaactccgtcccagccaactccgtcccgccaactccgtcccaggccaactccgtcccgagccaactccgtcccaggccaactccgtcccgagccaactccgtcccagccaactccgtcccgccaactccgtcccaatacaaaaaaggccaactccgtcccaagcaaaaattcaagaatttttttaaaaataaatttgagtttaacaaaattttatgaatgggaaacaaaaaatgataaattttggctttattagttcttaagtttttctatttgaatctgacgcttgtacaagaactcgtacgaaaaatattttgtcgcttttaggtggaggcgggatttatcgtttttggctgagacgggattttgtcgggacgggattttgtcgtttttaggtggaggcgggattttgtcgggacgggattttgtcgtttttaggtggaggcgggattttgtcgtttttggctgaggcgggattttgtcggggcgggattttgtccgcgcgcaaattttgcattttttattttcaaatcccaaaataagcacgtaatgctgaaataagcacaaatcttagaaataagcatattttaggtttctaagatccggcccctcaaagtaagcacaaatcttagaaataagcacacttgggagccctgaaaataaaagttgtcattgtttaaaagtttttctttcacaaattaggaacttgcataaatcaaaaactaaatcggtcattgaaatcaagacttatgaattgttcataaactcaaatttattttaaaaaaattcttgaatttttgcttgggacgcatttttcgtgcatattttttgcagccctgccaattatcaattatgtagcttttctcattttttttctcgccaaattattggcattttcattttcaccaccggtactcaaacatacgctaatgttttcatataaaaatataaaactgcacttttttaaagattatgtacatataattttttggtaatttcaaatttttaatgagaaattgctgtttacaatttaccttctctaaaataagcaaattttttgctctctcattttttctaattgttctctctgttttaagttaacaacaaattttttgccttttgtgacacacaaattaattaattggaaaaagggaaaagcgtgctaattgaaccacaaaatgaatcgacggtaatgaattttaaaaattataaaattttcattttcccccatccatttttttcatgtttcagttggatttgtggcgacgtgtggatggacattctcccatcttttgaccgtcctcaactcggcctcaaaatggcattgctttccgaccgtttcgatgttttggtggacaaacatttcgacagaaaaagcgaattgacaatttggaaagcaatcgaaattcgcaaggacaaaggaccaaaagcgaaactgtctgtacagatcgatgacaaatttgtggattttcctctgccggaccattcgctgccaaacaaaatccgttttcgtttccttcggattgagtaaatcaaaaaatatacagaaaaccaattaatatggttggtcgtcgtcttcatttttcccccttttcagctacattgaccattctgtgctcacatttctccgttccaacaagccaatttgggacagaatgggcaccaccaaattggaagtgtttgtggatgcaattgatacggatgtccaaccgatttgggatgtttttatccgtcaaatttggcctatttttgcaaaaagcattcgccatttgagcttcgaagatggcaatcatttggacaatttgcgtcgccgcatttcaccgacacttctcactgatcttgatcaattgatttcaatcgattccggttatctgtgccccgatggaattgctgatgatgggccaaatggaattgctggtcaagcgttgaccaaatggcttcacactccgacaaaaaatgggcaaccgaagcaattacatcgctataattgttttggtccacagaatctcgaatgggtcaacaacttcaaagaggtggccggccatattttttttaatctctttgtttgggtcaatatggcaactcgtacaaaaaaaaattttctaagaattttcaactaaaacttagtatttatgaaaaacatgaaaattgcgaaaaggtcgaaattatgaagttttttcttaataaaattttttccaggctagaaaatcatttcattttttgtaaggctaatagagcatatgaagagctttcgaatgataccaacaatcttggatttggatgccaaagaaaaaagttatagcgaaaaacataaaaatttttaaaatctgcccacagataacacacaagtacctttttttgtacgagttgccatgaaaccttttgttttacaaattttgtttagacatttcgccgtgccaccacttcggtcagttaccatattcaactgttttttcttgtggaaccaatgccaattgaaccatttgaattggtgaatgaacggacgaatgaaaagctgacactgaaacaggagatcgacgaattcgacttaaatgcgtataattggctgttgcaacggtgcccaattggggagacggcgacggcgccagcaattaaatggaaagacagcgtaaatccgagtgccaatttgaacaatgtcacttttgatctgtggagtttcgataaatccattgggtgagcagcagccgatagcgtttgattttgccgaaaaataaaatatttaattaattttaggcctttgtcgccaccaacggaagaagaaaaagaagaa

SEQ ID NO: 3983 - DNA, 2575 bp, Heterodera glycines
agtttcgataaatccattgggggaccaccagcaataccatttgattttccgaaaaaataaatatttaattaatttaggcccatgtcgccaccaacggaagaagaaaagaagaaacggatcaaagcaacggaaatgtcgtctgattaagtgtacgggaatgaataattaaataattctatttgagaaatgaatgatctcaatttgttgtgcttattttctctcagaaatgcttttgttaattcttttgtttcaattatataaaccattgttgatttttttgttgggaaatttctttagtatcaatagaaacgattgtctagagattcagttatagtaacattgaaaagtctaccacaaaagtgatatgagttcaaagagcaaacaattagcatcaatcaacccaattatcaaaaatcaataatgatcggccatttctcaagtgatcactttttcttccgctgatcaatgtgcccgggagtcgagaaaatggcatcataaagacagaagtagactccgttcaaacggtccaatttctcgtctttcttctgctgtttctgaaccaccgccgccgtctccccaacaattgggcaccgtttcaacagccaacgaaaagttccacccttaatcagtgtcagcttctcatttgtcacttcgttcatcaattcaaatggcgcaattggcattggtttcacacgaaaaataattcgaacagtgtaactggccgaagaggtggcacggtgaaatgtctaaacaaaattgggaaaaacaaaaaaatttgagaaaaatggcgagacacctctttgaaattgttgatccaatcaatttttggtggatccaaataatcactgcaaacaatctcttcggttgaccatcagttgtcggagtgtgcaaccatttggtcaatgattggccagaagtttgattttgaattggtcgcaatcagtgagaattgtaggggaaaccaaacgacgcaaattatccaaatcatcgccatcggcaaagctcaaatggcgaatgcttgtcgcaaaaattggccaaatgtgacgggcaaaaacatcccaagtttcggtcatatataaaggcacatacaaatccaatttggtaatttgaaggatgatcagaattggcaaggacgaagtaccaaaagcaaacgataatggaccagaacagaaaatgtctttactaatcgatggcaatgtatcgattggtggcaattttgtggattttccacccttaatcagtgtctgctcgtcaaaatcaagcgttcatcaattcaaatggcgcaattggtcgtcgtttaacgaaaaataattcgaacagtgtaactggccgaagaggtggcacggtgaaatgtctaaacaaaattgggaaaaacaaaaacaatttgagaaaaatggcgagacacctctttgaagttattgatccaatcaatcaaggacgaagtaccaaaagcaaacgataatggaccagaacagaaaatgtctttactaatcgatggcaatgtatcgattggtggcaattttgtggattttccgttgtctgctcgtcaaaatcaaggacaattaaatcaattagtcgtcgtttaatgaaaatatggctgatcagtgatcacctctcggaaattgttgagccattcgagatttggtgggcccacataagcacggaaacgcaatcgctttggttgaccatctttgctcggcgtgtgcaaccatttggacagaatttgattgtcaatcgtgccggagcacataagagcgaaatcgatcgaatacaactgatcaagatcagtgagaattgtcggtgaagtgcggcgacgcaaattgtccaaagcatcgccactggtaaagcccagtgcacacttcagatttttgttgtttttttaatatgggttcaatcccatatgcccacactttattttaccgtttttttcatttaatttactattttaattactaaatctgttaacaaattacactaaaattttcaaaattttccccagcggcgcctatcggcaccgccgggcccacccaagttccccaagttttctgaaaaaatgcgccgcaaaaaaattgtttaaaatctgatttatttaaccctataaatgatgggagaatgtccttgatcattttggttttcattgggaccatgtgcgataacaagccttcgtattgcctgatcattaagcggcggattgactacactgtgctcgcatttctccgttccaacaagccaatttgggacagaatgggcaccaaattggaattgtggccatacagaaccgagaaagatcagtcaatttgggatgtttttgtccgtgaaatttggaaggaattgccgatgccaccacttctgtcactgaaacaggagaaaccgcgaaaattcggatgccattttgaacaatatccaatttattttttggggcggcagtaattgtatttggtgagcagatcaattggtaccaagaaattctcacttaaaaaagaagcaaataaatttacataaattttgtatattcgaattagggaacggattaaaaggtttttgcttattttttctgcggctttaactcgacgag

SEQ ID NO: 3984 - DNA, 1992 bp, Heterodera glycines
cttatcaaaatgtacggtttgccttccgaccatcgttcagcgtggtaccaaggcttatagtccaattcattgaaccttaatatttaaacaattttaaaaataatagagatcgacattttgaaaaaagcctggacctggattccatgttggagctggaccttgatttcctggacaaaatccaggaaaatccaggtccaggaaaaatccaggctccttgagatctggatccaggcctggacctggattttttgaaattattttaaaaatcaaaaaaaaaatgtttgaaaaaattaattatttgcttagaagcatctaaaaatatctaattaataataataataataatgtgtttttaaatttatttaatctgtttttgaaaacttgaaaaaacatcggtcacttgaaaaaataaattctaaaattttgtccaggaaaatccaggttttttcctgttttgcctggacctggatttttttcacatttgacttggaccttgatttcctggacaaaaatccaggaaaatccaggtccaggaaaaatccaggttgccgaaaaatggcctgtacctggatcctggaaaaatccaggcctggatccaagtccaggtcgatctctaaaaaataaaaactcaaaatcaacaaatccataataaaattgccttaggcatgttcgccgatgaatttgttcaaaagccgaacggataagttccttctcacggtcatccaaactaaaattccaaagttcgttgaaatttatttttgtcaaaatctgttgcaaaactatgccataatttcaaattttctctcaatgacagcagaaaataaaaagaaaaaaaactcaccttggccataagtaaacatcatggttggaggcacgtacagttgcattatcaccaaacggaacatctcgttcaattctaagttgcaccaaaattcattttatttttgaggattcacaccgaaaacttcaaaaaataaacattgaaaaaatgaatttcgatgtaaaaagacaaaaaaaaaaacgaataaatgtttaaaaacatcatttatttaataaattttcagtgacaaatttgtacttttcagtatttatttatgtcgggcctacctgattatatttctgtcgtgtcggacaaatgttggcttttgctcaaaaatatgagcatctttcaccttttttgtgtaattttagatttttttaaataccaaaattttttacttctaacggtcgcttcacaaatccgctctcaacattcgcaacaaaggcacaactgaagaaaaaaatggcaaaaaagaagaacataaatttggattttatttggagcattaaaactgtaagaaaataattatttgtattttcatataaaataatattataaaataataaatttggaattaattagtcaccactgatcagattcgatttactcggataaacgaataaaacatgtttcgatcatttcattcaaccgcttctgatcaataattatccactattaattaatctattaggtgacgtacccggaaaagcagcgcaattaattgaagcttcatagccaaaataaaacataaatatatttttcagacattggaaaaaataacactttcaaaacttttaaatgaaccctttgtattagatattaatataatttgtataagaagtataattatttgtgtgaaaaagaggatgaaaagtttctaattttcttaacaatctcacattagaaatccattttttccagcggcgtttctcggcatcgccggatccaaaattacccgagaattttataaaagattgaagtgtcaaacccagccgggactgaactgagcgccctattaaagtgctcaaagacaatttatgattttttattgcttttatatttatatatccttctagataaaaggaatttcaatctaaagttattttatgtaagaaatcctctcggaaaaaatccaaaattctaatattatgcccgggttaagcagcggaaag

SEQ ID NO: 3985 - DNA, 4780 bp, Heterodera glycines
aagaaaaaaaactcaccttggccataagtaaacatcatggttggaggcacgtacagttgcattatcaccaaacggaacatctcgttcaattctaagttgcaccaaaattcattttatttttgaggattcacaccgaaaacttcaaaaaataaacattgaaaaaatgaatttcgatgtaaaaagacaaaaaaaaaaaacgaataaatgtttaaaaacatcatttatttaataaattttcagtgacaaatttgtacttttcagtatttatttatgtcgggcctacctgattatatttctgtcgtgtcggacaaatgttggcttttgctcaaaaatatgagcatctttcaccttttttgtgtaattttagatttttttaaataccaaaattttttacttctaacggtcgcttcacaaatccgctctcaacattcgcaacaaaggcacaactgaagaaaaaaatggcaaaaaagaagaacataaatttggattttatttggagcattaaaactgtaagaaaataattatttgtattttcatataaaataataaatttggaattaattagtcaccactgatcagattcgatttactcggataaacgaataaaacatgtttcgatcatttcattcaaccgcttctgatcaataattatccacaattaatttatctattaggtgacgtacccggaaaagcagcgcaattaattgaagcttcatagccaaaataaaacataattatatttttcagacattggaaaaaataacactttcaaaacttttaaatgaaccctttgtattagatattaatataatttgtataagaagtataattatttgtgtgaaaaagaggatgaaaagtttctaattttcttaacaatctcacattagaaatccattttttccagcggcgtttatcggcatcgccggagccaaaattacccgagaattttataaaagattgaagtgccaaacccagccgggactgaactgatcgccctattaaagtgctcaaagacaatttatgatttttattgcttttatatttatatatccttctagataaaaggaatttcaatctaaagtttttttatgtaagaaatcctctgaaaaaatccaaaattctaatattatgccgggtttatgcagcggaaaggcctcagtttttgaaaatgatagaaatgcgttttttgtttttaaaaaaaagctccacatggatcgacacccatcagaaaattggccattgtttactgaatgaaaaataaaattctattttattttttctgaaaatgaaatgccaaaaatgatattttgtgtcatttgtcccgttttgttccgtttgccatttgtccaattagttggccatcagagtgccatttggctgtccatctccgtctcctcccccatgccttcccattcgtccgcctcgccgtccatggcgtcgtcctcgagcagttcgtcctctgccaattggtcaaagtccgactcttccgcccccaagtcgtcgaccgcctcagtgtccaagttgttttcctccgccaccacttccgcactcgacggtcccttctgagcattctccgccgcctttggcacggctttcactgctgccattggtttggcttcaaattggcaattttggcacaatattaaatataattaattatttacttgggctctttttgtcagttgcttttgccgctggggattttttgtctaaatttattcaattttcattattattatttgtttaataatattatttaccatttttaggcactcctttccctttggctggcttagcttttttgtctaaaattcaaaaattaactttttaaatttctttttatattaaaattcttaccctttttgcctttggcgtccttttttccttttccctttgattttgcgtcttttttaattccttaattaattaattagttaattaattaatttgtattaattagtccctctcttttttctgctttacctcctttcgctgctcctttcggcgccgcttttccttttgctggcgttgtaattgctcctttaaaagcatattccaattaatatttattatcaatttatttatacctttcttattgtcttttttcactgcctttgagttggctaaaataataaaatatttttaaatttttaattaatttggccacctgtctcaagaataacagccatcaccaagcaaaccatggccaggaagagaacggcgcgcattttgaatgtttgggaaagggaattaattaatttaattaaaataatttcgaatatgattttcgcttggctttcttttggcttttatattcctccaaaaaacgtctattttctttgaaattggaaatgtttttccaaaattttttgccggaaattatgccaatgccaaccatttttccattgatttgtctatgccatttttatgttcggtttctttcctgtgatttcaacattttttatttcttcatcaatatgttttgttgaaatattcttttattggtaaatatcggtttgaggtcccaaactcagaattgcttacggtcagaattaatgtaaaaaggtttgaaaaaaagcatttgtgaagaattcaaaacggtcaaaaaaatcataaattaatttatataaattaatcattttttacagagcaatggcattggcaccattctcaaagacattgcgccgcaaatgttcaacggcactttggcaaaaaatgattcattttgtgccgccatgggatgatgacaaaatgcacgcgtttttccaaattgaaaggccaatattttcaaaacgcataatcaacgacgcggatttattgccctataaaaatgatccaaacagattcagtcagtaaaaaataaattgaatttttaaaaaaattaatttcggcactttttaagacagtctagacccatgtgatgaatacggcgcagattgtgtgccgatcagaaatttgttgttgaaaattgaggcattggcaacctgtggaaagaacgaaagcaaaacaaatgcggtaaaaaatagaaaaaacagtttaaaaatatttaaaaatatttttagatttctaaaatgccaccatgggccccaccacttccgccaccgatgccatggaaaaagccatccgaaacaatgctatgcgatggggatatgttttgtgataaacgaaagctgcgagaacagtacaaccgattgagggagagtgagtcattttacaaatattaattaattaagtaatgaaattaattaaattaaaattcagtttgtgggcttaagcccgaaaaagtggaaaccagcgcaaaaaacgacaataccatccaaaagagacattcatttatatttctcattgataattcattcataaaatttggcacaatttatttatttatttttattaattttacctatttttgtagcctgtggcgcatccccgttgggccgtgacagcggatggcaatcccttatgctgggaatgactaacgactggtgcatcgatgtaatttttgcatcatttattcattgcttattttcaaatccggcctcagtcgggattgaaaagtcgggactgggtataagagctatttgaaagactgtgatcggttttagaaaagcctggattatagggatccggaaactttggttttaatttgaaactgattaagaattttaacatgtccgtcgctgctggccatgaattgatgcacgcgattggctttcatcatgagcaaagccgaagtgatgtccgaaattacgtgattttacgggaagatgacggagtaattaacacaaataatttaaatataattttccatgtgctaattttaaagcaatcggaaattgacccatacacaaaaaactttgacttcccttacgatttcgggtcggtgatgcattatcaatctgggggcgatcatgaacagtaagaaaaagttggatttaataacgtaaaattggaattaaaggggcttatacaatctgatcactttgccacgcttttaccaacaaacgattggccaaagcgaacgaatctctttcaaagacgcggccataattaaccgaatttattgcgaaggcaaatcaattaaatataattaagtgatttcccatttgttcagactcatgcaaaggccatgaggacaagtgccaaaacgggggctatttgaatccgaatgattgcacaaaatgccattgtccggacggatacggtggcaaatactgtaaagaactcgaagagagtgagcaattaattaattcaattaaattcaaattaaattttgtaaatttttagatttgaattgcgaggatttgagtggaattccgagagaattggtggccaatcagtcagcagtgttactgaagacgaaggccaaatgtggggggaatgggccgtgccgatgccattggcgaattaaggcaataaataatatttttgaatttttagtttttttaattaatgcaaattttaattgctttcagcctgaagcggggaaaaaggtacgaattcagttcaaaagtttgagcaatttgtttgaatgcacatacaactgctcatcggcgtatgtcgaggtcaaataccgagacgacaaaagggcccaaggcaaaaagacaaataattaattactgattaattagcaaaaggatcgtttataaggtgccaaactttgctgtccccgtgcactcactgatctgaacgccaatgaatacaaaatattggattgatgcggaaaagccggacatggacatagtcatttctgcgctcctttcaacaaaatggaccatac

SEQ ID NO: 3986 - DNA, 2960 bp, Heterodera glycines
agcctggactcacctgaccacacaataaaaagtgcttaaaggtcatttaaataattttttatgtttttttactgctttttgttaggacatatgtaaaatcatagtcatatttgtaatatgcttttaggtaaaagttaaattttaatataataacgttttttattttattattttagcgtttttcgtagaatttttgggctttccaattgaaacatttaaccatcgcaaaaaggagcatgcgaaaacggagcaagtaacccttggctccggggggggggggggcggctgaagtcaaaaattcgatttttaggggtgtatttcatttttttaaaatttattttaaattgcctttgttttcaatgctttacaaaccattacaaaatgcaaattgttcaaaaatgttaaggcaacgtcaaactcataaattcaagcaaatgccgttacgccttcaatttgtatgccgaaaaaaggaaccccggcagcggcaatttgagctgttatgacggtgtaaaaaaccaatattatcaatgcccatgtaaagttggtaatgaaaaatgccgcactgaagaaaaatgggcacacgaagaatttctttgcccaataataaaggtaattaattaatcaattaatgtcaaaaggcaccgccacaaaaaaatatttgagttaaatttttaggcactaaaaaaatttgaatttgaaaaacaaaaaaaaataaggccgaaataagtgcaaattttagaaataaggacaaattagaagataaatgataaaaactccatctacatataattttacttataaattcaaggtcaatggaattcaaatccaaggaaaaaggcaaacggtgtttactgacccaaataatgaaaaatacaattggactaaaattgatgttgattgttatgtgagttgtgtcttctaatttcgaaaagcctatttaattgacttaattcacagaaagccgaagggggtaccgtaaacttttggggctacagtaagccggagactaacgaaatcattcgggtggacgaaatccactgcttgatggatgatgcagttgctgaagtgccaaaacagtccaaaagcttacaaaccgatgaacagccgccgatgaaattgagtccaagtccattcttggccaataatgtttcatcacttatccatgtgttcgtgccatttgttggcaatccatgagagaaaatggggagaccagtgatcagttggggatctgtcttctactgcgatcagttggccaatttccaatcagcaaatttttatttttttttaaatttgacaaaatttgatttatatacgtcgaaaaaattaataaaaataattaaaaatttaattaatgcatgtcgagatgtctttttgtttattttttccaattgtaaattttgtattccttatatgatacaccaattatttttattcgtttaattatttattattttgttctttgtaaatccgtgccaaaacccttcaagacaaaaaagttcaataaaaaatttacgtacaaaaaataaatttcaataaaattaaattaaaagaacaaaagaatttataaatattttttaatttttgggagtgtttgaaaatttattaaaaatgtttccatatttttttattattcactttttgtgttgtttaattgctgttcaatcttaaaaattaaataaacatgcaaagctttggaataaagccatcagtataaatatgagaagcaggctgatcaatggatttttttttaattttcaatgaaaaaattggaattttcaaaaaatggttcttttctttggccagcggggaaggatcccaaaaagctcttaaatgaaagagagattgcttaattaagtagaaatttaagccaataatgaaaatatataaaatacgaaaattcaaaaaccacgaaaaaatttcaacaaaattttttctgttcaattttttcaaattgaatcaaaaagagcaacaaacattttaaatgcttttggttcaaaattctcaaacttcacacaggaagcacagcgggacaaattcaaggtttatattttctgtttattttttgttttattgcacgttgttgggttgaccttccccctacccaacttttcagttgtccctaactgaatttggcccaaatttttccttttccaaacacacttcatcggcttttcgtttggcacgcccactttcacttgaaccgaattcaatcgctgtttgtttgccgcactttctccaaaactttcagaatttttgatcggaatttctttggttttcagttggggcacaaatgttttgttgaataatggcctccttttattgtccacagcatttcgatttgatttcttctccaccactttacctttcttggtaccagtgtcattttttgggtccgacctatgtttattcccctttttctgcccttctctgttggtactggtgttgccatggcacacgaaggctttgaaagtgatcagaggcgaattttcgggcttcgaagctggcgaaaagtctacaatgcggcagttcactgcgtcaagcattttgaaacctaattggtccatggcatttgtgccgaaaagcaaatcatagccaaatgtagattgggccacaaaaacacggattttcgtttctaatggtcctctctgaattggcaaagcaacaattcaaaaacatttcacttcctttccatttatgtcgatgatccggctttcagagcgggtgacgatgtccttttggcttactttgtccatgatttctaagaagaatttgaccgaaatcaaagaaatttgggagccgccgtcgagcattgcatccaatttacgtccaaacaccgaaacactggtcgccaaaattttaccaaccgccgggctttcttcccaaatctacccttttccgacaaattcgttgtttttccgaagaatcgatttcagacaggtgttcccaatttacggctccta

SEQ ID NO: 3987 - DNA, 2061 bp, Heterodera glycines
  misc_feature (61)..(61): n is a, c, g, or t
  misc_feature (70)..(70): n is a, c, g, or t
  misc_feature (77)..(77): n is a, c, g, or t
  misc_feature (268)..(268): n is a, c, g, or t
atcatgctatcgaataccagcccagggtggggaccggttgctgattgcactcaagacgatnttgttgatngctcttnataggtaggtttttttgaaatttgggtgttgctgtccttggtgaaactcaaatccttcgtcttgggaccggcggtgtccttgtgtataggcatgtgcgggagaattcgccgaacgtgtgattgttggtcctcaacaaccggttgctgtgtgagccttatctgctgttctctctgccgctcaaaattaccgncagcattttcgtacaactgaccattgggtcggcaagcaatcggattgactgcttgtgggtgattcaatgcagggaaattatgcgcgactgggtttggcatttgattttgcatgaaattcataaccctaatttggttttggatgacgctcaaattttctggaagttgcattcggtctcgctgcagggcgcttaggttttgttcgttaagcggtgttgaaaaggctcgcaatccatgtgcgtccaacgcatcgtttccaaaactccctctatccccagcttcaactccattttccaaattttgttgcaccataccgttgacattttgttcgtcgccgttttccatttcgtcgtactccaattgttcgtccggcgcgctttgatccattcctccgtaaagcaggcgacgacgaatctcagtctctgctaaaacattttcatgattgtcgtccagtcgctgattttcgttgttcgctaagggcgagatcggtctgccccccaaaactccaaaattttcagccctaaatgcgtttccatcgcggtcaacaatgattccctggttgagtgccctcgtccgggttaatggtggagaccgaagcacaggcattttgtttgagttaccgcagaggtactactaaacaacaaagaaacggcgaatccttgaaaaacggcacgatttgtcggtggtttgtcgatatccacacttatcgcagtaatgcgtttgcagtggtacgaaaattggtgaaattcgcagcaatgcgttaaaacaacagaaccgcagcaatgcgtttgttctggtcgcttctccaaatcagcttctcctcagcagccaaaaatccacaataccggcacagctaactcttcgccaggagcgccacgtgctaaataatgctgtttgggtcggggcctattaattgctttcctcaacaaatatttccaaagtcggggacaattaattttatttaaatcagcaacaataaaaatgggggaaagtccgaggaaaataactgacgacaacaatataaaaagtgcactgccaacagaatgaattgaagggaagacgggggaacattttctgctgggaagggatggcaaaatatagattaggcgagagactacaatgacagacaatgagacaaaaattaagaagggacaacataattactaaataaaatgccaataatcaaacattaacacacaaattcaaggtttatattttctgtttattttttgttttattgcaccagcggtaacgccggaaaaaagatgaaaattcaagaaaatccaataaaaatttaaaatgtttttccttttgtgtcggttcacaaatgctctgaattcctcgtcttccagtttggatgctctcaggcaatcatatctgtcaatccaaatggattgaagcctggcaaacaaacgcttcagctgctccacagtctccgcaaagtcgaactctgtcacatttttcggcatgcaggactttttgtattcggcaaacgcttccttgctgagcttcgtcatgagaaccttcactttcagcacgtcctgcaaattcggtgcggcaaagtctagagcagagtcgatttgctgcagctagtcctcgatgtcggtgctttgctctccgaattcgaagtattccacattcggtttcgacggcacattggagggttgctggcctgcttgcggcgcattttactgtgcttcaagcagttgcttaaccatgtccatcaattgctgaaccgtagggtttccattttttattttgtcgttcaccactctattgataatatcgccaagat

SEQ ID NO: 3988 - DNA, 4819 bp, Heterodera glycines
  misc_feature (8)..(8): n is a, c, g, or t
  misc_feature (1288)..(1288): n is a, c, g, or t
  misc_feature (1488)..(1488): n is a, c, g, or t
  misc_feature (1626)..(1626): n is a, c, g, or t
agtcttcngggtgtaataaagtgcaccccaattcaaatccattatcgtaacttctcacaatctccacataaattccgaaactggcagaaaaaaaaattgtgtttggttaacacaaattacaaatcacacactttttcacccatccctttcaagcagtaacagcagcagcatgatgatggcgttggacgccgccggcggggcgacggcagcggccgccgactcggcccaactgatctccaccgactcgttggacatggaacagttgcgggtccgctgcgagtgcaccaagcacaacgccaactacaagctgacctttgacgaggacagcggccagtggaccaccagcggcattggcggctcgttcaccaccacggcgactgcgagtccgccggcggcgcaacaacagaaacaacagcaccagagacggttgaagcaacaccagcagttgaagcagttgctggcgatgaacaccaccgccactgccatgaataacaacaacaatagccatgaggaggaggacagggatggtcatggagatgaggtacggtgcctactatactaatattcgctacagagcaccaattttatttcgggagggacacccgaagagttttgtttttttgctccccatcctaaaatttttgtacaatataatttcttaaaaattttttggcgccctggaaaaaacgaggaattttggcctttttgagaccaaattttggcaaaaaatacatatatttttttatcccaacaattttcaccaccaaaaacaatattaacagtaaaaaatctttattccattgcagcatcaacaacagcagcagcagttgtacaccgccatcatggacaacaacggtgcactggggctgcaactgttggagcagttgaacaacgctgatgacgacgaccaagacaacgacaccagcgcgtacagcggcggcgtgttcaatgccaccgccgagaaacgaagcggcgtacgtcgtcgtccggcaacgagtgttggccatggcacaacgacgacggcaacggatggttggcgaaagaacagtttcatggacgcgctgttgaacaacaacccaaaccacaacgccaacacgtcttcttccgcatcgtcgactttccatggcaataatttccgtggcgacgcggcgacgaaaaaaggggacggcggaggcatgggaatgatgaccacttggggacgactgcaccagcagagcgacgacatgggtggaggacagcagccgcccttcaattccgagaaggttcacaggtcagtatttcggaaggngagggggcgagggtgaacgggttggatgcattacgttcccccccatttttcaaaaaaaaaaaatttaaagcggattataaaggaaaatggcaaagtttaaaatttctataagttttaacaaattcgctaaaatgcatggctgggcaattgagtacccaagattttctcaaaattttaccaaaaatttcctcaaaaatggnagataaaaaaggcactcgaatttttcgctccaaaatttttttggtgacaggcctaaaaactcaaacctttaatccaatgaactcacggcttttcagtcttcccgagctgaacagcaccaaagcaaccgcagcagcgcnggaggtggcggcattggcactgatttgtcatccgtcgacggcgcccaccaccaaccacaatcacaacgtttgccaaaggtgcgtcaacgccggcaatggccacatatcaacagcagcaacctcaacaacaccgtcatgttcaaccagtacacggctcagtttcgtcgtcatcgtcgtcggctggactcagacggccgacctcctcaagtttgctggacaatttcatcgccacgcaacgccaacaacaacagcaatggaacggcggcccgcaaatggtggactacgcctactcggagacgtatctgggcaacggacgctacattgacatgaacgaaaatggtagggattttgtttttacggggttttctcggtttctgtcctcacaaatcaagggtatccgagtcttaaaggatgcctaactcggactattattacttattttccaaatactaaaatggattttccgtcatttggcctgacggccctgacttttcttaaatcacaatgaaaaattctggaaaataccaatttctcaaaacaaaaaaaaaaaaatccaagcaaattttccgttttcgtaatataattcttttccgttttcgtaatataattcaattgcatgaaaaccggaggggcaagcaacagcaaaaaaaacggatttttttctccgaaaactttaatttcaaataatcacgcgttttgattaaatttgacaactttaatgatacaagaaatgttttgagaagtttttcagttttcaaagccacaaagtccgtccatttttgtcagtttcagagtcccctccattcattattgactaattgcacaattaacgaatgtgccatttgtttgttttttcactcatttttattgacacttttttccccgaaaatgggatgggatggtgtgaactatgaattcatcctcaaactgtgatgatttatcacacatttggcgtgtgatggaacgacggggacataaaaaacaaaaaatcgtttctgttttttcaacgccaaacttttggtgggggctcatcaatcacaactttcgtcatcatcatcgtcgtttcgttccacattacctaattttatttgtgcattttttatattaattatataacaaataatccaaaatccgatcgaattgaatcggatcggaaaattccccggcgccctttcccatcgcccatttcaatctttcccgcccccctcccgccgtcgttctgttcgtcattctttttcatcatttactccctctcccctcttccccgcgcagagattggctatgttccgtcctgcaccgcatccatccaacgtagcggtggcgatctccatcatcatcaacagttggcgctgtttgatttggatttacggcgtcgccaattgctgctcggcgttggcggcagcaaagacagcgacgacgacggtgggccgtttgttggagcagtaccagtaacagcagaaaatgatccgcaaccgcagcaacaacgacagctgatgcggacaatgataatgaagatgaacaccaacagcaacaacatgacggagacggcaccgctggggcacaaattgggcaacgacaaccaactgcaacacaatgccaacgccaaccagcaacgacaacagcaacagcaaaggcggcagagccaccaccaaatgggtgcaaccaaaacaaaggcagcggcgacaatggcaatgccaacaacggcgaccatgccgcaacagcaacggcgcacgtttgccgacctgtccgccagtcggacagtgcccgacctgaagttcatcgcgttggcacacaatgtaagttgggacaggcaatagtgacggactttcgttggcaccggaagttggtcttacaatgggggactgattcaaaattgaaaaaagaaagttcgtgaggaaaaccatcggtcaaaaattatattgttttattttctttctttttcatttcacaaaatgagggatttcattcctcccatttcgttaggtcctccaataatctgacaatgaacaattttttttaatggattttactataaaaataaggcattcgtaatggcccaatttttcgagagtcactctcgaaaatactcaaaataattcgctctgtttgctttccgattactaaaaaattacattttcccgtctttcaggtgccaacaatttgtcccccctcctccgtgtcgttggacaatttgttgtgccgcgtgcgaaacagtgccaccgccgctgacggcaacggcggcattggtggtgccaatgccgcggccattgacgagctgatcgactgctgtgccagttcaatgcgcatcctttcggagccggacggcggcggggccagcgacgggcccgactcgggcctcggctcgtcccattccgacggtgagccaaaaaagcgaagaaaaaaatggaaaccgtcgtcaaaattttaatatgttaaatttttctggggattggctcttccgacgggataaactgcacggagaagggaaatgaagcacatcccattttttcatgttacatttatttacaaatattcaggcccctcgcacatcgaagattggtcttcactgtccgtgttgttgccaaggttggattcatttttatttttcaattttgagtgttgaaccaattgcactttttttgcgtgtcgtcaaaattagccggacccggtggaattccgggttctggggaaggatttggttcctatcctctcatcctttttcctggtgctctgttccccgttttcgacatttcctttccattccttcacccccccccccttaaatgggactcaattgtaccggacccaagtattttttctacaccggcggggctcagatgaccgctcctaaaactgtcaacaacgaggaggcaatgtgttttgtagtccaaaaaagttttgatttgaaaatgtgacaggatggcattagtgtcggcagctgacgcatttccgtcggtccgtctccccccccccccctcaaattgtccccgtccatgtggcgctaaattcgtccaacttcaaaagccccaatacttaaacgccgctgttttttaagtgcaagtgccgctcattaaaatgcgtgttgggaaaaccgcgagcggcggaagtcaggaaattttcacgaatggtgtctgtctctttgtttatttctctccctcacactcacactcattctccctctttctctctgtct

SEQ ID NO: 3989 - DNA, 2567 bp, Heterodera glycines
ttttattctgtcgtcttctttttcaccttttctctctcacactcctctctctctcgctctcttttccccactctttccccaatattttccctcaatttctctcttcatcctccctgctgtcccccttttccacaacaccaaatgaatgaccacagcaaatgcggcggcttcttttaatgctggccacagccacacacacacagctctttcatcgttttatgtttgtttgtctcctctctctcacatattgtggggctgcttttaaatgtgtgtgggaaagcgacgatttgtcgtaaaatggacaaataaacaaatgcaataaacaaaaatttaatctgttgggaaaatgcactaatgcaaagtgggggaggaaactcatcaatttgcaaaaatgaataaatgggaattgtatatgcatagtagaaggtgccggaattttgtaagggtcgggatttggaatcaggccgggatggggggggggggtaaatgtccggatcagaatcccgggggaaatcccgacgggatcccgttcccctcctgtctctaatgtacagtttggtggtattgcaaaaccaaaaggatcttttttcccaaaaatgggccgtctaaaccaaaaaaagtgccaaaaaaatatacaaaatttgaagtggacacaaattgtacaaagccgccatcataatttacaaacgattgcagaaatgtgctcgaggcgtgctccttcttcaagaccaacagcttcctgctcaccggctcctccaataacattgaggggcgacggccggcggtgccgccgccgcggtcgttcacttcggccacgctttggcgattgaaggaaaaggtcgttgttgggaagatgaaaaaatcagcgattttttgaaattttataatgaattactaatttttttcaaaacttctaaaaaattgctagaaaaattttcaaaaaacatttttttttttgaattttcttagaaaaaattttctaagcctttttcttcaacgattttttacaattaatttgaattttgtaaaaatagaattttggcggcgagattttgtctcgtctccttgtaaaattataagtggatttagacttttttgagcctacctatcccatattttttcatgtttaagttagtcaataggttccacaaaaaataaaaattccgatggctcggaaatccgaaaaaaaacattttttgccagctacccctaaaacattttccactgttgcctttcgggttcaggccaatttttgagcaaattagcttaaaatttttttgaaaaatagggaaaatcttggtataatttgaacaacttgctttttatttgtaaaataaaacattcttttgcaattagcctacgtaattacgtatttaactgtctccctcttcccgttttgtagggcaattgttgcctgaggcattggggcggtgccaacaccgatccgtcaacgccaacagtaaatgatgcggcgctctgtggctgttcgtcttcgtcctgttgttgctgttgcacttcgtttggcaccaccgccggtttgccgggcgcggcggcacacggcgaacagtgcaccaaaagtgccgtcttcgcgcgccaacaaatgtcgtcccgcagccgtgccgtgctgtcgcaaaagctgcgcttacatgcccgcgaattggcattgattgggtgggaatttgcaatttttgactccgattaatttaattgatttattttttggatcgtaagaaaattaggaaaaattttggtgccagcgcagctcaaaatttaaaatttacgcttatgtctctaattttttgtgttgaatttcttgttcttttggctaaatctcaaaatttaccattttaaattaaaaaaaactttttttcctcagcaaaatctcacaaattcgtcaattttaatctttgatatcattttgaattgttctttccccggtcgagagtcgcttcgagaattttctctctacaaatttcatttgagtcatcgagtgccaatgtgtgcgtgtgcttcgtcccctccccgttagattgcgtttttcaagtgccaacttttgtccctttttgagtgtttttattacgcacatttgattgcttttaatatttgtacacttcaaaagaacataatgagaaaatcaggaatttaagtgaaaaagaaattaatagaaattgaaaaaatgtgagggaccgaattttaatttatgcccattagacaattaaatcgctgaatttttgaattttgttcaaaaaatgggtgtgcaaaatgttctttgccagaagtttcagacacggggttcccagtcccggtttttttttgaaagcaccggtgtcttccggcaccgttcaccccgttccgtgttagtcccggccccgttcaaccaaaatggcacaaattggttgttttttggcgcaaaaccgctacaaatgcatgctttttcgccggcactgattttggaaataatattgtaggaaaaaaaattggctccaagagcaaaagaagcaaagtcttcgggtttcgcaaagacctcggctgcttgttttggctatcttccacgaataaaatttttt

SEQ ID NO: 3990 - DNA, 2524 bp, Heterodera glycines
  misc_feature (99)..(99): n is a, c, g, or t
tttttaatttattagcttttgatatttttttaagaatttctttggtggagcacgatttgttccgatgaaatggtctccaaattttcttctcgaaatttnttctggttacgttctgacctcaaataccccgaaaatacaccaagtcaacatcctggaaaacgagatgtttatttgcgttcgactttgtctaatttttgaatcgttgaagctaaaaggggctcgcatttcctcgtaaatccaaaattgtatcccatttaaaacaatttgtcgtttgttgttcattgcattgttattgtcctcctcccccttcacagtttgtactgtcgtctgatcgaatgtgttgagctgctgtccgtgctcaaccaatgcggcgaggcggacaaacggtgggagcggcgacaacggcagcagcaacgggtggcgaccaccgccgacgaccgtgtcgccgcacgggtcggagtcgccgtcgccaacgacgctcaccatttggatcaacgccaagtgcagcaacagcacatggcaactaggacgatgatggcatggtgcggcggcagtgccgcccgtcttcccaaggattcgcgagtgccgaagagttcttcaatgccgaccaaactggtggcagcagcagcatcatcaacaaaattgtcaacggattgcattgaggaggaggagcaagaagttgaagttgttcactgccagcaggacaaacaacaacaccacaatagcatcaaattggagggtgagaaacaaaatgatgagtggtggaaggctaaatttaccagaatgacccggaaactttttttggatgctctcggcccatttttcgagtgtaacaggatcaggttcgggtttttcaaaatcccggtctctcgctctttaacattcatttgttagcagactcaatttccatttttcagatgtcaaatgggtcgaagtgcagcagcgcgagcaggaggaggacaaaacggcggaaaatgagcgaccaaactcaatggcggacaacgacaacgtcgttcagtcaaggaacactgatgctgttggtggtgctgctgacactgttgtgcacgccggtttgagaccgtccagttccaggatcccaatactacggtaaggttgattttaaaaaattaatccaaaattatgagccaaaaaaggcattcggtagaagtactgcttgaacatgctggacaaaacaacaacaatttgttgtttttccgtttagcacgcgaagtcgttcgtcaataatgcacagcgacgggggcagtccaattgcagcgcaacaacgccactctccgacgacgctttcccgtcgttcgtccagtgctcgccctacaccgtcgttgtcgcccgtttacatttgtccggtccgcgaggcgatcactggcgagcacacagaccaacagtcggcatcgctaccacatgggagcgccgctggcggtggcacgctgctgtacccgttgcgcaagggcgagcgcgtgcgagtgttggccatccgtggcgagtacacgcgttgcagtcgcttgcctgctgctgaacatcgccagcaacaactacaacaacagcggttggcgttgcagaacggcctggtgccgaccaggacgctccagtttggcgccaataatggcactacggcattaaacgacgagcggatgacggaactgtgactgatgattgacttgctgatcagtgtggtgatcggagtttgctgtgtgccatgaacggacaaagaaaagtgaacgaaacgatggaaacgtacaaaaaaggacaattaaataaagagacacaaaacaacaacacttttcatatgattaattattaaattgatatgaatctctagccaatctcgctgctccatttttctgtttcgtcattatttaattctgtgcaaaaacaaacaaaacagtgtgcaagcaatccgaatgtgttgattttgtcgagcttttcatatgaaaacgattagttattatttagacagttgatcagtgatcagattatgggtggctctctctttttgccggatttctttttcagaactgttatctggcattttggactgcacaattccaaaatttctgccatcttaattattttggtaaaacgaaataatttcttcaaagcgatgtccattatgaattcattgggactaattcccgtgaaaaaaccatccccttaattagaaacgcttaattgaaggaaaaataatttatagatcactttgcaaaagtatcaaaataaaaagatcaatgtcaatggatcattcggtcgaccgacagtcagtccgtcttcacttccgccgtccttttctactgctgcttctcctcctccttctgctggtccacggccgccttcttcttcatttcaatgggaatggttcgtccgcctttgtcagccgttttcattccgctgatgaacaggcgaccgccgtccaactcgcacttgatgctctccttttggatgccctccgggatgagcacacggcgcgagaactgacggtggaccgattcgcctgaggggaggggggcaa

SEQ ID NO: 3991 - DNA, 1569 bp, Heterodera glycines
tgtttcatggtttttgactggatttagcttgttttgttcaatttggaacaaaagtgagaattttgaaattttttaattttcgactttttgttcgaattcgggtccgggattcgaaattattcgtgatcagcgacccagaaaaccccaaggaaatgtgttttacacggcttttttaaaacttattttttcgaaaaatgggggggggataaacttcagtattacctctaattcttactgacaatgagcagttccgactcagcgaaataaaagggaatttctaacatttccaaagttttttgcaatcattttaatttgtttatactttttgcatttggatataaatgtttcccttaaaagcgcaaccttagccttgtaccaaatactgtcacttatgaagagttggttatgttaaagcgcataaaaccccgaaattaacacacaacccatgcgaattcgactcttgatccgctagctgctttatcccacaacctcccaccacctcagcattttaacaatttaatgactttttccaaaaagattatctcaaaatagaaaatgaaaagggtataaatttaagcactgtgtgtatatgtgtgaaaagcatatattgaagaaaaagcttgcaaatatcgatgatagggaaatgtcgaaaatgaatcaaaattccttttttttgttatcctttccatagtcaaaataactcctctctttctctccctgtgcttaataacgtcttcctcctccaccaccgcccgagtacagtgaaccgcccgatcggcctcctgctccaccgtaggacatcgattgctgctgatggtagcgaccgccggatgacgaggaagcaccggtcatcttcgacggcgagccgtacatgttccattctgaaagcacaacaaaaaataaatatataactatgattgacatggcataaatttttcatagtttaaatcttgattgatccgaagcaggtcgtttcctccccggaaaataaaaatgtttgaaaattttccagcaattttttcaaaatattatggtgaatttctaatcttgtgaaaaaaatcaggggtttgaaaggagggggagaaaaattgaagtgcaccctgacccatttaccggatttcaaattcataaaaaaatccgccaagctcaagcagctattaccagagagaatgtcatcagtttgtctgctccaaccaccgttgccactggctgaagttccaccggcgctcgtgccaaatgcgcgcgaattgaccatttccgtggcacggctattagcagggtttgcccatgccgacgactgactgttgtaataggaggagggctggccaccaccaccaccgccggaggattggccacgggaagaagcgaactgagccctaaagtaattaattaccataaattaatgtgtacttcattttcattaatcatttccccccaaattatgtttttttttttaattttcaagcgtttttcgatatttaagataaattgttattgttttttaatcgaaaaaagtaaagatttctaatgggattttaacattaattattcccacaaatacataaatta

SEQ ID NO: 3992 - DNA, 698 bp, Heterodera glycines
ctcaaattgttattgaatttacatttccaaataaaaaaggtagtatttttctcagaattctttacataaaagtgcacaaccgtaaatgactcgccactattctcctttcgctgttccaagccaattaactcagtcccggggacaccgccaattattttggcgctttggcaaacattgactcactttgacctcattaaaatgtttttttcctgtaatagtgtgaataacaacatttttctgtgctttaggagattcagtttctgttgccaatgcttatggcacttttataattgccactaatttgggtgataaaagggcctttgattggatttgccattgctttcggttttcgcatggttcattaaactcttccccaattgttttgccatcgaattgccaaaattaaattggcacaatttcttcctttctccgcctttcttcctttgcccggagattcccttttctccccctttctctcataataatgttcggccatttttaatctctgtttttggcacggattactcacgcgcgaccgcctgggccctttcttcggttgtccgatgcctttccttataaatattggattatccccggagggggcggggggcgtcggtcggcgggtgttaagcggcggcagtgccattggcgctgtcccctcccccgcgtcaaatgcattcattcgttctgtccccccc

SEQ ID NO: 3993 - DNA, 4793 bp, Heterodera glycines
  misc_feature (4692)..(4692): n is a, c, g, or t
  misc_feature (4773)..(4774): n is a, c, g, or t
gggggtgccgaaaaagtagggagaatcggcgagagatgtaaacgcggtacccaaaaaggtggggcgggcgggggtacgctataaacaaaatgaaagagtaaatgaaaataaaaggaatgttttcagactaacgccgaacttggccaactacgaccccgtgctgaatgagtagacggacacttaacacaataaatctgtgtgttctcttaattggctgaaggtacttcttcgaccggcaccctggtgtgtttggccaagtgctcaattactacagaaccggcaaattgcactatccgctcgacgtgtgcggaccgttgtatgaggaggaattgaaagtgagcgaagaatggccaacaaaaaaaagcaatatttgacattttaagtattggggcattgacccgaacgaatgcgaaccatgttgttggtaaacagaagcaattgagtaattaatgatcatcagcaaaaccaaacaggatgacattcacgcaacatcgggacacacaagaagtgttgcaaacgctggacaaattggagttggacgacgaagcgatgcgtaacgaagtgggacaaaataagggggaggcgaggggggaagtgatcgaattgatcagacaaatgcagggggcagacatcggtcatcaacaacaacagatggctcgataatgattagaccggtcgggccaattcaccattttcgaaaagggttgggtagtcagcatgaccgcccatcggcaggggggagagggtgattgattgaactgattggtaccagggccggagggacggtcggactgatcagccaattcaggaagaactttacaagcgcttcggtttcgaggaacagtacaaaaacaaagagttgaactgttggcagaggacgaagccgaaactgtggcgaatgtttgacgagccgagctcatcgacaggggcaaaagtgaggccaaccgctaaactcgggagcaattgttggcattggctcagattgtggccgtcatttcggtgttctttctgatctgtgccattctcgtgttttgcctcaaaacgcaccccggcttaagaggtgggcggagggggggggctgaaaataattaattattttaaatgtttattatttaagattatatgtcattcattaattttctttgcagtggccgacttggaagagattggccctctgctgaaccattcgctgtttatgaatcattccgccgccaaaaggccggccgaccctccgccccctcccacaaaacccttcttcaaatatcgcacggagtccatcggagtggacaaacgcaactcaaaaccgcacccgagcttcttggcaagtcaaaacattatttacgaaatgccaatgtgacaatggatcgttggaatcctttttttagataattgaaacgatttgcaatgtttggttcaccatcgagattataatcaggtggggttgggttgggatcgactcgagactgaaccgttactcttgggcattggccaatcgctcgttttgccatttctgtccgtccttctcccttaggttcgtcgcgtgtccgtcaaaggtcgactatttcaaggcccccgtgaacatcatcgacttggtcgccactctcaccttttacatcgatttgcttctcacaacgcgtttcggtgccaccgccgacctcgagttcttctccatcattcgcattgttttgcctccatccctttcttaaactgctcatcgtcaccctttcccttaagcttcgtctgttcaaactcacccaacactctcaaggcctcaaaatccttctctacacgttcaggtgacaatggcattgtgggaactgtcgtcttcttctccccttttggcattccttccaaattggccaatttcctttccctgcagggcatcggccaaagaattaatgctgctggtctttttccttctgctcggaattgttgtattcgcttccttaatttattacgccgaacggatggaagacaatccggagaatcaggtgaagaagcacaacaaccgaatcgaccatgtcggatgaatttccggcttacagaaacctcgaaaaccctaaatcgacattttcatgacccgaaatcattcagagtaccaatccattaacaaatttacagttccattccattcccctcggcctatggtacgccattgtcacgatgaccacgataggatacggtaagagcaagagagtcttggtactgtatacaaacataatttctttgacttccctaggcgatatgacaccacacacgtggatgggacggctgatcggtctttggtctttgttttaatttacaattttggtttaattaggctcaatttgtgcattggccggagtgctgacaattgctcttcctgtgccggtcattgtctcaaactttgccatgtaaattttcacggcatttttttttaaatttcaattatgatttttcctccaaatatcataaggtattattcacacactcaagccagaagtaaaatgccgagaagacggcgcggagtgttaagcatggaccaagtaaggccaaatgagcggtaattggcagtaattagtgttaattaatcggggactatcccgccagataaacaagcaacagccccccgggggccatcccaaccggcgttttttgctttcgaacttcaattcgaacgcgacttccaatttgtgtgccgacggttcttctctactgaccatggccaataacatcgcggctgccgcgcattctaaccacgacacaattggaggagggggagagtccaagaaatgtgccggggcaccgaacgccggtggccatggccatcgaataccctcgccgattccaaaaaagggtcggaacaattaccgactaatcgctattaattgctattttaaaaaacatctcaaatttgttacagatggttcttttcgtatgcgatcactttcccctaaaatgaatggcccacaaaaaagtgccgaaaccgtcgaggaagagaatttagcaagatcaaacaaaaggacaacaattgttgacccgactttcattggtggacgggcaacgacagcgcaaatttgaattgaaaacgaacggtttaagaaatcaaattggacattcatttaagtgctaacaaattgtgaatacaataacaattattgtgatttcgtatctttgaaatgataagatttttatgctcttactgttaaagtaatttgtcaattttcactgtataaaaatgacggtcagggtcgttttcgtaccgccgttttcgtacggggacgttttcgtacgagttcttgtacaagcaagcgtcagattcaaatagaaaaacttaagaactaataaaaccaaaatttatcattttttgtttcccattcataaaattttgtagaaaattcataactttaacaaaaataacaaaatccgggacaaactaggtcgcatctcataattttggaaaataccagcgaggaaattgttaaggttttcgggattgacattggcataattttgatcattttgggggacaatattgttattgatatcgttatagcgttggacgagacgaagaatccgtgcgtcggcatcgagatacttctttttctgtgcaccaatttatcattatttagttttgttttaattacttgctgctggttcattttgtagttaataaaagcttaactgtcaaaacattaaaagtaattaaaaaaaattaacaaattatttgaatgcaatttttttttgcatatccactcgtacgaaaatggcggtacgaaaatggcggtacgaaaacggcggtacgaaaacggcggtacgaaaacgtcctggcccgtaaaaatgaattttcttcttttttaatttttaaaataaaattttaattgaatttggcgtttctttaaattataaatagagaccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaattttttaatttgaaaattatgttaataattaggaaaaaagtcgatttttaggggtgtatttttcaattttcttgtatttttattgcaatttttctcaaaaatgccaaaatatgtgccaaaccccaaaatatgtgctaacatattttatgtgacaaaacgccaaaatatgtgtttttataagtcgctctaaatcaaaaattgttcggagataatgctatttttgggcttctctcgccataactaagccgcaaaaaaaatatgtaaaaacataaaaatccggtctctaattataaaagtaaacggcgtttacgtttatctaacggttgattaggcaaatttaggtacttcacttcatttgatttgactaatttcctttatttgttttgacaatttacttaggtatttgttttatttgattttaccaataatttgctattttcggcacctcaactntatccatggcactgttttcgccttcatcgtctgacaatttttcttcacacgtccctttgctaacattcgtccaaaattacnntcattctgttcattttggc

SEQ ID NO: 3994 - DNA, 1336 bp, Heterodera glycines
  misc_feature (13)..(13): n is a, c, g, or t
  misc_feature (31)..(31): n is a, c, g, or t
atgaaaagcgatntatgacggcttctgactntattcgaaagttattactgttgacctcgctttttgttagtttaattcgaacgtttagatatcttggactttacacggaagaaaattataatagagaaacggttcgtcttttggcgagtgcggctgacacggcaaaggacggattgatttcatacgaggaattcagtgcttttgaaggtggttttgccggaacgactcaatttccatatttttaattgaaatcggttttaattgttcgttttagccagtctctgtgccccagatgctttgtaccttactgcctttgaaatttttgacaataatgcgtccgaatcaattactgccgatgaatttgagaaggtggaatttgttttgtttgtatttgcaattgaattctcaggtcatccgccacacaacccctctggtcgaattggattttgattttaacagcgaatttatcaagaaatatttcggcgcgttagttcttatgtttttcccaattcattaattaatttctttttgatttagcaaaaagcagcgctccattggttaccacgctttctgtcaattgcttcacgacttttacgaagaacaaggattacaagcatttaaaaagtaagacttgcagaatttaatttctgagttaatttcatattcagatttgacacgcaaaatgatgggagtattacagccactgacttttttcaacttatgacaacggtcaaaggccatttgctgacggatttttcgagaaacaatttgattgccgttgctggaggcacttcaagtgcgcataaagtgagaacctccgaaaaccgtgcatttgtactcatgcatattccattttctgtgcctttaattgagtgtctttttaggtgcgttttcccttttaccaagcattcaattcgctgttggccaaaatggaactgatcaaacgcgtttatcagagcattgcccgcgggaacattgacctgaaagtgactcgtgaagagtttttgcaggtgttttagcactccatttggtcatttatttataattagtaaaacaatccttttttgaaccatttttaggctacgcaatcctacgctcaaataacgccttatgaggtgagctattgcaattcaaatttgatgctaatcacaagtaaaccttattgtttgcaggtcgaaatactcttccacttggccgagctcaatcacccgggccatcggacagtcgatttgaccgacttggacaaaattgaccctgaacggctgaagcgcgtttcgcatatgatccggtaagagcaacagagaacgcaactaaacaaaccaattctgttgttgcc

SEQ ID NO: 3995 - DNA, 1216 bp, Heterodera glycines
ttttagatttcgatcgttccgctcagtccgaatgccgtcgttattttgatcggcccgaaaattcacagatcaatttgatcggtcgtagtaaagggtagggtactaatagtttggttttgttcttttgactggccattctcccctttcagaaagtccactcatcgttcgctgataaaccccgactgggacttccaacagatgggcattggcgggttggacaaggaattctcttccatttttcgacgcgccttcgcttctcgcgtttttccgcccgaattcatcgaacaattgggtgatttgtccttttgctgtttcgtatgtaactgtgctgcttccagcgatgaagcatgtccgtggcattcttctctacggacccccggggacgggcaaaacgctaatcgcgcgacagatcggcaaaatgctcaacgcacgcgaaccgaaaattgtcaatggccctgaaattctgaacaagtccgaccgaaactgatggcatttgtaaatgtttttcttgaagatatgtcggcgaatcggaggcgaacatgcgcaaattgttctccgacgctgaggaggaatggcgccggtgcgggcccaactcgggactgcacataatcatttttgacgaaattgacgccatctgcaaacagagagggtccatggtaaataatgcagggctattcggttgtaacgttcattcaatgatttttggtgtaaatttcttaggctggatcatcgactggagtccatgatacggtggtcaaccaactgctgaccaaaatggacggggtggagcagctgaacaacatcctcgtcattggaatgaccaatcggaaagacatgatcgacgaagcgttgctgagaccgggacggatggaagtgcaattggaaatatcattgccagatgagtacgggcgcgtccaaattctgaagatacacacggcacggatgaggtgagaagagaaagcatagagaaaacgagagagagaaaaggggagaagttgtagacagagagagagagaggaagggaagagggaaaaagaagagaatgccaacaatccattcccattaaattaagagaatataacaaattggacaccggcgtgaacgttgaggacatcgcaaagaggaccaagaacttctcgggtgccgagttggaagggttagtccgtgccgcccaatcgtccgcaatgaaccgattggttaaacccgggggcaaagt

SEQ ID NO: 3996 - DNA, 5581 bp, Heterodera glycines
  misc_feature (44)..(45): n is a, c, g, or t
  misc_feature (50)..(50): n is a, c, g, or t
  misc_feature (70)..(70): n is a, c, g, or t
gatacacgattgattatcgatttaatgagcttaaacattactannataanttaacaatattaataattcnaaaggaaaatatcgcgcatttttcaaaataaaaacgtctaacattattttgaaaacatggaatagtggtcataggtaatttaaaaatcatcaaaaatattgtaattgtgataaaaactgcataaggaaataaaaagtcatgttcatacaaaataaaaataaaacagagaaactaagccaaattttttattattctctgtgtttattgtggagctttacaaatataaaaatacagaaagctactttaatataaataagtgaatggccttctatctgaagattgattcggcttagaacccatttttataaattaaaaatagttattacaaaaattctaaaaaacatacaaatggaaataaaaaataaatatatattatatgaaattgaaattaaacgactacatttgtcttggatatcacatcagttgtaaataaaacagccgatgccttgcaagataaaaacctaataaaacaagttaattaattctaaatgcctctggatacgtgtgtaaaactaaaacatcaaaaaattcttataggaatataatcgccatttgagataacttaaactatttctaaaagtgactaccgactaaataatattatgccaagcagcgacttgatttcctaatgagaaaatttggaaaattccaaaattcgaaaacataattctaaataaaaaagttaaaatttaaattaattatactgtcagaatttgccgaaaagtgctaatctatttatttagcaaaaattgtaaaatttagaataaaaataataaattaattcaaatataaatgagaatataaaatttggttcctacgaaccggcgcacaaagcttctcgcgtaaaatgatcgtcgcgacttggccgtgtaaatactataattattaatttatatacaaaagaaaactttattctacagttttcgtttaatccataaaaagataaaagttattaaatttaaaagtcataaatttaacaataattttttttaaggttaaatcttatttttttttattttagctgacggtttcggccaataactaataaaataataacctgatcgattgtgttttttaattaatattctagatgaaaaccatgaaaataaaaagaaaaaactgaaatttattttgaacaaaattaataaaataaaaaattcataaatataaataacaaagctttgtataaaaatttattggctctacttcagtttatgcgtccaatcgacttttatgcgtccaatcacgttttatgcgtccaatctcattttatgcgtccaatcaaagttttatgcgtccaatcattttttatgcatccaataacatttaccatgtgaaaattattatcccttgccagtttttgtaaaaaaaatcttttacactacacgggataattgcgtctcatttcttccaaaatatgctgatatattttggaatttccgtgaaatcgtctgaacatatactgatacaaatatgtcggcaacatatcctcatttgagccacgcaaatggcgaagagatgtcttcagagacccccacgtagcctcaatgccttgggtatgcacttgtctgtcatgagggtcgacaataccgactaatggaaaaaggcagcggctgcccataaaaagtgtggcaaaatttttgactcatgaaagcataaaacctttattttggcaaaaaaacataatttgatacataaaaaatgattggacgcataaaaagcgattggacgcatgaaatgagattggacgcataaaactttgattggacgcacaaaactttgattggacgcataaaaagcgattggacgcataaaagtcgattggacgcataaaaaacgattggacgcataaactgagattggacgcataaaacgtgattggacgcataaaagtcgattggacgcataaaaaacgattggacacataaactgaagtagagccaaaagttatagcccaaaaaaacgacacggcgcccaactgacatagaccgcttcctcacttttcattttaaatgtatgttagaagttgcctgtaaactagagagtacccaactttttaagtagcgccaaaattcattatttaaactctggctgaaaaaatcgaacgttacgacgacatgtcaaaggcgatgaagaaggtgggcgaacagaggtcgaaggcacgacttaattgctgccaaaatgtgtttacgttttgtttttttcagctggtcgaaatggacgccaagttggacgaagaagagctcaatttgttgttcactggatacagaaaggcgattaaaattcttcagaaccagttgctcaaaaagtaaaagtgaagtcatcaaattggccaagaagatcgtcaaaaacgattttgaaaagaagtgccgcgagatgttggtcggtgccattttccaagcatttattcgtcagcttaaaatgacggtaaaaaacgatcaaacaaatttttggattgtaaagtcttcccattttagatctccagaaggcaaagcagtcgtacgaggaggcgtgggacattgctcagcagaagatccggccatcgcatccgattcgcgttggagtggcgctcaattttgccgttttcctccacgaattcatgaaagggtcgcaaattggctcaaaaggtggtggacggagccgaacaaaactcattttaatcaccaatttattaacatatcccaattttttgcaggctcatgacgacggaaatgctgatctgctggcggagacgacctgcgattcgttcgaagtgtcaatggaaatcctcgagaaaattaacgcgaaattgaacgaatgggcccgtaaacagtaggataattgcgtcccatgtcacatatgtacaaatattgtaaatattaggcatttgtatcccatgtctgtgtatattgtattgttgtggaatcacgctgatatgtaaatgtttgcctattatatatgtatgtacagattcgttgttcattaattcgttcagttgttaataaatgaaaaagaaaattgggtattttacggttatctgtacccagattttgagaaaaaaaatttagaataaacttgttttagggatttttaagaccgacaaaaccgattctggcacctattttggcccgattcgaactccgaacccggattcgaacaaaaaagtcaaaaaccattttccagaaaaatcacatttgatgcacaaaatttttaaacaaagactatgacaggaatagaataaattattcattagaacatattaaaagaatcggtaattctgtcgatggtactaccccacctcccttatgaaagtttttttttcaaaagtcatgagaacaagtttccaagggttttcgggctcgctggacatgaatccggcatcaatttcgaccaattcgggatccctgaaccgaaatggagattgaactgaaattttatttctgtctttgacacttttctggaaaatttgtgacaaaagtgcccttatttatcacaatcacaacaatatacaatttatatatatttacaatggttgtgacatacataattggaatatacaattgtaatattatccatctgatcggtcggtcttcttctcaacatctccttgctttgctgccctatttcgtctcggcatgtttggggttcaccggcttccacagctccaagttcttcttcatttgaatgataatgttcttgctgtcgatgtgcgtcgcagggattgccttcgcgctcttaagagcctgaacaaaggaaatttcactgtgaataaattaagttgtgagcccaaaactcactcgttccgtcatttgaatcgcttggtccacgtctttcaggagctggtggtagaacacggacatgttgagtgcgacagcaagacgagtcgggtcggacggggtcagctgcgctgcgtgttctgccgcttggttgtaggactgcttcgcctcttcgatggcggctgaaatgaaaaaatggcgaattatttgttagcaacatcaaaacaaattccctactcgttctgtcctcgcccagcgcaatttcggaaatgtagcggttgtagtcgcccttcatcttgaggtagaacaccttggcctccaggttggtcgtcgcatttggaatcagagttgagtcgaggaactcctgaaaagcgatggtatttggattgatatcaaaaatgaaggcacgaaacggaccaaaactccacggcaattgacaagcagctcagattccaactcctcgcgatacgtctctatgacctggaaaatgaaaacagttaaaacactaaaaaaagaatggttgagaagcaccagcagatgcgaattgctccgttgcgcctccgttatgtccgaaaaagagcgttgttcgatggcgcagagggcacgccacggctgacgaatcgacgacatcgcgcctttgaaagccacccacagcaaatagcgctcctcgtaggacaattcggggcaaatgctgaccaactgaaaaggaaggaaaagcattagaagctgctgaatgtatccaaaattgtcacctttttcactgcgtcgaccatttcgttgaagcactccgacgtgtcgcacagattgatgagaaacaacagctcttccttcgtctcggccgccatttgagaattgagttgcgaatgtttcgttttgtcggaagcatcgccttttatatcccatttttcttctaaaacacaattttttctcaccgtgttttgtcggtgcgaattgtgtttatataaaaagcaaattttgtgtaccgccaaagcatttttactgttcattttactctttattttttgaattaattgttttcatgtttattaacagttaaatatttaatacatttccaatatttttttagcatttccaacagcaaatattgagccttgtttgtatgacaaaatgaacttttaccaaaattttcaaaatgtaagtaaaaaacgtttcaaattcagtaatgggattttagtaattttctccgttttcatgggtgggatttggtcaaatttttatgtcgaatggttcgggtttgttcgcctttgtccaatgccattatttttctctatacttttttcaaatttaagcgccatttgaccaacagtgagctgatcgaccaatcgttgatgcaaattctggacattgcgacgccacagagcaacttcaacgacccgttagttttgagaaatttttggacggtcaaaataaaaatgaaaattttccaactaatttgttttcccatgactgaagccgtttatgcttttcctccccctttccaggctctacaaacgctttcgcattgtctattcgcgcgactttctcattcgctgctcgtcgtctccgtacgctttgcttccgccgaaagacattcgcaaaattgtcactgaaatgggggacattgtcgcgcactttcctcgccgtcgtccgtgcatcagatattagacgaattggcccttcatcagttgaaatgatcagtcagcggaacagttggaaaggaatgacccattcaatcattgtgttttaagtgatcttt

SEQ ID NO: 3997 - DNA, 3640 bp, Heterodera glycines
ttgaatcgcttgtccacgtctttcaggagctgtggtagaacacggacatgttgagtgcgacagcaagacgagtcgggtcggacggggtcagctgcgctgcgtgttctgccgcttggttgtaggactgcttcgcctcttcgatggcggctgaaatgaaaaaatggcgaattatttgttagcaacatcaaaacaaattccctactcgttctgtcctcgcccagcgcaatttcggaaatgtagcggctgtagtcgcccttcatcttgaggtagaacaccttggcctccaggttggtcgtcgcatttggaatcagagttgagtcgaggaactcctgaaaagcgatggtatttggattgatatctaaaatgaaggcacgaaacggaccaaaactccacggcaattgacaagcagctcagattccaactcctcgcgataggacttgaacccctgaaaatgaaaagataaaacactaaaaaaaatgtgttgcgcaccagccgttgcccctcagtatccgaatagaagcgttgttcgatggcgcagagggcacgccacggctgacgaaatcgcacctttgaaagccacccacagcaactcttttgttataagacaattcggagcaaatgctgaccaactgaaaaggaaggaaaagcattagaagctgctgaatgtatccaaaatcaaattgtcacctttttcactgcgtcgaccatgtcgttgaagcgttccaatttttcataagcatagatttaatttaatttatcgagcaaaccaaaggcacatgagtgctcttatatggtgccaaaaaagaaaacaacaaataaatttgatcaaaataaaaatacaaaatgaataccgtactaaaaatgaataaaaataattcaatcaaatgttaaaaattcacaggtgataaaaatatagtgtaaatatggcaacatggaaaatcctactcagaactcattgcttttagtaaacccctgaattcctttgccttattaatttgcaccgctaccactggaagattattccagctttttactattctattgaaaaaattattttgagttttggccgtgtggcgggcgctttacccgtaaaagtaaaggcctcctgggcctttctgagaaaaagaaacttttcccagcatcgaggctggtgaaccctttgattattttaaaagctgttgttaaatcattgatttttcttctttcttctaatttgtgtaaacccgtgatttttagtctttttgttagttatgagtagggcagcaacttttagtgatttaactattttttttgctcgattgttttgaagaaaggagctcaaaaaacgcatttctgcgttgaaatttttcgatttggatctcactatcgatcactagaaatcactattttcacgcttcgtcactaaaatagtgaaaattcactattttggcgttttgtcactattttttaactatttcgacatttttcagagattttattagcaaaaatgcaataaaatcaaaaaatacacccctaagaatcgatctaaaaaaatttcaaaaaaatacacccctaagaatcgaccaaaaattttttttaaatacaccactaagaattggaaaattttttcaaaaattctccccaaaaatttttttcttgacaaaatttttgatttaaaaaatgtcaatatttgctaagagaattttataaaggaaatgtagctcatttgcaactgcaaccagtgaataaaaattatttttgctcaatttttggctgaaaattatgtcactattcgtcactatttcggactttttgtcactattttgggatttttactcactattttagttaactatttcgggatttttcgtcactaaaagttgctgccctagttatgagctcgcaaaagtgtattttaagatgtgattccttgtattagcaagtaaaaaaatgtccgagaatttccgaatttttaaccaaaaaaatgtcgtaaatcggaattattattttttttgttgtaaagctgagcccataaaatattatattaattagcaataaatgtgtgaaatgaaacaacaataagcggaataaattttatgaacaaattggtataaagaaaagcacccaatgcgccaataataaacggacgaacaaattggacgctttctctgttgtcgctgcagaagtggcagaggataaagctgccgccggtggcaaacccccgagcaaatcgatcacgcggatttgcttaatggtggacagcaacagctggtaacggtcggcacgctccaaaagaaaggtgagctccaactcgtgcacaaagggagcacataactaagaaaaaatgagacggcgatgactttttgctagagtcaagaaagttggcatattaagctaaaaaatttcttttctgccccctcctctctctctcctactctcttgtcgcccccgctctctcttctctctatgtgtcaatctgtggcgcttcgacttctcctctctcctcctctctcactctttgtctcctcctctgtctctatctcttcactcggaacccgtcagttgggcccccatacgtttgggccccagcatgtttttccactatagctttttttctttggcatccaaatccaacaatcttggtatcattcgaaagcccttcacatgctctattagcttacaaaaagcgaaaagattttcaagcctggaaaaaatttattagaaaaaatttcaaaaattttgacttatttgcaattttcatgtataacctttttggtaattgtctaaccgcgaagcaataccttagaaaaagcttctaaacatgttaagcttttgaatgataccaagtttataggatttggatgacaaaggaaaaagttatagaaagttatagtggaaaaatatgctggggcccaaacgtgggggcccaactgacgtagaccgatctcttttcactccatatgtctacttatcttttgctcttccattttctcctctctctctcttctctctatctgtctaatctcttgctctcccactttccctcgtcctcctcgtttctctctttctctgcctccctctctacactctactctctcaccttttcccatttgcccgagtgccattttggccttttgttcccattgtcattttgttgctttgaattcgttatcattttctccgccggctccatgccaaaccattgaatttgcattagcagcacttcctccttggcgaaatgttcaaggagaacaactcggcattttttgctctatttaagcaaaaaataagaaataacacaattaatcattgggcacttttctcacctcgggcagcactctctcaagtgcgaattggactcgcgcggccaaatccttcgcgtgcgacgtgctttggctgatcagtccgcttgtttccaacacggcctttggcacatttttgcggatcagatccaattctgggtaccgtacattttttggcctgtattcactttatccagcagaggccccaaaacagaaaaaaacttccggccggaggggtgggaaacccgaagactttttttgttttttataaaaaaaatttccagtttaatttataattcggacagggggaggaatgaattaccgaccccttccctgatttcgggactactgtaccttac

SEQ ID NO: 3998 - DNA, 4348 bp, Heterodera glycines
atgcgaaggcgccaaattcgccaaccaatgggccaatgggaaatgaatgtataaaaagggaaacgttggattaaacagaccttagaaaagatttgatttaccagacaaacttcagaactgatctcaccaattttatgctattatttaaatcttcggattccatttttgacatcattttgaatattgtcagtcgcgctcaattcctgtcagttcgcccaccacatcccatcatacaatatcatatttttttattatatcttttattttttgatcgtacaaatttgtgaaagagagtccattgattagatttaaaaagcgactttttgaattgtgaattcttagttcgaaatagttttttttatcgcagtcgtggaatgtacctaattgtgcctttccttgtattcgctagtgtttgtttttctcaattggccgtcaaaataacagaaataaaagatgattttttctactgttattcaattcattcatcaattttgccattgtatttgtcaaaatgacagaaatttaatttacctctcctttaaatgatattttgattaactgataaattgtttagttattttactgccatgcacaacatactcaaaaggttctttgcgaatgtttcgccttcgcttttaaagaagcccctcaacgacccatttccgattgctgcgtggcgctcgcacccggccaacatggccaaaggtgtgaagttcgatcacgacaacgcgttcgtgcgattctgccgctactatctatggcattactgttggagtgggcgtcagtacggtgggtggactcaacaattgccgaggctgttaacttcaaagcattgagtcaatccgttcacaggtcttcaattctacgaccaggcattcgaaccgcatcccgtagtccaagaggcactgcgccggctccgtcttaaggacccctaccaggtggggatagagaacccaattttatttggtaattcaattcagtacgaccttcgtctgcagcgtattcttttggccagtcaattgggctcaaagaatgagcgactgccgaagaacatgtggacaaaatgggacgacgagacattctatctgaacccgtattttaacgaaattgaggaggaaaagctggagcgtgaagccagcacgggcatgaagccgggataccaactcaaagagcagatttaggggacaggttgcgttttacacatttttaagtgtaatcgttcgtgcaattttgtgtgatgtgaaaagggctgcctttaatactccgaaatttttccgcggggctttttctcatttactaatcgaattaaaattgtatatatttttagacattgtgttgtgaacgattaggcgcggaggaaaagcacattgcgtttgttggtactgtggccggagagaaattgattgatgagtgattgttcacaacttttaggacgacatgtgttatgttcatttaacgtgaagtaataaaaccattattatccgagtcgattaattgttgttaagtaatctttgcttatcaccattttggttctccgtttattcgctttaaatggtttccgttcaccgctaatgtaagaaaacctaaaagtgaaagggtttgttggtttaataattaataaatttttcgtgtttgattaagtctcgattgttgacttgactaaaaacaaaatttcattctttagctatacataaatataattttattgtgtcaatttgaaaaatgtcaaatcgtaaaaggatgggaatgttcgaccatgccaaatattctaagccggttcttcgcagcattactgagcctgtccaaagggcggtcggttcttttcgtttccgtcattttttgtttcctcttgtgacttggtaaaggtcaaacgcgacatcaacaaactgttggactatggcgcggcgtcggtgcgcttccgccagcccgaaaaatttgattcggaagtgagcgtggtggaggacagctttgagcagcagcagcaactggaagaggaggaggaagcggagagagaggcgaagcagcagcagtgccggaagaagttttgtccggaaattatcgacttggacaaggcgagactattggttgacaacgggcggactattctaacagtttgtcataattcacttccttaagccgcccatcgtttgggcctcttccttgcgcccgcccgaaaaatcgttcgccttgggccgtgacccgtcattcgctgcggttcgggacgcgctgctgagagcggcccctgcccgggggagagagtcgccgaaaatgggcgctgaattcgtcaaacggcacggagaaaaagctaacaaccgaacattacacgaattgcagcgtctcgccatgcttctcaaccccggccctgagaacaaacagtgcactcccatccagcggtgcagtgacgttgcggtgtcggcgaggccccagttccccagcaaatgtccgttggatcggctcgccactcgtctgatggattcattccccaccataacgctaaagtagcgagtccttctaaccacattttcaagtgtaaaatctgtttttcccagaaacaatgaaccgcttactctcactgatgccactttttccatggccaaacgggcactgctggcggcgcaggagcgccattcgttgggagtgaataacacacgcggggactctttggcctccgaagctcccatcgaattggtgtgtattgtctattaatacattcaattgctttaccttctcacaatcaacaaaatttcagaacccgcttagatcgatcagtgaccaaaccatgtgctttttccgcgcatcggaggacgaagcggcgaattattcggatgaccaaaacggagaaatttcgatggacgagtcgccaaccgctgacatttatgtgcgtaacacaactcattaatatttataataaattgggtttaattagcaaataatgccgcgatcgtacggcgattattacgacggcatttccgccactgccgccggtcagagcagcgtcactcagtcgtcttacagcacccaaccgtacgcctctcacaacgccactccgtcgcagcccttcttcgacttcttccgtaacagcgtttccaccaccgctggactgacaatgaatgaagtccatgggtcgtacgatgacttcatcccgcgcgtctgtgacgatggaaatcagcagccccttttccgctttagcggcgtttccggcgatcggagtgacactattggctcgcccgaattcgatttctgattttgctaattgttgtattatattggcattaaattttttgagcaaattggttctgtatgtattcggagtgcttcccataggccgagttatcgttaatattttactcgaattcttctccgacggaatgttttgtttgggagaattttgccacccccccccccccccctctggcaaatgtttgtcgcgctttatttggcagcatttgtaacgaaacgatcacagtgaaaaatacaaagtgaaattgggttgaatataagcagtgaaactgattttactttcatttcctattcgctttcacatcacttttcgccgattccttcacaaaactagtcacttttaaagcaaaccaacgtgggtatttgatgtgaaggtcgtgccctccctgggcatgtatttcaatcctaaaaattacattcctgctaattgtaagaaatgaaatggcgaaaacctggcattttccaatttcttgctcatcaagctcgggtcaaggacgaaccggtccatgttaccgttgacgatcaaaacggggatcttcagtgtgtttagaacgcggtcgcatggaaaacttcctccgaggtccttgtacactctaaatgagcagatttaaaaagatttaaccgcttttttgtttcgattattttttcccttttaattcaaaaataaaaaggaatttgataaattaattgactattaggtcgaatttcaaaaattcatgtgcacacactttgctacaacatcgcaaagtccggcccattgttccttgagaaattcgttggaataatgctccaaatagggtgcctttgccgcgggcatccattggtccgtgtttcgcatgcctttcaatgagttaaagaatacgtttcctttaaataggaattccaacacctttgaatgccaagtctccccgcatgtccacttgggagccggacgaaagcagtaccatgtggctgaccaggcccttcccttggcctgccacgtgtatcgatgttctgcccccttcgctccatcccaacacaacaaacggcgtcaatttgagggtctgaaatgagggaattgcagcaaggcgaaagtaccacaataaacggaatttatggattaaacggg

SEQ ID NO: 3999 - DNA, 5334 bp, Heterodera glycines
gaaacgagtttttggatctatgatttttgacattttcttttatttcttaaaatattgctctctttattccaagaatccccttcaaaattctccgtgttttcaaatctcccgttttatttgctcctttttttgcagttacgtggagtattcgctggcccagttcctttactatgccatgaaagagggtgcgaccagtgaacaggcgtcgcggatgaccgcaatggacggggcgagcaaaaacgcaggcaaaaaatcattgattagcttggctaatagccatcccacccgaaaagggcgcttatgcggaatatttcgaacttgatgaaatgcttataaatgctgtgtcattggacctctgtttatagtctgaattcataattttagagatattgtggctaattaaaaagtaaaactctaattttattaagggaatttcagtaacaaaaaatgtaggaattttttcccctttttagaaaatccgcaaattttttattttcagtaacacataaaaataagaatttttacggcaacattatgtccggtgacgttttgagtgcactttgtttcgaaaaaaacttaactaccaaaaaaaaacttccaaaaattgctcttccgaatatttttggtcgtaattattttgaaactaacgaattattcgaaattttttgctatggaaaaagatatcccaaaacaggcccgggtcccagtttatccccagcgacggaatcgactttttaatccaatgatatcgcatttacatgcagttccgaaagttaccattttaggcaacatttgaatttttggcctaatttgcgctgagatttacccacaccggcgcctctttacgcttccctttttcaaaaagaaaaaactgaaatacaaaagaaaatgtatttcataataataaactgatttgaccaatgttaaggcgagatgattgacaaactgacgctgcaattcaatcggacgcgtcaagcggtgatcaccagggaactgatcgaaatcatttccggcgccgctgccgtttaaatgaaatattttcgcaacaaattgtgaacagatgagagaattgaataggaaaatgtcaacaaatttttgtgctggcaaacgcaccgtttttttcgttcgcattgtttaaatatcatttgtttttttgtgttttgtagacagtgagttcaaggaaaataaattgttcagttgctgaggccaggataatcattcgggatgaatttgtggtaatactggggtttgttccccccccccctttttggcaaaaatttaaaattttaaaaagtcaggtaaagcatgttttctggggttttcggggccgctgatcacgaattcggtatccatttcgcccaattccgaaccccgaactcaaattcgaacaaaaagtcgaaatttatttttcatcaaaattcaatttattgcaccaaatctattcaaatgcacgaaatcaacaacggaaagaatagattttacaattactcacgaggatagatttcaattctgagtgtaagacccagtcgcggggtctataaaattctgtgaatgattcacagtaaaatgttgataaccctggggcagcattgagatggaattgtagccccgcccaatgaatgaccatttcgtgcatttgaatagatttggtgcaataaattgaattttgatgaaaaataaattttcgactttttgttcgaatttgagttcggggttcggaattgggcgaaatggatgccggattcgtgatcagagaccccggaaaccccagaaaaaatgttttacgtgacttttaaaaatttgaaatttttgccaaaaaaggggggggaacaaaccccagtattaccaaaaatagtaaaattttaaaaagcattttttctggggtagaaaaatacgctgatcacgaatctgaactcagattttgaaaaatcattgattttgtctatggctttttatcaggtacttgattttttccaaaaaatttaagaaaattaattagcgtaaaaaactcataccagatgttgtagagcttaaaaagagctttcgaatgagctattgaatctttacagatgttaagtatttaaatcccaacttatgattaattaactaaaaataagtcttataggtaagttcgaaaatttctttatcggtacgctctcgactagtgattaacattttacggctatcttagcttcctaattgtttatgaaatgatcttttccaacaattcttcatccaattcaaaatgtctcttttgtatttcatcgttgttcgttctttttgctgttctgcgtgagttgtttttagtgtgtattgctttctgaatttgcttctttctttttcagtatttccctcctctgaatattcgtcggtcgatgccactcgaattcgcttcaggccgaaagatttgcagccggcgattataaatcagacggagttatggaaacaaagtgtgttcgcttcttttttgctttttcattccaccgttaattcacacattactttcagaattgaagcgtcacgcaatcaaccgggcaagaaaactcgccaaacttgacaaattgccaccaattccggaggtcaaggtcaagcgtgtgatcagaaatgccaagggcgagtacaacccttgcagtgttgttgataatctctgtctgaatggtggcacatgctactccgataacgaagagtgagtgcgctggcagactagaaagcttcaacaaatatatgcagttttgctcaattttttttaaagatagtcatgtcttttagggcgtcgtataatgctgcataagtcgcgttcaatcgaagtcgaaattcgtacgtcttccccagtgcgacatcgactgcacttctcctcaatatcgccctaattgataagtgacgccttggatcaactgattcaataataatatcactatttgactgactaataatttttgatagtaatttgggtcgtttttaacctttttgtatttttaaataaaataaccaaacagagccaatcataaagccccatgagggaattccgtaaagttaagctttatgcctttttccaaacattctgctaattgtaagttaaacattttcggtagattttcggatttatcacaaaggggtccttttcgagaaaatttattcgtgtagtttacaaggctaaaaacgactggcatcccttacatatattatatttcttaataatttgttttcattttacaattattgttatcaatttatttgaattgacgaaaaaaataatgatttgattgatcatttgcttttcgtgtcacatattttatttgtacactgttttgcattagaataaggacaccctgttttttgggagtttgaccacttcccatgaaccgatcgagctgaatttttaactgtacgtagaaattctgaaaatattaagattctgaaagtgagaaaccgaaatgatgacggaaaaaagttttacgattttttttcaaaattggggtgttgcattaaaataaggacacttttgaaaaccgaacaaaatctcaacaactaccaaaaagaaactgataaaataagctaaataagaaagaacaaatcttttttcacatttctgtttattttgcgaatagaaatatgtcttttaggcagagttatgttgaatttctaagttttcaggagaaattaagggccaaaaggcttaaatcgcctctaacatttgcccaaccgaatcaaactaacagcaatcagcactaagataatgtacagacatcctttaagcattttttattcattttatgccataaaaaaggcattaaacacaaaattttatggattaaacgggggaagtggcacattaaaacggtacggatgtatacttccaaactgactgacctccatcagtttcaagcacgcaaattctgttcagttcgccgtccgccgggcaaaacccaacacttttcaagtggatgaggctaaaaacagttagtttgtgatcactgatcagcgacgcaatgaatgttctctacccaaaacttcatctgcgttatttcaagtccctcttttcgaaagcatttgacagataatttccgattgttgaccttttgtcaaactttcgtcgcctcgtctccacaagcgcactcaaacggctgctcaacgagctaattttattatgataattgcccaaagtaaaagtaccaatatgagaaatgccggggaggtgggagatttggtgaaacggtctttagcggagaatggaggagaaagacaataggaagagagggggcaaagtaagaaaagtggaaatggatctttagaaatttgtttattttgtcacaaagcgaggaaaagtaaagaacaaatcaatgcataaacaccatttcacaatatatagattatttcctaaataacgaaagaacagttccaagcgccgtcgtcaaaagtgcgccgatggcgatactggcgatacgctcgaggcgacgaatccgccgatccatcctacgcatttgactcgctaatttgataagctcatcaatacgctcagcattgtttggcggctgtggcgggtcaattggcaaagcgatcggcggcgccacttgcggagcgattggcagaagtgcagccttcaaaatttcgatgtattaataacattttaaaagcatgctttcaattcaatttccaaaaggtttttttttgattcctttatactttctgatgaattttttgtattaggggattaccgggccaattgacaaagcaatgggcggtgccattggaggagcaatgggcggagcgattggcagagccactggtgggtcaatcggcggcgccacttgcggagcgattggcagaagtgcagccttcaaaatttcgatgtattaaataacattttaaaagcatgctttcaattcaatttccaaaacttacagatgctgcggaactgctcgaagaggttccatcgaagtaacacgtttcatacaaccagaaaaatccatccactacaatttaaaaaatagatattatagtgtaaaatattgttaaacacaatataatctgcccgttggtttataattgaaagcttttccaaaaacttaaattataaagaaattataaccaactcaatatctcctcatagtcctgcgcctctcccttgagcaaattttgtggtccagaggactttcttttttccgcgccttgatcagttaatttttgtgacatttttctaaaagaagttcttaaaattttcgctaaggacattctcaatgaacaaagcataagaaagcttgataaaaaggttattccatatagatgtgaagatggaaatgaattttgtttagattttgttttacttcgggtctg

SEQ ID NO: 4000 - DNA, 2427 bp, Heterodera glycines
  misc_feature (2419)..(2420): n is a, c, g, or t
tgaaatgagcaagaaatggtggaactgacaaaaaatctctccattaagtgtcaaataaaattcggccgaactttttcactgaaatttttcgggggaaataattggccaaaattggcactgtctgagtcggctttggccaagcgcagatgagctgacaaagaaaaaggatgaatgattaagcaacacttcgcttcccaattgttcaccttctctcatttcattttgcaatatcttaaaggtcgattcgtttacattattggcacaattttgtgccaatttgcccggcgttatgattggcattggacttttttgtccatccgccgatggattccatacaaatgcttcgaacgctccatcgcctccaatttgttccgttaatttcaaaggcatcggccaattcctttaaaaaattattaactgatttaaatgaatggataaagccaccaagtcgcgtagatcaacatgaacttttggaataagaattgcactgatccgtttgggtaccacagaatgacttttgccgccaaaatgcacaaaattgtcccattgaaaaagccaaaaatgtttccgtaaatatgagaccctaaaataaataaattcattttcaaaaaatattctgcgcaaaagttcactctttgcccaatgttttagggccacgacaaaacgtctgaactttggtctgtttctttcggcaattagcccaatcatttgatggttggccaaatagcctgaaggtgaataatttccaaatataaatttaataattgatttttttttaggctattccatttgaattccctaccggctaatgatttgatcataacttcggacggcatcctttgattggccagcacttccatcatcaattccacgtcgatcggttctaacggttcgtccggcagaaattccatgtccggcacagagaccaaagaaagatcgaactcaacaccgaacagcttcagctgtatcaaatggagataggcacttggaaatttgctcaaatgccttattttggggtgctaaaaaatgccaaaatgtaaaatttgaaaatttaatttattttatttatattttaaattaaattgattttctcctcattctgtctcctaattatttttgctcactttgcaaagtcggcagtacagcgaattgtcctcacaaattcgctgttccaatggaattgccaaaacacaggtgaaagtgccggaaaatttagccttttcctccccaattgaccctttttgtggcaccacgcaaatggtgtcaatgtccgagtcggaagagcgcgtgccaagaaaatgtgagcccgaaacgacgagacgagcagtgccattggactgaaaatgagcaaatgattcatttactaattaatttccctctattaacagcagaactgtgctattgggtgggacttttcataagaacgccgccaaatggatttaaaatgattaactcttgcccagaaccaactaaatttaacattgatagattgatatatgtgttctttagtaatctgtaaaatttcaaaactttcatcaacttaccaaaaaatatatcaagtaaaactaataattataccttacaattagtcattttcgaataaatttttgtttttatataaaaaaaaattaaaaaacaattttcattattttcttcttaaaaagtgaaagatttcgttttgtaacgaaatttcgggaatttgagtgaacttataaaaagactttggcaaagaaacttttttcgagacctaatctttcgaacgtatttatgtcaaaatatttcaatcattttcaactttacccattcgtttatgacggattttaaaatatccaaagcaacgttcagtgaatccacatcacttttagggatttcatttgtgaatacggtaaactaaaaattatatattattttttattgtttacttaacattccaaaattaaccaaatatttcgattgaaaattttcgcattggtcgacgtgaatctgttgggtaatttctggaaatttaacctccaaatgagggcgtgtaagttcgaaattaaattgaacattttcttcacataattttcggtctgaagaagtaattaattaatttcaaaattgaaatggcaattcatttggcttaatttatttttaattgcttttttcattaccaattcattaattttttaaatgcttcaattgttttttctttacctttaattattttttatttctttctcattaccaataattaatttcaaaatttaaacggtaataggtttagcttaatttttaattgctttttctcattatcaattaattaattttttaattgcttttttattatcaattaattatttttaaattgcttcaattattaactattaatttctttttcatttcaattaattcatttttaattgctttctcatgaccnntgcaggc

SEQ ID NO: 4001 - DNA, 1842 bp, Heterodera glycines
  misc_feature (1774)..(1774): n is a, c, g, or t
  misc_feature (1780)..(1780): n is a, c, g, or t
  misc_feature (1795)..(1795): n is a, c, g, or t
aatcataaaaaactaaaaataacaaaaaatattaaaattattttatttgaatatttattatataataattcagttaatcgctttacactaattttatgctttattctgtgctccaaatgattaccttctttgtttctcattttttctccatgctcaacactaatgagtgctaattgcttttccccaattaatttcttcagtcgggtccgcgccccacgcttttccgcgatgaattctttgacttcgtacaaatcgattttcattaaactgcccaaatgtttatggtgaaaagccatgagcataaagtgttgttcctattaacaatacagataaattatttagccctaaaaatgtctcgaatctctaaaatttctgattttttaggtagggtaaactaagtacttgaaaaacaatgggcggaccggacttgaaccggcgtctcttctggctttccggtccagtgttctaccggctcaactcccgccctctaattacccatataaatattaattaataagccatttattcattcattcgcacattgaatgcccgcatttgctcattaacatcggcacatttttcttctccgtcccaccgctggattttatactctttcattttgatcacttcttcattttttatttccctaataaaattgataaactgttgcaaaatgcacaacgcccaaattctgtgatgggcttgccccattttcgggtaaatttgagcccgaatttgtttcagcttctcttttaatgattgctgaagcgttttttgattggtgccgacagattgcggcatttgcttagtttggcactttacgaaaatgagaagcattggcaaagcaagtcgcgtccctgtgattatgtgctgctcactgcccgtcttttgctccaaatacattttgtacagcttcgactgaacggacagcgaaagggaatctaaaaaaagaagtgaaaaccatatggttgcccttatttaataaaaaaaattttaccaatttccaaaatttttgggaatttttcctccaattttatcaccaattcgtgccctactaaaagtgccaaatcccttttcgcgtttcccagcgttccttcgcttgacgacaaattacaataaactcgctgaatctctttggagagggcaattagcttaacgatggcaaggtaaatgatctgctgaaggatttttgcatcgcttgtcgtttcttggtaaattcgaattgcctcgtccggatcaaacgcaacttccacccaattgtccaccaattccatttcgtcctccttaattgttcgatattacctctttaattatgtaatttgtttacccaaaacagtccgaagtgttccttaacgaatttttgccaattttcgctgtttttccacagcgttttgtttctgagcaaaaaacttctgaatttccacaagctgaatatctgttcgattatgcttatgccactcagtgttcttttcaattcgtcatacaaaatcatttgaatggtaatttcggcatcaaattgcgatccaagcggctcttttagccgattggccgacgtaagcaaaaactccaccgaaagtgccaaaagccaaagaatcgcatgcatttctaatggcactaattgcaaatgttcttcgtcctttggcactttcaattctttcttttcccaataaatgaattccaaataaattttgatcaattctcgagcaattcggtctaaaatgagaaggcattagcaacaaatgtctaacttttcagtagtcattcattttacctntcactngttctctgtccattntccgcagttttttcatcgaaatttttctgagggcatttatgtgctta

SEQ ID NO: 4002 - DNA, 3456 bp, Heterodera glycines
aaaaagattaaatacgcgagaaataatattaaaaatagcaattaaatactaatttttagagctcgatgttttgaaaaaagcctggacctggacctgggttccatattggatccaggcccaggaaaaatccaggctcctcgagacctggaccaaggaaaagaccaaaaacatgcctggacctggacctggatttccaaattggcctagacctggatttcctggactcaggaaaatccaggtccaggaaaaattctggttaccaaaaaataatctggacctggtcctggatccagatccaggccatagtattttaaattgcaaaactctcaccaattcgcataacctccgggaattcgttctccaaaatgtacatatgttgtgcagtggtaattttgatcaacaatgcttttaccattttaatatttgtcagttcatagcacataaaatagcgaaagtgttcactcttttccaaaaactcatacaaattttcaccgctaataatattaatttttggcccagtgattaagctcgaaacgatttctgaattcttttctctgtcaatgcagtcaatgggcggttggaccttaattaattttacgctaattaatgagtgagtaccaaatgacctcaatgatgcccgacactcccttttccgccaaatgcctttcccattcgcctcttattgacgactttttgctgtattttaacatcagttcgataattgccatgccacttttgtacattaaacaaagacacgttatgtcatcgttcgtctcactttttgccactttgttaatttcgttcattcgcttttttgcttttccatttcttccaaaaattctttttcgttcattttctcgcccaattccccggcaaatgcgaacattccatcaatttttctctgcaaattccatttggccaagttcactcgcaatctcaaatttgtttcagacgaaacattgcccaattgtcgaatgaaatttttgaactggtcgattctttcatacccttaaaatgctcatagtttattctctaatttctgctgatttatttataaaacctaaattttcttccgtttcttccggtggccaattttcaccgcctttttccttttttgggcattggtgcgtcaatttcactgagtttcgaatgcctttaaattgctcatttgccactgattttcgttctgctgttatcgcttgcttctcacttttactcacttttgcccttttgttttttccactgagaacgaaatttgacgaaattaaaataataaataaaaataaaattagagagatgatttttcgatttattcgttccgaagtcattttctgaaacaaaaggcaattaattttgaaatatgataaaataaaagtgtttctattaaaataattttatcaataaaaaatcctcatattaaagcttaatcttatttcgtcagtttatcaaatttgccctaagctgtgctgattaattgaataaattcggtgttgccaaaatttgcatcactcagcctaaagttaatatattatttataaaattatttttaatttgttatataaatatatataacttagaagaataaatataaatttatataaaatataattatatttaaaatattaatcctataatttttattattttcaattttattcatttgaaattaaattctgcttgaaaaatcaaagcaatatatgtgttaatattactatccacttaacaaatatgtaaatgccatgggtaatgataaaattcttcaataaataatttgttgttggcacatttgaattggtgcttttacgtgtctattaataaaaatatttttgttggagaatttctttttgaaaattttttgacacgaattggaaagaatatcatggatttactagaaaaattaaaggggagggaccctttttgcaatttttttttgtgattccgttttatttcgtgaacgctcaggcttaagcctaagaaatcgaaaagtaccaaaaaaatgtatttttttattaccaaatacttgagacgcaaccggctcaagactcaaccgcccccagacgcaactggccctgacgcaactggtccagacgcaactggcccaacggcaactgccccaaatgcaaccggcccaacggcaactgccccaaatgcaaccggccccacgcaactggccagacgcaaccggccagaacgcaaccggcccaaacgcaaccggcccaaacgcaaccggcccgatgcaaccggcccaacggcaactgccccaaatgcaaccggccccacgcaactggcccagacgcaaccggtcagacgcaactggcccgaacgcaaccggtcagacgcaactgccccgaacgcaaccggcctgacgcaactggcccaaacgcaaccggcccgatgcaaccggcccaacggcaactgccccaaatgcaaccggccccacgcaactggcccagacgcaaccggtcagacgcaactggcccaaacgcaaccggcccgacgcaaccggcccgacgcaaccggcccgacgcaactggcccaaacgcaaccggcccgatgcaaccggcccagacgcaaccggccagacgcaactggctcaaacgcaaccggcccgacgcaactggcccaaatgataccgtccccagacgcaactggcccacgcaactggtcctgacgcaactggtccaaacgcaaccgtccccagacgcaactggcgatacgcaattggccagcagcaatgatttttgtgcctcaagctctaagcaagctttcgttattttctaagggttcccgtaagttctgatttatgtatcagtaatgttctgatttggagagtccaaatttaacaaaataaaaaatgttctgtttaccgaattctttataatttccttcagtttcaaagtcgccacttttggtttcttaaaagattgattaattttaccaagtttgagctaagttatgatttatttttagcaataaaaataaaataattaaatttaaatatttcaatcattgatacttttgtagcaccctatgtgttatacaacttttttgggcttgctttttcaatctttggccattactcatcgattttggcttcgttttcgttttccattttgtctgttggtcccccgtattcaccctcggggtgttcttcgtcctccgccccccccccccccttttttcttttttcctccaccatttctcttccctttccctctcttctcttcttttagacggtccatgtgcttggaatacacagcacaacagcagtgaatgaatgttttgcttctgcttttttgtcccttttcccatcgattagcgttcattccgtaaaatttaaaattttttgctcaattttttcaatttttgctaggtaaatttatttattttttaaggtcaaaggaaaaaaaagttgattagtgcctttagcaagggcgtaaccgagggggggggggg

SEQ ID NO: 4003 - DNA, 2407 bp, Heterodera glycines
  misc_feature (2269)..(2269): n is a, c, g, or t
tatataataaattttaaaaataatttttatcgtcgcaaatgtcgttttgactgggcgccgtaaatgtcgaccaacagttaatttatgcggtgagaatgtgaactttgcgcgccttggttttttaaatatttatagaaactaaaaaataaaatgtattttttctcgccttattgatcacgaatcaaaaaaattttgtcattaaaattaattccaaaatgacagtgccgggaaaaagaataagaccatcgggtacacctcagcagttgggcgctcatgtttgggcgccagcatgtttttggctaacattattggtatcatttttaaattttttcttaataattaacttacttcaaaagccaaaaattcttttttattttttgtaaggctaatagcgtttgttaagagcttatcgaatgatgccaagaatgttggatttggatgacaaataaaaaaaagttatagtggaaaaacgtgctggcgcccaactgacaaatgagcgagtccgatactagagaccggcgcgggacggaatcccgcgcgggattttgcgggatcccagtccgcaatggatttgcgggattaatcccgcgggatcccgtcccgcaaaaaattttggattccaatcccgcagcgggatccgcaaatttgaaatttccggtctctatccgataccaccacaattttcaattttaaaaaatattctttgactcttctaaaacaaaaaaatatccatatgctttttctttcttcgtttcccattcgtcaaaccaataaaattctttccttcgtgagtccccttacaaattaatcatttatttcgcctcccccaaatttttttttctttctgatcgatcggctggtcacacatatgtaataaagagtttactttattctttgttcacacattgcttacttaatatattcttttatctttcatggttcttattcctttttttatttgtagtatttggagaaaaatggcttattttgaacggtggcatcgttttcaggcgctaagaattatttattattcttgcatgcccaccaattttataaaactggtatcattcaaaagagcttaacattgggttgcagttttgaatttaaactcattatgcggttttttacaagtcaaatgtaataaatttattttttctcattttaaaaaatgcttctcaaattaacaattagagaaaccaaatattttatttatttcagcaaaccgcaaggcaacataatttttaaaaatggtcccgtcccaaaccacggaatagttgaaatttggaaaaaaaggtattttttatagttttttgacttttttcatccttcttcagcacacattttgctttttttgcttttgtattttaatgttttttttttattagttttctggtttttagcacataaatcccatctctgctgataagttatgtattatcacttacattcatttggggaatctttttcaaattcatagggaagttgatcaatgaatgaatgaatgataataataataataattccaattgcttattcgtcaacaataaatgaaaagccccaatagtttttcggcaactccaagcagttcacggtcatcggttggcgatgaacacgaacggtgtgagtgacacctcttttgagtccgcattttctgttcgttcttgctaaattaggttctgtgtttgttggccatgttccactagaaatgaacgaattccgacttggcaacatttttagccgatcaattgggcatgttaggtgattaataatgtcatttaattttttgattcctcagttttttccagaaaagttacaattttgcgcgactttcacactggacggagtcgggaatgtgccttcattcgctttgattccgaagattttgccaaaaaagcgatgaaaattcgctatgtttacgtaagtttgtctaacctgcagaaatttttttaaataataaaattagcatttttatgacccaattacggaccatcagctgattgtcaattcttacgacgcaaaattggcgaaaagaaaagcggaggagcaaaatttgaagaaaggagcaaaaaggacgaacgatgtgtggcaaagtcctcccaattttgtgcaagtcgacgacatttcgtcaacagttgaaatggcaggaaatgaggacaaagtgccagaaaaggtgggcaaaatgcgaagcaaaaaattcaaaccgatttttcagaaatttttctattcttacatttgaatccattttgggcaaaaaatatacctttttganattttttcaactttttgttcggtttcctggatcgaatttggttggattgggtttcatattcgttgattaaacggttccccagtgccccccggaatgcttcggagaaaatttatgctttaccacgattttaaattatga

SEQ ID NO: 4004 - DNA, 1487 bp, Heterodera glycines
tgtgcctttatatttacgttctgtccgtcagtggtcaaacaaacacttttctttcttttcccccatctgtcccacaaatatgtatttttctacttttcccattgtgtgcctcatcttaatcattgttcatcatgtgttaccaatttatggtattaatcaaaatatgaattgaacataagtgaataaattgtttcagcatttgtttgatttacgttggtcgggtcggttttttattttagaaaaaacaagaaaatacctaaatgcatgtcccggcattcgaaattggtacaaaaaatatcagatttatgttcagcgactccgaaaaccattagaaataaatcacatttgcggttaataatattaccccaaccccagttacatagcttaaattagtttaaaatatacaacaccagaaaagcaaaacagacaaaatgaaaagccatcctaattttccaattagtacaaaatgaaaagccatcctaattttccaattaatattttcataaagcattaaaatgaccatgttcaaggaactgaccaaccgacaattggtcgccattgttatgttggcaatttcgaatctgtgcagcactgtggtggtcagttgcataggaccaatttacccgggcgaagctaaacgaagagggtcacttttgaattcacatgcaaaaagctaacaattacggggcttcagaatgtcagaggctcaaatcgggttggtcttcggtttgttccaattggtgatgttcatttctgcacctcttcttggcaaatacgtaaacatttttttttgatttttttgccattttactaattgaaaacaaaattcagatgcatgtgattggctctaaatggatgtgtatcgctggccttcagatagccagtttggctgcaattgcatttgggtacgttgtttcttgaattcagcagaatatctttagttgggggttctgttttgcagttgggttccttcctaatagtcatcattgtttaaaattttgaactgcttcaacttcctaaaccttatccatgctgaatgtgttgttccttccattcccatttcgtccgttacatccttcccttttcacagtactctgaattggatacatgacggcttctacttcttctgggcttctttgttcatccgtttcatcgaggcgcttggcgaggcgtgctttctgactgcgtcgttggcaatatgtgccaaatcctttcccggccgaatatccgttattgtggtgcgtgatttgaggcatttaaaagcaaatttgttcacttgtaccagaatttgattcccccttttttatggctttatggaaactgtcgcgggtttcggcttcactgtcggcccactgattggcggtgttttgtacgacaatttcggcggtttccaagtgcctttctttgtgctcggctcgctgctgttggctgccactattcttgcctattttctcatcgatgaggtcaaaggtcggcgagcaatttca

SEQ ID NO: 4005 - DNA, 3038 bp, Heterodera glycines
  misc_feature (1696)..(1696): n is a, c, g, or t
  misc_feature (1782)..(1782): n is a, c, g, or t
  misc_feature (1883)..(1883): n is a, c, g, or t
gagcgagaataataaacacagcgccaacgatgagaagcaaaagttgaaaagggcacaaaacggaagggagaggaaaaagcattttatgggaggaggaagaaggacgaaatattatttattttgtgtattgcgacgaatgaaaaaaagcgcaaaaatgcccatttaagtaccctgtagatttaaaaaaagttataggtagttggcctagtacgatttggggttttcccatgcttttccactataacttttctatataaagcagcagtttttttatgcattttcatttctactgatttttaattttatttcactcccctttccccgcgctttttgcttcctcaaaaattcttgtttataataatatttagctccaattcattgtccttattattaatggcacatattcgagcgaccgcacaaaaaaacccacctgaaaaggtgaatcactcatttctatgtacatatgtaatctcgaattttctttccaaaacaggccaaatgtttatccgaactgggacctgatctccgtgacgacaaattggacgtcgacggacaaattggacgtcgtcattcgcaaccagcacgaaatgaaggagcagcagcaggcaatgaacaacaaattgaataacggattcaacatcgtcactcgcaaccagcacaagctttataagaagatggcaaaaattgagaagaaccagcaccaactgaagaagaaccagcaccaactgaagaagcagcagcaggaaatgaacaacaaattagacgtcctcatgtccatcaatcagcagcaacaacaggagcagccgcagcagaacgtggtgagttagtggcagggataaatgcattttaaattttctcccattttaagggtccaaatggagcgcgcaacttgtttgatgccttggcaaataagtgcaggaacgtgtgaaagaacatgcgatggacaaagctgtggaactcctcgccaatggattcgatgcacctacacacaaagttctccccaaaaagtgatgctcctataacctgatctattcaatgtgtatgatgctcctatacctgatctattcattgtatatgtttgtatgatgctcctataacctgatctaatcattgtgcatatttgtatatatattgttttacagtataaccgtcacttgcaatgaatattcaactcgttgtataaaatgaaaatgaattggcattctaattcgactcatttaactatgctagatctgtgtcaaaccaaatttctgataacgaaaaacaaacgcttttcaatgaaccgatcaaaactaattctttaacatttgcttagaaaaagcttcaattctagtcggttttacgcgtcccattacattttacgcgtaccatgatactttacccgtaccattatttactcgtcacaaaaacagttttttcaaaccgtcaatcgaaacattggtaattctgtcaatggtacccccccccttttttgagaaaaattatttttgttttcaaaaacatgaaaacacgttttcagggttttcggggtcgctgatcacgaatccggcatttattccgaccaatttcgaacccagacctgaattcgaaccaaagttcgaaaattaaaatttttcgaattttgtatttgtcgaaaccctaggaaacatgctttcatgtcttttgaaaacaaaaaaactttttctcaaaaaaaggngggggggggttaccatcgacagtattaccgaaactttatacctttcgaatctctaattgttcttgattgtatactttgattattanaatatgcaaaagcaaccctaagcacacttaatgatatcattagaaactaaaatttaaaaaaattacaaaaaagaaagcctaagattaagcctaaagcttangcctagtctaagcggtaggggtcagttgcgtctggccagttgcgtctggccgattgcgtctggccagttgcgtctggggccggttgcgtcttggccagttgcgtctggccagttgcgtctggcgccggttgcgtcttggccagttgcgtctggcgccggttgcgtcttggccagttgcgtcttagtgattaaagggccagttgcgtctggccagttgcgtcttagtgattaaagggccagttgcgtcttaaatatttggtaaccaaaaataccttttttgtattttttcgttttgtgaccccaaagaaattatcaaataaaaagtgatttctagggtaatttgtgatgctaatcacaaatatgacctttatttttcaaaattccgattctaaaccagaacttgaactaaaaggatcgggtgtcatgacaattcgtacaaaagtagaaaatccgaactcgaacaaaacattgatttttgataataaaaggaatggtgtgtccccccattttcgaaattttttttatagttttttctgaaataaagtgcttatgggttttggggccggagaatacagttctgactagaacccggcgcggggaacgggatcccgcgcggattttgcgggatcccagtccgcaatcccgcattttttggaaaatgcgggatttgcgggattgcgggatttgcgggattaatcccgcgggatcccgtcccgcaaagaatttagagttccaatcccgcagcggaatccgcaaatttgattttttgtgcgggattatgcgggattttattatttttttgaaaatttttctaagacagaatgccaaatatttttaaataaattaaataataaatttaattaaagttaactcatttttcatcgcaaatttcattcaaaatttgtgaaattttcccggcggcgcctatcggcaccgccgtactctcctccaagttccaaaaaagtttttgaaaaaatcgcgctgtaaaaaacatgtaaatagtcactccttttcccaaaaatgttctagaataatgaaaaatgacaaaaaaagattttgaaaaaataattgaataattttttcaagcgaatatactaaaaacatttgtgaaatacctattgcttggttaagaattaaaaaatttagcatattaaa

SEQ ID NO: 4006 - DNA, 2056 bp, Heterodera glycines
  misc_feature (1922)..(1922): n is a, c, g, or t
  misc_feature (2002)..(2002): n is a, c, g, or t
  misc_feature (2031)..(2031): n is a, c, g, or t
  misc_feature (2036)..(2036): n is a, c, g, or t
  misc_feature (2039)..(2039): n is a, c, g, or t
ttacaatataaaaaatcttccaatcttttgttaacagatcagtcaaggcctggaatgcccttgataaaacgttaatgtctagctccttaaacacctttaaaaaattattagaattgactcttgattctgaaagcaccaatgtataaagaattattaacttttgaggcattttattgactttgacctcgattttattttcatataaatttttcgttattgtttaagtgccaacccatttttttgatgttttctggatggaaagatatcgatttgggtaaaaagactatgaaaaacaatacgaataaatcgcaaaatatgcgcataaaatatgcacaaaaaattgcaaaatattcacataaaaagtgaaaaatatgcacataaatttttccaaattgagggcaaattttcaaatttcttcaagttgttaaatttaagcataaaaatcccgaaaatagctaaaaatagtatgaatgattattttagaaccaaaaaagtaatatatttatttattttgaagaaaattgagcaaaaatggagaattttcaattttctgactatttttggcataaagcttcaattttttaaaaagttacctttttatcagaaaatatacccaaaaatctgatatttttgaaaaattttcggtcattagagcccaaatggccgctttaatagagggggccgtttaatagaagatttgaaaaaatgcccaaatatgcatgaaattccgaaatatgcacaaatatgcaaatacgcacataaatcgcgaaatatgcatatggaaatcaattcttcttctagaagcttctaatcaagttaaaaacatgtttttcatgcgtttcaggcctcccgcagttcaggaaaaaaatatgcatgtgcatataattaccagccctagtaataattgtgcgaataatcgaacacctaattcttcacacgttctctacgataaaaagcaaatatttcattgaagaaatttttgagcctttttgtagttctttggggaaaatcactcaaaatttctttaaatcctgctacatagcaaaaccgcaatgaaaattccaaaaattttctgaagtcgttggccaaaatcaaaatatcgagcttcgaatttgaaaaatgttcgtttctgacaaaaaaaggctttatttaaagggcgtaatcagaccttttgcttcggggggggctgaattaaaaaaatttgattttagaggttatttttcagttttcttaaatcctgaattaagggggtgtattttaccggaatttttaacggttttcgcaaaaaaaaatccctccgctcgctcgggctccccactcttgcttcgtcatcgcatgctcgctaagagggcttttttttggatttttttataaatcctagtcatatttccgtattttttttaaataaatccattttagcttttcatagataaaatcatatgatgaaaagcatagatttttgcagttttgacaccaaattcttgattaatgcataaaattaccccagaaaagtgcgtgctttcctttgttgggatcacgacatttttatgggcggggggcataacggaaaattaccaaatctcgaacatttattttctgtcgacataagcacaataatacatacatatcaatcaggaggaaattgggagtgtgttcagtatacaataagtgccgaaatgaatgcgtgggggtgaaaggacaaatggtgaattatatacaatataacgagcaaatagatcaacgtcatcgacacgatacaatataatgagcaaatagatcagcgtcctcgcggcacgtcactcggttcatcaccagcgttcagttatcggtcatggcaccgtccgattcgtcctgattgtccacgtcgacgtgcaatttgtcctgcattttgatctgattgcgcgctccatttggacccttanaatgggagaaaatttaaaatgcatttatccctgccactaactcaccacgttctgctgcggctgctccctggttgtgctgntgattgatggaccatgagggacgtctaantttgntgntcatttcctgctgctgc

SEQ ID NO: 4007 - DNA, 1351 bp, Heterodera glycines
atttgtcctgcattttgatctgattgcgcgctccatttggacccttaaaatgggagaaaatttaacatgcatttatccctgccactaactcaccacgttctgctgcggctgctcctgttgttgctgttgattgatggacatgaggacgtctaatttgttgttcatttcctgctgctgcttcttcagttggtgctggttcttctcaatttttgccatcttcttgtaaagcttgtgctggttgcgattgacgacgtccaatttgccctgaatgcgcatggcaccgtccgattcgtcctgattgtccacgtcgacgtgcaatttgtcctgcattttgatctgattgcgcgctccatttggacccttaaaatgggagaaaatttaaaatgcatttatccctgccactaactcaccacgttctgctgcggctgctcctgttgttgctgttgattgatggacatgaggacgtctaatttgttgttcatttcctgctgctgcttcttcagttggtgctggttcttctcaatttttgccatcttcttgtaaagcttgtgctggttgcgattgacgacgtccaatttgccctgaatgcgcatggcaccgtccgattcgtcctgattgtccacgtcgacgtgcaatttgtcctgcattttgatctgattgcgcgctccatttggacccttaaaatgggagaaaatttaaaatgcatttatccctgccactaactcaccacgttctgctgcggctgctcctgttgttgctgttgattgatggacatgaggacgtctaatttgttgttcatttcctgctgctgcttcttcagttggtgctggttcttctcaatttttgccatcttcttgtaaagcttgtgctggttgcgattgacgacgtccaatttgccctgaatgcgcatggcaccgtccgattcgtcctgattgtccacgtcgacgtgcaatttgtcctgcattttgatctgattgcgcgctccatttggacccttaaaatgggagaaaatttaaaatgcatttatccctgccactaactcaccacgttctgctgcggctgctcctgttgttgctgttgattgatggacatgaggacgtctaatttgttgttcatttcctgctgctgcttcttcagttggtgctggttcttctcaatttttgccatcttcttgtaaagcttgtgctggttgcgattgacgacgtccaatttgccctgaatgcgcatggcaccgtccgattcgtcctgattgtccacgtcgacgtgccatttgtcctgcattttgatctgattgcgcgctccatttggacccttaaaatggaagaaatttaaaatgcatttatccctgcca

SEQ ID NO: 4008 - DNA, 2539 bp, Heterodera glycines
aagtgataatccgtttactgtgtttgttgtttgagttttgtggtgataatttatatatgtagccagatatgctcacgacattgacaagatgtactcggatttgttccgtttgtcccacaatggagcattggatttgggatttgaccaaaatttgaaattctccattgaatttattttgttttacattgacattgaacgtcttttcaatttggtcgatcattcacttttaaatgagaaaaaaagggaattaatggaagagaaacgcaaaatgttcgtcaattttatgagcagcggacagcaaaaacattcatttgtccggaactgtgaagcttggaaattttggcacgaagtcagcagcacatttggtaaaagagtttaagcggggaaatcacaaaaagaactaattcgtaaaaagttagagaccggcggaagtttcaaatttgcggattccgctgcggcaaatgtttgcaggacgggatcccgcggggttaatcccgaaatttccaaaaaatgcaggattgcggactgggatctcgcaaaatcccgtgagggatcccgtcccgcttcccggctctaataaaaagtgcaagtttttgaacagaaaaaaattcctttgaaatttttggatgaaattaattaggttaaattttcttccatctctaattcttgcctactctcttactttcccccactctctcctctttttcagttaaacgaagtttattcaacgaaaacacaaaagaagaaatgcaaaagagaaaaatcgtcgacattaagaaaatcaattgtgaaaaaatggagaaagcattaagtcaaatgggagaagccaagcaaaaaaatgcggaaacggatttagctgaattttatttgctcgatttggaactcggccattttaatgcaattcgctttttattgggcctaaaaggaaatggagagaaatggtaaatgatcaaaaaaaatggcaattacgttttggttgttttataggaaattttctgaatttttcgatgtttaccaattgccaaaagagtccaattttgcattccaacttcggattttacacataaataatgccaaagtgaaattgactcaaatcaaaaaggaaatgaagcaattgcttgacggaaaacattggaccattctcgaattcgaggctctcacttatttggccccgggtttgttatgaaaagtattgacagaggcattttataaatcctttaaaaaaactaggtagggtcaaaggtcgatttattaattgaagttttcgtttttcgggtccccggctttgtctttggctcagaagcgccgcttttcggtttaagttaaaagaccgtgacgaaccctaataaaaaaacgaaaaaatgaaagcaattaaaagcatttttaattttatttaaatttatattattattattttctttcgttctttagaactattagatgagcaatcacttgcaatgaaatatttaccaattatttcaatggggcacaacgaaatatttacagttgttgaggcaggcgtaagaatttattttggaagaatttggaaaatttttttggcattcaaaaggcaagaaaaagactccgttcaaagaagtgattgggcagcgattagcaaaaaattggaaaacaaattaaaaatatttttcggagaacaagtgaaaaaacattcgttgtcattttcccacaaaatttggttagatttggccaaaatgtacaacgaaacttttgcgttgaatgaaaatgaaaaaatggcaataaaaaattttgatttttcaaatttggaattgattgaacaagaaatagtcgaggatcattgccaaaatatggagcaactgatcggtgggaaaaatgaattcagtgaagtcatcaaaggggcgagtaacttggccaaatttcgagtgaagcaattcattacggcgagattaaatcgggaaaatttggacgaagaaaacgaattgatggcgaaattccctgcccttgggcaaatgcttcaatttggtattttaacttaatttcattaaaattcttctatgaaacaaatccgtaccaactgcgttaattaaagcgattagtgtttaattcacttttggcgattttatttttcctccgattaaatgcaattacaatttttcctcattcagcagtcattttgccccctcccctgtttagatgatctgtcattttcgatcattgatcaataccagcgtgtgctgatgcttgagactgctctgtccggcgccgacttggacaccttcaacacaaatgtgctttattatgtatttagacaaatgttgattgaaaaagtggatgctagacaattagtcaaattaggtgcacaaaatgcgcaattgggacgaaaagtcgccgaattaatgcacgcaaatgccgacggccgattggaaggcgaggcggagaagcgcaaacaaatttgccacttggaacgctttatgaaatggtatgtgaaaaacaatgaaaaacaagacgaaagtgggtaaaaaagggacagcgacattaattcaatgctcggaagtgacga

SEQ ID NO: 4009 - DNA, 1849 bp, Heterodera glycines
attgtcttatttttgcgaaagggcgagagagagagagagatagagaggggggggggggagaaagacgaagagataaacagtcattagtcatgaatttaattaaatttcataattaaatattttatgcacttaaaagggcccaaagatagaatctgttgatgacatttggcaagcatcaaattgtgaagatgaaaaggtggcaaatgaagcagtgcaaagactgtcaaaatgccccatcattgagcaaattcatatccgacagttggccgtattttattaccaacacgagtttttttcaaattttttgcatgctaatgcctacaattttccaataatcaaaaattcaggtgctaattaaatacaatagactatccacttttataatttttgcggcctaattacccttaattatctccctatttttctcaggtttgaatttgtccgaaaacgcttctgacttttactatgaaatgattttttcgccttacaacgacgataatcaaatgtatgcagaaataatgctcgcattaagatatgccatgattcgcatttatgggctaaaggaccaaattaaggggtcgcattcggaggatttggaaagagagacaattcgaattttgatagtgttgcgaatcattgaactgtttgacgacagaatgccaaatgtgcgaatgctttgcgttgcgatgtcatttttgaaaatgataatagacaaaagaaaaaccaaacggtaatttatttccccgggaaagcttcataaatttgttcatcaaaattttaaaataaattgcattttaagtctttcgtgggacccatccgccgtggtcgctcagtgcctggagacagaagctgagccaatttttgctgaacagcgattttatatggtgccgtaccatcaggaatatttcaaacagtttttggcgttgtgcaaacgtgatgatgcactgaccacaattattcgggaaggattgtgcaaactcagcctgttgagtcggctgatcggcgacgattcgctctttaggctgtttaatttcacactaattcgcgagaaattaattgaccgaaattgtaagtggaaaatatggaatataaattaattcaacttttaatttatatatatgataattagaggtgccgagaattcattttattgcacgtaacaaaaattaacaggcatttaaatttgatttatgatttatttttaaaaaattgggaaattgcaacaaattctatacttttctctcagttttcaacaacaaaaaatttttgctgtcgcaaaattatcttggattattgatcggtcgaactgacgaagaacgacagaccaacagagtgttggccgatctgatcgtgctaacgaccaattattttgaagtcgacaaattcgggcattcggaagcgatcagaaaaattgtggattttcagtggttgcactgtcgctttttgtacgaatcggtcgttgaaaatgtcgaagagtcgcggaaaatttcgttttttgtcggcatttttataccgggtaaaaaagttaataataataaaaattgggaatttttataaaaaactcaattcatttttcgctgaatttcatgaatttagaattaataaaatttttggaagccaataaaatgttggcaaataactcaaagaaattcactaacgctttgcaagtaacggaaagagaagcggttgcggagatggacacgcaatggttcaactcgaaaaatgagtatgcaaagccaagcgaaattgtccaaaaaatgcattttgatcagctaatgatgctgcgaaatgacgaaaattttacagaaatttacaaaggtttttcattaaatattttatttgatattta

SEQ ID NO: 4010 - DNA, 2791 bp, Heterodera glycines
ggtggtggcacaaaggtcaagctaaaagcctttgtcgggcgaaaagccctgacaaatctctttaagactgcgataatgacctctcagagaattcttagggacctattaatacatgaaaattctatatttgggctgttattaagataaatttttgcgtgtgcaggacctaattattaatgaacgtttatgaggatttgcgaaaagaaggcctccgaaaaatgtattatgggcttcaaaaagtgaaaagcacacctaaagctgataagagaatacacagcaatacgaagccaaatttgaagagaaaaaagaggcggaaaatgtggaagaggaaaaagaaaatgaaaatagagaaaatggaaagaagaaaaatgatgaaaatgctaatgaaaatgatgaaaatgttaatgaaacaagggaatttttaacaggagagattgtgcccccaaaaaatgaccatggaaaagtattagctcctacagaaagttacagtaacaaattatcaggtttctaactgacaatcataattattttttacattaattcagcattatgtaaataaggctgagaattttagtcacgaaaaatcaaataaaagttgactaaaattcaaaaaaaaaaatagcaaagtaataaaatccatattttaaactattttgaatagatttataaaaatattaattttgatttgcaaaatctgataaaattgggcgattgttcaatttcgggatcttctcaacaattgtgaaaagtttctgccggatttcaattctcctttttcttttaagtcgctttaaggccatttcgagtcagcaaaaaaaccaattgacttcaattctcatccaaagtaataaaaaagaataaatgtattttttaacgtttaattaataaattatctctcgcaacatttttaaaaatttaaacaaaaagcatttcaagaactttgcaacaattcgtttctttggcaagaatataaaaatttcattttaaatgattttgatgaagaaaatatgaacatgcttacattgggtggctttataaatgaaatagaggatcgtttcaaaatggttgaaaacatcagcaaaatggaaaatttaagcgattttatgtgcaaagaaaaagcacaaaatttgctagaaaaatgggaagaatttaagaatgaaatggaccaattcaaaaaagtgaataaaaaagaatttgaaaatttggaagaaaaattatacgaaaaactgcgaaatttattgctttttatcgatggagaaggccaactgagcggacttaacgtgaaaaacaattttgcgaaggcaaatttgaaagtacaaattcatttaaaaaatattttgtgggcattaattagcgacaaaaaaatggggaaaaattggcagaaatttgacaatgagacgaagaaaatgaaattgtttaagctccttcaaactcaaatggagcaatttaaaattgaacaatcaatggagaaaatggaaaaaatgatggaacaaaatgaaattggtaattaaaatgtttatttttttaaattaaattaaattttagacaatgaattgttcgagaaaagcgcaattaaagaagacgaacaacaaaaatatttgctcactattttccccttgcattcacaacaaattaccattgtaaatcgcgattatttggtgaagaagttcaacgaaaatgtttgagatttattggattaaaattaattaattcattcattcattcattaattattgcttaatttagtttgacaattacttgacaaatgtattgtatcaaaatatttactacaaaaaggagtttgagcgtaaaagagaagctgcgcttggccaaataaatgcaattgtcgataattgggcatgttaatccgatttaattactcaattacacttaattaattgccacatttgtgccttttccagtccaataagcatgcccgactgctcatttcgggctcacttttgctcgatgtgcacacaattggctcggatgtgaatttgttttgtgtagcgcccggcgaacggctgaaactaagcgattttatgggaagcgataaaaatgggaaatgcatggaaaataaatgcaaaagcgaagaagcggacgatgcaaaatcacttttttgccaaatttgtgaggtaaaaagtgaaacattattatttgtttgggttaaatggcaaaaaataaaaataaataaatgaattaataaatgaataaatgctcgttaatcctattctatatattaaataaagctaaaaacttaatatttttaaacgaattaatatatttaataggataaaagcaccgccaatctgattaaaattgagtcagccagcattttacttattcgatttgccttcgatggcatcgaatttgacatttcattcgttgtcgtcccaaaagtgaaaactttggcacataaaatggatgacaacgaattaaaaagtttattggaacactttgattggtcggtcaacgaacaaaagcatatgctacgcagtctttcgagtaaaaaataaataaaaattttaatttttaaataaatttttacattttaacttttaaaatataaaggttttcgcgcaactctttacatcttcaatttgttttataaagaagcccagcaaaatgtaaacgaactcaatgaaagcagaaaaactttccaaaatttacttattacactgaaaatttgggccaaaagtaaatgaatataaaatttaaattataaaaatatttagtttttcttcgataaaatagtataatataccacccctccccgtcgatgagagttgaa

SEQ ID NO: 4011 - DNA, 1859 bp, Heterodera glycines
  misc_feature (41)..(41): n is a, c, g, or t
  misc_feature (73)..(73): n is a, c, g, or t
  misc_feature (78)..(78): n is a, c, g, or t
attttactcgataaattcttcttatttatttctcgaggttnacacaaataattaatcattttaaatagaaatntaatnttgttaggtaccctcaaattccaattcaattgtcaaaaggcaatgccatttcgccaaatgccaatttgttcctgtcagatgcccgcgagttagaaatgcctgttcttactccaacttctctcgtgcaaaatgctgctcgactcgtcacacattcaaatgcaaaagtcatccgtcgccaaatgtttgatggtaaataattaaaaaattgtataaaaaatttaattaatttaatttttattttaaatatggaatttatttttaatattaaatgtttttgctaatattttgtaataataacatattacagccactaaaccaaatcagctcaatgaaaaataaacaatttgaattggacgcactgctgaaaaattcgattccattctctcaaaaagtacaaataaaattaaagaaaaatggcaaattaattcaaatttaaattttgtatttattttttcagtttggcaatttcatcgtcattaattgtgttgccgaagacaaagaagaagccgacgcattttgtgactttgttgaatggcgaatgcgcctccaaatcattttcgacattgacaaaaaggggggaggaggcattgagacgcatttgtacccaaatgtttaccaagaaaattgcattttaacacaaaaattggtgaaattttcctttcggtatgcatggattattccttaaacgaacacttttattatacctattttcccacattgaataattcaaatttgttcagggccaatcactgcaaaatttggcttctcggaatttacggaaaaaacgcaattagcgaaagaattacggcgatggcacaaagtttcgacacgaccattaaaaggcattatttcttgaagaaagttgaaaatggcaacattcgaaagatcgacgactttttcaacacaacgaaaattgaacttaagtcgataatggccaaaaaggaagaactaatttgaattttcaatgctttttgtttttatggacttgtattcttttcctagaaatgctaagctgtttactattttattgtgtataagattattatttttatatgttattatcacatatattgaccaaatttgatataaatattaccaattggcaaccatttggttgatgttgtaattgtttgtgagtaatttatgcttaaatcatttctaggccatatttgtaaaaatctaaaaattgatgttttgtgatttttaaaaacgaaaatatgatgtaaaaaagtgggactatcttatgaagttaccaatattttttttatcggccactaattaaaaattaaaaaaaaaaattttcaggacatatcaaaacatctccacattttcatttaattcagttttgaattttgtttactgacgctgttgcatgttcaatttttctaaaattttacgaaaggtgagctttggaattagggatcgactgaatgcacttttttctaatgactagggaaagcctaatatgcacgaaaacttatttttagtttttctaagaaaatttagacgcatttttggcgttttttatgctcaaaatcgcctgttcaatatataatattaaaaaattaaatgaaaattttttacattgaaaaattgaaacaacgaaaaaaaggaattttaaaatatataatttatttttcattattttaaattaaattttcactgatttcatccattttcaatccgttcatcttgtcatcgttgtattatttaattgtgataaaatatttttttaacttaaaattgttctaatgctgaacaagcattgaaatatttacaaa

SEQ ID NO: 4012 - DNA, 1044 bp, Heterodera glycines
aaatattagacaaattaaaaaaattgtttacctttccaattaacaaacaataactttcatccaaaggccaattccttaacaatcgctccagaaaattttgcaatatgtcaacgaacaaaggtttccttaaatgaaatgaaaagaaatgtgaaatttcgaaaaggaaagacaaccttaacaaaagcaatttgagtgaagcgaagtcaccgtcttccgtttcagagaacaaaaaagtgaggtaatggtcgagaataatgcgaaggacttggaactgggcaacacttggccaatctaaaacaaatgccatgcctttcaaaattttattgttctttgaaacgattttataaatgatgaatttgaagtgtcaaacttgacagagaagcgacatggcttaacattgtgccaacaaattggaggagtcgcgggtaaagcgttttgaaggcgcccgaccgaagagaaacgtgctcaagtggggcacattgggccaacacttcggggcgcagcaatctgcgcggactcgtcactgccgacgttggtaaagaggagaaaggagcagaaatccaggtagagttcttcagcaagttcagcttctgttcatcgacgggcaacagatattgcaaataatcggccaaaagccacatgtaaactggaaaaaataactgagagattgagggaaggaaaggccgtatcagcgaaccgctctcagtcgcttccttaaccgtagctggtgaacgaatgcagtgtcgactgaacagctcgatgaactcgtcaaaaagtgcatcattgacgtaaatggtctaaattaaatgcaatcagaaagaggataatacagattggttagagcagtcctttttgtggcttagaatttaccagtagatgattttgcataaaaataccataaaaacggtcgactcaaaaccaatcaatgcgttcagtcgattaagcgcatcggcatgtagagaatcgaagtgcggttttagaagaagaagatcaactgacggatcaccaagaagcgtttgaagaacagtgcgagcgaattcctcc

SEQ ID NO: 4013 - DNA, 4654 bp, Heterodera glycines
ttttttctgtttacttacacataatgatgtatattaagcatttccatcacaattatagtgaataaaaagtatattcacggtttttatccaaaaaaatttttacaaaacaaaagggtcccccccccctatggtttttgataaaattcaaaatctatcacattataactagcgccaaatttgtttaacaggcccaaataattgtcatattcgtgatcagcgacctctaaaacccccgggtacttggtttcaggactttttaaacaaaaaaaattgagcaaaaaaaagttgaaaaaattttcaacacctgtcacctttaaactagcgccaaaaaatttctttccattttacgtttattttttgcttcctatactaaaaatggtttggaaaaagacagcagacatttcgatcggtggcaaggtgccacttgcgatttatcactccaaccggtataactattaatacaatgttaaatgttacaacaaaatgtttattctttgaagatcaaaaatttgcgtatttgtggccgatacacctgggccaatggtggatgggcaaataacttttggtaaaaaataggaatattaaaaatataatttctctgaaaaatatttgcttgtttgaaatttgttgatactgaataagaaccttttgaaaatttgttcagtcaccgaaacacgcacaaatgatgggctgccccacacgttggagcaccttgtgttcatgggcagcaagcagtacccctacaagggcacgttggacatcatcgccaaccgctgtcttgcgagcgggacgaacgcgtacacggaccaagaccataccgcgtacgaactccgcacagccggaagcagcgggtttttgaaggtgctccccgtgttcttggaccatctcctgcgaccgacgttgacggtacaaacaacattggcaaattggcggttttggcaaaaaatgatttaggcatttcaaaacttaaacatcaatatctttttttgaatcatttattttaaattttactttcagcagtcacaatatgacacggaggtgcaccacatcaatggcgagggcaaggtggcctcatttatccgccaccaaaaaataaaaagaaaaattacaataaatttcagaaattcgggggttgtctacagcgagatgcaggcgcgagactccgaaatggactcgatgttggacaaaaaaagaaaagagctgttctaccccgcgggaagcagctacagagcgatgacggggcggttggtttcgactcaaaaatcaaaaaaataaaataaaaaacaaaaaagaaaaattcgtagcaaaaagaatagaggatgacttcgaaacacactcaaccataaaaaattccggcaatcatcaagaatttgtgtctcgacgaaaaaaaaatatggcaggcgtttttttctaggcttaaaaaagcgctgattacgaatttgattataaggttttgttcaaaatatgagaaatttgaaggtttttgaacctttaagttcagcgaaatctgttaaaaaataacaaaaattttcaaaaacaatccttttaggcaccctctctgacatccgcgaactgtgctcgctggaacgggtgcgaaactttcacaagaagaaaaaagacgggaaacgggaacgggattcccgggttttcccgcggcattcccgttcccgtccaactctagttttttgataggtcaatgaggctagattttcaaaatgaggctttttgtggtttttgagaaaacccgcaaaataaagaattttttaatgaaaaacggaatggaaaatcatcaaaataaaattttgaagcacaaatttgaaaaaaaagtgtcagattttggtttcgttttagagcttttgcttagtttgaaaaattagatttgtcttgcaattgccgattatcccatggtgagtgttctttgcttacccgcgcctcccatggcatttcacgagtgtccccacaaaatccgaaaccgttgaatatcctatcaaatgtagtaggccccaaaacattttatttttcagtctcaaaaatgctatttggacgcttaaaatgccacaggacgaatgaaatgccgtgatggttggacgcataaatttaaagaagtccaaaaagcaacagtttcaattcacaagtgatttacaagggattacagctttattgtccgaatacattcatacaatatatacatatttatgtacacataatttgggtgttgcattgaaattcgttttgtgaaatttttaattcgggcggcttacaggtcggccagcgcaacatttggatggtccgacattgctcaattgtcgtcgttttcgttgtacacagagaagggatgattgatgaagatgaattgccgataattaatgaatgatgaaaataatggcaaccaaatgaattttttgtgccttttatatatgaatttatccgaaaaatttgactcttccgactaaaaaatttgctatttaaggcccacacattttgcttatccacgttcattccgttcattcattccatccacttaattattcgtcctcctccaccgccacttaaatcgtcagtttatttaggtaattaattgttttgttatgtgcattttcattgtgctaattgccccccccccccatttttcagcgaatggccaacgcaatgtacgcggcacgggcgcgcgcggccaaggcggaaaagcgtcaagcgcagctgcgcaaggcggccagagcaagggcaggaaacgtaagtttagattaaaaaaaaattttaaaccgaaaataattttccccaattgttttccccacagaccgccaaatcgcgacgagccgagcgctgttcaatttgcctgggccgactgagccgaatcacgcgtaccacgatgggctgccaccatccgctgcaccgacgctgcctctacaattgggtgcgcgtcaacttgttttgtccgatgtgcggccacgattacacgcgcgggaggccccgtgatcgccaaggacgccgcagccgcagccgcagttattaaggatggaagaacggacgacggatcacaatgaatgattggccgagtgtatttattgatgtatttgtgatggatattcttcatttgttgtctcatataaccatgtcagaacacacgcattgtttgtatcacttaccttatatttgtactgaattgaatgcataaaaattctgtttgctatcgctgtttctccatttgtgccaaatttgaatttcaaaaatagaatttttcttttttcgactcatcagtatacacgccgagtcaattttgggctcccagttcaaaaagtaaatgtgtgtgtggcaaagtggtttttgtaagatagtaaaggaacaaagggcggaggttcgagtccgttttgcaacatgaatatttttatttatttttgtccaaaatattaaaaaatgacgatttttgggaattatttttgaagctttttggcaaccaaattgcataaacttggtatcactcgaacgctcttgttgaggagaacctttatacgagccgtcgtggtggcatttttggttataggagccgtcgtcgtggcattttttggttataggagtcgtcgtcgtggcattttttggttataggagtcgttgtcgtgacattttttggttataggagtcgtcgtcgtggcattttttggttataggagtcgttgtcgtggcattttttggttatacgagtcgttgtcgtggcattttttggttatacgagtcgttgtcgtggcattttttggttataggagtcgtcgtcgtggcattttttggttataatagtcgttgtcgtggcattttttggttatacgagtcgttgtcgtggcattttttggttatacgagtcgttgtcgtggcattttttggttatacgagtcgttgtcgtggcattttttggttatacgagtcgttgtcgaggcattttttggttatacaagtcgttgtcgtggcattttttggttatacgagtcgttgtcgtggcattttttggttatacgagtcgttgtcgtggcattttttggttatacgagtcgttgtcgtggcattttttggttatgcgtgtcgtcgtcgaggcattttttggttatacaagtcgttgtcgtggcattttttggttatacgagtcgttgtcgtggcattttttggttatacgagtcgttgtcgtggcattttttggttatacgagtcgttgtcgtggcattttttggttatacgagtcgttgtcgtggcattttttggttatacgagtcgttgtcgtggcacgcccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactagagcatcagagtgctaaaattaagttgtaaataaaatt

SEQ ID NO: 4014 - DNA, 1868 bp, Heterodera glycines
aataaataggtgacccaatttcaacataatgataaggcaatgggtcaccaaaaaggggaaagtcgtggaacaaaaatcggtgacgacctgccaaaagacatcaaaaaacagcgcacccaaacggacactgcgttcattgaggccacagacgagcaaaaaatttgtcatcagcgaatcctgggcattgagtgtgacgccatttgaaaaacggaagcgcaggaaaaattggcaagcgatgaacgcggggagaaaagtcaatggaacggatcggaccaagtcaaagtggacgagcaaacgcaacaaaacgccaaacgaagcggcggcggacaaacggtggcagtcgaaacgctcgcggcaattgaccaggcggcactgctgaaaagagaaaatattggacatctttaaggcagtgttcgctcattggtcctatgatatgcaccgatataaaccaactatcgtactcaatgatggtgaattgggtacggtagttgtttgtgtcggtacggttcaaaataccgtaccacgtcaccgtcatccatcactgacgacccctcgttgctcgtcagttccaccggtgcagtttcgccaccactgtccgccctttcttccccgtacattccatcaatcgttggcgcctgtcttctttcgccaccatgcgctgtcaaaattttcgagattcgatcctccgcattctgaaggattttctgccgccgacgttcgcgcctctccgccaccgaagtgctggaaggcacggaagagttctgtgcggtcaaagacatgtccaaagtgtactcaacaagtatcaaaatcacaaaaaagtggaaaaattaaaccaaaaaaagaaacaaaattgttatcaatgggatacaaatttacgtgtaaaagcttaacaaaaaacagaagtttatcgtcagaaaaatgcttatctaaaatgatggtggaattgcaaacaaaatttgatgcgcgtcattcaatcgtatgagtgggttctgatcggtttcagtgggtcaaacagtctcgggtctcgcaaatatttggcgtccttcaccagcaccggcatgtagccagccttgcgactggtcgcgatggtggccaacagagtctggtactgttttttgcacagcccggtcacgtgctggtcgtacacgcgcccgctgaagttggagacgaactgttggagcagccgtccgtttttgtagtccaattggatgcccagctcgcacaacagacactttcggtcggcccgttggaatgggttgaagcccaattggatcggtgcgtcggggtccgtcgggaacaactgcttgcacttctcttccggcgcttgccccttcctcagcagactcgtccgaacctcgccaaaatcgaactacaattccaaccatcgaccattgaaaaaagacggtagaaaagcccaccatggaagtgtcaccaaatttggcagtgaatttgctgtccttaggaatgcttttcatcattcgcaaaaaccgacattggacgaacagaacatgaggctttgccttcaacatttctgaagaaaaaagttgcttttgcaaattggcaattacaatattctttttcgattaaaaacgaaaaaagaatccgctctcgaataaatatcaccaatatttatatataatcaggagcaaaatcaactcgaaacaataagttacacatgtgtttgtgttgagattgatgagtgtatatgtaaaaaatgaccaaaacaaagcggagggagcaaaagggtagaggtgaaaaacaaacgaacagcagaagaggtggcaaaagcgaagcaatgagatgcaacaaaatgagtggtcaaaagtgatggaattttcaggtaatgaaaaagagacaattcattcatt

SEQ ID NO: 4015 - DNA, 6724 bp, Heterodera glycines
  misc_feature (6429)..(6429): n is a, c, g, or t
  misc_feature (6657)..(6657): n is a, c, g, or t
tcataattgtcttgcctgtcgatcaagtctcaattttctgttttcgggtttaatttcatgcgcccattggcagcctccccccccccccctcacccctttcaaggaattttcaatatttttccaatcatttaactttcttagtttccgcccccctcccccttcagtgctttaccatcagctcctcctcccaccgtcggtggacaaagccaattccatcggacgacaaatgccaaacaatcggtgccgaagcgcagacgaaaagtcattttgcgacggaaacttttgcgaaaaggcgccaccgccggcgatttgcagcagaaaaagaaaagcggaaatggtggggcacaaaaaaaggagggaaaaccaattaaaatttgaaaatgtgcagcaaaaagcggtgccgtccgccgcgtcgtttggcgcgttgtgccgttgcagcgattgccgccgtcagaggacggcgcgggacaaatggctgaaggcggaagtgccgaggagcgacagagcaatccatggaacacttttcccttcgaaaatgagtttggcgtgccatcgacgggagggacggagaagggagcgacgatgaggacgaagacgggcactgtggtggtgagggggacggacagaggagaaggcgtacagctgggaagacgaatggcacgacggagaacgacggcaccaaacgacggacaaaagccaacgcatgatgtggacggtaagcaacgaaatagtaaattgtgaacgtaacaaataggagggggcgggaagagtagtgctgttcgagagtctcgaatcgagaaaagtctcgggtttttttaattacggcataattgaactgtctcccctttccagcaactgcttcttctgctgatgattctctgtccgttgtcgattttcttgccccaaatcccatcgctttccgccgtttgccaccgtttaatcggtcgtcggcggttccgccgccgtccctcgcccaccaattggtcgccctgttcagtgtcggcctttgtctgtgccgtgccgttttcggtgccttttgtgccctttttgcccctctcattttcctccctcagattgttgggcccttctccaatgcttttgctgtgccctgtttctgctcggcctttgccttcgccgtcgtcccctttcgctgctgcccttggcctttgacgttttgtccgtccttttggcccttttcttttggtcagtctcttttttttggcattttggctaattaactatcctctccattgtccccatttttccaaattgcttcatcttccttccccctcctctctcttcagtctgtccctggttgttcttctgctcgtcctgtcactgctcgccccctccgtccctccgccgcctttgtcccttttccgctgctttcttttcatcgcctccctgtgctttgccgtcattctcttcaccttttgtacattttgtgaacagagcgcagtggccgaaatgactaaaaagaggaaaagacggaaaacggaggacaaaagggaggaggaggaggaagaggaagaggaagaaaaggaagaggaaaaggacagaagagaaaggagagtatgaaaaacaaagaaaaacaaattaaaattcgaaattgaaaatttatttatttactcagttaaacaatcaataattaattgtatcaattagtcaattaatcaatcaattaatgtattgatttgtgatgaatcaatttttaaacaataaaattgtgtcaaaatcatctgctgcttcattgcccgctgaatggtttattcgaacttttcttctctggggaattggcaaatgggagaaccaacaaatgtcggacatttatttacccgaatttggttcgaacgggaggaattttggggaacaattaattggggagaattaactaattgggatatggaagaaaatgtaaaaaggaccatctgataaatgtaaatttgaaatacaaattcaaattttttgaaatttgtggaaacgaatttaaaacgaaacagagagcttacaaaaaaaaagcaaacaaattctgaaagaaacaatgtctcaataaaaatataaggacaaataatgttttaatttttttagccatttgaccagtcagaaaagtttgtcaaattttaaaatttaattgccaaatttgtccatgtcaatggaagaagaagtgattcatccctttttgggattagacggaatttttcatttttaaattatgtatttaaccagtaaaaaacattaattatgtcgccaatcttttatttgcgccgcgcgcttgggggttggggtgggccaagctgaggcgggattggttcccgctcctcttcaccgctctcgtccctttcgctttctgctcactccgttcgcttgttgtaaagggaagcgcacccttttttgccgttctttttgatgggtctgatgctgctgaccgatccgatcagcgccaaagggggacgagaatgggaggggggaggggtgacaaatttggattggtgcttgagagaattgtgcagcaaatcgctgcttgcttaacggcaccaccgacaaggttggaggaagggcttgtcggacccctttgactcgacgaccacgggtttcgactcccgttccctgcggcggacactccggctggtgggagtccgcttcgatcgacgcgcgcttctccggctggtgggagttacgctgacgaacggccctgtcctttcgtcggacgatttggcaccgctcggctcttccttccttcactgccctgcttggacttgacgacgacgggagttctccccgtctcttccgctgctcctactggtgggagactgaactgctcgaatttggcgctacttcgggtcactcccgaattttttcccagtggctgatgggaggggaatttgggatccgggagggttgagggaaaagacgtaggcgaatgtgatggagtgaggagggtctttttccctccttaccgtgtcccccgaaaacgaattcgagacttcgattccgacacaaaatttattaaagaagcgatcgacgaattaaaaatgcgtaaaatggtgaaaaaaattgatcgaaaagtccagcaaaacgaataaaagaatggttgggggtgaaggaagcgaagagagcgaccccttgggcagggccgcttaaatagacattcgacaaaatgggcggagtgacagacggcccgataatgcgatgagaaaaaatgggacaaaaaatgggcagaaattgtgatgtgaaaagtgtgaacaaagaaatggcgcataaaaataaaatgtaaattggcagatgtgaaaagttaaagaaattgaaaagaaagaactttgtgcaaaattgttttgcacaaagcttgggccggagattagccagccgatgagaaatgaatttgtaaagaagtgaaaaatgggacaaaaaataggtgaaatgataatggctggtacgattaaatggagaggaacgtgatcaaaatcagcgatttaggaattgatgaatcgggaatccgcccgaacgtctcgtcgcctttttgctctttttcttccggtatttcttcgtatttgacggtccggcccatgtgctcgtgcttggtcccgagaaaacggactccccgtaacggtcctcctcgtctgtgtcaagttctttcccgattcgctgcccgtccgcgccctggttgaacgcgagcactcgcgcacgccgtggcgggttggcaccccccttctcgtcgccaatgagaaaattggcgacaaattaattcgtcacatttttctctccttttgtaaatcaattttttgttgtttcttcagttcatttgtattaattcacaaagtgataaaatgggctcagagaaggggaaaggggggaacaacagcatcaaatcatcacaatataatacaaaattaattatgtattatattaatttgttaaacttgaaagggcatcaaaaagcggggaataaactcgacttttggaaggccggcactccgaacatgccgaaggcgctgtccgcccgtgtgccgccgccgttcagttttgtggagccgccggccgaggtggtggaccgtcgatggggtgccggcgacagcagcagtgaggacatgcgccagggcaacggcacggaggaggccgaacctgtaccgccgcttgtgccgttctgctgtgtcgtatggaaatgggacgacaagggttggaacatgggcctcgagggcagtgccgaggccgagtgccgatgccgcaacgcttccgtgccgtttctgctgagcgggggaggaaacaaaagttggtttttggtccgaatgccgacaaacaaatggcaattggcactttttatggatttttagtgcccgcattaagcaagctccgtccatggcatttttacatgccggtggtactgctaggcaaagccggtaaatatttttgaaatttttccggaattgtaacaatagcagtactgcactcaccgtgcgtggtggtggttgtcctgctggtgctgctgctgtccccccatttgccgacttcccccgccccccaccaattggactgggattagtgtggcggtggcgcgtgcgttggccgcgttcgtctcccgctgctgctcgcgctccctctgccgcctttgaagtgccacaatctgcgggtcgtgctgcggtgggcccgggttggacagaatgtgcccgcgcaagtcggacgagtaaacgtcggggaagggcagcgccgacccttctgccggcaccatggtcacggtgttgtgccctgagacggggagaggtgtgaaaaagccggggaaaatcgggggaaaattggcatttcttaaaggggggggggaagacaatagcatcaagaataaagacatgaaagtttagtaaatatttgaaaatttaaaagcgaaggaaggtccggcggtgccaatgccgccaaaaaatgtttaataaattttttgttggaggataaaatagaatttaaaaataggtaaaaggcaataataaaaaattatatattaattcaaactcggatttagttgaaaccagagaatattcgtaaaaataattaaatttaaaaaaactattaattgtttaattatgcctttttaaattacattaaaacgggagacaaaaaagggagttgacacttggcggactcgaaccgccgaccttctgcgtgtgaagcagacgtgataaccaactacaccaaagtgcccaacgataaagtgatttattgaaagcattttgtgcacaccaataaataaataaatataaataaaaaaaccaatttccataattgtttaattagcactatttttataattacttttgaaccctaaaaattagaaaaaaggaagttgacacttggcggactcgaaccgccgaccttctgcgtgtgaagcagacgtgataaccaactacaccaaagtgcccaacgataaagtgatttattgaaatcattttgtgcacaccaataaataaataaatataaataaaaaaaccaatttccataattgtttaattagcactatttttataattacttttgaaccctaaaaattagaaaaaaacaagttgacacttggcggactcgaaccgccgaccttctgcgtgtgaagcagacgtgataaccaactacaccaaagtgcccaacgaatggggaccattagatagtcaccaaaaggcaaacataaagaacgaacctctcaatttccgctcgtattccaccagctgctgccagaagccgaggtttggccgaatgattggacgggcggacttcacgtaatggtaagcctgacgaagggacattcgctcgtgtttcatcagactgaaaatggacaaaaaaaaacccattgaattaccattaaaataacataattaattaatttaattgtaaaaatatatttaaaaacgctttttggtggtcagccctaatataaaaattaaacactacaacaaaaacaacatcaatttgcttactaagcgatgcaaagggtggcggagcgggaaacaccggcgacgcaatggacgagcgtattgccaccgcgttcctggagcagtacagacaaaagttaaagaaggtcatgccgaaataattaatagaaatgggaagtgaacggaagggggggcaaaagatgccaaaaagcgaaacagaaaaggggaggactttgaatttgaattgaaaaatgagttcagagtttttgatgagttaaaaataaatttaaataataaataatttatttgaatcggtgaacaaagggaaaagcaatcggatgaattctgcataaaaacgcatcaaaaaggagaggaattaaaaaaaattgtttgatgggacgcaaaatgccaacgcgcaaacaccttcccccccccccccttggggtatgccccaggggatggatggcattctgatgcctcaaaaattttcggaaatcggaaatccatggcatcttttgtatgcccncactcgatagaatttgtccaccaatcagcccaccttgactgatttgattttgtccgccgtttggtcaaagtaatggtccaatcgggcgaatggcgagtcttcgatgcgaattcggacgctgtcaatgcctgtggaatgagttggaaatgccaccaatgttttgccattttgccgctcgccaccaatcaattaattaattaattggtcatccctttcaagaatttactncccggcaaattcgccgtcggttcctttaacgtggcgttgaccacgcatgtgatgcccttctgcttca

SEQ ID NO: 4016 - DNA, 915 bp, Heterodera glycines
  misc_feature (28)..(28): n is a, c, g, or t
ttcattggcggcttcggccaaacccttngggccttaatactttaaaagcgcttgctgtgcactttgcttcattaattgggaatcccaactcggctaaaaatgaatgactgactactgactgagtgagtgaatgcaatgtttcaaattggggggcaccgtcatggaaataaatgagtgttttttctgtcccaaatttgctccattttcacccttttgctcccattttttgtcgtgtccaaacggagcgatggacgaaaagcaaagggaaaggggggacactaaatgctaaatggacctgtgaggggaggagaagcgacaacaaaacaagcacacaacatttaccggttccctcactcactcaatccatcaaagttccaaatcacagagagggagccttggggggggggggaaccattggaccgacccctcgggggcaaacaaaatttgggacaattgccggcggaatttcagagtgaacccaatgaaaattagtgttttgtgtattattggctgtcttttgcccacacccgccattggctcatgtaaaattggcctctttcaattagtgacgacgaacggcgggcaaaggcaacggacggtgggcaattgggggggggagagggaggggattcagtcatccgacaaatttgggggtcggtgttcgacgcattttctaagggcggggggggggggggctaagggcgatggttcggagagggaaatgggcaaacactcagaaaaaaatggctttttgtattttttaaaattttaaaaacattgcccttttaaaaatttaaatgtgaaataatttcaataattaaatgttggaaaattccaaaaataattaataaaaatgtaaaaatagttaattaaaatgaaaagtgaatttcttcaattaaattggcaatggaagaa

SEQ ID NO: 4017 - DNA, 1146 bp, Heterodera glycines
tttgtcagtgttttggacattttttaggatgtgaacatccttttctgaccaagacgtgctacgaaatttagcacacattttgaaaactaatgtggccgcctgcaaatcaattggagctccattcttcagccaggtctttatttttgagtatttcagtttttatggcatgcccttagcagtatttatttattttttaaaaatcaaagcagttggattttcatttgtggaataaaacaaatgtataataaatttttatgtatttttagctaaaacgaattttgaatgacatgttgagcgtgtaccaagtgatttccggaaacctgaacaaagctgtgaacgagcagggcgaacaggcgctgaaatggccgttggtgaagcaaatgcgaattgtgaagaaggagattctgacccttctgtccacttggatttcgcgtgcttttgagccccgtgtcgctattcccgtaaaatccaagcgaattgttttaatctttttgtcttctttgaggatcctttgttcgtgccagttcagctggtcatcgagaatgtgattaagcctctgttcagcaccgttctcgtcgattatgaaatgaatattccgcaagcgcgagaaccgaaagtgctttccctcctttcgattaccattgtgtctctgaaggtttcacaccgtcattttgaatttgcaattgttggtttcttgaaggaggacgcgtcggcacaggtccccgctattctcgacgcggtgttcacgtgcactctcgaaatgatcaacaaagatatggaagccttcccggaacaccgcacgaatttcttccaactgctgaaggccatcaaccaacactgcttcgacgtgctgatcactcttcccgacgaagtttttggcctgctcatccaagccatcgtttgggcagtgaaacacacaatgagaaatgttgcggaaaatggcaagaaatttgcattaatgaatgagtgttttaatttacgatgattttctgcaggagttgacattctccgcgagcttttgaccaaagtctcaacaatgacggacaaagcgcaggcacaagccttttacaaaaagcactttatggtgatcatggaacatgtccttggcgttgtcaccgattacaaccaagtgaactttgttggtga

SEQ ID NO: 4018 - DNA, 4975 bp, Heterodera glycines
gttaggcccgcaaattcgagtcacagtcaaagggttcttcagctttaaccgcacagttacaaagatgcgtgaacacatccgagacttcctcgtccagatcagggtttctctctcttcgaaattgaaaaaatgattttccattttgtccttaggaagaagccggcgacgacactgcggaccttttcttggaagagaaagaggctgagatccagcgcattcaatcgttaaaacaagcgattcccggggttagaaatccgaacgaattgttggaggaggacatggtctgacaatgcgtccgtcgggtgggctcggccctgccttccccgtttttgttttttccatttgtccatcctgacattaaacgatcgttcgtattttttctctgcgcccatttgaattcctttcgtctgtttttgctctccttttcatgttttgtgtccgttctgctgagctttcccctgcttcttctaatggagtttgtttctttgcttctgattgtctctactcgtctgttttggtgagagatttgattgtttctgagtgtgttcctccatccgttttgctttatgaattcgaccattgtcgaccctccattattcacagtctgtcatctcttttttaaatattttttgtctgaattatggtactgtccaatttcaaagtgacatttgtggtctattttatttatcgtttgttaaatgactgctttttaccgtataaatttgagtgattgttgttggaaggaaagtgcaagaagtgtccccggtggagtgaggtcatctccccttagattcttgctaattactcgcggggagtgccgccccaaaataagcgggtcatctcctccaatttgcggggcttgggagggcgagaatgtccagtgtcttctcgcccttcggtcacaatccgtcccccaatggctttcctcgctcttcgtccccttctgctgctgtgcctttgcctcttcgcttccgttggcgttctgttcgcccaatttcccttccgccacttcagtcccgaccatcgctcgccttttgctcttggcgttgagaatgggtcggtctgtgctgcgcttgctccgtttgtttcattccgttccgttcttcagtctgtcctccttcccttttggcccccgtttttcccctccgtccgtcccctctttttcgggtccgtttttccttgtccttttcccttccctttgccttttagtgccctttggctttgcctccgttcgtcccaacttcgcttcctttgcttttcgtcgtccctttttccccccttccgtcgccgcccctttcccttcacatttcgtcgccaataattttctgcgcgattctctcttcgatcgcgacaatttccaagtgaattacattaattaattacccccccccccatttttggcttttattttcctaaaaaggcacgtggctgcggatgggagccgagccaagcgacttgcgtcgatttgctgggcatttgtaagggcggctgtgccgacttttcgctcggcggtgcgctgttgcgcgactgtcgctgtgtgccgttgggatacggcgctttgctaatgggcggatgaaggaaaggcaattaattgccaacgaatgacgattattgttgaccaatccgacaaatcctcctcatgtcattgcgagtgtttatgttccaatggcccgttgtaaaagtgataaaatacaaaaggattaactaatgaattgactaattaattaatgagtgcgttgattcattcccccgggcattcctttctttccatttcgcattcccttcatctcttcccaatttcttcgtgttttcctccgttcgatccgtttccttcgccgctttgcgttcgtttctccgtcgtccttctgcaaattgttccatcactttcactaatttttcaggaatggactcaattttaggaagagaagcagaaaaaatgtcatatgactcaactacgctaatgtgatgatgttttttttttcatttttagattattgattgcgggtttcgctaattacggcgttttttaaccccacgtaattacggttttccgtaattaaaagtaaagtccagtacgtccagccctgcttccattgcttttccccttcacattaccttttgccctcccaaagactccttttcccagttttcccaatggcatttccgtttgaatgtacgcccccgccgcattcggcacattctcgtcaccgtatccgggggttctaccgtaccccgggaacattcttccatacacaggctcattgctgtatccttcaaaaagatcttttcaaattctctttacaatatataaataatttgatgcacgttaccgtatattccgttggcataaggtcgaggattactatacgccccattgttgtacagttgctgattatcatatgctatttcactaactatcggtggagtgccgtgtgcgttgccgtataactgttgattactgtatccggcgactgtgccgtaaccaaaaggcgaaaaattggcgtcgttttgaacgggatattgttgtccgacaaaaggtggagggatttgtagagaattttctttggcggagcacggaacgcacaaaaacgaagggaattgaggggaaatgggaaaagcattggcaatgggcggcggataaggcggagagaaagcgggcgaagcagcgggagacgacgaatagggatcactttgagaagagaggggcagcagggggaggaggacgagcagaaagagcatttggcacggcggaatgaatgggcggaggggcgaagcgcactttaaaagcaccggcgggaagccgaatgggagggaatttgacgcggaacgctgacaaagggaattatctgtcggatggacggacaaatgggcgaccaaaaaaggagacaaaagcaaatggtagctaaaataccataataatccaaaacatttttggtgctaatcactatggcaaccaatcgcaattccccgccccaaattccaattttggcatcatttcccttctctgatggcttccgtcgttcctcaaattgctgcgccgtcgctgcatttgcctttccaagttctgctccatcttcatgctcacctgactccgttcgccataattggccaaattggctgttttctgctcaaggttgcccaccattcccacttagtctctccacattaccccccccccccccaccatatttctcatttttctttcattacccccctccttcgttggtcagttccgtcttctctacccgacttatcgtgccactcttctcgcgttgcatttcgtttcggtgctcgtccaaattgtgcgtccttttctcggctttcatggcaacttaaaaggccgggtttgttgtcctaaagcgacaatcggagcatttcactcgctgcttttcttcggcagatcccttctctgtccggcttttggattctgtcagccctccatctgccctctcttctctttctcggccttaactccgacattcgtccgctccctttggaacaatttttctattccatcgattgcgccttttcttcagtcgaagtttttataaaaattcgctaataaagaacgaaaaaaagagcgatttcagctggtaattgcgacagtattaatacgacgattggccaacaaacaaatggaaatgatcagcaaaatgatggcggaagagacaaagaaagaggggacgaacggatgaatggatgataaggaagagtcagaaatggagacaaggacaaattaaggacaaacgaattaaggacggaaaggcaatcgcaaaattaaggacaaacgaattaaggacggaaaggcaatccaaaattaaggacaaacgaattaaggacggaaaggcaatccaaaattaaggacaaacgaattaaggacggaaaggcaatccaaaattaaggacaaacgaattaaggacggaaaggcaatccaaaattaaggacaaacgaattaaggacggaaaggcaatccaaaattaaggacaaacgaattaaggacggaaaggcaatccaaaattaaggacaaacgaattaaggacggaaaggcaatccaaaattaaggacaaacgaattaaggacggaaaggcaatccaaaattaaggacaaacgaattaaggacggaaaggcaatccaaaattaaggacaaacgaattaaggacggaaaggcaatagcaaaattaaggacaaacgaactaaggacggaaaggcaatccaaaattaaggacaaacgaattaaggacggaaaggcaatcgcaaaattaaggacaaacgaactaaggacggaaaggcaatccaaaattaaggacaaacgaattaaggacggaaaggcaatccaaaattaaggacaaacgaattaaggacggaaaggcaatcgcaaaattaaggacaaacgaactaaggacggaaaggcaatccaaaattaaggacaaacgaattaaggacggagataccatcgcaaaatggaaggacaaatgaccgaaattgaacattttataaacgatgacgaagagacaaatgaataaataaaatggcatttgcttaatgaagcttccttcactttactttggcccatcgctttgcctttttctcttgcttttgcaactctctcccccattttccttggccatcgtccgtattctgtccatcaccagcacagatgtgtttgtttgtccgtggccaactgacggggttggatcactttggatcattcccagcagtggcccctcccctctctcccttcgatgatggtcccttcctttcccctccccccgataaatcttttctctctcatcgcctgccgggtcattccttcgtccaattcttcctcaactcccttttccatttctcatgagttttcgcttaaatcgccgccgttcttcgggcaccggaagcaatttggcttccgccggtgcagcatgtcacagcgcgaccttttgaggggcaaaggtcagcagggcaaaatgcccgggggcga

SEQ ID NO: 4019 - DNA, 1304 bp, Heterodera glycines
ctttccaagttctgctccatcttcatgctcccctgactccgttcgccataattgccaaattgctgttttctgctcaaggttgcccaccattctcacttagtctctccacattaccccccccccccaccatatttctcatttttctttcattacccccctccttcgttggtcagttccgtcttctctacccgacttatcgtgccactcttctcgcgttgcatttcgtttcggtgctcgtccaaattgtgcgtccttttctcggctttcatggcaacttaaaaggccgggtttgttgtcctaaagcgacaatcggagcatttcactcgctgcttttcctcggcagatcccttctctgtccggcttttggattctgtcagccctccatctgccctctcttctctttctcggccttaactccgacattcgtccgctccctttggaacaatttttctattccatcgattgcgccttttcttcagtcgaagtttttataaaaattcgctaataaagaacgaaaaaaagagcgatttcagctggtaattgcgacagtattaatacgacgattggccaacaaacaaatggaaatgatcagcaaaatgatggcggaagagacaaagaaagaggggacgaacggatgaatggatgataaggaagagtcagaaatggagacaaggacaaattaaggacaaacgaactaaggacggaaaggcaatcgcaaaattaaggacaaacgaactaaggacggaaaggcaatcgcaaaattaaggacaaacgaactaaggacggaaaggcaatcgcaaaattaaggacaaacgaactaaggacggaaaggcaatcgcaaaattaaggacaaacgaactaaggacggaaaggcaatcgcaaaattaaggacaaacgaattaaggacggaaaggcaatccaaaattaaggacaaacgaattaaggacggaaaggcaatcgcaaaattaaggacaaacgaattaaagacggaaaggcaatccaaaattaaggacaaacgaattaaagacggaaaggcaatccaaaattaaggacaaacgaattaaagacggaaaggcaatccaaaattaaggacaaacgaactaaggacggaaaggcaatcgcaaaattaaggacaaacgaactaaggacggaaaggcaatcgcaaaattaaggacaaacgaactaaggacggaaaggcaatcgcaaaattaaggacaaacgaattaaggacggaaaggcaatccaaaattaaggacaaacgaatataaggacggaaaggcaatcgcaaaattaaggacaaacga

SEQ ID NO: 4020 - DNA, 1308 bp, Heterodera glycines
  misc_feature (1297)..(1298): n is a, c, g, or t
atggacacggccaatggcatttctccctttggcctttctgctggcacttttttgggtccgaatcaaaagggacgaattgcgctgcttcgctttgtacggccaattgtgggctcagcactgcgcccgcgtccctttcattctcttccccggcttttaatcgtcgcaaatccaaaaattgtgaatttattgcttcaaatatttgtataaagcagagaaaatatttcataagaattgtacaaaatattatgactaaccaaactttggactatgagatcgttctgctaattgtctgagtcaccagtgaattggccaacaatgcaccccttttcacgtacttcttggccttaagcttaaccagttttcaaattgtggggccattttcgttcactgagacgcattccatgaagaattggtgcaggagagagtcttcgtaagtggggggaggcgaattgcccgtcgggggactttgacgataaaacggcggggggacggcggacggttcgggcggcgtaggttcgccccgcgcttccttcgccgcaatggctctcttacggacgtcccttgcttctgcaattcgttcaaatgcctttccgccaccattcctttacaatactttgaatggctttgaaattgcgttcgcggagtcgtgccgttagcctttggatgatccgtcgggttcgtctgatttcgatcactttgtccagctcccattgcttacatttgttgattccgatcagcatggccacgaccattccgacgcaaaaagcgatcgtcggaaggattatttgggtgacaacagcagaagacggcgtaaaaaacttttcgtcagttcgaagcatttcagaatcaatttattaacgcacaagtgcttaatgtgagtaaaaagaaaagaaaaaaaataaacacaaaaaagaaattaatttggggacattttccgggcacaggtgatgagatatttgttgataaattgaatattgccaaatgattggcattgtgaatttattgtttgttcccaatgccacacttctcccccccccctttttccatgttttccttttttcttaaacgtttccatcactttccccatcaaagaaaagcttctcttctatggcttctcctttttcgaatgcgattgttggtggcgacaatgtttttgagattaatgactttactgtggtcaccgaatttgaggttctcactctcacattggaaaacgccattcaagaaatgaagacagaagcggaattgcagggcattgaggtgtgacaatgtttttgttttattgtcccaaaacganntaattttctc

SEQ ID NO: 4021 - DNA, 1138 bp, Heterodera glycines
ttttaaaagtgatgtcatcaagacgggtcaattgttccttatttatgcatttcgacaaaaacttgccacacttattatttattattaatatttatttatttatttgcttttataacgacgacgaatttggagggtttgtttttttattaaatttaaattttaaattagtttaaaaaaacatatttataggaacggaaccaccggagactatttctcaagtaaaatttatttatatttataggattaaaatttatttattgataattatttatattttttaataattttaaatttttatttatgcttcatttaaatagtatcatcaattaattttttcatttaataaaaatttaattgttttaattaataatttatttctagctactttccgttgaatcattgaacccatttttcgatgcactgctctttgcagcaaatattacttcatcatcttcgtcaatcataaaaaataattcaaaaaaccgtaaaaattaaattaaatttaaaaatttattattaaaataaatttaattaccccctcccaatttatcaattctatcatcagtttccgcggctgctgaattattatgcaatgcgcaagaaaattcgatgtgtgaaaatgcgcgaatgtgccgacgcagagaaaatgccaccgattttgagtgcgtttgtcggcgaggccatgccggaaaatattgccaattttgtaagcaatttaagtagccactaattggacaggctatttttaatacgaaagaattttgcgaaattaatacataatttttcgaaatatcaataatttttaatcttttaaatttcaattgaattatttttaaaataattaaaatttgagaaatttattatatttaattggtttataatgaaacttatttatttttaatttttacatgctattaaattgtttgctaatttaattagaacctaattaagattttctaaaattattttttgtaaattttaaagaaacttatcaagaaaacaattttttaaatataatttaataaaataatttatttattttcataatttagcgctttttccacgaaattgtgccgatgcatttgccttccatgaagaggtggaggaggaggaagaggacatttttgatgggggcgtt

SEQ ID NO: 4022 - DNA, 9371 bp, Heterodera glycines
  misc_feature (7404)..(7404): n is a, c, g, or t
gggccactttattagttcgtcgtttttggatgttgatgccgaaaaccaaaagtgttttcctttctatgggcgcctttatttgaaatttgcggtgtcatttttgttgaattggcgcgcgcatattaatttttaattgggctacttttttaattaaatttttaattttcatatgaatttttataaataaattttaattttctaattaattttcttatataaaatctatctcctgcaattgcaaatttaaaaaataaaaataaaatctgcccttgattttcctggtaaaatgtcatgtaaaatacacaacccgtgccctctattcaggccacactttacaatgccagtgccggcgtcagtgccatttattttcgcgcatcaaaaggacaccaacaacaacaaaaacaacaattaaaacagaagcaacagctgaagggggcacaaaatttcactttgggaccagtggaatgttcgggcgaaggtataataatggtttcgggattccaatggaaacctaggtctgattgatgatcaaattgatcaattttcatggatttgaatttctcctgataaaattgatctgataatttaattcgattaaatttggctaaattttcatatatatttttttgatcacttctgatggattagttaattgggccggatattaataaatctaactgaattaatttagtcaggcataatgacctgatttggtctgacctgctgataagaagttaaagatttaaagttaattttatatatgattagcttgatagatttagttagtttaatctattttctttgcttaaatgatcttactctttttttcatgcttatttaattagctcgatcattaggccctgttcagtcaccagctgataccatttctatcactatttccattttagccggcacttcactgcccggcgcggtggtcacactccgctcgccgtctgtcggcattggcaccgacccaatgggccaatggcgtcagctggaatttgacttccgcaccggacagccggacattgagcaaattgtggccggatgggacccggcggacaatgggcttcaaatgaaaatctcgctcagagcaggtggccaattataacaaatttcgtccatttgtcccttttttcgacaatttgtcatgccaaatggggccagctaactcgaattgcttagtcatagttctatctagtcgagaaatttcttgggttttgggattctcggctttctgcaattagcccattttgatactttgtcgtgcgatgtcgaccatttgtccaatttattaaaaaaatttcggttaaaaggttcataaaaacaaggatatttttcaccttgtacagaattaaaaagtattttctcgatagtctttcattttttgttaccccaatttaaaccgtaacccaatgtgttaggctaccgtatcgagttgacactgtcgcatcaggcgaacattgagcaagcagaaaaaagtgccgaaacggatgacaacatggacacaaccaatgataataataaagtatttgtccatcaacaaaagcggggcatacgacgagaaatgagtgtttccattgcatcccaacggcctttaaacgatttgttttggcacagggtaattaattaataaattaaaattagagtattcaacaactaatcaatgctaattgcttttaggtgttggtcgaagtatttcgtggtgaaattcgtttttctgtcgaccgtttgaatgcatttcaaccactttcatttccattcgcaacatccacgaaatttagcattggaggcgatgaaaagtaaaaccataaaaatcatttttaaaaatttaatataaattttattttcagagggaatggctttgtcggatgcattggcaacttccaaattgatcaaatgctgcatgattggacccagcaattagcacagaaggacagggatgaagatggtaataaatagcccgacacatgacagtatcctatacagggtactgtacttttctgaaaaacgggattcatagggcttcgcaggactagtccagaaaaagcattatttcattgtaaactttaaaaactgaatcctaaaacaggactcggaaattcgaagtaaacccggcttttaaaatgcgtattttacagaaatgttttacaagtgtaatataatttacgaaaaaatgcggattttactatgttattttacaattgtaatttatcaccggaaaaaagcacatttatgttaatattttacaattgtgtattactggaaaatacattttatgaaacattttgtttaaataatcacctataacaaaaaacttttaaaatgattaaataatattttatccaaacattttatcttccaatttacaatccaacatttgacccaaacatgaaaagcacattttatgataatattttacatttgtaattgattaccggaaaaatgcgcattttacgatgacaaaatggcccttggaataaaaagattattatgtaaaagcattctctgaaagaattggccaaataataataattatataaataataatattttatttttttaacttagttcgtgttgtttctggttgtcttgagttatgtgctgagaataaatgtgaacaaggtcaaataattaattttttaaattttcattttattaattaaaattaaaactaattacccaatgaattaattaattactccccaaataaggctccaaatgtgtggaacattttgacacagaaacaacttcgtgtgcatgtaaattaccacgaattcattatggcgagcattgtgagaaaagtgagagaggaaaattaaaaattaaattaaaattaataaattaaattaatttttaaaattattatttttagatatcaatgaaaattcttccgctacttttcgtggtggatcttctggatttttacgcttttttaaccttcctatcagtgcccttcattcggacgtcatttttagcattcggactgatcagaggagggcattggtgggaaattgttgactttaattaccctagttaattagtattaattagttgttatgatacacaaataatatgtaattgtttcagctactttatgaacatgatcaggccgataattttgtgcaggtgaatgcaattaaatgtttttctaaatatatttttttacttaattttattttactcttaaaattttattttattttgtgtaaaacactaattattataaatgttttttacaaagattattttaaatttttattttttaaatatttaataaattcataaaatttttaagattcatttggctgatgactaccgaattgttctcacaatgaataatttgtcctccattgtcagctgctctgtttttgctccaccaataaaaagtcaattaaaaacaacaaaaattattttaaataaaattaaattctttataaaagcccaaattagtgtattttacctactctatttttattatttatttttaattcattttcagcatttaatgacatgcgttggcttcagctaattttggagcgcagcaatgagccgggcgcgacggcaccacaaacagtggtgcttcatgttgacgatgatcagtgtcaaattggacctgttctattgaatgatccggattcaaccgatcaccaaaatggattatcattaatggatgatgaagaaaagacggtggaggagggtaaaaatgttaattaaaacaattaattaattggaatataaaaataattgatggtgtacaatatggtataatattaattatttttattttttttatttttaaaaagatatttatttaacatattaacttttaatttattaaattagatattcaaaaacttttaattttttaataaaaaatttttatttataacttatttaatcatattatttaatattcatttaaatttaattttctataaattttcagatacttttcccagaaatttttttattaaccaagtaaattctcaatattaaattccattcaaagatgatgcaattttgccaccagctccgccagtgccacccgaaaaagtgcggccttttcagattttgtttgttggcggtatgccaagggcaaagcgaacactacgccaaaagcgggaaaggcacgctttaaaaaattacaaaattagtcaagatcaagctgggcctaattactcataaataagcatttttcttgccccaaatttttttttcttaatttaatatctaattgaatacgaaattaattttcggtcattaacacgctagttaatggtgaaccaattactgttaattaataaaaagttaattatgcctaattaagaatgccggtctatttgtcaaatttgccgccgttgaagggatgcattcgcggactgatggtggatggggaaatggtggatctgtggcatgctgtttctgaacgaaaattggcacaaaataggcgatcgggtaaagccgaaaaaaattatttaaaattaaaaaatttaataaaattccattaaataaattaaataaaaatgtttttgattaaacaccgtcaaaaatatattctcagaagcagttgaaattggttgtgatcatatacaatgtgatgataattcggagcagttgaactgtcaaaatggcggccaatgcgcagtgaaattatttatttataaatttaatttaattaaaacttttaaaataatttttaggtaaattggagaaacacggccgccgatggtaataatcgccaaaaaacaaggcaatgtgattgcacaaaaagctcatttgttggaacgattgcaactgaaggtgtactcacattgatttaattaattaaaatttttatttaatttatttaaaaagtaaaaatatttaaaaaaggatcaattagataatatgccaacaattcattgcgttttaaaaaaaatttaatcgccatttttactgaaaagacaaacttcgagactcaaatgactttaacgcaatgataccaaaaattatttttttaaaaatggcgaaatttcagttttttttgtgtggaaacgggagaaaacaaactattttttgtataaaaaaattaaaaaatttctatttttatgtaaaaacataggaaaattttaattttaaccccctacaaaaaagatgtcggcctttcctttgttggccattccgccgtggttttcgacatgtccgagccaaaacggtttgcctttttgcagcacagtgaacggcaaacgctgagtttggcattttcatgtgccaaaataagtggccaaaatcttgcgcaacatttggctaccattaattttgatgatggaaggtaagtcatagggaatctttggcatttgcactattaataggttgttctttatcatctattccttgatttgccaaataaaaatcataatttttggcaatttcagagaatttcacattgttttggacagaaatggcacactttttgttggcatttttggcttggacagaaggccaatgctcgtgcatcacattccacacatttttaatgatgtaattttataataaataaaaatattattaaatattaaatgatgaattaatttgtaaatttaatttatttaattaaatttttaaatgattttttcagggatttcgacaccatttccgtgtccattttttgtcgcaaaaaattcaattggaattggccgagccttttgggccaaggcgaatttggacaattcaaaatgaaggcataaatttagcaaatgcgcaacaattttattttggtggccccaaaaatggggggaaaattggcgaagaaatggcggcaaatgattcaaattcaaatgaggacgaaagcagcgaaagcgggtaaattttaaagcattttaatgacattcaatatttaaataaaaaattttaaaaataaaatggaaaataatgaaaaaataaataaatacatttgaataattagaaaataaattaatttaaaattggttatcaatttattatgaagaattaaatttaagttgattagaatttttaattaaattatattactccaactagaaattaaatagattaaaattaaattttaacatttaatttcctcaaataaaactattttgtttttattggaaggagtgttgaaggagagaaaaaacaacagcaacaacactatgaacaaaatgccaatgccaatgctgagcaagagtcggcattggcgtcaacaaacactgatagcattgataatgataatgataataatcacccgccggactccgtcattttggcggatgcaatgcgcgaaattttggcgcgtcgcagtgccaacgctaatgagcagaacgaaaatgggcaacaaaggcatatggacaaaattgggacagcgacagtaaaagtgccaaatgcaaagtcaacaacggcgtcaacagaatttttatggccacaacaaattgtccattttgtgggatgcatttcgagtgaatttttgcaaaatttaataattttttattaataacaatttttattaatttcggatgtgttggttgtgttcgagaatgacctgaatctgatcacttttacgccatttttgtattatttacaaaaaagtgaactgttgcatcgcaatgttttcgttgtgccatccgatgatcagccaaaacaacaccaaaaacaaaaactgttggcaccgatggcatgtggccaatttaaagtgccagaaatggcaaaaagtaggccttttaaacaatttaattttttaaatttaaaaattatttttcgtaaatgtatgtaaataaatttaattataaagttttttgaacagaaaaattatcatttttatctttctgtcagaaaataatttcgtttcattaaaacagtaattgacatgtttatgtgatttgaaaaaattaattgttttatcagattataatttgaaaaacgggaaggaaaccgtttaccgcaatttaaattggaaaagggacgattgaatcaaaagttgtaaaattaattaaaattttctaattatatgtcttttttaatatttcataaaaataacattaaaattattttaaatttcatatattttataatagtatcataaaaatcattaaatattttaattcaaattttaatttaatatggttaataaaaattaattaaataatatctttttttgaaaattcttaaataattaattcaaatgttgaattaataagtttttgtcattgcaaatattttaatatctttattgaaaattaattaaaaaaacaattagttaatttaaattttcattaatatttttctttttggaaaattatttaataatttattttcatcatttaaaaataattaatccacttcacttttagccatttcaaattaaaaatgcatttagagtcacgccgaaatgtgacttttcccgtttgngaggcaccctttggaccaattgcattccatgagaacgatgttagctctgagaagctgatcaaaactgatcaaacagatgaggcaattaatgaaaaaggcattttaaaatgaaatttctaaaatttaatattttaatttttaaggaaattcatttgtccattggcttttcctcatttttctgctgctcattttgttggcattttgtctgtttctgatcagtttgatctgccgacggaaaattcgtcaacgaatcggtcgaacttattatgtgctccaaaaatcggaaccaaaaaatggagggccaacatttgaaggtgtgcaatattcaaataaatttaatggttttgtgacagaaatttttcgagaccgaattttggtccttgagacgagtcgccaaggcttcaaaaattcgagacttgtcgagatctgcatatagactatcgccatcgctaacaggacccttggcaattcgttcaaaaaactcgaaaataaaattttaaaaattcgaaaaaaataaaaaaacaaaaatgaaaatacagttcttaaaacaactggtccaataaagaagcgacggtttgggagcagaaccgattcaatggaacccattcagctggctcaacataaaagtaaaaattatttttttttaacttaaaatttatttttacatttaaattttcaattttttaggattttttcccctggagggctctttttcggccactccaccggtcacgccaacggcaccgctactttttgctgaacaaaagcctatactaaggccaattttacggcatttgcctcctcccaggctaccgtcatcatccattacggtaaaaaaagggaggagaaattaaagaatgggaatattttttaaaatttttgttttgccagaaatcccctaaacacccaattttcttggttttttaagaaatttgtagaaattctaaaattctcaaaaattagtaggaaagtttgtattttttataatttttcgaaaattactatttttttttgttttacagaatatattttcaatacaaatagccatttaagcggataaaatttaataatttttttttcaaaggatgcttctcctcacactcagtcggctaatgaaaatgatggcatcgcaacttcgtcgtcctccacaatttattacacggcgcaagaagaacagtttgcggcggaggaggacaattcgtcaacaacaatttcgtttaaaagcttaggtcacagaaaagaaaggaaatattaaaaattttcaaaaatttccaatttaaattttctcgaaagttttcttcactttttttgatttagttggtgctatgacgttagtcaaaaaccatcaaatgaaaataatttttgatataactttgctcaaaggcaataaaatttttaattcttgatatcattagataggcctaggtgttttctattagcctataaaatttcaaaaagtttcgttaagtttcaagaaagttatgactgaaaatgttcaaaaaaacacggctgagggccaatagggctgactgatgttctcaagagtcttgacaatggattagaaaagtcacggattttttggaatcttgcaacgaaatccgaaaattaaatttttaataattaagcattttcttcataaaaatttgtttatagttttaaaaacattgcctgcagaggcaccttttccaaaaattttctgggatttttgaaaaatttcacaccaaaaaaatcatagaaaaaaccgaaaaatccccaaatgtgcaactttttttacttaagatgaaaagcagacgagcagtggggacgaagattcgacaacaattggccaagcttttgaagagaatgcgcccgaattgatggacgagcgcacgtaatttcaactaattaattagcctaatttaaattgtttcagtttaggcgtcaattaagcgccgccctttcctcctcttacggtggctcttccgaat

SEQ ID NO: 4023 - DNA, 1944 bp, Heterodera glycines
ggggtaattggcgttaaacttcgttttatttaaactttatatataataattcagagacaaagtgatcagagggaagagcacgatgagtttgatcaaccggaaaaagaaactgacgaaatttcgcttatcaatgtcattgattgatggtgatttagcaaaaagaaattggtgatcgacgggagacggacgaagaaaacaatggagaagaagagcaattcgattttgaatagacacagttcgataaaaggtttttcttcgtttttacaggaaataaaattttttttaatttctgagcttcattaaaaactgtgttatcatttcacttatatttatttgctttaaaaacctcaaaatacagttacgcatgcatgggactcgaacctgtgaccccccttgtggtgactaactcacagaccactaagacgaaaaaaccaacttaattgtacttggagcccaaaattgggccgctgtgtaaaccaataaatacaacccctaacccttcggaaaaaagtcaataattttttcgtgttacgatttttttgggcaatggtaaagattattggtcccgaaaatttttttttaaaatctcatttttacaaacattgctaaacccttgtaaacaagattcaacccaacaatcttaatttattttacgggacagaacgttttgctgacggacactgccgaggtgaaattggtcgactttggagtcagcgcacagcttgacaggacagtgggcaaacggaacactttcatcggcacgccttattggatggtggggagagaggggcaaaggatagcatttatggggggagggaggggcaacagatggcatttatgggaaggattgcatggattttaggcccccgaagtgatcgcttgtgacgagaatcccgagtccacctacgactcgcgcagtgatttggttggtttgagacttcccatttgcaattggcaatctttcatttgcttttcagtggtcacttggcatcaccgcgttggaaatggccgaggggcacccgccgttgtgcgacatgcatcccatggcaattcccccccccccccgccgaaatgcccttcctaatttggagcttttccttcagcgcgctcttttcctcattccgcgaaatcctccgcctcgcctcagcagaaaatcgtccaaaaaatggtcgaaaaagttcgaggcattcattgaggtcagttttgattttggcgtttcgcctttcaaagcgttcgaatttttaagtgcgttttggaaaaggactacacgagaaggccattcacagaaaatctgataaagttggcaggccaaaagatgggtttctaatggcgaagaatactttttagacacacattcattagggaccaaatttcggaccgaattgtacgaaatgcaattagagaacacgtggaaaggcatcggaaagtgcagaaaaagggtaaaaggggagaaaaagcgacggacaaaaggacgacggacatttgcagaagtggacgattacttttcgttcagtggaagcgacgaggaagaagtgcaaatcaacaacaatttggacagactaagcgacaacaaaagcaatgccaaaagtgagaaaggaaaagccaaagcgaaggggcgggggagggagacaccaccacctccagtgacaaaggaaggtcctccccaagttgggatcgccaagcgcaaaagactgcaattggaaatcataacttactgcattagttggttggcttttgatcagcctttgtttgattagattctgcgattagtggcgtcgccgtcactcccttcgccgccgcgggcggtggccgtcgcgtcgcagcgaccgccgccggaggggcggaagagacggaaacgatcaaagggggcggcgacctgcgcaaagagttccagcgcattcaggagaacaaccgaagcgcattcgaaaacgagaagccaatgaa

SEQ ID NO: 4024 - DNA, 2671 bp, Heterodera glycines
ttaattaattctgtataattatacatacaatcgtcagattggcctgcaattacgacaaaaagcgcaaggagcagcaaaaacagagcggaaacgaacagcggagaaaggcaccgcaacaattcgcaagaaaggggagaaagcccgaagttggcggaggacggattggcaccaaacattgaccttttgctaaggatttggacgttcttgcggacgaactgcgcgagctgtccaaattggtccccgtccgacagccgccgatgggaattccggcaaagggcagtcccccgaaagtgcccgactcgccgcctgcgcctcccccgcgaggcattgcaccgctgggaaagcatccaaattgtttatttgttttcagattcgtccattgctgaatgcttttcgtcggcttccgccagcggaagaatgggaagagacaaagagaaaccggtgaaaaggacaaagagaaaggaaaaggaaaatgtgccgaatttagccgagcaaagcgaacgctttcaacgattcccacgacaaacctttgccgccaacgccgacgcattgcgaaagcgcacactttgacaatggcaacaacaataacaacggcactttggtgctccgttcgtccgtttccccgcagtggcgacggcgcagcaacagcagcaatttgttgcggagggcggaggagaaaaggcagcggacggagtcacggggaagtctgaacagagtggcaggcattgtcaagcagtgctcagtgccagaagtgcgagggagggaaaggggacggcacgggaggggtgattagggtaattaggtgccccagtagttgggggtcttagggcgggagggacaatggcacggcggacgggttacatggccctacttttttgcggtattttccatttctactcgtgcagcagcgttcgccactgcgaagcgacgacttcgattcctcgtcggatgagtcggaagaggcggcatttgatcagagaatggcacggcagcagcaacaggcgtcggcaccgcatttagccaagtaaatggggggaagacaaagtgcagaagcccaaaggcaccaaaatgggcgttttcttttattacccttcccatgccctcggggttcggcttttgccacgttcgattttcggttttttttgtctaattataaatatatcgtcagattggctaaggtcgaagcggccattgctgctggtaaagcaatgatagtccttcccggtggaaacgtcagtgattttttggcactcgaacctgaaatcagagacggaataacgagacggagtgtccatgaagtccgagatttgttgcagtttctgtcttgattagttgtggtctcactatttaatgtttaaatttttcatcaattctttttgattaatttatcggcgaatcaaccatcagttaattttacttttgagacgtatttataactcgagggatgtgatttgttttatttagaagaaataaaaatatccaacgaaggggtgaccacttacacgttagattttagtaaattaatatcaagtccaaggagctcttttacagactaaatttttgtttaactcaatccatttatttattcgttttttgaaactgtcaacagatggagcatctgttatatctttgttgagtttagaccatattaaggccgttctgttgataaaagaatttgaagttttactggattgtggttttaacacaactttacgtctaagattgtaagggatgtgaccagaaaattgggggaatatgtcttttttaagatgagtgagaccattaataattttgaatgcctgaactaaatcaattgtttttcgcctttcttctaaagtttgaataaatcaagtctttgtttgtaaggtatatacggaagcctacatttaaataaagcaatttttgtaaaatatttttggcatctttccaatttatttatatcttttttgtatgtcggattccaaatttcgggcgcatattctaaaagaggacgaatgtatgtcttgaatactttggtccaaatacgtatagagcgggtttttaaaatttttggcaatattgcgaatccttaaataagcagctttagtaattttagtataatgattagaaaatcttaatttattatcaatcaaaatgcccaaatcactaatagattcaacctcattaataatatggttggataatttatattgatgttttgagttatttttgccaagaaataaaataaatgttttattttgggagatgtttaaaccaaatgcattcggtcagggtcgttttcgcgtggccattttcgcgtggccgttttcgcgtggggacgttttcgcgtggctggggtacgttttcgcgtggggtacgttttcgcgtgagtacctgtttagaactcaaattggtcggatttgtgcaaaacttccatttttcgaattccgaacccgaattcgtacaaatttattaactttttaatttttttgtttcttgcggctagtatcttctacaataattggtcagtttggtcggatgtgcgtcaaacggaaaaaataattaaaattttctaaaaacacataaatagtataacaaaaaataacaaatttcagaacaaactaaggtcgcatttcatagtttcgtgaaacaccagtgagaaaattgttaacgttttcgggattcacattga

SEQ ID NO: 4025 - DNA, 3817 bp, Heterodera glycines
aaaactgccaaaagtaaggattagggcacttttccagtttatacaccccgaagcttccagtatatacgctcccaaattttttttttttaattattcgccttccaaagtttatgccaccgcatttctgagccacagacacaagttcgctctgcatgaaggagatgcagagaagttaaccattcttgaaattgagcgtcagaaagttgtattttttgatataattttgcaggagtaaaatttttggcgctatttaaaaagagggcctttttgaattttttttttgctcgaattttttttttaaatttattttaataataatgaatagggagtccaaaaatatttatttattcagaagaaataaaaatatccaacgaaggggtgaccacttacacgttagattttagtaaagtaatatcaagtccaaggagctcttttacagactaaatttttgtttaactcaatccatttatttattcgttttttgaaactgtcaacagatggagcatctgttatatctttgttgagtttagaccatattaaggccgttctgttgataaaagaatttgaagttttactggattgtggttttaacacaactttacgtctaagattataagggatgtgaccagaaaattgtgggaatatgtcttttttaagatgagtgagaccattgatgattttgaatgcctgaactaaatcaattgtttttctcctttcttctaaagtttgaagtttgaataaatcaagtctttgttcgtaaggtatatacggaagcctacatttaaataaagcaatttttgtaaaatatttttggcatctttccaatttatttatatcttttttgtatgtaggattccaaatttcgggcgcatattctaaaagaggacgaatgtatgtcttgaatactttggtccaaatacgtatagagcgggtttttaaaattttggcaatattgcgaatccttaaataagcagctttaataattttagtataatgatttgaaaatcttaatttattatcaattaaaatgcctaaatcactaatagattcaacctcattaataatattgttgcaaaatttatattgttgttttgaattatttttgccgagaaataatataaatgttttattttgggagatgtttaaaccaaatgcattagcccattttccaatattgtctaaagcaacatttaatttgcttctttcatcacgagttttgtaagaaacataaattttgacatcatcagcaaaaagcttgatgctaactcccggagggattacctgcgggaggtcattaatgtatattaaaaacaacagagggccaagaacagaaccctgtggaacaccagactgaatcggatataaattagaaaatttgttgttaattttaactctgtaaaatctatcctttaaaaattcagataaccaacttagcagttttcccctaatgccaatgttatgaagtttatttattaaaatattaataggaagggaatcaaaagctttccgaaagtccacatagatacagtcaatatttttcttaccgtatatgctgtcgtaccaatcttctaatactgtaattagttgagtattagtagatcggtgtttaacaaaaccgaactgatgttcggatattaaattattcagatgaaggaagttataaatgctttttgcaattattttttccataactctacatagacagcaagtaagagaaatgggtctgtaattatgtggatcatttcggtcaccttttttaaagagaggtataacaatagattttttccaaatttcaggaattttgcctgtgtccattgatattctgaaaagttcggaaattacaggagaaagagtaaggtggcaattacgtaagattctaaaggaaatttcatcgggggatgtggattctcgattcggtaaattttttaaaattttagaaatttcatcggcattaaattcaacatcagaaatagatggtccattgggattggaaggacaactgctaatttgtggaacatctgaatttgaaaaggattcttggaaaatttttgcaaaagtttctgcttttaaataatcatcaaaaataatttggttctcgtaactaagagagtggatttgttcaaaattttttgtaaatttatttatatatttgtagatagcattttttcctttattcagaaaattattttcatttttagtaacaaagttatttatttgaatttttatatgtaatgaaatgctatcatacaaatgcctatatttatcacggtttattttttgtagtttataaagtctggctttttccttaattgacagtttaagactcaatgggtagttaggctttctggatttttgaccgacagtgattttaggcaagtataattctacatattctctaaaaagaaggtaaaaatggttaaacttatcttcaatggtaaatttttgtagtaatttgtagggtaaaattgaagataagtttaaatttaatagattaagtttagtagaattataattgcgtactgtaaatgtatttgccttactcttattctgaggaaatgacaatgaaaaattagtggatagatgatcagaactaaaaatgtcctcaattaaaacattattaacaaaatcaggtttagaagagagaatcagatcaagccaagcactaccacgagtgggtccattagtcataaggaataagccatacttattaaaaaattcacaaaaaatatttcctttttccgacttagcataaggcgttccactggtccaagttatgtcctttgcatttaggttaaagtctcccattaatataaaattttcttcaaaatagttaccaatgaggttcagaatcttttttgtgaaattagcagaagtgttcggtggtctgtaaagtaatactattcttaatttttttgctccatttatctgaataatttggatttcacaattgaatttagagcaggataagacagaaaacgaatttacgctcgtttttgtcaaaatcattactccaccaccattttttccgcttctgctagcttcatatattttgtaattgttagtaataaatggttggaaaggtattttttcttttgcccacgtttcagttacaaaaactaattcaaaatcttttagggctataatcgcagtaaattcgttaagcttattatttagggatcgcatattgataaatgttgagtataaaaaattttgttttttatttagtaaagttttcgaattttctatggggtgttcaaatttcctatatttagtttgtaaaagagcttgcgttttaagagatttcgtgttacagtggccaccaattacacattaagagtcatcaacattatgcacatgacaaatacatttaaaagagtcggggttggatttgtaacggggaatgtcagaggcaaacataacatggccggcataaatgacagaattcgaattgggattactcatatggtcatttttgcaaatgccaataagtcgggaacgttcagcgagttgctgtttggatagagatgggcggaccaagacattgttaaatttattgtgatttttgagttttgtcttgttccgcagaaaattttgggcgtgttttttggtggggaattcgattttaatgagacgggggcggtcggacttctttcccattcggtaaacctgacatggccggcattcgatctcacaggtgtcgagcattgattgagcatccacaaaatcggagttgacacgagcagagggcacagtttcttcactttccggcaggttcaagaccacgacagagtggagtcggcgttcttcctcacaaagt

SEQ ID NO: 4026 - DNA, 1299 bp, Heterodera glycines
actttttcgttcggagaccgctcatgctatggacatttccttgtttccaaagacggatccaagaatttgctcggattggacatgatggacagacttggattgtcggactccatcagaaatggtctgaaggacaaattccgaaatgaggcttccaaagagaacggagcgagccaaaagaaaaagaagaaattcttcagaaaagacggacgtggcaaaaagaagaatttcttcgctgtgggagcgaatgtgatcgccagcttgggtgatgagccatggcgtgccggacgtgtgatcagccgaaaagaaggcacttacgacgttcaatttttggacggcacgatcccggcaaaaggtgtacaaccgtacaagccggatgaagatgaaaatttgaattttcttcttgacgggtttggtctgaagagagcctcatccggtggatctatcgggaagcacggcagcgatggccgacgagatcaaacgaaagatgatcttcgagaagcttccgactgtggacacaaggcataagaacgccgacctgaggatgcggatgatggacggaggcccggcacttttcaaggggggagatgttagggttgggacccaattgtccggtgcccattttgaccctttgtttcatttgtatttcccttctcccttcgttaagtcacgcccacttttccgcccataaatacccgcgatgttgacccttcctcatcattcttttgcttcttctccatttatttgttccctttgctcccaatcgatatttgaccccgttcgccctgtcccttctttttgaataaatatttcttttattcctcttcggactttggggcgtaacaaaaacacaacaaaatttaccattcactaaatttccaatttataattaataaattaaatttttaatttgaagactcgcctcttttgcgtctccgtcgcccaccaaaaaataaacatccgcgtcctctcccgtgctcaacaaatgcttcatccgatcaagcactgattgggacatgataagcaatatgaaaatcgtatttatctattaatgtaatgaaatgaaataatgggaattaagtgaattaagatattcaaaattggcaataaaataaataacaaaatcggctaaatccttatgattttactggactattcagctggctaatcatatgccaagcccataaacaacgaatgagtgaatggtgaaggcttcccctatttttggggggaaagattaaaaatcgccaacattttaattaatttatttttcaatttgtatgtaaaaaccaaataaaaaaa

SEQ ID NO: 4027 - DNA, 8372 bp, Heterodera glycines
aaataccggtcatatgtcaggttgataattcttcaatattgaacacaattacgcccattaatatgccaaaaagcgtgcataaaataaccaaacagattgaactctttcgaacagcgaatttttaatataattcattctaaaaaatgcttttgtttaaaatatacacaataaaagttataattaattgaaaataataattagtattttgaattaaagtaaacataaaatttaatgctttaattggtaataaattattttactgcaacggaaaaaggacgatcaacaatcgttcaattgagatcagatacaatgccaaaattgagccatacgatgctacggtagatgccataagagtggccagacagatacggtagtctattggactgtactgaaaaatgacgtcaaccaaattgagggcgaacggtgcgacaacgaaaagttggaacagtgcgtcgtaggcgatcaaccaattgcacactttgtggtgctccctgagaaaaggggttattattttggctcccttttgatgggcatttaatgccatttttggaattggtcctcatttttcgctttttggttggatttttgtaaaaattagggttgaaaataaaaccccctgaattagaacctcccccccccttgagggggttgaaaattagagcccccgggggctcttttcactaagtacagtatttgaaagaacttttcgcatctctgggctctctttcttcgaaatatcgccaaaaaaattcatttttaatttatttttgtttttattgctcaattactaatgaattttttaaaaaaccgaataagcaccttttgataattgtgacactgatcagcgaaatgttgaggacaatggaaatggctgtaaaaagactgggcaacacaatccatgctgcagtttgtgaaatgcaattgaacttgtcggacaacacgagtatggtgtcacggtaatcatcagactttaatttaagaaattaataagaaaattgattttaattttaaaattaaaactccttaatgcctcctttaaatcgcttgcaatttattttattttactaattaatataaagataattaccacaactttgttcaaattgtactggaaagcacatttggcggcaacaaattgatggataattgaactgaaaaaccattcaaaaatggtcacatttttcgatgaatccaaagccgaaaattttttagtcaaattatttgaatcgaatttccttgccgaggtgatattcaaataagtgcaaatatcgtcactcatttggttttttttgctacaaagaattttttagggaaaaacaatatttataacttacgaaattctggaatttttaaattaataaagaacacttaaagctatcgaatgataggatgtcgacaaaatttaatgcttttcagcaaattatgtgaagggatgtaaaaatttgagattttctgaaattcatcggatatttaatggctaaactcactttaaaacattaaaaaacctttatctgataattaaaggaatgaatctaaccaataagcacttatgaagattcagcgccacttaattaatgtgcaatttcatctggccgtaattattgggtaattgccacctgtccacctctttcgtaccaggtgttttcgacagtgattgatttcgacagtacttttaaattaattttctacatgatttattgtacacatgaatttatatgaatatacaatttgcatatacaaaatttataattgaagtaagtaataaaataagacttgtatgatttttttggcaaaaatttatcgcttttattttttctaaaaaatatctcttgctagactgtagtcaaaaatacaacaaatttcttagataagattctcgaatcgtgtggaaaaaactgctaactaatgccgggttcaagtgccaaaattcaaatttgcaagctcttaagcaagaattcgaaaactcgaacacctctgcaatgtataagagccatgttcttatcattctaattgtcaaaatttaacgagacttatgccatatagaacaatttttaaaaaaataagctttactgtcgaaatcaatcactgtcgaaaccaacactgtcgagatcaccactgtcgaaaactaacagcacccccatctgggtaggggtcaactccgtcctgccaactccgtcccagacaagtttaagaatccataacttttgaaaaaaatgaaatgttggcgatcaatttttgagaaaaatttttcaattcttaggggtgtattttattacgctgatacaacatttaatctataatttaatccaatccagtttttgtaaaatcaaaaaaatgtacacagtaagaaatatgataaaaaaggtccataggatgatagtttaaggacgagatttcccagagcatatgaataatttatgatttgttaaataaatttcaattgatttgtggatcatctttatccactatttttatttgagcaaagtgctgagctaaaactttgtcataaattctaaacggtttcaaaatttgaaaattttagacagatttgcgtcatattttgatcaaaaacaactttttgatggaggtttttatagccaaattcagactcgactttttaaacgtcaaaaatcaatttcaataaatacacctctaagaattgaaaaatttctcaaaaatgatcctaaaaattttgtattttttttgataaaaatttttggtttaaaatttgtctttattcgaaaatttttttaaaatattgaattaattttaatttacaattgaaatatataaccaaagtgttaataaaaagattttttctgccttttatgtgcctattttgcgattttttgttcctaaaattcacatccctagtgatcatgttttcattaaacgactgactaattaattaattggttggattgcctttagacatttctccgtgccaccatcgcttcttctgtcagttacactgttcactttaattccgccgtgtcaacgccgtcaattgtgccatttgaattggtgaacgaggaccaatgagaagctgacactgatgaatagggtgtaaaattatatgcacatgcatattttttcctgaactgcgggaggcctgaaacgcacgaaaacatgtttttagcttggtttgagcttctaggccgtacttccatatgcatattttgcatatttgtgcatatttcgcgatttatgtgcatattttggcatttcgttcatatttttatgtgcatatttgagcatttttcaacaaaatcctctattaaaacggccccctatattaaagcggccatttgggcctctaatgaccggaaatttttcaaaaatatcattttttgggtattttattttatatttttggttctaaaatgattattcatacgatatttagctattttcgagatttttatgcaaaaatttaacaaatttgaagaaatttgtaaagttttacccccaattttattggatattgaagcgatgcccaatttgggagacaaaggcgaaggttcagcggaagaaagacgaaaattcggaggacaacaattttaacaatgtccaatttgatttgatttgtggcaatgatttgtttttctgaattcttaattcgaaatgaattttttatgaacttctgttgacactaacttttaaattagctaagaattttcaaacccggccgatggctcgcttagtcaactgaaaatttgaaggaattcccttggaaatttggggtaaattgaacgagaatttccgaacaatcaaaaaataaaagtgatttaaaattatttaaacaatttttaaaaaattaaacacgctttttaaagaaaattttaattttgaataattcgaagtatcagaatgtcctgcttggtagaaattttttagtgattaactcatagatagggttgtaaataacatggactaaaaagcgattgccaaatatggactaaaaactgccaaaaaatcgttttaaacactcacaaattccaaaatatattcaatttgattaaacaaactttaaaaatatcccaaaattaaaaaactcaaaaaagccaaacttttattaaatcctagcttcacaatttaaaaccagatacactatgggtcaagcccagtgttagacaaaattgctcataacgccaaatagcgcatttggcgtaaatttttgcgcgttatttcaaaatttacactgaaaaatgacttttttgtattttttattttgatctgcaataactcgcttcatacccaatgaaactgaacaaatttgatatttaaaaaaagcttctgcaaaggagaatctttttcttagcgaatgctaagcaatttgacatctcagaaaaaagttggtggagtttcaagtttttatcacgttataactcaagtccaaggccgccgtttctaacaaaaatgctaaaattaatcattttttattgattctaaatgtccgtagtgtttttgtacctttacaatcaagattattataatttgtgaatttctatttttcatgtgttagagacatgaaaatagtttgccaaaaagagagaaaaagaaattcacaaaatttttcaccaaataacttttgagtgagccttatttttgtattaaatttccttattaatcgatgcaaacacataattaaaatcgatgagttagtacgccaaaatgagagaaattacaaagaaaaagaaaatgacgagatagcactaggcttttctctgcacagtggagttgacccatagtgcagatacatcttacattttttggtaataatctcattaatgttgtcagtgaatgtggccaatgtcacgcttattttttgggaaatggtttttctaatttttttaatttaaatttttgtcccctattttaaggttccacagatcgagaaaaaaagtttatttaattatgattttttttaataaattctctttatgttaataaatatttagaaaattatgtgtacttttcaaatagtgttgtaaaagattattattttttgcaaaatttaaaaattcaaaggcgggcaaattatgggtcattagtagtggaacaacaatggcacaaaaaatggcggcgttttcatcgcggcaaaatggcggcgggcggacgggtgacctatggcaatgccaatgtcagttatcagatccaaatgcaatcatgggaattttcttttcttttttttgtttccttcattatcattatcattagtagagattttaaccaaagataaaggtatgggattaattttttgcctttaaaagacgtgccattttttgaatttgtttcataaatcagtgcccacatatatcataatttttattcccttcttttacccctttattcagaagagtccaggattttcagaattttttgttttttttaattattaactcggtttggtgggggcttaggaaaaaaataaaaaaatttccgaaaaacttttatttcaacaaaaaatggtccttaaatgaaaatttttttgaattgttgagctcgctctctttctctagagaaccaacattcaaaagccaattcggtagaagttttgtgctcttttgggaaatttcctccccgacatttctttccccgaatgtcgggggggggggggtaaaattgtaattatttttctatcttttttggcagagagagatagcgttggatgttcagtcgcggggtgggggggccactaccgtatcaattaccacactgtatacattttctgtgtaatgtaatagtgcattttagccctaaattactaaaaagcattctcaaacataatggcccacttgctgtacattcgaatgaaagctaacgactgtccgggggtcgcttttgttcgatccggtgggtgcttttttaattgctgaaaaaatgcctgggtcaaaatttaaaatttggcatactgtaaaatgccggtttggtatgtgtcggactgagactattaatgtatgcacgctattttatttttcgcgctattttaacggcacaggatgtgaaatctcattcatttcggagtcatttgcgcgcaaggccaaccttttgggcaatattgaccgttccaattgtcagacaatatacgtgccggtttttggaggtggcaaattgcttggctggtgagtggtgtcaaaaacagaatcattgctttttaggaggggacggaagtcgaccaggaatggtcccaggatttcatcttggagagggtaccccacccacgaaaattttttttgaaaaattaatgattttttcaaagttttatgaagaactaataagttttttcaaaattttccaaaaaatcgctgaaaatttttaaaataatttttttgtttaattttttttatgaaaaagacatttgcgcctttgtccccccaaatcgtgttcaaaattaacttcttttttttccaagctttgatagcctaaacagctttaagtaagcgatagaaaggattgtaaaaattaaaaaaaatttttcgaaggcatgacttaaaaaattgggcaattaattctcttatttttacacttattttctttgcacgttttgcagggtcaacgatgttgaaattagaattgatgagctcaaattgaaatttgggcaccgtttgggggtgatggaggacaagcatttgccgatgtgagtttggcgtatttttttttattttgtaaaattcaattaattaaaaaatgcccttttttgtttaaacatttttctattttaaggtattgccaggagaaattcgacatgctgtaagaaacagcaattaatttttattttccaagcaattataagaaatttgacaattaattaattcaagcccccaaaaatttttcaagattattttccaaaaattatttgtataattggtaaaaatatcttttttgcaaaaaaaaaattgatgattttttcatgaatttttggatcaaaatttcaagaaatttgaggtcttagagattgttttttgcaaattttatgaaaattaatattttcaaaatacacatttttttcttaaaattttttccttcggtgaagggagggagtgaatttcttagtgctattccttggattatattatggtttctggcgccaaaatggcagcgccgaaacggcactgatttacccaatttttcagccaaattttctaaaaaaaatatatattaaaattttgtccaaatttttaaacacagccttggaaccgatttgctgtatacccatgaattgaacgtcgactatggccgaggaatcacccgcaggggcaaaattgccaaatttttgaccgaagaggaaattcggcgcatacgttctcatcgcgggcgggtggcccgtgccatatgtgcaatgatgggaattttttttgttgtgttcattatcattatcattagtagtgattattaaccaaatgataaagggatgagattaatttttgcgttcaaaagacgtgtcattttttgaattttcttgataaatcactcactgcctacacatatgtatccacaatttttattgcttccttcaacattttacgcggaagaaaaccttagattcagaaatttttgagtgttattttttcattaacccggcttatggaggcaaagggaaaaaaatctttcgaaaatttttttatttcctcacagacgcgcagattaaatgaaaaaaaattttgaggcttggcgaaagctgttccaaactgtggaatcaattagataaagaacttgcaaaaataaattcattaaatcaattaaaacaaaaatcaaaaattctttagagtaattaaaagccgaaggactgaaaaaatatatatttttaataaatagttaaatatgccattcgataattttgataaatttgagccgctttgacttatatttattttaaaataaattttcagaaatctatgttgtttttaatttgacttgggggataaggaaaaaataaatttaaaaaattcacacgaaaattttattacgatacaaatattaattaggtaaatgaaaaaaattttatgtagaggctaaaaaagcaatatacaaatgtataaaaatatggaaatataaagtcgtaatgcttcagcgtcaaattttaattttaaaatggtgcttaaaatatcaaaatttattaaccgacaaaatcattttgctatttaattatattgaacccaatttattaattaccctgatcagctgtaaatgtatcatttgttaaatggttaaaaaaagacattaattgtttaatttattgctaaataaagacaaaaattaaattttacatatttttatacatttctatcttgcttttttggcacatatttaaggtttttgaatttcgtatgttttgcatatgcggcctaaattctctaacaaaaattaaa

SEQ ID NO: 4028 - DNA, 1226 bp, Heterodera glycines
  misc_feature (1113)..(1113): n is a, c, g, or t
cttaagctaaaacgattgaaatgagttttgcgcaaggaatccgttgatttatttgggacgaaggatctgtaccaaattttgaaattggacaggagcaaaagcaacttgagcagtgcacaaagtgatgctgatttaatatttctcacgttttgatgtttcatttttcagtcaaaaaggcctattatcgccagtcaattctgtggcatcccgacagatttgcatcggcacagcatgacgaaacgacgcgcgagttggccaagcagaaattccaagtgatcggcagagcatatgtaattttgggggatagtgagaagcgcaaagcgtacgacgaaacgggtgagaaaacattggaattttagtcagcgaatccgactttatctccaatttgttggcacaggttcgctcgacgatgagaacgaattttacgaaggcaaagattggtcggccgtgtggcgaggcgttttcaaaaaagtcactccggaagagatcgaagcgtacctggccaaattcagaggtccgtatggaaagaacaatagttcaaggatgaaaatgtataaatgaatctaccgcttctcgttaattggattgatttagagaaattagttttaaggattgtttaagcaattggtattatatggttcatatgggtttgtattaaattgaacttgtactatcaaatatatttaacgacgtggagaggaagtcggataacgaaactttcaaaattacatttccaaattattttttaccttttaaggttcacaggaggaaattgacgaggttaaggaggcgtatcagaagcacaaaggcaacatggacaagatcatgcaaagtgtggtcggcgccgagcatccggacgaggaccgaatccgcgagatcgtccgccatggcatcgagcggggcgaactgcgtgcatatgctcgcttcgtcaacgagcccgcctccgctcggactcggcgtgccgcgcgcgcacaacgcgaggaggtggaagcgcagcaggcgctggaggagttgcgccagagggaagacgtcagcaaagggacggacggcgacgactctttgggcgcattgataagggcaaagcagcgcaaacgcgccgaaaagaatggttcngtgtgctgtttccggacattagaacgtttttgaagcacattctccttcatatttgggtgcacttcaccccattcattccaatctcattgtcagacatattttgaaaatctccc

SEQ ID NO: 4029 - DNA, 9316 bp, Heterodera glycines
acccgttggttaatgggctatttttattgccaaatgcgtgcggtccatttgtgccatgcccgccacaaaatgtccacctcgccttttccttgcccacaagtccaacagttacatcttcgccgttgagcacaatgccattcaaacgccgctcagtccgtcgccattgtgcgtctccgagctgttcagcgacgactttcgcggctccggcaccaccgggcagctgttgctcatccccggcaaacaacggccccctctgtcagtggaacagatcgaacgctatcgcaacgaggaaaagtggcgcaggaaaaggtcagcaatcaattcggcaatggtaaagaattgtggtccctatttaattttcctgctccaaatcagttttcgagggtgctgttcacgaacctgaactcgggtttgagccaatttcaaatcccggacccgtacaaaaagttgaaattcttccaaataatatgtcgttgagatcaatcaaatctgacgaaaattgtgaaattttatccaattatcaattgacattagtgcagtttgcgcaaatcgtcttccaattttctttccgtttgtctatgtcagattgactttctattcggtgttgtggctcggctggctgttctcgttgatgtttgcccttttgcttgtccatgtccatccaaagtgtgcgccgtcgtcgtccctttcgctggaatggtggaagggcacactgatttatgaggcattgcttaaatttattttctttttaagtgagtaaattttcagatttggactctctccttccatggtaatttattttccgaatgattgaaatggtctttaaaacattggattttgtcatgggagttgatttggattttcggtgaattagacccgaaaaatgcgctaaaatatctaaaaaaatttgtttattaatgaattgtatgaatttttccgagatcccttctaaccagtatcatcttattttaattatctttcccattttcgactcggacggcaacggcgtcggcgatttggccggcattcagctcaaacttggccacttgcgccgaattggcgtgggcgctgtgttccttcgtccaattttgcgcacagaaagcacgggaatgggcgtcattgacttcacggcattgagccaacaaattgacgcgacaatggaccaattcgacgcatttgttgatgcagcgcacagaaaaggcatgggaaatttttaaaactgagcccttgatactcagatatgatcaaaatatttgaattttatgattttttttactcatatgagcgaaaaattcggcggaaattaatttaaaaaaattatcgaaaatagtctttgcccgtgtcattcttttaaatttccattttaaatttccgtcctttatttctttttatggcccttccattctcttcaggcatccgcattctgctcgaccttccgcttgccgtcacttccgttgcccacccgtggttccgtcgcagtgcgttggctgcacgacccgaaaatgcgccgtttgccgacttttaccactggcgacgaagtgccgtcccttccaactcagcgttcgtttcggctttcgacggttccatgcttaaggcactaccgcttctctgctcgaatattaaattaattccttttttagtatttccatgtggccaatcgtgccgatttgccggtactgaactggcaaaacgcaaatgtttcgagtgccgtgcgggcagcgctcagtttttggcttggccacggcgtggacggcttccatttggcgggcattgactatttgcaccggacagctgacggacggagaccgtcgtgggacgaggtcctaaccaaaaccacccaaataatgaaattaatgtacattagtcgaaaaacttgaggaatcagaggtccatcccatctgtcaattaactgataggacgtcaccgaaatcattggaactgattttaaaaattcatttgcttctgttttagattgtcgcgattctcaaatcgtttaaaacgaatgcggaggagcagtggcgcatcagacgaagagacggggaagggaaaatgtaaggggacagaccgatccaagggcgtagccttggaggggctgacaaaggataggtacccaagtaaattttttgagaattttaagcaattctcttaaaaaaatcacaccaaaatcattttttggcgaaaacggctatagattcccctaaaacacaccccctaattaattttggatttccaaaaaaagaaaaaacaaacctaagaatcgaatttttgaattcagccccccccccgaatagtgtttcatattttttcccatgtttcagctttctcttcacttcccatgagcatttgtccgaggcgttaaaggtgcgtctggtggatgaggtcggcctggacgcggtggtgaacacggaactgcgcgacttggcactcggcaaccgcgtctgtgccaacaaaaccgcacacgcagtgccggcgatgagtgtggccgagtgcgccaacgaaattttagcagatttgttgctgttccaccaatcgttcagtgagtgccttcaatttcaataccactcataaaagaaatattcggagcataacttttttttgatctgcgtatactcgggtttttattgactatctaattcaaaaatgaaagcaaaacaaattctaaaaatttggaactccttttttaaaacatttgtccatgcatattttttcgaaattgaaaattttcttaattcctctggataagctcttggctcatcactcattttgtattttttcttaattggccgtttagccaatgtttggcccctttggagtgtcggcggttcgttcgcccgtcggttggcctcgcgcgtggacggcaaagtgtacgcggagttgatcatgctgctccaactcgcgctgcccggcactccgattatttactatggcgacgagttgggactgcatgacgtgttgaacttgaaggcatattttttcatagatttgaaatcaatctaagcatgggtttttcagtttccgcaacgcggcccaatgccttgggattcgtcatcgccttttgacaatcgaacggacggcgcgggcagcattgaaacaaattttgacgttaatttttgaattcaatctttactgtaggatgccattaggatgagttggccgactcgcgcagttttctgcacagtgttcgtgccatggctcgccttcggttgcgcgacgccgcgctgagggcggacggcacgggcgatgtgcgcacatacatcacaaaacgagtggacggacaagcatttgcactctgtcgctatttgtgctgcccagaggaggaaaagaagtggaacggaggggacgagtcgcagcagcagcggatgagcacgacagtttatggcgatgtaattttttgacagtttttccgaacataattttggcacttgggaagtccacagtcaataatgccatacttattggcatgccttcatattaaattgtacgatttccatctttttcccccgttcgcagagtgttgtcgtgctcgtcaacttcggccccgcgccactcactttttctttgtccgatttgccgcccttccatcgccgtggggtctatcggcgtggccgaattgtcgctcgcagtgcgaatgccgcctccaaatttgcgcttggtcttggcattgagttggacggacggcaggtgcacatcggagccgggcagggcatcgttttcaaggcgttcgaattttgagtgtctgcctgcttttccatttttcaccctttctcttctccaattttgctttttgagcttgtctttcttctcccaaatcacttattattgatcactttggcgtccttgtcaaaattctttcaattttctttatgaaagctgtctaaactaaataaggacgaccacacccgttgagcttctcattatctatagaatctcccaatttctggtcactttttgttactattaaattcgcccaaaattcatttcattttgattatgttttttatccccttttgagcttaattgttccctcaaatttgtactcatcgtcgttactttcgcttttcacttacgcatttttccattcagcgagcttattttttttctttacttttttttcctggcataaatatctaactttcgcttttgattatccaagaattttattaggacacaaagcaaacgttggatttaagacatttaattaaccataaattataaaaattaaaatcagaatttcaaaatgggaaagagagatcgagtcgtgggtaaagcactttttctgaaatcactgcatgcgttcatccaataattgagcatcagcgagtctgttttttggccaagtgaatgccgtagatgagcaaagaggtgagcaatgagtacgtcagcatggcaacagtttcgccaatctggtggccatggatttcaaggtgcggcgatgccattgccaacagattgacgaagccagtcatcagattggcacacagaaaatggagcagtgcgtttcggctgattgctgccacaagtccaccccggcgcgcatcctgcggcaacggaacgacgagctgaatgagctggaacagggcacaggtggtgctgaacagggtcaactgtgccaagagaagggtggcaattattggcaaaaagcttttcccgaccgccgcgtaccatggcgaacgagtaggccaagttggccaaccttcgggaggcgctcaagccaaagtgtgcctcgagcaccctctgcgagcagtagcagcacaggctgaaaccgagttcgcccgcgacattcagcggggacagcttcttgtctctgcaaatgttcaaattgtgaatatacgaaaattcggtttttgctttaatccatggagtgatgatggaggttcaaggttatgaataaagaaatatcaaacgaccatccattttaccagaggtttcttctaagaattttgccgcccctccacccaaaaaattgagtcgctttcattgccttagcgtcagtttggcgctgcaccgcgcgtacatcagcgacagcgcgtagatgaagcagtagccgaacagcgagaaaattccctctctgttctggtcgagaaagccgtgccgtgactccccgaagtcgggccgtaaaatccattgctcaagcgttgtaagccgaagcgcaatttggtagacgaggccgagcagcacaccgagcggcataagcagcgcattgggcacaccgatgacgaacagctggggaacaaatatatcagataaaatcatcaaatttggaaacccaatagaaacggacggaccctgacacaaaagagggtgaggaagaagttccagtggacgccgtactccgtcacgtcttggccatagccgctgaaacggatgaacacggaacggccaactccgatcagaaacagtgccaaaagggtgggcactcggaaggcgaacagttgcctaaaattcaaaataataatttaaattagttagtccaaaaaatgttttctaattgtaagaaaatttactgaaaacaaattttttttgaaagattttagcaatttttaaaaattttatgatgaactatcaagtttttctaaatttttacaaaaaaagcactgaaaataaaaaaaaaaaatttttttaaatttttctgtcgaaggaaatgaaacaaatgcccacaataattttcccagtgtggcattgtgccacggcattccaaaccctccgcccgtccactgacattgtcgccttggccgccctctgccgtgggctttgtccgcgtgccattccatcatggtcggcgatagcattcacaaaaatgaacgccgctgtgccggtgtccatcagcgactgaccataatactgtgttttggccatacggcgcgggaacagcgtgaaatcgaccgccaaaatggccaacgaagtggcgaccaaaagcacggccataaaacgaagagaaaattcaatttacataaaaaaatcaaagaaaaggtattcacaaaatttacttacctagcctaattcgaaaaaataagtctaataaaaaaaaattattgagaaaattcaaggaaacaaaaaaaaagtcaaatttttctgaaaatttagcaaatctatttccattaatccttaggttgaaaaaagctttaaaataatttttaaaatggtgaaattttggtattttttgcagcgacgttgtgtcccggcgacattttggggtgtacccgacttttcacgaaaaaacaaaaacggataagaaacgccgaaaaacacgccccagaaatgcctaattaaaatgtgcaattttcttttgaatagcatttaattccctcggctgatcatttcatgtacgtgtcgagaaggggtgatgcccccggtcgaagcaattcatcccggaagcagttctttccccccccccctccagcccggaaaattttaatttttcaaaaaaaaaattagtgaatttttcacaggaaaatttaaagaaaaaaattttcagcgaattctctctcacctgaacattgtgtgcgcgtcgcgttgggcgcgtgccgcgtccacgcgcagcggacgcattgagcgcagcggcgtcacaccgcaggcgcgcgcactgtcacagcaagcgaaaatgacggcacagagcgcgagctgaacgagcagcagaagggccaaatggtcggcccagaaggtttggccgagaaacattggcaccaccagggcacagaagtccaagcagaacagcgacctaaagcgaatggacaaagcaattaatttggtaattcaattcagacataatttgaaataaattaaaaattgccaagggatcggaaagcactattaaaaacttattattaacctaattaacttatattccccaaaatccattcaaatgcaaattttgcaaagaatgaatagacaaaacagcagatttatgtgactctttcaaatggaattgagacctaaagctaaaaaactcgttatcgcaaaattaaatggcatttttccataaaattgtaaaaagttgcgcttttctaaattttcagtttgcgaagtggcttaaaggaatgcaagaatgcaaagtaaaattgtcctatgaataagccaacccaccaattggccaaatgccgtcccggcattccgacaaggcattggaccagcacattgcggaaaagcatgcagaacacgccgaacacaaagtacagcgccgtctcagtctgttgagagaaatcaaagacgggcagcagtcgcatcggcggcgaaatggaaaaagtgcgccaacttcaataggagtaaaattattacaataagaccgaatgttaagtaaaaggcaccggaactccgctaccccttctatgcactttttggcattttcaagaccattttttgtggaattaatccgcggacccggaaaatttcagcttcccgataaactgtaaccaggtctgaaaatctgatcagctgaagaagaagaagccccttgttttccgaattgtcacaaacaaaaattctttaaattaaaaataatgctttaaaggcaaaacgccaaaattaaaagtaatgaatttgaataagaaatttaaaaaatgcaatcatctcacctaataagagcgagagcactctgagttcgatttgacgagttgtgcgagagaaacattttatacaaataaactggagagcaaaataatttatgcaagcggcaaaagtgaaaatttaaaggaaattcgaatttgtgtgttcaaattgagggatgaaaaattgcttttacatacaatgaatgtgagaataatgagaataaattcctccgaaggaaagggagaattgaacagattatgatggacaacagagagaggaaaattggatggacgaaatgggggaaaagcaaacaaaactaaaaatggacaaaaaaacgaaagggattcattcattcattcaattcggcggatgggagaaaaatggaggaagaaatcgaccgcagttctgttggtgatgaaaagtacgcataacaacaacaacaacaacaacaacggtcgtgaaattaaaaacacaccctgccaaaagaaaagagaaaagcggagagaaaggggataagggaaggcatttggcacgggaaggaaaatatggcagacaaaatgtgtgtggggaaataaacgaaattcaatcgacggaatgggaggaaaactatcattgggttattaaaggaaatatgatcaaaccaaatttaggggagaccataattcatattgtcaaaaatatcagaaaaatgttgtctaatcgtgaatttatgcgtggaggaagaggcacacatcgacggaggcggaaaaagcaaatgccaaagccgagacacaaagctgaaggaaagaatggcaccaaatgtacagacaggaagggtataattaacaaacaaatgaagaagacatataggcaaaactagcaaccaaaaacactaatttcagttgtaagttttctctctgccacgtcacaactcaaaaacaaagaaaaaaccgatcaattttttggtggaaagaagaatttggcatttctattttctggcaatttgtttctttttccttattttgtcttcctctccttttcccacaattaatttcttcgttttctcccctcatccgtttttccctactttctcctccatttcctttatctctcatcccatccgccctccctctcataccccccccccaatttcctttctttctcttccaattcatctccctctcttctccctctcattggcttttttcctctttcgctctctctctctctctcttccggtctctttccactaacaataagtgcaaaaacagtgtgctccgtccccttacgtcgtcctcatggaatgcgcgatccgttccgtctcgtgcaacattcgctgggcggtcgggagaagtcgtacacataggaggggcgcagttggtactccgagggaaggcacagaatgccattggtggccaaattggtgaacagccgacgcatttcatcgggcgactttttgtgggttatctgaacggagtgccaaatcattttttaacccaataactgcttgcagatcacttgccaaatattcgttgttgcagccccgggaacgatattcagtgtctggaatatgcttatgttagtcgctcagagcgagaataggaaacggcaaagaataaaatttaaagaattttcttgcctttttttagaaattttatgatggtttgctaaactaagttttccaaatttttgaaaattttcagaggggaacgacggggggtgggatatttcaccacggaaaggggcgtctatccgcacgtggaacatttaaaaaataattgcatttttctaa

SEQ ID NO: 4030 - DNA, 6288 bp, Heterodera glycines
catttttattacaatttttcattacgttactaaaaaccattttaaattttttttttaataatttgaaattaattttaatttcataaaaattttttgcatttttcgttgtaagaaaattacgaaggatgcaaattatttttcatatttttttgcttatatgcataagaatgcataagaaaaaaagagctcaaaaaattaaatttttttcatttgaacgtcagtaattgtcaataaaaaatatatatatatttttggggtttaaggaaaaattttttatttcaatattttgaggtttgtcaatattttgtaaatattttgagcaattttgaaatttatcatgtaaaattcagaaactttaatataaatgtaataaaaaaaattcttaactaacatttttaattgaacttatttttgaaaaaaagcattctcaaaactcgaaaaatataatttctttgtaactataatcaacgaattaattctttgtgtaagctgttatttaattttacacacaaatgttcatttttcttaaatatttgctcaaaaatttcggacttttttcaatatttttgttaatatttcggcctttttcgtaaatatttatttcaatttttcgtgatttttaataattataactcccatcactaatagttattatacgcgtaattgtgcccaattgataggttttcctaaaaattaaatgctttttcgaaatttattatgcaatatctaattaattataaattaaatttaactatatatatttttttttttgcaaaattttaacatttacttattaatctttcctctccatacactgcattttccttcgcaattttgcgaaaggtcgtttatttaaaaaaggcagctgcaatcgggtgattgaaaggccaagaaaatagggctgctgtcttcccattcaaataatgcaaagtgacgtcattataaaatatttatttattttttttactaaataaaataaatactctaatttttttcaataatttttaaaattcatttaaattttcataaactttatttttttttggttttgaaatttttttttgcttaaaaattaagataactgggtcatgtgcacttttttacaaatgttctcattattttagaatttttttttaattaatcattttttaaaaaatgataatacaaaaaaattttaaatcccaaatgtgaatttttaatcacaaatttaattaatatttttaaataaacatattttatatttaagtaaatatttcagacactcgcaatttttttaatttgttaaaatttaagtttttcatctcatgatttgacaataatatttttgattatttacaataaatcatttacgccctcgcaaatgaaggaaaaagttatttaggtgtaaacaattagttcttaatgagtgctacctatttatttcacgccccaattaattagtgtattatttgttttatttattttttccattcaaaaattaatttaatttttttaaatatttaattgatttaaaataaataatctacatttaaccgaaaattatgcatcaaaactcaaaggttgaccaatttaacaccaattaaaaacgattatgagctaaggtacccttccaaaaccattcatcagatcacatgctttgttcctgatcggtcacacattaatttgaacaaaattgggtgtttaggtactcaacacacctaattacgcccgaggggaaaagcaatcaattttcctaattagaaaattaactgcaaattaatactccaaattgcggtggataaaaataaatgatttcacatctttgtcaggatgtggcgttgtcattgacaactaaaacatttaatccaaagaattttcgattatatattttttttatcttttttgttttataggttttcatttattttaagttttctttttgaggtgccgaggcaccattttctcctttctgtgccactatctcttctctctcattcgctctcttgctttctctctctcgctcatttgctctcttgctttctttctttctctgctttgtactatttcaaggcattcatcattctacgcgtttctcattttaactttctctttcttttctctgtactatttcttcctattctttatctttttacaatttttcagccaatgcattacatccacccttaaatacgcacgcatgtcatacacttttaaaggcaaccaagctttgggtgctctaaaattttctctatttctttcttcacttcttttctttctttctttctctactctctctctctttctcttctctctcttctctctcactcatttcccctctctcttctctctctctcttttctttctctctgtctctctcagttccttagacatctatttgtctctctttccgtgcattgccattaactctcaaatttttctatttctttttctgtactatttctctctctctctctctctttaaactttttctcttccaatgttatttctctaatcttttgttctctaataattctttctaactctgtgccatgcttagtccccctttctctgcttcttccttattttcaaactgtgctgcattttgcccgaggcaattttttgacattacgtcatatgacgtcattggctattgaaaagatttttgtgttgctgacgctgccgcgggcgctcagttggcactcaacgagcattttgccatagacagcgaaattaatttgaattgagtcccccagtccgcccgcccgttattcaatcagcagcaaagcaacagcaggcagacgtaggaggacaataagtcggcacaaaattacggcatggcacacagtgtaaatgatgtccttttccttgaaattaattatttgctaattcatgcatcgcatttaacatgctttactgggagaccaaaaatcaggaaaagcctatcgccttttcgggatttttgcccgggttttccacaacaactaactagatctcatgtgccataatatctgcttgaatctcgcattatttacttattcaatgatattatatttttgcttgataattcggcgctttttaaaagtgggaccaaaggggggggggcccttttgttcgcaaaattttttatgataattaatcgtgtaaaatttgttttctaggggttttatgggtcgcttgatcgcaaatctgacatccatttcaatgaattcctaatccctagcacgaaatcaaacaaaaaaccgaaaaattaattttatggagttttcgatttttttcgaattaattggttaaaatggaggtcagattcgtgatcagtgacccttaaaatccccaggatcaaggcaggactagacaaaaatttataaaaaacaaaagggtccccctttggttctttttaactagcgccgaaaattctttaacatttttgtagaaaaaaaatgtgcatatttcaacaaatgcctttaaaaaatcttagtttttctaccattttataattcttcattttcttggcattattgaacaaatgggatttaattctggcaattactcatttttcacccttattttatttcgaaaaaaggattctttattagctgtgcgcccgccaccacggcattatcactttcggcatgccatttatgaacattttttaatctctccaatttttaatttatacgagagttttggtctcatgtcttggaaaattttgttctcatgcatttttactggaaatcattttaatgttttgggagtaatattaatgaatttgccaaattatctttctttgtcactaattctgttttgctatttccgttttacaaacataccacatcattatccatcattagaaccattatgaatgccatttttggccaaatgcttaatttttctacacttaaaactttgggaaagcgttgttaaaacttagtttggaatcttaaggatggacattctgatagcaattttgccaatttttaattgaatattacagtgatgtcaatttcaataatttgggatatgaaaaatttcatccattattttttcttaccaataatgccaccattctattcaatgccctcatataaattcaattgaattcgttcttggcatttttcagtttttaatgtgcccttgattgtccttaagaagggtcatttaaaaatggttaacctaatcgggcacaaatacatttcccatcccccttctgcaaatcccatcatcatccccatccacatcatcaattttggcacacaattttgtggcccattcattcattttaccccttttgcggccatccccgccccctaaaatgcctcggccccccgctgagtgaatgaatgaatgaaaattgtactgaacaaccttttggccacaaaatgccaatgccattgtcgaggctgttgttgtccgcttgctgcccacgcgccaattttcatcccttttctcaaacatattttatgtgttatatgtatgcttttcgtttgccccccgtggggccccggaaatgaagcggaaaaagccgcaattttgtccacgtctattttgcccgtcccagggcggaccgccggcggggcggcgatggcaaattttttattttttgatcaaaatttattttaaaaaaccttttttcgaaaaactcgaaatttaaaatattaaaatgcaaaataaattgtaaaattgtcatttttgcgatgaaagaaatgaatgttgtgatttaaatttggaaagcttttctctaagataattaagagaaattaaaaaaagtctcagtttttccattttaatttggaatttttatattataatattattaaaatcttgctttttcatttctttttttttacgaattttttagtttacttttacccataaaattgaaatgataaacgattatcgtcggcgggcgtctttaagtccccagcacaaataaatttggtcatttatcaaagtcactaaattgctatttgccttcccaaatggcaataacgtcatttttaaaatgaataatatgaatatatatttttatttcaatttattttttagaccatttttaaaaataatattttattaatattccgtaaattaattttttatccaaatttgttttaccatgcaaatttgattttatcatgtttggcaaaaatataaattcttgaaggcttaaatatattttcttgttttttactataattttaaaaatttcaaatccagttttttttttgtatttttttatttaataaattgagatttgtgggaatgacaaacgaattagacgaggaagcccccacacaaaatgccaaaaggggggggggggggagactttttgttcgtgacaaatttgaaagaaaatgccaaaaaatgtatttgtgtgccgttttttgcccctctaatccttggccgggcaattttcaccggaaatgacggcggcggaacattctactatgaattggaccctatgagaatgtcggccacaaaaacaaagcccacaccatcaattggtataaaatgccacaaataaacgaaaattacaaaaaaaaaattaaatttaatgttcgcgaaaaaaatggaccaatttttttgtgaattaaattctcctaatgggaaaattattatttaattcaaaatttttatttgatttgattttgattttaactttttaatcaattcatttttaaagcaattttatttttttatcaaaaactaatttatatcacttatgtataattaaattttttgttaatttttctataaatcgtttccactttatttacagccaaaagaaatccaataaatttttctccataatctttgctcaaaaattcgtggccaaatctctttttgtgccaacataatcctccccaaataccaacagcaggaaaatgccattgtgcttgctctctttattcatttattgtaaattaagcaccatcaccaagcatcagcagatggttgtgatggtgtcattttctcatttgtgccctattcattggttcggcatttgcgccgcaaaaataaattgaattcaaattggcattatgtcgtcgcacagtgaaaatgccaaaataatgatggcattttcattttaatgaacttcaattcaacaaaaatgaatgggtaaatagattcatacacctacgtaaagcagaaacgtttttccacacctcggcattttgttttaacaataatggcacgtcacttggcaaaattgctaatgaaacaaaaatatttatttcccacggccacaaaatgtggccaaacattggctaaatgtcacattgtacatatgcagttgctatgtgaaaattacat

SEQ ID NO: 4031 - DNA, 877 bp, Heterodera glycines
  misc_feature (48)..(49): n is a, c, g, or t
  misc_feature (59)..(60): n is a, c, g, or t
gatgcatttttctttgcaattctatatttgaatgctaacaaaaatganncaaacacatnntataaataattacaaattctaaaatttaacttttttttttaattttattatttacatagatttttccttttcccgaaaatttacacttattttgttcaaaatttgattggtcttttttggcaacttttttcacctcgatgctctgtgctatatgcctttcctcatcatcaagtaaacttgttttttaaatttttatttatgatgaagccgagaggaggaggaagggaatgaatgatgtcatatttttgcccccatataaataggtgaagaatgcgaagaattgtcgtctcctccgcccgtctctcatctcatctcatctctttctcttcacacaacattctgtcattccgccgcacccatcgcgtttcataattttccattttccgcttcgttttttgtgtgttgttttctccgcctcgccgccggcagtaaattccatgcgcttttttagaatttttttttgttgtttacaccctctataaatatgcctaattatttgtgtcacatcaaatgccccgagactcttgacacaaaaattcttttcagtgcctattgacaaaaattcttcctaactccgcgccggcggtgcaaattggcgccccatttgggaattaaaaaaaaagaagtttttttggctgatttatattaaaacattttgtaactttttgctaatttttaaatattaaaaaatttttgtccaaaaatcacaaatttgttaccacaaaaggtacaattttttaagaattttttttttcatcaaacctgcttttgcaaaaagctgctctcgaggcttgcccgtaattccgcataatcctta

SEQ ID NO: 4032 - DNA, 2606 bp, Heterodera glycines
  misc_feature (26)..(26): n is a, c, g, or t
  misc_feature (2369)..(2370): n is a, c, g, or t
attcgctgtccccgtcaatgaatttntgtgctggaatctttgggggcccgcatttagtcaagcagccccatcaaattgagtccagtgattttgagtttttgagtaactattgagtgctcttctgattatgcttcaccccgctttaaaatattgggttggatcaaacaaatttttcttttttttattcaaatttttcgatctacctgatattttttttttaaatgcaaaattaaattatttttttaatttaaaaacttaaatgcgatgataacccataactcagccaataatttatgctaaattttaccatgaattcgtaccatggcggccggccaagaatttgttatacttttgtttcgacccgtccaacaccaagaattttgttgcaaattcccctttaatcagttaataattatactataccatttttttaattttgatcagttattcttgatcaatcactttttttcgtgctccattttcttccacattttctcccccggtaccccgtcaatttcccctctccccctgtcccattgtgtcgtcgtcgtcaccttcttgtggtggtgggccgacaattgagaacgggccgggccattttctgctgtttgtacacacatattacgacgacgacgacggactctcgggactctcgcctcatcagcagcattttgtgctttctgagcactgtgtttagtgaatgtattgttgttggaggagaaggaccaatgtgcgggaaagtctcggctctctcgtcccccctcccgcccccggggcgctcctcactctgtcgcccaactctcgcgcaaagtcgagaattggcagaccatctccatccatgcatgcatataatgcttcttcccatctcgcgcaactcctttcctcctcctcggctagagctcttcttctgatcaatgtgattgatcaattttgtttgtatgtcgggcttcatcccactcccacctttttttctacaaattttggcaattaattatttatattttcagcttaaaatgcttttttttaaatgaaagcataatcattggcaaaaaaacatatgtaaagcttatcagcaatagccgcaccatgtgcactaaaaattgactagaatgaattgagccctgaaatttgagaataaaacattatggcaaaatttggatggcacctgttgcccccccccattttctatgtacataaatctcagggatgttgttgcttgtctcgggtttcgtgttctttgatgcgtgtctcgttctcaccattattcaatcccaaaatcagctttttgagcccgaagctctgagttcgaagattttttgatggcatgcctgcaagtctcgtaatttatttttcttctcgaaatatccctgttgtatattttttcaattgggctgcgggaaaaatttatattcacgtagttttttttctattttttccatctaaactatgtattcagaaccttgattaaagcatatttgggtctcattttaattgggaaaattgaaaaaatcgactaaaattaataaaattcaatttttttttttttttttttgtatcggcgcgccaataaaattcgctttcgattttccagttttttcttcatcattcatcagtattacgatgtacggactgatttaagactgcaatttgttttatggctagctgtggctgatcacttttccctttctttttattgttccggatcaatgggcgagcggcgaaaattattttcaaaacccgatcagatcaccaatttcttgctgtatttgagctggatttggttaaagaattcatagtaatggggcaattgaaagtcagtggcatcaattctgaggtggaaaaaacatttaattaataattcatttattactattttttataattatcaaattctttaaaattttcggctccaatttttaattagagttcgaccttcgatccaggctggatttttcctggacttggatttcctgggttttgtccacaggtccacaggtcataaacattttgtttgcttattgaaacaaatttcaaaaaaatccagatcaggcccggatccaggcctcgaggagcctggtggatttttctggatttttgtgcaggaaacccaggtacaggcatttttcaaaaattcgttctaaattcgacaggtaaatttggttcaaacccaataaaaaacatatataattcaatcaagtttcgcgaatatacgcctatatgctggagatttttctccagaaaatctgatcagaaacgctgatcattttcacttttccaatttgttttcaaatttttgaccatttgcatataaattcaatgcacccagcagccagcagcagtaaaatttttcaatcccaaaatgaaagtgnnggcggacggacgcgcagatgcgcaaacactcgaaaatcccccgaggggagaaaatgcattaaaatctcttccagcggcgacgctggcggatgatgatcatcatccacccacgccgtccgcttctcaagcgccgccgggcgggtgttgttaggtcaatccctcccgtccagcagcagcatcaagctctgcccgggtcggaagtgtactggcgcgaatggggatgatccccccccccc

SEQ ID NO: 4033 - DNA, 4076 bp, Heterodera glycines
ataaatgtcagggatgttgttgcttgtctcggggtttcgtgttcttgaatgagtgtctcattctcaacattattcaatcccaaaatcagctttttgagcaccgaagctctgagttcgaagattttttgatggcatccctgcgagtctcgtaatttatttttcttctcgaaatatccctgtcgtatatttttacaattttaaaacatggcattaactaaatcaaattttcttgcgcgtcattctgcttttctcaaatcaaaatatcaggtgatgctctctggaatctcgctctgaaaaaatatcgagaaaagaatgtttactctaaagattaaaaaaaattttttttgtttgcttttcaccgatttatgtcaccgcttttcggctaccaaagcaaaaagtatggcactttttcaagggctgcgggaaaaatttatattcacgtagtttttttttctattttttccatctaaactattcagaaccttgattaaagcatatttggggtctcattttaattgggaaaattgaaaaaatcgactaaaattaataaaattcaattttttttttgtatcggcgcgccaataaaattcgctttcgattttccagttttttcttcatcattcatcagtattacgatgtacggactgatttaagactgcaatttgttttatggctagctgtggctgatcacttttccctttctttttattgttccggatcaatgggcgagcggcgaaaattattttcaaaacccgatcagatcaccaatttcttgctgtgtttgagctggatttggttaaagaattcatagtaatggggcaattgaaagtcagtggcatcaattctgaggtggaaaaaacatttaattaataattcatttattactattttttataattatcaaattctttaaaattttcggctccaatttttaattagagttcgaccttcgatccaggctggatttttcatggacttggatttcctgggttttgtccaggaaatccaggtccacaggtggcgctaggacttttcgacagcggacctttcgacagaaggacttttcgacagcggacttttcgactgtaaaggacttttcgacagtgaaggacttttcgacagtacactaacaaatcaaatttttcattaaaaacaaataatttctaataattaatcttgtctttttattttattatttgtgaaataagaatttttaattaaaaaatatatttttataaattactggtttataaaatatcttaatttagcggggtttaagaaggcattttagtttattgcactgcatttttggagttctcatgaatggttttcttatcaataataaataatttatttgtttgacctccgtttctcgaccggcccaaaaaagagtgaccatgccattcataactattactgaaaatatttttgaattgctgtgaaaaatgtcttctggttctagtggtcccgaagaaggtgaaattggggccgaactctttgcaaatgaagcctttgaagaagcagaggaaccagctggtcttgtccaattttttcgaccagaaagcaagcgtggccgagagttaatcagaagcggcggttttgaatatgcctttgaagcggacagcggacttcaagaaggtgcaaaacttggaattttttgtccaaaccccaaattagggatcgaattttggcgctgtatcaatcgccccccgtattgtttttgcctatttcggactttttatgcctttttaagtgtctatttagtatgcctaaaaatctaatccctaataataacaattgaatttaaaaaaaattaaatcccatttgagaactggccaaatattttgcaaaaaattggcttggatgccgtcaaatttggcatgaatggaattcgtggtaaaggcatgaaaagaaaagaaatttatgttgaacaagacgaaaatttgctcgcgctttacaacacacgtgaacagcgccatccctaccaatatttaagagctgtggcctatcgaatgccggacccaatttaacttttccataaaaacggaaataatttcgaaacaaaaataattattttgcttactaaatgaaatagcattgtcttttttaaaactaccatttactgtcgaaaagtcctccccttaaacaaaaattttttctgtcgaaaagtcctttctgtcgaaaagtccgctgtcgaaaagtccttctgtcgaaaggtccgctgtcgaaaagtccggcgcccaatattttatcgaaaaattatttttaaaacaaaattagaaaatcattaaaattatttaaaaaaaaagaaatctgaaaattgcacattcgataaaaaaaatggaaattgcacagtaaccaagaaatgaaaaagaacaaaagcgcaaatacggtaatcagggaacagcgaaagaagaggggaatgaaaaggtataagacacaaagtgcgtggatactgtagcgtcaattttggtacaatgtaaccttaatgaaggcattaggtaaaataattaatagtgatagggttataagttgtatgattttgcatattttttctgcgcatatgctatgaagaaaggggggctcaaaaatagcatttctgcgttaaaactttttggtttggagaaggtttttagtgcatataaaagcatactttggtgggtttttgaaaataaatgcatatttggccatttttgcattttgagagcatatttcggtcatttttgggaaattttcacaagaaaaatgcgaaaaaaacgaaaaatacaccccctaaaggatcgactttttggaatttttaaaaaaatacacccttaaaaatcgaaaaatttttttattttgtaagacttttggaaaaaattatgtatataaaaatgtaatttcgttttagcataaaataaaaatttgaaattgaatattttgcaactgtctaaaaaatgcttataaccctaataatgaatgaacataataaaaacggtgcacgacgtttgagtgccgagtcatttttgggtcctgcgtggatggaattatgataattaatttgttagcgattaattgaagaaatggacgacgacggcacaatcaatttcctaaaataattaattaaaacattctatccccttccttatttaagggcactcccactcattagtgaaaggcacgaaagcttgaaatacagtttttctggggctctcaatttcagaaaaacggtggaaccaaaaaaggtgtgccaaaacagggagagaaaatgccatcaaaagagtgccgcatttttgctcataaaatgaataataataataatatggatggctttattggatggttgattgaatgaaatatatgttggaaaatgaaaatgatatggcatttgccaaaaatgaatgtgataatagctaagctgctgcataaataatgaattttgaaataaaaatgatcaaaaaatggtgatcagtcaatgattatcggtcattcctatgccaaaaatgctgatcagtcgtcagtgggtgatcgatcattcccaactccctcacatccatggcacctaaatgccaacaccattcttgttgttggcatccgcttctggcacaactgcagccgctgtttcgtcggcatcaccaccaccaccggcaccgtcatgcttttgtacctttttgaaattttttttcttttttttacacataataatgaatacccgggggttttcttggtcgctgatcacggatatggcaccaatttcgaccaactcgagatccgttcccgaacttgaacaaaaagtcgagatttgaatttcgagtttttgactttttggatttggggttccgaataagtccaaataattgtcatattcgtgatcaacgatcttttattgtcttacaaattatcaaatcactactcatctgatcaaaactcacttgtcgtgggtcgttcacgtacacttcatgtgccccaacaatttgcacacgtggctcctcctcctcttcatcagttgcggttttggtgccgtaattatccgagccattggttgtccttgtgcgccgcgatcttctgctgggccgtcggaactttctccagcaaaa

SEQ ID NO: 4034 - DNA, 1233 bp, Heterodera glycines
gacaaatcactaagtttttttaaagtttcattgaaaaatttttcttgaaattttctcatgagaaaacgagctagtcctattaaaaaagactgtcccgcgtttcgcaccgaatggccggcttggccggcaccgccggaggtggctgcttttggtgccgtcgttgctcattttgctgaacttctgcggaccgcacatcattgccgccttcagcagtaggctgtccttgttgttgtggtaagtgccggtttctgtgctgcaactcggccaccaccgaagtgccatcgcatcgcggcggcgacggcagtgacgtcatcgaagtgtccaacaagctgagcgcggccagcgatttgctctgcctggaaaattcacatttcattacgatatattttgcaattatacagtatgagtaaaatatatataattattttgtcaatgcgcttttccttataataaatcctctcattgaaacgacaatttgaaaagctttaaagccggggaaacaataatgataaacaattaagtatttccaaaatttttcaaaaaagcatgtaaaattttctcaaaatgtcattaaaatgcattttttttcttagccccaccccccttttaaatgtaccgccacggcaaaacgccacacctttccaattgttgcgcagcagcgaccattgaggcgggcaatttgttgcggtaggaggcggaggagacgttgtccacagagagtcggcgatcaatcgcagaagcggacgcgtaatggttgttctcctcgacgtcgtccgcttgttgctgtgcactcaccacaatgctgtccagttggtccaactcgcgttcaacctgtaagaaaatcaaaaaatctgggttttcaataaaaattttttgaaattaacgaaattttatgagtgctctgaagcaaagttttaaaaaattttttgacggttttcaaataacgaggacccagacaaaattttgtgattgggcccaaaaatgtaaagaattttgaaattcaagtccatccctgatcaaatgggtgagatgaatccgtctcattgtgattgatctatgaggggaatgggaatatcagaaaatgacaattttacatatatttttttaattttttcaaaaatcatgaatttataagaaaatttgaaaaatatttcagcgatttttactgggcttggctttttctgtgcctctgctgctgctgttgatgctgttccgtcttggccatcctctgcc

SEQ ID NO: 4035 - DNA, 2098 bp, Heterodera glycines
cgccacttggagaagcgtcgcgggacactgcgcgtgaattcggcactcggcaaccgtcggcgcagcacaaagcgaccgttatgcatgggtgacggcggcacgcagcgctcgctgccgtcgctcctctccttgttgccggaggcgatgccgttgttgtgacaacaccagcccagctggaccaacagtggtcgctcttccgcgtccatgtgccgctcgctaatgccacccgtgccattgtcgtcatcgtcgtgaacttcccacagcgagtaggaggcactcgccggtgttgtcgccgccatgtgcatggcgttcgcctctgcatggaatttggagaccaacgcggccaccacatgtgcgacggtgtgtatgctggacactcgcatgcattttgttgccaaggcacccgtcgtcgaagaaggggaagactgttgttgttgccgctggtgattttggatttgttcatgaagatggaagcggatcaccccgtggaactccgtgttctgcgagtgcgagagtaataaacaatcaattcattttttaaattaattgatgatgaagctatcggaaaagagcaatgcttttcggaaataaatcccgccccctccacctcctcaaggggtggacaaaaatcacaaaaattcagtaatgtaaacaaaaaaaggaaggccgaaaaacataatatgaaaatgcccatgcccagcccgtcaacgaaatgcccccgtgaaaatgccacgaaaagcggcaagtttaaaaggcattttttggtttaataaccccccccccccctcccaacggcatgggaacacatgagcaccagcagaaaccacacctcgtcaggcaaactgatcgcgaatatgtccatcattgtggcgttccagcgctcaattgtctcgcacaatttctgcctttgatgtgccgccgctgccattttggacaaaacaaacaaacaattaattaaatgggttttacaggcaagaaaatgtgtcaaaaatttgaaaggcaagaagagaattagtcaaaaattaaggcgatgatgatgaaggaagtcaaaaatatgcaaataatattatgggagatcattgaaccataaggtcactgaaaagtgaaaaaacaaaataattaaattacagtaacaattattataatagtacagtatctctctctgtgtcggagaattggacaacaaaacgcagcaatttcatggaattttcacaattgttttatttcattttatggaaaaattttaatatgtatatgtgtatttgtatgaaatagaaaaataggtgtcaagataactcatacaaaagtcaatttgtacaataggcaattcgtcgtacaaaagcttaggccaggcctaattaggcgttggcctaggcctgcttgagttgggttttttttgttgaaaatttacaattttgtataatttgccattgaatcggaaaatgggtgtattttaagaaaattgggtctcaattttaaaatttttggaagaatttctgacaatcacagtccccgcaattgtactgctacacaaggaaaatctttttgaaaattcaaattttctttgtgtctaagcccagcagaaaaatgggtgatttgccataaaaatagaattgaaaatagttttagattttttaaattcattcaaaaaagataatggaaaattaattgaaattttaaaaaaattggttaatttccgtaataatttcgctataaatgcaattttgccgtggtgaaatatcaatttaattaacaattatttttgctttgaccaacacatgccaactttttgctagccgtaaaaatgattattaaaagaggcgataaatcaattttttctcggggattgacttgttaaaaaatgaaaaaatttctctccctgaaaaaaatgatacatcattaatttgttcattaaaacattttgtgtaaaaaataaaaataaataaacgcgaaaaaaacggagattcaaaatgcaaatgaatgggatgggatgagatgacatggttttttaatcttcgctaaaaggaacaaagaagggggtgggggaggggcaaaaatatgtacttaaaatatgtaaataaaattttttaaatggtgt

SEQ ID NO: 4036 - DNA, 1106 bp, Heterodera glycines
aaagaaaggattttgacgggagaggaaaagccggcctcccccggagaaaattaatgctttttgttattggtggaggaaacaaaactagtttattgtgtgattattacgtgtaaattaccatatgtaaattgtgtgtgaatttcgagattcgttagcatataaattattagcatgcgaacggtaccccctttctccacctcctctctcaatttgttttccaactacattggtatgtattgtttgcccgaggacgtcgagaatttggccaagtgatcaatagtgacgactccttgatccgtagtcaaataatgagtcgagattactttaattaacggagtggtgaccttcgtcccctccccctccctctgtcaccgccgtttaatggagaaaagaaagcgcccaatgaatgaatgggtgaacagcaaagaaattgttgcgcttttaaatttaataagtatttgtatattattcgttttaagcgaaattgggaaatgctgtgtcgtgttaagtcaagcaaattaaaaataagaacttcttgaaaagcaacactccgttcttatcttctccccttccttgtaagcatgtctcaattttcctgtgattttgctcccaaaaacagaatcaagcctcctaacgaataaccacacttcgcaagctttaaaatcagttctgtcctcaaaacatgaaggcgatgagccaagacttttattgctttcaaaaatagtttcgtagatacatagtcaccaaaatggggatggtctcttcatgccttaaatttttgcgaaaaatgaaattctatgtattgtatgtatatatacatatgtaggtatgtatatataaaatattattattattattttaaaaatctaagaaaattttgtttctaaatgcatgacaataatttggggtaaacccaactcatctaaacccaattcatccatacctaactcatccatacccaactcatccatagacccaactcatccatgcataaaaatgccacgaagcagaccgcacaatcaaagaatgccacgacgatgactcgcagtgttatggatgagttgggtatggatgagttgggtatggatcgagttgggggtgactcc

SEQ ID NO: 4037 - DNA, 4236 bp, Heterodera glycines
acggttttcgaattaaggccagtttgtgagcagagatagtgcccaaccgacgacaattaatggcatcagcggactttcgcgtggcgagtcacgagaagcgacatttcagaaaggcagaaaacgcattcaagaggttataaagggaaacgggcgaactaatggcggggaatgggcgaagaaattaattaccgctcccttccctcattttcaaattatttgctattcttcatagaaccctgcttcagatctccaaccagcttcacatcaaccagcactgcactgatctcgcatttggcttcttcaaaatgtgcgtcaccaaaaatttgacgcgcggccgtctccgttcgcacatcgttgtcgcctgtctgtacatggcgtgccgaagcgaaaacacttctcatttgttgttggattttagtgatgccacccaggttatgctttattcatacttattttttttaatttttccaaaaaacaattttcggcatctctctgaaaaatattttactttgttttggactagaaatccaaaaattcgacacatttttccatcattataattcccacccgacacattttgatttttcctctttttcaaataatttgttatttaaagtttagataaatatattcgaactcggtcgcaccctaaacttcttgactcgctctttgttcatcaaacttcctcccaccgatccgtgcatgtacgtgctccgtttctccgctatgctcgattttggcgaccagcaaaaggaagttgcgctgttggccacacggattatccagcgaatgaaacgtgattggatgtccacgggacggcgtccgacgggcatttgtggcgcggccttgcttttagctgctcgtgcgttgaatttgaacaggcgagctaacaaaatatccacgagaactttattagccaatgatcctgtgagttttctcctgatcacttctttttgtcttttggggcttggcttttaactatgccaatgttattgtttttcgtattttccaggagtgtgatggacatcgtccatgtcgtcaatatcagttatgcggtggtaaaacgacgacttgacgaatttgccaacactccgtcgggcggattgacaatcgatgagttctccaccgtcgatttggtaattttaaatttcctccgttttttaagtttttataaatgactaaggaagagagcgaagatcctcccgccttccgcgagtccaaaagaaaacagcacgaagaaaagcgtagaaaggaggaggaaattgttgcggaatcggctttgaaggaagtgcgttaggtgaaatcgcagaacggcacccattgactcgtcacccggaaatatataacttttttgggtgggtgagatgggcataattggattgcaaccgatttgcaggcaaattcagattaactcatttcataccggacccttcctatattaattgaataatataaatggcttttagtttgaaccagttcgtctcgaggttgagcaggcactcctaaaaaggttcaaacgctcaccttatgccaaaatgattgcgaatggtttggtggacgacactgtgccggaattgtcacaggcaagtgatatgctgcaggaagaagtgatcgacacggtgtatcaactggcagaggaacaccaacagcagcctggcgcaatatcaaacaggtgccgtacaatcttacaattagggggcggaaattaatgacaaagccaataggctagtaagttacttttctcgttttggcacttccccctgcccaaaaaaccttcgccgaccttgacatacatgtgcaaggggtgtctcaggccaagggtcgtacgacggacgattgagacaggggggggtgtacgaaaaaggtccacttttttccccgatgacgaccttttttctttcctttttttgctatattttttggcaaccttttgctattaagaaatctgagtataatttgttgacagatttacaccaaaaaaggtccattttggaattttgagtcaggtgacgaccagttcatacttttaacaacacttttcggccgcttttgatcaaattttaaattttcccccgtcgtcgacgatccccccccccccgttcccacgacgacccctttcctcttttacagccgccccccttacgacgaacgaagggagggtgtccgaggcggcctcttacgacgagaggggggggggggtgtcgagacaccccttgcacatgtatggtcttgagtggtggtggatggagcaggagagggttttttaaattttaataaagcactttttcatttattttcagcgggcattatgccctttatgggccatctttggcttcgttgggcatttccaaggatcaaaaccagcagcgaactcagcaacaccaacagatttcttcctttccctcctctgattcaccagccatttgtccaccgactgttgggaaccaatcaaatgatacaattatctcaaacgaagacctcgacttgacaggtcctttttagtggtggccttgacattttacaatatttaggcatcgatgacaatgaaattaactcgtacattttgacagacgtagagacgaccatcaaagagaagtattggatgaagcaaaactccaaacatttagaagtgatggaggaaaggttggaattcggtttaaaacaatatcaatctaataaaaccatttttcaaattcctatttttagaaaacgacaacgccaggaggagcaagaacaacggcaaaataaagaaagcggcccaaagaggagaaaacgtgccccgaatgttcggaagagggaagtcaacgcggttacgcacaatgacgcgatgctccatgtcattcaggtggagggggccaatgccgaattcattccttcactgttataaattttaggaaagaaatttgtccagcaaaattaactacgatatactgaagcaactcgatgatgaaagctgacaaagtgaagttacaggaaaacaacaatgttttatcctttaatgtaatgcaagttcacaatcagtcttcgctttaggcggcacacccaaaatattgcaatttttgaattacaaaatattatttgaattgttgctagctttttttctttgttaataaacttttcctaaagcgttgtttttttctaatggttttgttacaatatttttctatcaaaatgtcatgacacaatatcgaaaagagatggtattattttctactccatcaagtgtaaaatgctccattccaaatcagtgacctctttttcttctcgtcacaagcttccaactcataaggacagtgtcggcatccttctccacaacatttttcatggaacagcaattggctcagcgatttcaccggctgcgcagtctccggacatttataagacaattttctgtcgcggatggcccgcaaatgtgcggtcaaaatacgccgttcctggccttcaaatgggatgactgattaaatgcaaaaagaaaaagcttaaaaactgactggtcattttgtcaaaacaaagccatgacacctaaaaaacaaagagaaaagggattgatcatgctaattaattcctatttgcacaccttcgtctttttcatcgtttcttcaaaaagcacataatcggccaatatttccccgccttttgccggcacgagttcgaagacgggtcggcccggtccccggcttttggcaaaatgcgtcggtagcactttttccacagttatacgcgcaatttcagcaggaatttttggtgtcgtcataacaaagtgctgcacaaatttacaaaaatatattgttgtagaatactaaattattgaaaaaccactagaaaaaatacttctgcttctaattatatgtagccgggatggcatttcgaggcctcaaattttttcggtaatcggattccgtgccatccctgataggaatgtactgtaggtatataggtcgagttaatgttaaacaggtccaattaaaaattaaattgctattatattacaattttatttttaaatttttgcaaaaacattctagtcatcttcatctaaaaggcaaatttgctcttttttgaagaatgatcgttcaaaacggactgttgcacactaatcagaactcaacatcggcagctcattgtcagtttgatttcttcctggacacgatcaaaagtgccaacaatcgcactgaacttcttgctttgttctacaaattgcctgaagtctgagttgtgaattctctcaccgtggaa

SEQ ID NO: 4038 - DNA, 1421 bp, Heterodera glycines
  misc_feature (24)..(24): n is a, c, g, or t
gatatatcacagaagcggatttgnacgctttgttcaggtcccattaatcaaaatgataaaaattgttgtgctgtcattcagtaaaagtgttaatactcagtgatgcattgttcttgcgctcgccttgccctgccaccagcctttgggctttgatttgttcacttagccaatgcgacggcggcggagcttttcagttcagcaaatgcgtcgcacttttgaccaaagttcagcgggagctgttgagaaaggcattgacaaatgcgcaaaattcagaaggttgtgtaaaaattactttttttctcttaattcgttttaatttggttttcttttcccccattgttttttgtttccttttcagatggtttccaattcgctttcgttctgtccagcttcacttcgcgtgtctataacttttttggtggtcacgaatccttccatcggagaaatctttcacaattttgtgaattttcttccccatcgctctcttccgatgcttttgatcgcgccgctgcaattgttgccacttttgaagataatttgcttgccgttttggtggaagttgctgagagggagttttctgctttgaacatggcattgtttacgcacattttaacggagtacagcacggcttccgccggtggtgaggaggtggcattcaattgcctggcattttttaaataaaactttattttacagtttattcgtcgattttttgctgccgcactatccaatccaacaacgatttctgttctacatcaaatttttgctcaaaaaagagatgaatgttttcatagagcagagagccgacggaattgggaagcgatgcttcgcattgttgtgacaatggcaccaaatgggcaatgtttgcaggtgcatctcataatgctgaaaaattcaattttaaaatttcgtcttccaaaaaattaaatttgtttgggatttcatgctatttcaacatcttttttatttctttcagtgcctttttgacgattcccttctctccgatgctcacttccgtccttttctcattgagcgtgtgtcgctggtcccttcgtcttccgctgattgtcggccgcgcaattccgaaaaaatcgccgattttttggcgttgtctgcccccgccctttcattgacggcatttctttcgcatgtccaactttttgtcgaccgttccaaagttgtggagatggcgtcgctgcactcgcatttcgtccaatctttggctgtcgtggactttgcgcgacgactcaagtgaatttgctgccgatgggcattaactggtagcaattgaattggggtcattgacagctctggacagcgttgttcggttcgtgatcagctgatggtctggttgggggcaattgggccccaaaaggttggaaattgccgggccctttttttgcattaattttggtaaattt

SEQ ID NO: 4039 - DNA, 913 bp, Heterodera glycines
tgatgcgcgagttgcgattttgttggacagcgacgatgacgaggagacggaaaaggaacaaaacgcggaaaatgggtgcgattacgacgaggaaggtaagaaatggaagtgattcactgatttgacttgtcatgtcatgtcagctgcttctccctctgatcggcccgcttatttgcgcgattgtttggaaattcttttgcagtccaatccaaacgaccaaagcattaaaatgtaagaattcaattgatttcatttaaaccgaatgcaaaaggtggcattgggtcggtgcgtttcgtaccattccggaaatgttgcgaaaaaggtcaatcggatggaacactttgggcgaaggtttgatggaaatgattcttcagttaaacaaccgatacaatttacccgattttgaggttcgttaatgtgaaagaagggtcattaactaattgttttttgtttcttttttactttcaaggaaattcgagtggaaattctcaaacttttgttggcccaatcacctgaattggtctcaaatgcttttcggtaattgtgcttttcaattttgattgtgattggctgtttcttcagaatgatttcttcccgttgctgcccaatgtcgcggcggttccttttgctcagttccgttgtaaatgccgccaaatttttggcaaatggcggcgaagagggcgcaaaaacgggggaaaatacgccgaaaatagagcaatccgtgcgtttttgactacttttcctacacctagttctctttagacaaataacactaatcaaatcggtgaggggaaggggtgcaaagtgatcagacgatcgacgacactccaaaagggggacagcaaaacgcatgagaacggatttgcacgcagggaggcaaaaaggcatatttggattcaaagtccgtgagtgg

SEQ ID NO: 4040 - DNA, 4493 bp, Heterodera glycines
  misc_feature (33)..(33): n is a, c, g, or t
cgcacatgttgttaattgtcaaatacaattttntggtttattaaaaaatttggcaaagttttttatttttcaagaaatattcgctttcggaacggataattttgattcaaaatcaatgatcatcatcctcagtttttcttaggccattaacttttttcttacttcgtcaatgcctattcattcttggtttaaaaagaaattttttgtataactaaattatggactataaaactcatacaatagataaaaaactcgaaaaatgttgcatttttcgagtattttcgtttcaatttttttttcttattatcataatgtcatttttcttgcatttataaattccagaaaatttaagcttccttttgttaccaagaataagtaggcattgaccaattaagaaaaaaaaaaaattatggctcaagaaactgaggatggccaaaatgatcggatgccataaattgatcaaagtgtcctggctgatgtttttgccacaaattgcgaatgttttttctcctccgtttttgtttttttaccaccgcatcgccctgaaaatgtgaaagaaaatattataatataataattattattttgttgcttggttcaaaagctttaatgacatgtgaacaaaaaacacttttcaaatgtaaccaatattataataataataacaaatcacagccattcattcattcatttatttatttattccatcaaaaacaattgaattgttatgttttcatggggccaaagtgttcccaaagaatcgcaaaattttgaagagatattaaggatatttgaaaaaagggcatggaaaaaaagagtggagtgattggcatgggttgggattgggttagaagcgccgggcaggcctgaaaaagccgggcatttcctttttccggtcccgtgggactgaaatgtcgggacaccgggagtgccgagatgacgcgagaaccaaaatgactgtaatttggtggctcgtcgcggtcccgtgtcttgactgaaatgccgggaccgtgacagccgagacggggaccaaaacgactgggatttggtggcctcctccggtccatggactgaaacgccgggatttgataataagcaatcaatcaaatttgccgtttccacggcttaattaggcggcgcctcttttgatgggtttttgagtcctaacggcgaaatctgtgggaacactcccaacgtaaaacataaagcataataaattcattttcatttattcatcaccccaaaaccacacaaaacatttgctgctgatcaaagcaaacaaaaagtccatccaaagagtgaaaaattcattaattaattgcattatagtcaaactcattaaatttatattttatttgttaaatttcatttttattttattttattcattcaaacattgattctatgctaattttattgttcctcctattaatcgcaatttaatattttcaaattttgttgctaatttccatttgctaattgaccacttttatttgtttaactacacaaaaggacactcgccaagcataataaaaactgtccattcgtagcgctttcttctctttttttttaccatatatttttgcgcatagttttgttttacgagaccaaggtatggtatttgttgtcatacggtagaattagtaaatattctaatgaaaaaaatcagttttttcgtaaaaattcctataaaaatcggaaattttcttttatatttcgagaattgccataagtcagcagcctccatattttggtctcttaaatttcatcgcacaatatcaaaaagtccactcatttttcggattcaaacattttggcccacttaaattaaatgccaaaatcccccctccccccaaaaatcagagtttctaacaatttaagtgtttctgaggctaaatttaaattttttttttctgattgtgaggctaaattttttggggccaaactcttcccgaaatccgttttcatggtaataatatgtaataattttatttccaccacacagatccaagcatgattctgctgattgtactcatcagccaatgactgatattatataatttttgtttgttttttttcaattcaatttcattttttcttttaaaaatactcaaagtgtacaaaaattttcattttttcacacattttttaaaatttcgctgactcactaattaattaattaattaccacaaattctacgcaaagattgggcgagaaaaaggccgtctctgtgcaatcaaattctagtcatcgctgtacaaaccaaacaacaacaaaaaggatggaggactgctgccaattgttataaatgatatttaattttttacatttttttttttacatatttgtgtttcctcgagacccaaaaatttttgccagaaaaaactcgagaatgacggctaaataaaaagccccgagaatttttttttctgaatcaccgtcactctcgagaagcactaatgtgtataatgtttgtttcttatggtaaaaatcgaatttgcactggaaacctattttgaaaaccaagtcgaattttcggaaagccgctaaatcccatttttatcaccggcaaaaatatgcatttgccccaggcactatttgaaatttcatttcttgttacatttttatttttgatgtataagtatttgtgctgattatgatcaaatgtgtataataatcaaacaatgacccttctttaaacataaagacgtagccaaatgcaccgaggggtcatttatctgaaaatatggcatttcttgccattttaaaaaaatcacggtaaacgatggattgattaatgacagggtaattaagcaataattgctcattttttgttggttaattagcagaatggtcggtcccctcccccctcccatggttacgtctttatttacgttgtcaattatttcgattatgcaatcacttaataagaatttttttgccaaaatttcatccaaacaatttcttagtaaaagaacatgtgcaaaagttgtacataataattcattcatttgtgaccagccattcattcatttttttagaatttcctacaatgtttgtatttccaaaattcaaatatttttttcccgcaaaatttaccaaaaataacaaacagtgaaagcagcttattgtgtaaacacaacactgattcaatttctaaatgtcatttcccattattttcatgttttagtcaattcattaacaattattatttttggtttgtagcacattttttaattatatatttttttggtgacgcatttatttttttaaacatttcacatcattatttttacttggaataaatttgaaaaaagcatataaaactggaaagaaatgaagtagaaaggtattctcaaagctgcaaatatagagtagataaggccggtgattggagagggattaccataatccgacaggagagagacggtaactcaaaaattacgatcaataattatgtaggatggcagagaaagaagggtgcaaagatgagaaaaaaataatgtcaaaataaaaaaatttgatgagaaactcatgatatcatacggataaaaacgatggtagtcaagagaaaagtgtggacggtactgtagccgtaccgtactcattccaaagtgtacggctcattggtcggcaaattgttgtgtgtgttgcgccgagcctgacgttcccggaaaaacggcgtctcctgcgcagaatttttttttggttaccgtagttaggacaaatacacagtataccataccttatagatgaaccaaatatttgaggcaaacaaaatgaacagaccaacaccggccaactacaaaaaagtgagggaaaaagttaattaaattaaattttcctttttcttattcactctcttttctgtacttccctctctctctctctctctctctctttgtgtttgctcctcttctttcttttctttttctcttccttttttctctctctctgcccctggcattgggttttcttttctcgttctctcttctctctctcctttcattcgtccgcactttctttcccatacatttatttcctttttctttgctcaccgtaacagcagagagtggcgcgtgcgtcgcatgcgattcccacctgcattcgtccccgctcttcaccccatcgcaaatgccatgcgccaccattgttttgttcacattctcttccgtcgtcgcctctgaaatggcacgtgccgaaagcgaaaaactcagcgtgccgatcatccagccaacggtcaacagcacagtcaaaatcagatcctggaatggacaggaattttattaaaaaattttgaaaagtaaaattttgacgggtgcacttcattcccccccccccgcatcgtttccccccggagaaatttaaaaaaaaaaattgctaacttagaaatttttcaagaaaaaaatcttagaaagttttttacaagaaaattctaagaaaaaaattttctgagaaatttttatggtgaattactaagatttttcaaaaaa

SEQ ID NO: 4041 - DNA, 4573 bp, Heterodera glycines
  misc_feature (33)..(33): n is a, c, g, or t
cgctggttgattaaaaaaaattattcaaacttncggccccaaaacggcaaagtacccacttttttggaaaatttcaatgccaatcacaatttttgatcattttttgccaaggcctcaaacactcaccagcaccggaactcgatcatcgcttgtgtaatggctgtagcaaagcaaatagaagagaaggccagtgacagtgacgaacagagagagcggaatgagataagcgacaaagtcggcaccactttaacaaacagacaacatgtagtaaattactgggtaattaagctttagctggtgccgaccatttttgtaaaaaaattttttgaaattttgtcgtaaaaacttgttttcaggggttttcgggagtcgatgatcgtgaataatgcggcatccatttcatcaatttcggactccgtacataatacgccacccatattcgaacaaaaaagccgagaaattcaaattgtgtttttgaattaaaattggtctaattgctgcattggtcatatcattttcagttttgttgccatgtattttttgaatgaataaattgcaaaatttgagttttcgactttattcgaatgccccccccccctccttttcagtgaattaaattcgtaaaatcacaataaatgcacaacttacacgccaaagtttgggtcaaacagcaacgtctcggtcttgttacatcggcttaccgaaagcgtatcaatgcttaaaaaattgaaaattaaacaaatggaattgaatgatttattaattatgcacccacttcaaggagccaaattcgacgtgttgggacgccttgttgggacagaaaatggaaagatgaaaattccatgcgcggaaggcaatcagagagagctgaaaacagagggggcgaatttgcattcatattgctgtacagaaatagagccccgattgagtaaaccaacaacacgaggccatttggtccgggaaatttttccgaaaaaattgtaacgaaaaatggtaaacttttatgattccaactcaccacacagaaagctgcctccattagacggatgaacctacaacagttaaaaaatgtaaaaaactgtcaaaacggcgaaccccaacggcatttggagctgttcaaaatcgacacgacgaaacacgcgctccaacggcgacgaattcggcgacatttcacacaggaaaatagcggaaaatggaaataaaaacgaataaaaagtaaaatgtgattaaacaataaataaaaagacaaaaatgcaacaaaaatattcacaatttatcagcacatttcttttgttgttgttgttgttgaaggaaagggataaacagaacaaacgcactaacaaatattcatttcgggttgacagacgacggcacaaataataatgacgaacataaacgacatttattaaaacgacactgtgtgatttaagccaggcaaccctcctaaattaatgacaatgaaattgatgccgatcaaatgaacaaaaaaaaagatagagacattcagtcagtcaatcgatcgactccaaaatcaaaaacacatccattctcatccgattattgtgccatcagtcggagcccactttgatcagggtgtccgacaaaaactcgtacttgggcacttctgaaatgtacaacaaaaatgaaaatattaatttaaatagtacagcattttgagaaaagactggcccaggagggaataaaattcaagaaaatcgaggcccataaaaatctgacgaaaaataagtagttcgcgcaaagtgtgcctttgtagtaaaactctgctcatgtttccagaataaattgctattttgcagcaaacacaaattccagccatcgtatcgaataaaaatccatccgcgactgagggtgcaccccaaaatctcgccgagacaagatctcgccgccaaaattaaaaaaaaatcggcggcgagaatttgtcccatttcctttttttctacacacaaaatcttattactaaatatattagcaattaaatagtaggaaaactgccatttatttgttgattaagcatattttaggcattaaaaagacgtacccaaattgagcggtgccggccctttacgaatgcgaccagaagcgtcataatgtgagccatggcacggacaaaagtaaccgccgaattcacctttgccagctgaaattggtggaatttgagttccatgattgatttgttggtaaaatttgctaaaaaaatgttcttacaattagcaaatgcctaattttttgttgctaaaaaatgtctgtccacacaaaaaggtcgccgtacgtttttttggacaactttttttgttgttgttgttgttagccaaatttaagcattatggtcttgtactgttcgctggctctgtggtatactgttattcagcaaaaattcaaaaaattttataactataaaaaatgtatgcccaaataaccataaagaccatcatttttttgagtgtttcgtcattgaatttttttgtagatgaactaaaattttttttacgtgttaatagagttttcgtcaagtgctttctgacagtatcagaaatgtcatatttgattaataatgaaaaaaaagttatggtccaacaacaattcttcgacaacgtttcgacttgcccaaattacaatgcctcgaaatccaacaatttttttctctaaaatatcgcttacacaatgggatgcagccgaggtgggtgcacacgccgatcagcacggaccattccggcttcagcacacggtcctcgtcccgttccgggtgacgcagtttgcccacttccaccgcacgttcgcgctcaatttccttggccgtccgatgcttgacaaacacgggcttaccacgccactcaaatgtctttgtcttgcccaatggcacctggaaaaaaaaaattgaaattggaaaatttgggcggaaaatggcattgttttgggttcactactcttttattcccaaggttttttggaggtccttggtcaaagcgaaatgcattttatgaatttcggaactactgactaaaattcggtacaaaaatctgagaaaaaaaatcttagcaatggtttttcttgataaggagctatgtaaaaaaaagatttgttagattaattcatttgattatgaaaaataaaccaagctgaggtcgatttcggttgctgccattgcggcttggtcccgtggcatccatttgtaagtgaccgcttttcggacggcgaactttgctgtcatcaacgtaatggcaccgcccactgaaatgtatacaaaatttaatatttaatttgagaaccaatcaattgaattaaatataaattcgaaagtcagggtcacattcaataaaaagacatccttttttggggtgacaaagtaaatacgtaaactttagcagtgcaaaacattttgtttcatatcccgaacgaaaacggataatccgttattttttcaaaatttcaacggataaatgtccaatagtctccaaggaggtttagaccactctggtgggacaacccttggttaatcgaaaccaaactcggcaaaaaatggcaaacctccataaaagatgaagcttgacacgcctttgcgcctgtcctcagtcacatgggacggttgagctgggtctttggtcaattcgttgcgatacgcgtcaaagttggggaattggacatcgttgtgcactgcttgacgaccaagcggaagcgcgttgaccgactgttttcgaaggttgtgaaacagcagcattgacgacgagttgggcaacataattaataatgttgtcttatacgagccttaaaactatgttttgaattgtttgtggtaagtttttggatatttttccactttaatccccccgaaaaatatatactggaatttcctatatttttaggggttatttgatgcgctgagcacgaatttgaacttctttatatgcatcaaattgcttagcatttgttaagaaaatattttcaatttaaagctttcgaatgatatggaattaaataatttcagtttagttagagatcaagcgcgaaagttaaaaattaaaatcaaaaagttacgaaactcgaaaagatatctatttgaaatccaacaatgatttacatattcctagacatgcacatttgtccgtttcgcaacatgaataattttatttatttttgtcaagcaaataaaaaatggctcccggacatttcgacaatgaccgtttcgccaatgaccgtttcgacaataccttttcgacaatgccgtttcgacaataaaattaaatatatttttttaaataaaattcaaatttctgcaaaattatatggacggtgcggatttgggatcaatataaaaaagtttttttttcgtttttttcaaaatagcattatgagaatggctttagtttgtcaattttcggcgcaaattgcttattttttatttaattaaaaattgaaacattgttttacacctaaatagttgataatgaattagaagcttttaccctgaaaaaactattcttgattaaaaaaacaatttttttttgttcgaattcgggtctggagttcggaattgggcaaacccgagttaagatct

SEQ ID NO: 4042 - DNA, 2349 bp, Heterodera glycines
ttttgttagaattcgggtctggggttcggaattggtcgaaatggatgtcggattcgtgatcagcgaccccgaaacccccctaaaacctatctttaaacacttaaaaattttatatattttttaaaaaaaaggggggggggataaagtatactaccgggaatagtaatggaaaaatcggcttcagcgcgctctttgttgacatttttaaaattttgaggtgtaggcccaaaaccgaaaagtacctaacaatcttgatatcattcgaaagccctttacatgctctataagccttagaaaaagcaaaaagattttctcacctgcaaaaaagtaaaacagcatctaaacattgttaagctttcgaatgataccaacaaatgttggatttggttgacaaaaaaatttctaaccttttacaaatgaaagttggataaaaattatccatcgaattcatttgccccaataaaagcggagtcgtcactgtcgcttagatctgatcatcacggagtggaagtgccggattctctttgaacacgaccaacccggacgatggatggagacttggaattgaataaatggcctttttttgtcacgatttcgttttgattcgatttgttttttgttggtttgaaaatgaaaaatctaattgtttattttgttttgttttcgctgcttatgaatgcatcggaatccgtcagcagttggcatgttttggagctttgaactattcacttttttcttcgtaagccaaatctaacaatatcggtacttttcggttttgggcctacctcaaaattttcaaaagtgtcaatttgctgctgttcctctcttttctgcttcattcttctctcatcctcctcttccttccgtcgaatttttccttttcctctctttctcatccgtctctcctccttccccaatgctatttccctcctcttcccttgtttctccatttttgctaccaacaaatgttggatttggttgacaaaaaaaatttctaaccttttacaaatgaaagttggataaaaattatccatcgaattgattgatttgggggtaaggtaaaacgcccggcaaatgtcatcattagggatcggatttttaagtttttgcttatttttctgcggctttaactcgacgagaaatgcacgaaaaacacattttgcgctcggaaattcttcgttttgacgcatttattcgaaaatttttcttgacgagatcacattttttgcaaattttcaaaaaattttccacataaatttattttttcattgaccaaaatttttgtaatttattttttttcttgaccaaattttggttttttcgcccttatttaaggccttagtttggactttttcgcgcttaaaaatccgttccctagtcatcattttgcaaaatattctcctctgttgcggttccctttttcttccaatccgtcgtcattttatgccaaaatgtttccgcgccttccgtttttgtcaatgggttttcgcctcccattggcaacaatttaagacgaacaaaattcaaaaattttttggataaaattgattttcgtgcttctttcatccaaagtacaatccgtaaaaaataggaaaccctaaaaatccaggctttatccaacgcaattatttttctgctatttgtgtgacatcattcgaaattcaacagcaaattttgctaattgccaaaaaatgaaccgacggtaagcacaaattcttcatttatttaactaaactgttttcccataatttcagttggatttgcaacgacgtttggatggacattttcccatcctttgaccgtgctcaactcggcctcaaattggcattgctttcaccacgttttgatgaattgtgaacaaacatttcaagggcaaaagcgaattgacaatttggagaccaatcgcaacaaaatccgttttaaatgccttcagattaggtaagtcaaaatcagagttatagcaaaaaatgcattctttcctttttgcagttacatggatcactccgtcttcgcttttcttcgttcaaattagggttcctccccgacccctcggggggcaaaatgtcgggggccggggacctcggtgggtgacatgtcgggggtcgggtcaggggcgagctcaattgtcgggggtcggggaccccggtcgggtagtgtgatcaacgaaattttttaacgaaaaactcaatttttatttttaaatgctcgtaaatcttcctttttctcactttaatcatctgatttcgttaagcgccagcaagagttagtccaatctggcctttaaaccaggggctttccatttgttcttatttataaagaattttaattttggggtagcgacaaattttt

SEQ ID NO: 4043 - DNA, 1918 bp, Heterodera glycines
tcaaaagatcatggtaaggaggaaaaggggaaatccattaataataatttgggagtaaaacaaaaaataataaatcaaatttaattattaaacataaatagatgatgatgaattccgaattggtaaggatgggcctgcaaatttaaagtcaaacactgagcaattcaatgatcggcaacaaatcaaagttggaaaaaacaaaaatcatataaatgcactctcggggtgtactatagtcaacccccggaaaaaatagcatacctaaatgctataccaatcgattcgtctggagctatgcacgaattcgcaactggagacctactttttcgtgcatagctcctcgagacgaaatgattggtgtatcatttatgccattttttctggggggcttgactaaagtatatcccattctcgagatttcatattaatttgttgttttacagcaagtttgtgaaaagtttataaaaatggaaatggaattgaaggaggcaaagcacttacaaacgattgccaaattggaatttgaaaatgtgagttgataaacagaggaataacaattataaaattaattacaagtttataaattgcgaaaatttgtcataggattttgggttcgattataacgaatctgacatttccaattgaccaatccctaatccaaagtcgacaaaagtcgaaaattcaaatttttagccaccctttgacttttataaaatttaaaaaactccttttttcagtaacgccaattatttaatttaacatttattcaattttgtcaccggtttgaattagaattaaaagcatgctttaatattaagaaaattattaatttgaaactcattaaagcgtaaaagtttaattttcgatttcactgaaattttgattttagaaggcacttcaagaaaagctaaagcagcaggaaatgatgacagatataaatgcactgcaggcgaaagtggccaaattggaaaaagaacaacaaaaggaaaaagaaggaaaatacggtaaaactgaaaatatactgtaaaaatgtctttagcccttatactgtatttttgaacaatttttattaattattttttgtttagttactgtcgagcaattcaacaaaattttggagagaatcagtgaattggagaagcagcagaaaaatgaggagaaacagcggctgacatcaaaaatggcagcagaaaatgcaaatggtaatgagaaaaagagcaaaaatgaaaatgggagaaaatgaaagcacaaagtatcggataaatttaatggagagcataaataatacttaaaaactaagaaattcaaaaaattctatgtttagcaattgtggaaaaaaccgatgcactttttgaaagggtcgctgaaattgagaagcagcagcagcaaaatggcatcacaggagaggaacagcagaagaaattggacaattttattggcattttgaaggatcgatttggaaatggtaaaaataaaatttatttaaaattaaaattgttcaaattttagaacttttaaatgccgttcatcccaaacttcgtcagaatattgctgaggtgtggaaaataaaacacatacataattaatagggatgtcaaaaatttgtcaaaaattggtcaaaatatgtacataaatatgtaaaaaaaaatcccaaaatatgtacgaaaataagtaaataaaatttttttaatggctatttttggaaaaaatctttgtaaagggttaaatatgcaaaaaatggcagaaaaatgacctaaataggtttagaatccaccttttaacattttaaaaataatttttaagaggacattttaaaaaaaatttaatttttttcacaagaaatttctaaaaaattttcaaaaattctaaattatgtttaaaaaaaaaagaaaaatttgctgaacttttggattttttt

SEQ ID NO: 4044 - DNA, 4535 bp, Heterodera glycines
tcaagggctatcgtatgaaaccaagattgtgtaatttgattgcgtctggaaaagttatgagttgatatagtcaaaaatttagcaaattttgcacttttcggcgatcgaccaaccacgagtccggctggaacgggaatcccgcgggaaaaaacgggaatcccgttcccgcttcccgtcttttttgcctgacgggtatgccgttttcccgcgattctttccatgtgcaccaatcgttccgtgtcaatgaattattattgccttcttcgtcctcatcctcagcttcttccatcactcacaaatccggcacaatttttgaccaagcccagcaaattgccaatgccattcagatacaacagaaacaacagcaaaaattgctgcatatttaaataattgttgttttcacaatcagctttttgcaattgttgcaccgaaaagcgcctttttggcatcgatggtcattggatgggcatttttggaaaatgctttacatgtgttgggccaggatttcatgaattagccgggaacgcgctaaaccccggcattttctgggtgtttggcgtcagtgccagatttttccgcatttgatagtttagtcgatttttttgggtttttgaatttctatggtttttttaaaaaagtcatagacaaaatcatgattttttttaatctgagttctgattcgtaatcagagtgtttttctgcccctgagaaaaatgctttttaaaattttactatttttccatcgggaccactattctgctcttttgcctatatgtatatacttacatctaaatctgtaaaaccctgcgggttttgatataaacgaaaacaatttttttcattttgttgcttttacatatgtagtatttcggtcctccccccaatgttgtgaaaggcgtttcattctctgcgtatgtgatgggaagggagagagaagggggggggggggcaaagcaaaatggaaaatgatgaggggggggggggggggaagtgtagtttacaaaaaattaggattttcttgaatttttaagtcttattaatcataacttttgatgctgaatcgcttagcttttgcttactaatatcttctaaacacgtagagttttcgaatgataccaattttgaagaaattaacgaacgaacaaaaaagttatggccattcccgtttgaagttgtatgaaacgccattgtacgaactgctaccgacccgttggtggtgctgctggacggaggggctgccacgaccaaaatgggtgaatgggactctcctcttcttctgtgtgtgtgtgtgtgctgtggtggtggtgtgatgtcccgtattttcgcgattttgtgttgtccacaatggcggcggacagtggcagcagtggaaaaatccctcccccccctcttcgccattctttttttccacacatatacaatgccataaaagaagagcaacgaaaaaatgttattttcatttacacattcatgtatatgttgtgttgtttatttttggctttacgaaaacatttttacttttataatattttataaattttgctttttttggttttttttttggattttttgagcatttcttaatattcaaaatacggttcaaaaccgcaccaaattgtcacctttaaatgtcctctcttccctcttctttcgacatttttgagcaatcattttttgtttacaaaaaatattcctaccaaaaactgtattgtgtttttacttcagaaacaccttaaaattttaaacataggtattttttgtactcaccttactgatggtgatctcgggtgaaaactgaaaaagtacatttaaaaaatttacattaaatctgaatttcagtcagctaaataaattgccaaattccttctaatgatcactaacaaataagggtgcaaaaagatcctcggaaaatgggatcacccgggcactccgtcccagtttccgtcccgcttttttagtttttccgtttcccgttcttgctaatttttttttgccgaactcacaatttaaaaaccaaataaatgaaaaatttaaaaaaaatcaatagcagaatgccaaaaattttaaatttccatgaaaacgattttttttttttactttaaattaaatgggccatttcttttctttttaaacagaagcgatttaccaaacggaaaaacaaaatcactatgattaaactaatcaatttttagctcaacaaatacttaattacaaaatatttctaatccaacgcgtcaaattcctcctcaccgtcatcagacaaataagggttggcacgcgttgatcttggccgcacctcataagccggagccacgtcgagaatgcttaaattataatccaatacatttatgagtcaaataaagaacaaataacaatttagaaagttctagactttaaaacttaacaattaggaacaaaaaaattgactgattcagaaaatgcattgaattaagagcaaagccaaaaaccattcctaattcaaaaagcattatttactttttggtttaacaaatttatccaaaataccaaccgttgcacctcggtcttgctcaaagtgccgctgtcaaaaagccgaatggccagcttaacaaaaaatctaattaatttttaaatcaattttgtagtactttcttgaggagcctgcgccgggggtgaaggatcacctccgcttcttcttcggcctgccggagcatgcgccggatggtcttgttttggcttttagacaacggcccaatggccgggaacccagcaaactgcaaaaaaataattggaattaaattgttttttttcaattaaagaacttttttggcaatccgggtggcatccgggatgtccgcgccacggtgaccgacgcttcgtttgcaaaacattcgctccgcgaccttgccgccgagaagggcaaccaattcggcccattgctgacgccgcgttttcgattcgatgacttcagtcaccgttgctccgtcggagccgtcctcgtccggaatgccggtgacctgtaaagcgccttgatttcttgggcaaatatttatgggaattttacatggatcaacttagctcggatcctggcataaaccagatcacgagcgtgtgtacacactcatgaagactgacacgtgccagcgtttgtgaatttcgccggtttccaatttctacggacttattgaagtcattaacgagatgccggtaggccaagcactggccgaatgcggagtaaatgacatttctaaattagaaaaaatctaacaatttgagcaagtgattgaagataaagatcgactttttgggaatttaaaaaaatgcactcttaaaattgaaaatttttaattttttgtaagaacctttggaaaaaatttattttataaaaaatttgattttgtttttgtatagaataaaaatttggaaattcaatatttttgcaattgtctaaaaaaatgctccttataacttgttttggtgcttttaaagtcaattcttaatttatacacaatttttggcattttttgagggttaaaagcaggggtgccagatctgaggatttatcctcattttgtggctttttgataggtcaatgaggatttttttggaaaatgatggatttgatgatttttgtggctttttgagaaattttgaggattttgaggctttgggggaaaatcctcagaatctttttaattttgataaattggcataatgttttgcaattatttaataatttgggtttgtaatagagcatcaaaacgaaaatagaaccaattttttttccaaaaaccacaaaattaagaattttttaatgaaaatctgctaaaaatatggtcaaaattctcaattttttccccggcctaaaaatcctttattttcttaaaatttttgcttaaaattacaaaatttggccatttttgttgacaaattctgttaacaaatcatattaaaatttacaaaaattctccggcggggcctatcggcaccgccgtaccccttgttccccaaaaaatttttggaaaaagcgccgcaaaaaaacaaccgatttttcatgctcataatcccaaaaaatgcttatttctaacaaaaaaatgctcaaattgatcatggacatcaaaaatataacatttgaacattttaaacgtgtttagaataaattttgtaaaaatgaggctttttgaccaaaaatgaggtttttttgcatgccaaatgaggcttttgaaaattttaatctggcagccctggttaaaagccatttttgccagtttttatggcatatattttcgtacatatttggttaatttgcgttaataattcttctgtggttgtgccactgcagtgaagaaaaggaaaaatcataattaatttgtgatctttgattaatagggtttgaagttgtatgcactaaaattcgccaaatatgccctataaacccgaaacaaaagagcaaatttttttgaaatgtcgtgcgatattccgaactaaaaagaacaaataataatagggtgaataaaataataataataaatcgtttttttttcccttgtcgacct

SEQ ID NO: 4045 - DNA, 3121 bp, Heterodera glycines
ttcctcgaagcgtttgagaaagatttggttgagtaccctctccagcgagcagttgctcaatgatgcgtttggcattttcgactttgtcaggaggtccagaaactcgtaagggcttctgaggattaaaatttccagaattaaagacttttggtttttttaccgttcccatggtcggttgatgactttcttgcactaacatcattttgacaccaatttgttcctggacaatttattgatgttttaaattaatgtttttttcgaaacctgtaaacccttgatagtttcgccattcttcccaatgataagtccacattttggtcctggaatgctcagttcaattgttattgcattggctccattttgtggcccaggggcacttctattgctgcgttcgagtacttcttgaataagttgtttcgccttactaaaaggaaacaaattggtacatggaaaatttatgtcaggattctcactcgatgttatgtcgtgcgccttgtaaagtgcactgacgaaatccactgacattgctttcgctggacatttgtacacgacagctgctctgctgttgtatgagctgaatttgctcaccacctcgtccaatcactaaaacaaagtattcaaacctaactatccgatctttcttatgcctaggttctgtaaatattaaactcttgccgagcccaacggcgctctcggggatgtccacattttcgaccagcgtctcagctacttgtgcacccataccaacgttagccatgtcggtaccgttactctttcgcttggccggataaactaaaaaaaggacattaaaccgctattgagtattgaccccaaaaccaaatgtcaatgttttaaatcgaaaatgcacatgaaattcaaagtttgcaaaccgtacaaacactatgaaatcgcgtggtaaatgaaaatgaaaaaaacgaaggaaaatgtgtggcaaatgtgaagcgacaaatgttatttgtacgtacaattcaagtcgtcggaaaatgttctcttttgtcctccgttagaagcagcaagctaaataaatgcataatgataaaatggtcgcaacgaggcagacctcgcctgttgtatactctaaataggaccgctcaattttagatatattgtaacaacgaaatagaaaattggagttcaaaaatggaaatgcaatgcaatgtaaatgtataatgtaattccattatcaacacaaatatcatcaaaaacaaatataaaagaaatttcaccaaaattgccgcattctcatatacatatgtgataaaatcaaatgtgaacataaaacactcacttattgcaaaatgcgaataacaaacaaaatattccctacccaatgcaaattttccttaaaaatcacctgtttcgatctctgtagagcagattcaatttctggatctgtcagttgttgaatagcagagtctttcatcagaaggcaaaagccggcattgaataaagttttttaagcttacggacactgattttacctattaaaaaatgtcaaatcaagataaaatatataaaacaatagaattcaattacaaaaatgaaacaatcgcccaattttttcatcaatacctaatattactctaaaatctctcctattattgtctcctttctcacagaatttttttttatttaacaaattttgaaatatttttgtaattgacaaaaaataaccgttaaattcatattagataaatagggcccggatttttagtgacaaaaattcccaaaataattaactaaatagtggccaaaaaatgccaaaatagtggcgaaaaagttccaaatttagtggtgtaattttttaaatagctgttttttaatttgaaaataatttaaaattaaggcaaacaattttattcactgtttgcagtcacaaatgaggaacatttcctttccaatattttcttagcaaatattaagcaattaaaaaaatttggggaagaaattttgagaaaattttccaattcttagaggtgtatttttgaaaaattttaggtcgattcttaggggtgtatttttgattttttttaggtcgattcttggtgtatatttttcgtttttattgaatttttgggaaattttccaaaaaaatgccaaaatagtggcaaaaaactattttagtggccaacttccaaaataattttttttaatggcaaagctccaaaatagtgattcctaatgatgaatagtggcgttaaaacgaagaatttccgagttaaaaatgtgttttttgtgcatttctcatcgaaataaagccgcagaaaaaatagttaagaaactaagaatccgggccctatagataaattattgaaaatttttttagcatttggctaattttttttgatttttttgtattttcatgattttggtagttttttgacatttagtcgactttttgctgatgtgacttaaattcgcacctctactaatgatatgctaaaaatttaaagaataaaaatgctatttcatttttattaatgaaaaattaaaatataccagtaaagtgaatctcaattgaaattcaattttagttgttttgcaattccaggacttctttatagtcataaaatggcggatcctttgactttgcttcaggaatatacaacaggaaagcgtggattgcgtgagctgaaacacgtaagtatagtttttatacattaatttgactaacttttgactaataccattttaatagtttaaaacaaatttcagaatgggactttgtattacgtgttcgatgatgctgcgtatccccatgattcgaagaccaatttaagtgtctacaacaagccagatgagttttattccatcgagtcgatcttgaatttttggaggatgcgtgaaatgcaacacactgcgtatgttcgggatgtctccggaaagggaatcgcatcgatcacgcgagttcaacggtaattttgctatattgacgaggaataataaactttgctgtgccaacgagttttagtcgggatctgatcgattttttgcgaggaggtgcattgccaaaagaagcgaatatgttggctccgatccctccaccgatccccgcttctcggcttcaagacgagagaaatcaattggagccgccggaaaa

SEQ ID NO: 4046 - DNA, 2132 bp, Heterodera glycines
ggagaaaaaagggtagctcctaactttcgttcttttttaatcgtgcgttgattagccaacgaattgacaaaattttggacatgtcaacggacggaggagaccaacccgaagtgagaggacttagtaacgaattgccagccgagaaagtagcacaattacgaacactcgtcaagaaaaacttgaagaacaaaccactcgacgacgaaaggtgagtcggttcaattccgacggtcaatgtggaattaaaagcttcgtaccgatctccgatttggctatgccggatgcgagtaacgacgccgtagggaaatttataacggagaaggaacggctgagaaaggatcgcacgacttgccttgaatcacagtccagggacttttcatgcgttttgaccgctttgaaggatattcaagtggttttatccttaattggttaccagtaattttcgaattaggtgcgagaaaatcaagccaaaagccatccccagcatgacttctcactttcttctcaatcgcagtcttcgcgggttcaaaagccgctaatgccgggcgggtacagtcgctacgaccaggagattttccagaaagagacggtggccgactttgaaattgaaaccgatctgagctttcacggtaaaatttctttttctttcttcggattcactacacctgcccataggaaatgctgcgctgaaccaacgcattggcgctgctcaccctcaaaatcgtccaactgcgctaacatcgaacggcgtccaaaaggcggacccacgacgacccatcaccgctggagttgctccgtccgccatgcgacaacaacacggcccgggccaaaaacgtgtgtcacgcgttccaataataattatccctgccggtgcaagttcactcatcacaatttacaatgcgcaggaaattttgcaggtttattcatttaaaaatattataaattaatttatgttaaggatttgcgttacgtaagcacagaagaaaaaaagcaatttagcagtaaacgagagaatgagctgttactgcaaatcccaaagaatggcgtcactgttccgtaccgagtcgtagacaatccaacacgattgaaggacgaggaatgggaccgagtggtcgcagtgtttgtgcaggtgggcgtatggtcatttcaggggatttgcaaaactgctttagggtccggcctggcaatttaaaaattggaaatggaatggcaatccggttgagatatttgccaacattgctgcgtttcacttgcaattcgacgaacttccaaccgatccaaatgtgaaaaagtggaggtttgttcagctgtttattttttggggaagaatcggagcagataaatgccttgaaaacttaatttttgaaagttaaaacaattctttaagtgtgcatgtgttgaaattgtcccgtacgaaaaggcatttggaccgggcggagctgcacaaattttgggaaatgctcgacaggcacatttcgaagagcaacaaaagggaatggctcagatattagcgaagtcggcacattacatttgaaaatttacaaacgattttttgtttgagttttttttttgtataataatttaccaacttccagcatttactcccttaccaaatttggtagtgaaaatttgattggtaaaaagtattagcaaagaccaacatttaaaaaaacatggaatcggcatttataaatatattttttaaatctatttaattttttggcaacttgagataaaaaactggtcacttcaaattaaaaatttctaaccttcgtgcctaatttacctggacaaaaatccacgaaaaatccaggcgttgtatccaagtacaggtcgaattcacggaaaaagaaacaaccattgttaattattttaaaaaatttattattaatcggacattttgtgtttttctttcgtcattagtttctctctttgttgttttgctttaagtcttccatttcctccgtcgctgccaaagtgtttgatcgtcctgccaatttccccctctgttgagtgggtccgatttcttttttgccctcagacggacgtcggtaggcgccgagtcggggcgatgagagaatggcatttcctgggggaggggcgtcgcatcgatgacgcggtcgtagccaata

SEQ ID NO: 4047 - DNA, 1168 bp, Heterodera glycines
tccttcttttctcacggtttgtcctcttttatctccgtccgtccttcactcgttttgtttcctctttaatggagcgtaaatgaccggaaaagggggggggggggggaagaacgaccgaccgacgggtggcacttttttctgttgcccatttatgtcattggcaatccgtcacaaatgtgggacaaatgcttgatgaacgatgggttgccaaagtgtcccccccccacggcgccgcttccgccaaaagcccaaacgatgagtgaattacttagtgcaaattttgcttcgggaaaagccaaattcattgaccaataatcagggaaaaagaaaaatatatctttatggctaataaatacaatatttggccatttttcttcaaatttgatttctctccacgcacatattgtagccacagcccgtgtcacaacaaagtgccgacttggcacaatccttgtcatgatggcaccaattgatcggcttaggctatgcaaagtttaattaaattatgtggcaatagcaattgcaactaaagtcgtcaaaactgaaaacatcctccgctaccttcaaacaggacacgtccaattgggccggcgttggacactctccgtcccccggggcgcagcacgggtcgcccgttatttgcacacacatctgcccgaggggggcgtaacttatacatttttgtcagcagaagagaagaaaacgggaaaaagcaaaaaaaggaaacggaaaaacggcagaaaaacttcggatgaaacaaagccccgtaaaacgcaccctttgcgtgtcgcattgcttcgtttggttgcaactgctcggaatgtatttgaaagtgcagtgccgtaatttgcctatgaaatgccttcattcatttcaaataacgaaaatagaaaaagcaccttttcgttggggatttcgttctatcccatcgttcgctcgttgagtttcgtccccgaccccaaaaaattcgaagccatccgccggttcagaaagggcaaagggaccgtgccgactttcggaagttgccaaagggggttttggcgtaattcgaatgggcggactgagaaattctgagtcaatggaagtgaaaaggagggaaaggagaaagaaaacggaagggaggagaagggaacacatacggaagaagaaaaggagagaagaggaattg

SEQ ID NO: 4048 - DNA, 2214 bp, Heterodera glycines
  misc_feature (2115)..(2115): n is a, c, g, or t
ggaaggaaataaaaagttggaccaaaaccggggggggggggggaggggaagggggaaggggcccgttgaagaggaaagagtgggaaatggacgaagaaaaagttggacaaagaaacaaagaaaggaaaggaaaaaacattcagaaattataaaaaacgcacttaaatgctgcagcattattaaccaagtgtatttaataaaaatttaaagttgaaaatattttgaaagtgaaaagggcgattcttccgaaggatcgcagccaaacaaattgaaatggaaaaatgagtattgtcaaagccatcgtggcattttccgctccttttgtgccatccatctttttaatttttgtttattttcagcaatagacaatctgtgcttttgttgaacaatgccaaggtgcgattgcgcccccgaaggaccaaaagagtgcctattcggtttttgccgctttttcaattcattcgatggcaaaaagggaatattttgaactcatttcaatcaattgccgtttttgtattaactaaccttttggaaaaaaatcattttcgcgattttccgttccctgctgctcggtgagctccaacgaacgatggacggtgcccccccccgtcccctttggtgccctacattcacaaacccaccgactctttcttatcaatcatccttcccattcacctattctaaaaataacggatcggatggatgaaggcattcataaaccacaaaagcatttatttatccgattttatagtttctgtggcgaaaagtgagataaaagggaattgggcgggggtcattaaggggctgtggggcgggtgaagctttccttccccagccatgctatttgtgatcgtttggttctatctttcccatgccgacgaccttcaatgctaatccgatcacttcccttttaagggcatttcccttcgaaaatcacagcaattttggcgatacggcacttatgccctcctccccacccccgcccattgtcagcggcggatggtcaaaacttgtctttctttggtatttacgagtgctgccgatttgcgcataatgcgctctccgtgcgcataatgcgggcggtcctccgacttggatttgttcgttctgtgcttcaattagtccgtcctccatttgccatttgtctctcctccatcaatccctcccataatcaatcaaaatcaaattgaatttgtgccatttgtttttgttaagcatcgaaatgcctttgtcggtcctcgcgttggccttcgccctttcctttccgcttctgttgccttttgccaattcagctgctcaatgcaacagcatggaaatgttgggcagttatttgaaatgtttgaagggcgaattggacagagattatgccggttttgagcaggaacttaaagagcacacgcggtcagtggcaccgcccaattaatccattggcaattaattaattgcttgttgtcagacgggcgaccggtgcctgctttgcgcagaatattggcgacgccaatcagaacgagcgctgtgtgttggcattggccgatttggatgccaaggcgtgggaccgcaacggccccctgagggaatgttccatttgccgaacggtggattggacttgcgcatttctgaacattaagcaactccgttcagtttgccaccggtgccatcaaagccatcctttcaacaccagccgatgagcagaagtgcattagggagcaaatctcaaaagccattgggtcagaagcggagacatgtctaaagaagaaggtggccgacttcaggtgagccgcttttctgtatcaatagacaaaattggcagttcagtgggccattggtaatccccgacttggaggagggcgcctttgccatcaaagagcaagtgatcgactccatttccgactacatttggatccattcgcgactcgcattttgtgccgagcggaagcccgagagagccggttctacttcgaagtgtctgaagtcgcctttccttggctattatcagaagcattgccaaggtgaccgaggccaaagtcggccgagcaatggcttttcgtatcaaaattcgttttgccatttttttgctcagttctgaacgcctgtgacacggaggctgctggcgcnggagtgtgtggagactctgcgcacttccaaggcgagcgtttgcgaatgcatcgacgaggcacgcgacgacctgaagcgacggatcgccggcatcgcgga

SEQ ID NO: 4049 - DNA, 4574 bp, Heterodera glycines
  misc_feature (2287)..(2287): n is a, c, g, or t
ccaggcgttaatttaacaaaaaaaattgctactttttccatttttttttgactactctgaaaatttttatgaagagcgaactgacgcatgccaaaagcactcatttttagtaatgctgcatttttctgagccaaattggctgagtttttctttgcttcgccatgggagggcggggcgttctccgccactgacctcaacgccgtccatctccgcgtttagttttcaatcgactcattcatttgtacattcccttttctttattagttttttatataataaaaactcatttttcatgaacaaaaaatttctgcaagaggtccacccataaatggctgagtgtgccaaaaaatgcaaagttcaaattccgaccgaattgttttttgaattggtcgctgttctccgttttgatgcccggtgggccatcgtccgcgtttcagcggcctttgacattttggtttttaaaaaacaaaatgcttttataattgccaaaacagttgcgcaattcatccctttaaaagtattttattttctctaattttagcagacggatctgaacagtgggaaaacagaactcattaaactcgtggccgggcacagtgacgaacattcgcttaaactacatttcaaaagtgagttcttttgactgcttttgcgcaacggcagcccgaggatttttgaaaaaacctttgtagttcaccataaaattttttgccaaattttttttttttgaatttctcaggggaggaggtgggtgggctgatacgaggggaaaaggctgtgtgtgagaaatgaagtgcacccgtcatgcgcggtcaaaattaatcatttaacaaatgcctaggccttcgcaatttcctcatgttgaatggcgttgctgtgagtcagtccgttggtgatttgttctccgtgccaactttcaaaaatgccgttgccgaaatgaccaaaaaattgcctcacgatttgaagacacacaccggcatttgtgagtgggttttgggtcttattattgcaattgttaacatttaagttctgcaacatttcgtacaatcattaacaattgcacaaaaaaaatacatctatgggtctaccggtacgatgaaaaaagactgatgaggacgctaattgtctaattattcgtttagtcttcattcattggatagcgttaaaagatgcaaattcccacgaagcattctttactcgccctggacagcccgctgatgtttgtgaatatttgggggaattctttactcgctctgggcagcccgctgatggtcgtgaacatttggacggaaaaatgagaagcgccaagtttaagctgtttaactatgcttacttattttgcaatcatggtgctctacaatttcacatagaaagtgcgtaacttttactttgcttcccaaaaaactgacagggtttttttttgtacaaacaatactgttaagcactttggaagtgttttggtaaaggcgaaacagtgaagcgctcggacggtcttcagggcggattaccaatgagctatcccatcttcatgaagtcatttgagcaattaatcaccgacaaatgcacatcaaaagaaattgccgactcgttcgccagctgtaatttattatatgccaaaaacacccttaatcacatttagttgtggagtcattcactgattccttaatcgatcaaagtcgtttgttcaattcgttatctgtgaatctatccgttgctggtaacgaggaactgctcaccggtccgtcgtcatcgaattcgtccagcattgatgcacagcagaaggcatcgtccgttggtccgtcattcagttcgcccgttgttgatgaacagcagcagcagaaggactcgtctggtgtatcgtcggcacaacagcatggacaaagttggcaaatgcatcgaaatttccaatgattttcaacttttgttctcagagcgagccaacactactaatcagtgccagcatcctccgaagaaagaaagaggcggaaacaaataaagtggaaaggcgacaaatgaaggaaggaaattttgttggatttcgagaaatttgtcattggaggcactttttgttgagttttaaatggacaacgaaacggcgtattttgttgtttttggaaaatgttcagttatttatattcttttaccaatatgcataaagacaatgtttaagaaaaaacatttgtaatcgcagagattctcacgcaaaaagcaaagtgcaaacgcccgctgcagtgggtgtggcggggcgaatttggtcagtctcatcaattagcgcgctaattacgcncaaaaataagtgccctcagtcgcttgacattgggcgtcagccgaggcggtccataggggagaggggcgggggagtatttggatggcatttgagggcatactgtaatcatgggctaataataagtttatccatttttttcaaaatttcaaatgttgtaaatagacaaagagagaaagagcaaagggggaggcagtgagagaaaaagttgagggatgacacgtgagagagagagagatagcgaaaataaatggacagacagggtgagacatagcgagagtgagagaaagcgaagagacaatgcgagagagaaagaataatgcgagagacagaagagagagaaaggggaagagagacaaagacagtgggtttcttcgatttttgttcctactgtatgcacttggcggaatgacaccgaaaagggcacacagttcaaacaaatttcttttattccgctaaagaactgtttgttctttttaattatctattggaacatttatggcacaccatttcaattactgcttttgtttttatgtattgtccttattatgtttgattgtacagagagagagagggagaaagtgaagtgagagacagtgcgggagataaatagacaaagagagaaagagcaaagggggaggcagtgagagaaaaagttaagggagagacaccgggatagagagatagagaaagtgaatagtggtgagacatagagagagtgagagaaagtgaagagacaatgcgaggatggtgctcggtgctatgacgttagtcaaaaaccatcataatgggcgttagtcagaaaaccatcaaatgaaaatattttttaatataactttgctcaaaagcatctaaatttttaattcttgatatcattagatagcactaagttttttctaacagtctacaaaatttcaaaaagtttcgttaagtttcaagaaagttatgactaaaaatgttcaaaaaaaacttgggtttttgagcttctcaggtcataacttttttaaacttaaagaatttttaaaaaattttgcaagatagtagaaaacacttagggctatcgaaaaatatctagattataaaatttgatccattttatgcgaaattatgaataattttctgtcaaaaatttcccatttgatggttttttgactaacgcccattttgatggtttttgacttaacgtccccagccccgttttaatatgttgaatgatttagtccaagaagaaagaaagatcacaaacagagcagatttgatgtaattaacttaaaaaaaatttttgttagcctccgaccggggtcgaaccggcgactttcagtttacaagactgacgctcttgccactgagctacgaaggctacatggggttagcttaagcattaaggaaaaagcataaaagcagtgggtacattaaaaataaaaatacgaatattaaacaaatagcaagcgatgctaacatccgactggggtcgaaccgaagacctttagttttacaagactgaaaacatttaccagtaagccatggaaattatgcaaaaaggcaaagtcattaaaagaaaagcataaaaacagaatataattattacaatttttagaaaaatgatttaaaaataaaaaagctgctcaaaagcaacgctagcctccgaccggggtcgaaccggcgaccttcagtttacaagactgacgctcttaccactgagctacggaggccatacggaatgacacaaattaaaacttaagtagagggtctttttagcaataaatgatgaattaacacaaacaaaaagaaataattggtaaaggaaaattcaaataaataaatttgaaaataaaacaaattaattactcaattaaattcattttggctcaccaaatgtctgatagatgtccaatccgccggtcatttgcggcacagtccaacaacaaattgtgccatccaatccgcccgtgtagcaagtctcgcccaagggggccaaatccaacgcgagaattggacctctacaaagcaaaaaaaaaggtaaattaatcaagtaaaactatttgtacaacaaattatagtgaataacagggcattaaatgggagaaattttgtaaaatgattttgtcagtaccgatgcccacggaatgtgtacagcggttcaatgtccacaatgccagtggccgccgattgggctgcaaaggaaagaaaacagtagtaaattacgaccaagatcgctggactttaaccctcgggtaaaacacttcattttgtctcgtcaattagcaccctctgagaattttttgtttat

SEQ ID NO: 4050 - DNA, 2838 bp, Heterodera glycines
  misc_feature (6)..(7): n is a, c, g, or t
ctgcannggtcacaagttaaagtgggccaaaattggggggacaaacgatcactgacaaattatccccgacaaatgggcgaacgaatgaatagacggacagtgccaaaaacaaaggaaagcgaagcaaagaaatacttaatggtcccgagttttgccattttgtaaaggcgcggcacagcaaaggtattggaagaatattaatgaaagttgaggaggaattcggattggattgagggagggataaaacagggaaagccaacgcgggagaagaaaatgggggattaaggatggggggggggcaaaaccaattcaattaagcaattgaaatggcacggcacggaacaaccttaagagcatttgaaacggaatcaattggaagaggcgactgattgggcatcattaaattgtggaattattacaactgccaaacaaaaaatgaatagcaagcattttgcatatggataactttggataaatttgatttttcgattaaaaaatattttaaaattcatttaaaaagggagtttcaaaaaaaaatttttcaaaattgaaccaaaattgtatttttgcatgtatggcctagtggttttgtaacataatcaggggattgaagacggaggttctaaaccaggggtggggcgcgcacagaaaaatcccgcggtcgcggatcgcgcatcgcggattcaatttgccgcggtcgcggatcgcggatcgcgcaaaaaaaatcccgcggtcgcggatcgcgcatcgcggattcaatttgccgcggtcgcggatcgcggatcgcgcaaaaaatgccgcggatcgcacatttgtaaaagcataattagaaaattcccatattatcaataatcaaaattgtaaaggataatattatgatgaagaaaaataagccgttcgagattttcatgcgagactttttcggaggtcattcaaaataaatcctgcatacaaaaaagtagagtgccacgggaccgggaatttttgccaaaaccgggaccgggacctgagaagccgggaccgggacctcgattttttttcgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaattatttcaaacaattaatcatttttggactaaatcatcgaatattaatagaaattcagatttgattttcacatcactttttttcggagcgctttttcaaaaaacttttgggaaagaaaggggtccggcggtgccgataggcgccgccgggggaaattttaaaaatttgggtgcaatttgttaacagattttcaacaaaaaaaggttggtttttgcgattattaagctcaatcttacatttggcataagaagaattgtgaattttgtcaaaataaaaccaaataaagtctttttcgttggtcatttggtctaaattacaaagaggaaaattgtctataaaatgaacgatgaatgtataaatattttctgattgcatattccatttaaatgcgcgagaaaattggaattttggtcgttttcaaaattttataccttcaaatctaaatattcaaaaaagaaaatcgcttcaataaattttctttataaaaattttgccctaaaaaatgcgcggcgcgccgcgcacagaaaaatcccgcggtcgcggatcgcgcatcgcggattcaaattgccgcggtcgcggatcgcggatcgcgcaaaaaaaacgccgcgaatcgcggatcgcgcatcgcggatcgcggtcgcgtcccagccctgtactgtagtcatgggctaattgtaagtttttccttttttcaaaattttaaatgttgtcctcttaaaatgagtgtgtacattttgcaggattttgtcggagtgcgttcaaacggtcaaatgctgaaggtgtgctgcagggagtgggaaaacattattgaaaattaaaaattaaagaattttggcacaccattccttccaatcactgtttttgttttatgtattgtcttattttggttgtacagagagtgagagaaaatgaagggagagatagagagagagagagagtcaaggttaaaggagagacagtacgggagatggcagactgaataaagacacttattaattattttcaattttaattgaaaggtattttatagtttctcattttgttattttgacctattattatatttttaattatttggcccttctctgttgaccttctttattattattattattatattgccgttattcatttttatacaaaatatgaagtgcactttttgttgttgttttcataataaaaattagacaacaaaagttcgctgacccacgaaatgtccaagtctcgaatttgagtttattattcagatgggcctaaggttaggcaaggggtaatataaaggatatattcgtattcagcgaccccgaaaaccctaaaaatcctaaattagactcattttgtttttataaattttggacatttcgtggcttggacactttgtgggggtgcccaaaagtttggtttaattgaagtgtaaaataaaagattttgaaaaagcaataagttaggcaaaaaatagaaaagcatctcttatggacaattaatggctctaatgcactttatgagtccaatcaactgacaatacctgctttttatacaataactttgttcatgctcgaacaaagcctatctttttggtagcattcgaaagcacaaagtctgaataatgtaataatacgagaaaacaagag

SEQ ID NO: 4051 - DNA, 1920 bp, Heterodera glycines
  misc_feature (14)..(14): n is a, c, g, or t
  misc_feature (55)..(55): n is a, c, g, or t
  misc_feature (1880)..(1880): n is a, c, g, or t
ttcaaattttaaanatttttgaattttatacattttattactttatgccattatntggtttgatttgaataaaaattaatcatttttcattacttattataaaatttttacgtgtctttggttttactaatttttcccgttatttacttggaaatcaatattacccgtccttgggaagcgaatttttctaatggaaactctatattaaactcatccccacaaaaagcattacatttaaatctgttgagaaaaatactcataatttgtaaattctttaaccttcccttggattatcatcccatcaatccgaggttttccgaaaaaaatgccgaaattattttttaccagttgaccacttatggaccggttggccccgtgtgccgtccgttacccttcccaacaacagaccgccggtccgcaacagaacagcttatagttgggtgcacaacatgccacatcgccggtataaccgcggtgctcagtgcaggtagcccaatggcatccgcacgacttcagaagcatatcacaggctaaatatatggccatggaaaaaatgatttaatttattgacattttttaacgattgaaataattttttatttttaaaaacctatttttaggtgtgtaaacaagtcgcggtctcgagtctaaaaaatcgaaactaatgacaaacatccgagagaagtaagtcgagaccgagatttgggaaaaactgaatattaccaaaaaagagtttgaactattttttatggttacctaatttaaattagaaaaatgtttagttgttccttcataacccctaaaattctccttaacctgattagtctattaacaattctaattgctgtttttttaccccacgagctgcgccgaactcgcccaacacgccgttccccatcagattgatgttcaaataatttgccatcattggtgtgacttggaaggtcgccaccctcgacgagaattgcaaaaaatggaaggaaagtggcaaaaatgatgaaaataattgagagaataaggacaaaccgattgtggtccattttagcgaaaataaaaaaatggaaataaagaaaaatgaaaaataaaaaataaaagtaaaaagaatgagtaaatgatggaaatttggaatttataacaaacattaaaaaaatgatgatgataaatcaacaaattgaatagggaaaatggagatgattcaaccccttccataggttcattagtgagaaatggatgttgatgaataaaaattgtctgccgatatgaaattgaaaaagtaaatcagtggaataaatagagataaattaacttagaaataacgttttatttaaacaatattcagcataatcaaaattagatgcctaaatccaatgaccaaatcaattcagtttcgatttaaaaactttaattgatgcattaatagttgaattaaaattagcgtgacaggagtccataatataacctttccaaatggattattatcagctgggatttactaaatgtcgtttcgtcttcgtttcgtaccatttttctgcactttttgagtttcgttttcgtgtttttgtcataaaaaaattttcattgttgtcatttccggttttacatgttaataattcgttactgttttcgttttacctttctctgtctcgaggtcagcacttgatctcgagcttagagccattcttccattaattctttttgactttcttattttttccattaaaaaagcaaatttgcttttttaatttatatataaatgtatatattttaaatctttcaaataattttaaaaatttttaaattgaatctcatttaaagttcatatcaattaagttaattaacaaagtgttaatatccatttcacaaattaacattgcatttanaaacgaccgaaatgtaaaagtccatggggcacagacaatg

SEQ ID NO: 4052 - DNA, 3649 bp, Heterodera glycines
ttaacaacaaccaaaaaaaaacatgtttttcgtgcgttttaggcaacggggagctcaggaaaaaaatatgctaaaacctaaaaattgcatccctatttacgtatatgtcagcccgttttcatcagaatttgatagtgtttgagctaaattttaaatatttttgtttgtaccgtaaattgcagttccatcgctaccgtaaaccactggatgagcgacagctgaaccgcttcatcaaaagccatcgtccatttttggtgctgatcaccgaggaattagcatcatcgaaaattagagggactggagacaaaattgcaagaacgcgtccaaagcgggacattggcgcaacactgactgattacggtaggactactgtatggttcttgataatttttaaatctagcaaaatcactattatatttttaccagggaaattaaaaaacatttaaaatagtttttatagaacacaaaaggaacaatatggctgtcctcaaaaaagtggtcaacgaccctttttacgacaaagcccgcgcattttggcgcagttggaaccgacgacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacgtcaagaacagtgacaacgccgacaacaactacgacaaagccaaggaacaaaaaggcagagttgcctaaggcaaatggtgctatgcaatggcctcaacttttattgtgcggagcccttctgccatttttggcatttgtttggcggcaccaaaggggtttgtttaagtttataggaaatttggtcaaaaaatttttgaatcctcctcaatcaaaaaagggaaattttgtgaatttcaatcaaaacatttttcgtttatttcaagatttgagtttttgagaacttatagaaagtatttcatgcttcctagggattttttcaaaaaaaataaaataattttttagcaaaatttttgtacacatttcgtgcttttttgcatactaaatattatatttacatattttaaaaatatggatgaaataaatatttttccctaaaacctcaaaatatttttttattaatgaaaaaattaattttaaatgaaaaaatttagtgcatgaatgcgttttttgatctcctttcttcaatgcatataagcaaaaaaaaaaaaaataaataaaatcacagtcctactgataattcatttaacaaatttacagacgtcgccaatttgttggaagacacaatggcacaacagcggaagccaactcttgaaccaatggcacccactgggacggcacatcactcgccgattggcacaactttgttggaccaaccggcaacatgggcgctgatgtcgggaacaatccgtccacaatgccacccactggggcgccacttcactcgagcagcagccgattggagattggtgaaagggccgaccgaaagaagaaccaaaagcgccgtgtctttttgtgagtttggccgacaaatttcaaccgaaggactaattaggaaaattcgttttgaaattgccgacgcattgggaagaagtattattaattaatctaatcaatcattgtttgggaatttaactggcaatttgaaaaaggaaccgaatggacgcgctaaaaaaagtggtcaaggaccctttttatgatgatgtgcgcgccttttgactcaattggaggccgtcaacaacataagcaacaacatacaacaacgacaacaagaacaacgacaaagacaacagcaaacaagcaaacttgccgaaggcacatgcagctttgccattgcctcaactttgttgtccgccacccttctgccatttttggcatttgtttggaagcaccagaggggtttgtttaagtttatagataatttggacaaaaagttttttgaatcctcttcaatcaaaaaatggtcttgcgtttgttatttgttgtaatgatccctttctctttgctctccgttcaattgttcgtcattatcgttgcttctgtgctcacactcgtcacccaatgctgtgcttgttgtaagaaaaaggtgaataaatgattcattcattatttatcaaatgaattaatttaatttgttttttattgacagaaaaagccaccgacaacaaacttcgttgatcgtaagtctgtttactcaagtgttttgtgtctccgaacagctccaaaacccttacattttcagcagccgattcgcgctattcgacgcttgccaccgatataaacaaggaaattttcgttcaaaaaaggccatcgcagcaacagcggtcacaaactgtaccctatggaccttttgtatgttggagtgttttgtttgctttttttaaatggcactaattgcgttttttggtttcagcaagtgcgacgcccgtaaagccggcacttttggacgagtacaaattcttgccgacattgcgcgtagacccgcccgcttttccagcgcaggccgcaccgccaacttctgtattggcctcaccgaccatctcggcaaaaccgaccactccagcagcatcggcaccgacaacttcggctaaaatgatcacttcaacaaaaccgaccacttcagcaccatcggactcaccgagcacctcaggaaaatcatccacttcagcagcaccgaaggacatggcttcgtcgatgagtgcgccaatcattgcagaggcgacgggtaaagattttttttggaaaatgttgccaggttccagttctaaaactcatggtttcatcaaatttttgattaggttttccaaaggggaatctgccgagaatttagcgcttgtttcattttcattcaaagtctaatgattcaatttgcggtgttttgtgtcatacacaattgcttttccaacatgacattcattaaagtttttcaacagccgactcgggatactcacaaatggatcaatttggtcaggacatgtccattcgagtgctaacgccggaggaggcgaagaaccgaagtgagagagtgcggaaaagcattgcattgattctgatcactcatttcagcgccagagacgggccaatccatcttgatttttgtgctggtcagcagcagcagtaagaagggggacaagcgccgctgagatcgtcgacggtcagtcaaacaaacgaataaatatgtttttcattggataattatcatttttcagcactcgatcggattatttgtgtgatgctgttggccaattggaccgttaatttaccctttgaaagcgttcgctgtgttcagatgaaatgtgacctttcgataacctttgtttatcatgtgattgctgtcttattattcccactgtttctgcccccttaattatgttcttgtcattgtcatgtgattatatgtattatttacatgaaatgtcgttgcatataaat

SEQ ID NO: 4053 - DNA, 5421 bp, Heterodera glycines
  misc_feature (5408)..(5408): n is a, c, g, or t
taaacgagcgttgtgccgaattgcaaagaatttttggtttgtctgtagactttaaaatcactgcattttaataatggattaattgcatcctttttaaagtagccgtggaaaagtgtcaaccaatgccggtgccatcaaaggcggctgctgacgaatgccgcccacctagcccagagaacatcccactcccgacccaattccgcagttttgtggtaaaaaaaaactgatttacccgattctttttactattgacattctaatccaatccgtactaatatttccattaaattaaagtaatttactgattgaaaaaagctttgtaattctgttccaaattttaattaatttttttttgcccactcatttccaagttattccttttcaatcataccgaccttcctcaaaccggacagaaaactggagagataagggcccggtcgggatttttgggatcctgtcccaagtgcttgatcccgaaaaattgaagtcgggatcccgctcctcgacattttctcgagatatcattttcttaagactttaattataattggcaaaatttatttttaattagctgaaattttaattttaggctatttaaagagaataaatattggattactctctgttggttagccattttttgacatttggatttttcaattctacagtaagaaatccctggccggggtcttattttagtttcaaagccacacatccctaaaccagcaaatcatttcatttctaaatctgaacctgcccttacatatcccttatcccaattttaaaggcgaatgacggaattagtgcgcacaacaatggtttagtctgatgatgttcatcttttacctgctgatgttattaatattgttactaattaccattcgctgtgtgaaattttcattttcaaacaaattttatacacatttttatgcacgtaaagtatttatctttaattttaccagtatccaattgaattgaatgtttttcattgtacactttcttttattgtaatgccttttctcccccattgaattcacacgaattggcccttttctcatttcattattttgtcattcaaaaaaaggatttgtcaacagcagcagaggaagaacaccgaacaccccctttatctgctgctgatctctctcactttttgttattgttttgctctttctttcccactttttttttggtccgtcctttgtgcccaatgttttcgtttcgtttcgctttttctgtcatcccccccccgcgccctcccaaatccaacatttttccattttcaaaaggttttgagcattttgataaacactcgaaaaacattttaaacaaaacgatttaagcttctcatttgcgtcatcgccatccctttctaatgttccttttttatcataaaggttaataattagtcagaaattgcattgttgatggacaattccttaacaaggattgataggcggagatagggaagaatcttacaaattaataaagttaaataagattcacgatttaaaaaattttgatcctacaatagaataaacatggaaaaatacgaatactgacgatttgataaaaaaaaacccggacgaatatttttcacttataaatattataatacctgttttttttactttaatgggcttaggcttaacttccttcctcttttccttgagcactttcacaaatacacattttgttgaccaacaacttgttttcttaaccccccccccatttcaaacggagaaaacgtcgacatttatttatttgagaggaaagggacacataagtaaacattttcattttccaccggaggaatgaataattaaaatgccaatttagattcattttgcttttttgtttcttcctacatatattccatgtaatgtgtttctctactaaaaaaacaatgacaagttttctcgcaaaaacgaaggcaatgtttgccaattcttccgattgtttttctgcgtccgaaattggcgcgtttgaggcggagcattgctgtgcatgcggcacaacgcatctttgggccgacaaattttggaaggtcaatcatttttttctttttgactcaaatcaaatttaattgatgcctaattaaaggttgcatgttctgtggactctgaaaagttggcatttcgcggacaggcgacgacagccatcggcgccgcctattggcatccgatgttctttaaggaaactcgtgggtttttgaattttaaagaaatttttattactcaatcgcatctaaatgcatttcttgggatatggtaggggcggagtttgtcactcacaaatcagagcagcagttcagcaggagggttagggtcagcgtcgggttagccatcggtcggtgggtccgagtttagctctttttagtttaattttttgcctttgccctacagtttaaaccccgcctacatccaggaaagaaagtcataaaaaaagaaagcttagcagtataaaagttgccgccgggttggaacgcttttccttaaaattggctgagcctaattgccccctccctaccttttcaaatcagttgcaattaaccctaggattggtttttcgttaatttagtagggcttttgaggccttgggtgagaagagttcaaacaaatgtcattcccaccacatgtacaacgttttgtgtttgtttcaggtcgttcacgcagtgcggtccaagcacatttaaaatgtgcctcttgcgggaaggaagtaaacaaagtttacgaagggacggacgacgccggcggggggtcgcgcagcgcttttggccattacaccgacacggaaaagcggacggagctcagcggtttgggtggcgtcgcttatgcggacattgagcgggcatttgccgtcggcggcatgcggtcggggcacaggcggaatgccgaagatttggtccgttgtctccgtgattatgccaaagagaaggaagaggcggcactttgacagcggaaagatcccaatcaataactgggtcgctgatctcgaatttgacattagatttcaatgtgacatacaataaatatcccgtataattgattaaaattggaattttaaatgatttttcagaaaaaaacaagcataattaatttaaaaaccctctcaggattgccttgtttagggcaagtcataaatttttaaatttatcaataattttaagaaataagaacaaaataagaacgatagcccgaaataagggcaaatcttacaaataaggacagatcgcacccctggtttaatcttgcttgtcaaatgttaagcaattaattttaattcattgtaaatcccccttctcttttccttcctcctggccatttttggtgaattaccattcgttcattagtaaagctacttataattaataagtgcagcacaaaaacaatagtgggccaaaaatgccataattttaaaaatgccaaacaaaaacaacggaacaggtgcagcgccaaaacataacattaaacaaacaacaacaaaattaacaacataacacctttttttggtttcacctgtggcccacgcattggcaaaaaaacatcccattcacagaatgccgaaaacaaaatcaaaaacaatcatttaaaaataaatcccttggcaaatttggcaccgaaaacacgaaacgacaaacgcacaccaacaaaggttgaaggggaagggagcatttcgttacaaatttattggcattttattattacagaggaaaaagaaatggagttgaaaagggggggggggatggcatggccaattcgggacaattattaattgttaattagaatgggtattatgtttacaaatttaacaataaaacgttagaggtttattgttaaaattgatgatcaaataagggagagggaagaagtggaatgatataattagatggatactcttcactacaattaaggactcattgtcagatatgttttttggcgatttgatgagtgattaacataataaaagtgctagtgtaaaatatattattaattttcaattaaaaatcatttaccataattatggaattgtgagaagaatcagacattttggaaaatttaagattaaaatgaaattttacaaacgatatataacgggcgggaattggttatgataattaaaaaagaggaggataaccggaacttcaatagaaaaatttagttgaaatatttaattcaaacaaacttaaaaagggttaattcctccttaaagtgtaatatgtggcgtgctgtttaacacaaaaattaattaattaatgatgcccaacaaatggatgaaattgacggattgccatttttaatgactcattataatgatcaagcttttctgccgtgcaatcaaaaatcgtcatcggttgtaattgggttcagtttgatcgaacaattatagaagaaaattgactgggccattcagcgctctgatcagccgaaaatgatcggacctttgcctcggaacaattgggtccagcgcagcacgcacaagcagtccatcggcaccaacacatcgtccgcaaattcgaactcggacgtgccaaggcggagcagctgccgctcaatgcttttgggcggttggaccaacgcttttgtccagcctaatgcaataggaaattaattaacaaacattatgtgagaaacaaaaaaaacaattacgataaacggtggcacagtttgagccgaccgcgcactgttccttctcggcactggcactgcccgtcgtctgctgctcacagtaagccactttgaagcgctgttgcggaagcaaaaggacaggttggccgctggttttgcctaaaacaacgaattactcacattaaaaaaaataatgagtccgcccgacaaatgtttgtttagggcaattgtaaagggcatgaaagggaacaaatggcacggctaattagggaaaagtgtcccagtacagttgccaatggatggctaattgactttgacctaacgaaggtggtgaacacaaatgaaaaggaacccgcggagtaaagagccgcattaagccgaatggaaagggaacggcacgcaaataacaatcgtaatttatgccgcttttaattatggggatgcgcaagggacggaaaaagtacaggaaaacggatttccggctaaattagtgcagaaacagcagtattaaaatatcatcagcttatgaatggatggacaaaaaggaaggcatttttaatgggaaataaaggtcatcttcttcattctctccccaacagcagaagaggaggtggaagtgagtgatgcgatgttttgaagagcaaaaacaaccaatccaacaccaaccactgctcccccctccggggatactttcgttgtcctttcagcttccaaattaggagcactaatttgtgtggttacacataatccattcattcccagaacatccgttttatttanatgttatgccata

SEQ ID NO: 4054 - DNA, 1483 bp, Heterodera glycines
gaatcaactcatttacgtgcctcattccgggtttttaatctggagattttttaagcttttcttatttttagacttttctgaaatcaacacttacctatgtcgataaatggttccgggttgagcgctttccaacggatttggcatgggtttctctcaaagaaaaaaaaagtttctcgcgccgaagtgatgagtttggctgaacagattgcttcggaagtgaacgacaatgagctttttgacgaaattacggcgctgaatgaaatacttgaaagtatttctgacgagaaatttggtgaaatgaacgcagaacagaagtggatgaaggttttcgaggcggaattacccaatcttgtgttgctcgtcagcaaaattctttcaatttcggtttccaatgcatgcgtggagcgcgtcttctctctttgttcagctcagtggactgatgtgcgcaatttattgaaagttgaaaccgtgaaaagtctggcccaaatcaaatcgaattatgatctcacttgcactgaaatatacgatttgctcatttcctcaccaaaattgttaaaaatgatcatgggaggtgaaaaatataatatttaatacatttttgatcgaataaattgtaaaaataacgatttgaagcaattttgcaaaatgtccttattttggacccaaaaatcttattttttggccttgatgttcttattttgaaaaattttcgatccgaaccctgccttaaacatctaaagaaatcaaaatttggcataaactcgcaaaaaatgttttgcattccgaaaattaccaattgaagacgccaatcgccaataagttgttgagggagttgaaatacagagcattttgaagtgagaaggcagtacgcaatcagaaaaacccagttaggttagcctaaaaagaaaaaatgaaacaaactcagatttataatatattcgtttttttaattaaaatttatcagcagggctgtaaattttatgcaaatgcatttttttttcctggattctacgtagtccaaatagtacgaaagacaccttctttttggtatttgcttataaaaatcgggacttttatttgcatatttttgcatatttctggttttttatgcatattttggctttatgcatattttgccattttttatacttattttcagattttttgcatatttgccattttttgtcaaatattttccaatttgaatatctcttaggaaaaatttttgattatgccctaaaattaaatccaaatttgaatggatgcgcgaatggatcaacagcagggcgcggatctgtcctgatttaatataagatttgtggcaatcggcactgccggacccctcccctcgcccgttcaccagaattttttggaaaatgcgccgaaaaaaattgctaaattcaataatggaggcgaaaaatataatatttaatacatttttgattaaaggaattttaaaaaataacttgatttaaagcaattt

SEQ ID NO: 4055 - DNA, 1439 bp, Heterodera glycines
cgaaaatgcaaagactgacgaagtcaaaatatatataatagcagcgttcaggcaattacaaaaaaagatttgattaattaagcatattgttgattattttggtttgtaactttcttgaaatgttagaattctcttgttttctcgtattattacattatttagactttgtgctttcgaatgataccaaaaagataggatttgttcgaacatgaacaaagttattgtataaaaacacgggattgtcaattgattggactcataaaactcaattgaactcataaaagtcgattggactcataaagtgcactagagccaattttattctttcgaattattcaagttaattcaagcataatgtaatcttatgatatttgtggaaaatttaaaaaaacgtttataaaattattttttatataattatatgatttagtgagtcgtataattaaatttaaatatttttattcacactgagactatttgcagttcgcccacactgagaccattttcggttcgtctcagcacgctgtttatcactacttgttgaaatcattctttgtcgaattcacaatttttctgatattgtcgaaatcactcactgtcgagatcacataacatccattttatcatgtatttccaacaaaaaactaacaaaaacattgaaaacatatgggtgagaaatcgtaattttgagggtcaaaaaaccggtaaaatttacgaggaataaaattttaattaatttgcacccctagttttcaacttttttgtgcatatttggtgcatgtttcacgactttattgcattattttgttttaatgtttattaaagaataaaattattcctttgtactatatgcaagatcaaattacaccaaaaaataggcaaaagctacagcacggtggccatctctacacatttgccaagacaagtgccgatggaacgattcattttggcgatggaaattcaagaacggtgtcgataaattcaaaagaggaatttggacatacacttcgagatgaatccatgctgtttctcttcaaagtacatgttcgcctgcagtttcagaaatgaccctcaaaaaatgccaccaatttcaggttgatgtgatgaacaattatacgggtcgtcagcgcacagatgggtcgagaatggaaccgtgtttcaaagttgaagcttggaatatctacgagagaacgatgcgcaatgacgacacagcaataatttttcagaagctacagaattcactatttggcattttaaattatttttatctactttggcgttttgcacaaaatttatggcactatatgaaaagtggtcgttttgaaaattttttgcactttttttggattaatttttttcaaaatttttttacacataatgatgaataccacccgggggtttttgaggtcgctgaacacgaatatggcatccatttcgac

SEQ ID NO: 4056 - DNA, 7507 bp, Heterodera glycines
cagacagtgcactatttccttctttatttttctcacctctttccttttcccacacacaatgctgctgctgtctacccttccacgcgccgcagcccgcgtagacagacagtcagacagtgcactgtttcttcctttgtgagaaaaataaagaaggaaatagtgcactgtctgactgtctggttacgcttttaaaaaatttgacccaaaagggggacccaaactgaaagagtacctcggggttcagaataggacaaaataattgtcatattcgtgatcagcgacctcgaaatgggacgcgaagcgcgattcgcggcgttttttcgcgaccgcggaattttttttgcgcttcgcgtcgcgaattttttgggacaaaatttataaagaattttttttgaagcgattgtctttttgaatattcaaaatttaaataaaattttttttgaaaactgattatttttctcaaaaaattcgttccaaaatttatagtcgaaatgtcggaaggaaaaggcgacgctgttttgccgttggattcggtgccaagttcatcccactcatccgagaagggtctgtcgttcaaaaacattttacaatgggtctatctagtctccgttctcccctctatagacccaaccaaaatgagcaccaaagagcgcttgcggcgtctgcaagcgatttgcaagccgggcaaaacgccattggtgcaaaaggacgaattgcgcaatagcaggacaaaacggtgggggaattatcagcgggagagagtcgataagcacgtattttagtttggttgaaatagggcaacaaaaactgtaacttagtcactaaaaattcaggaaacaaaaacggaaatttgttgaggccttcaaaaatgctaggattttcaaaattcgtcccacatattccctcccgttttcaagacgacgtgtcgatcatttggacagtgcgcacggcaaacggttcgcttgctccgccggcagtggcgtcgacgcgtgccttcggcgttggatgctgcagggcactcgtgtccacgtcaaattgcgcgccttttctccccatcaagagccaaaccggttgttgcaggtagtcaaagtgtccaagccatttcccggggataaaatgccgggaattcccgagattggtgtgttgaaaagtgctaatttgtcggaaaactagcactcattatgatggataaagtgaaatgaattcattagggagcaattgtggcgttcgacaaacattggaacattgtgctgcgggacgttgacgaggtgtacatgccagcgacccgacttggaaaggtctaattgttagaaacgacaaattgttttggaaaacgaattcaatttccgtcccattggacaggtgcaatcaatgcctggtgccatgccccaatctgtgcgttacaccgatgacaaatcggcaccgaagggccaacgccggctgctgacccggcatctgaagtgctcaatggtcaccggaacttcgctaattgccatttacagtgggaacacccattgattggcggggaaaggcacttcccactcaatgctttttgaaatggaattggacagaaaaaataaaactttttaaaccaaccgcctaatctgaacaaaaaacgggtaacaaatccttggatttttcgatggccataaattttacggctcccatgcccaggccttttctggcaacctgaattttggttaagaaaaaccagatccaattccaccatagaacccaaattcaggcttttctcaaaatgtctaagttgttacttaaacatcatttctttattaacatttgtttcttgtatattgttatttttgatgttttataaacaattattgcaagagattttcgcatttttcattttatactaaaccaaaatggaagtggaggagatatgcacacaattcacaaatcacatttttcgtccccataaaaaccgttccgtttcaccgcatcaaaaagtagatgatgaggaagacgaaaaaggagaacaagaccaaatagcagagcacattcttaccttaaaaatgaaaatttaaaaaggctagcaaaaatttacacatttccactaacctccggccttagacacaatgccaagctttttcattgtggaacccaaaaggcctcgtgtgctgtcgaatttggtgtcctacaaaagcgaatttcaaatcttcaatatgaattcgctcgaaatttgaccgatttagtgtatttttattcctggatcattctatttttaattaaatgtgtagccaatcaaatcataaaaatttccattattttttgaactgagtgccaccagaaaagacttgccatttcgtcgatcagtctattctgcccacgaacatcatccccaattgcgatggtcaccctcttcagttgggacactttgttgctcaactcttccaccatttcgtcattttgctgctccaacagaaagccgccatccgaaaaaggagaaaaattggattaaagagacattttgatgatagtttaaagaacctcacttggtctgtaggccatttttggatgagttttttgtaagttgtaggtcgattgatgaaaaccgaaagagtaatttgggatggatatacagcacaactgaaaaggccaaagaaactaaggaatacagagattatatttttaatttatgttagaaaatgcttaaggtattttatgagaagatgaagcaattccattaagaattttgcaaaatttttcctcgtttaataaagtccacgtgaaacaacaaaacgccatatattttaaaattacaaaaatcttcgacttgaatttctaggtgggatttcggaatttaggtaactctttctcggcatttttcctgaccttaccgggtattacccaaacaataataagatggggttttggcagatttttgaaataaagaaaatctataaaggtgtttttatgaaagtttgagtctgggacctatgattgatatttttacccgacataagttcaaaatcctcgttttattactagttttctgttttcctttcatttaaatttatttagaatttccatttataatggccttggcccattacggctttttggcacccaaacgacgcattgaaccggccggcatttcttatgaattctcgttgatcaaagatcggctgatcctcggcctttccacacttcccgtccttcaaattgtctttcaaaacagcaggacgacggatggcgacgacattgacggagccgctgttagtggaacaaaaaatggcatatattggccgctttattttcttgatcaaattttttgtttggatttcaatgcgttaaaatcataatcaacgcggggaaggctcaacaaattggttaaaattaagggtactttccagttctggggccccaattcattcgaatatttgtcttacattcaaccatatcttctaggacagtgtcgattggcttgaccgagatgactccaagttccgcaaatacatttcccggttggaccccaacgagtggaaaaagcaagaccagtaagttatgcactgttcgctttagcaattaaaattcaaatgcttttcagctacaaagtgctcggcttgtcaaagttgcgctaccaagcgacggcggcacaacttaaaacggcgtgtgagtgcaataaatttgtaaaaatagaattcgacttggacccggaccaaggcctggattttctctgtccatgtcaaggcttttttcaaataatcgaaccttaataaaaaaaaatctagaaaagtaaaaaaatgttttagacagacgcaaagtgttgaaatatcatccggacaaaggcaaagcgacggagactgaggacaagttgcttcgcaatgaagcagtttttgcgtgcattcaaaaagtagggaattggaaaacattttaaaaaagtttagccatttaattttttaaaccatagtatgacaaaatgttgcccgattcgtacaaaaatgtgatttttcagaaaaaattaattagtccaaatggttgtcagattactcggctccaatatcatagccttttatttcgttcaaaaagggcccgccatttgcggtactcccccaattttgattgtcttcaatttttaggcctacgaacaattgggcctttctgaggagcgtcgccgtgccttcgactcggtggacccccaatttgacgactcaatgccggacagtgtggacactgccaatttctttgaactgcttggacccgtttttgaacggaatgccaggcaaaacattgctttttattcaatttaatactcaattccggtgggttttcccttaaaatccccgatttgcttaggttttccgtcaatcagcccgtccctttgctgggcgatgaacacaggtaaattttcattctgtcccaaaataccaaaacaaaacatttggcatttatttgtttgcgctgccccttttctagcgatcgcctccacgtggaacatttctacgaattttggttcgattggcgttcctggcgagaattttcctatttggattcagaggacaaagccaagggggaggaccgatgggagaggcgggaaattgacaaattaaacaaagtgcgaatgtggtggggtgggggcggaccaggaaaaaacgtcgccgccgaacttaatacgaaaaatattctagaaaaattcaaaaaaaaatgttatcaagaaaattcaaggaaattttaaaaattttaaagtttttggtttttttccgaaaattcagcaaatttagtttttattaacacttagattttcaaaaaactaattgtaaaatacttttaagtttttttgaaattttgaaaattttttaatttattttaaatgaaagagcattttagggccaaaaatagaggattttccctggtcttccgagtctgtacgagagggaattagcaataaaacatttcttgtattaataatcgcttcattgttcaggccgaacgggaaaagcgacggaagcgcgacctgagacgcatttcggcactcgtcgaattggcctactccaaggacccgcgcgtggcccgttttaaagtcggattctgacgcgtctataaatattgcatttacaaattaacaatttctttttaaatcattttcaaaatgtcttttttatattctttaggaggaggacaaacggtcaaaaaatgcgcaaaaagagcggcggcggatggagcgcgaggcgcgcgagcgggcggaggcggacgaacggcgtcgcgcggaggccgaggcggcgcgggagagcgaagcgcgggcggaggagcagcggagggaggcgcaggtcgagattcaaaataacagagaaaatgccgcggcatttgtggactgattactgacaatttgcaatcatttccattcagattcaaaatttttgcgattttttcaaaaaacccattcaaataaaagtattgggtgtgatcaatgctttagttttccaacatcttttttgattaccgtacgagaacttgaggttactgtatgctattcaaaaaaatctttttttgttttaatttatgtaaattttcattttaagaaatatttgtccccgttttcaggtcaaacagcaacggaagaaggcaatggcagcacaacggcgccaacttcggacgatggcgtccaatgcaaattattggatggaaaacggcacggcattggacaaccgacggatggcatcaattgctgagcaaattgaaaggtggagaaagtttccaaaaatatcacccaattatgtcaaaatagcatgccaaaggttgtgactgatttccgattttttaaatattgttcgtgtgaaaaagccggcatttccatcgtctaactgaattcaggagtttcttgtgcccctcttttcccaccccttggctcattcccaaataattttttagaatttgtctgtccgctgaattcgacgaattgacggcactctgtgaggggttggccatcgtccaaacatttgacgaggcacagaaactgctggtggaatgtgtatgttgtgtttctcaattctttttcaatgaattttattaaatttaatttttaaattttaggcaattaaaaaagatttcgccgatggaaaggccggcggcgaagggccgtcgacaaatgcgcagaacaaagcgccggttgcatcgaaaatttggtcaatgaacgaattgcaacttttgatcaaagccgtaaatttgtttccgccgggaaccaacgaacgatggaaggtgaacggaacggacgaaactgaattggaaggggggaagataaatgggtagtaaatgattaccagacccggaaaatttggtccaccgattaattggtcggatttacactcccaaccccctgaatcataaaagccctagaaaatttcataggaattttatctatttttcttgagatttcaatgtaaaaattcaaaaaaaaatttcgggggaatgaaacgggagaaaatgacggatgggcgcacgaacagcttccaaatgaaatgcaattagaaaggaatttcggaactgttaattttaccaaaaaacggacaaaacattttttaaagcaagtggccgagtacgtcagcagccatggtgaccaacagcgcactgaacgggaagtgatcagtcaggtaacagtttaattgcactattttagttaattgattacccattttcatcgacaaacttttcaggttaaactgctcaaatcaaatccatcctcaaatttggcgccgccgccgaccgtagtgactaaaaatgccgaaacgaatgcctcggcgacattgacggcaccgtccgctgcatcggatgaccaggaatggagtgccgaacagcaaaagtgcgtcgagtttatttttggaaattctcggaaaggcttgaccacgataatttacaataaataataaacaaatagtgacatggagggaaattttcaaaaaatatttcgcaaattgattttgaatttattattttttaattttatagaaggggaaccctctagatcaacatagcctgatttttggtggggcgtacaccgttccaatttttccgtgcgctctttcgttcatacatattgggtcccaattttggcattttgtccgttcattaaatttttttaggcaattagagcgcgcattgaaggcgacaatttctgtcgatgcgaaagagcgctgggacaaaattgctacgatggtcgacgggaaggacaaaaaggagtgcatccgacggtacaaaatggtggcccaactggtgaagaaggcaaagatggacggtggtggtggccaacaacagcagcagcagcagaaataaatgcgcgcgggtttttaaaacattttgaaacggatttatggccaatttgcgtatgttgtttttcgactcaaatactctctctgttttttgttgattattgttgtcgcttttttgttttgcgttttattattgtagcttttaagagtaaacattacaacttttgttgtttaccgggtccacgcactttatgggcaaaaccggaaatcgctgcacaaataat

SEQ ID NO: 4057 - DNA, 5380 bp, Heterodera glycines
  misc_feature (34)..(34): n is a, c, g, or t
tgcgtttgcgtacacatgtccgctgcggttgccngagctgtttgtggacacgttccgaatgcccgaggcggtcatggatcgcatttcacactcattcgtcgaccatgttgttttacttctaaaataatcagcccgggacggcctttttttaaaaattctgtccttaacaggcactacaaaaaaattttttcccgttgcgtgtttttgcttccggtctaaaaaggccgaatcttcccaaccacacacaaaaaaaatttttttcacctaacatcgaataataatgcgtgtaaaattgggtaagctgttccggtttgttgtccaacaacccccacggttttgactatacttcatttattcgtacccttgctatttaattatattttcctcaaattttccaggccattcactttcttgaccccatcgcgaagcttggggccctgcgcgagaagtaccgacaccattttgtcagcaccaacgaacagttgtgccttctcagcggccttggacacaaccatccttagacagaaaaatgacggactgctcgctgattttgccttcattctaacctacgctgagttttttcgcccacatttgagaaactgtccaaacccttttcgagccgtttttcatcactaattggacgctaagtttggggaaaaacaaataaatgaaaattattgagaaaaaaataaaatgtgtcactttaaatgtgtttttcatctgcctttgccactctctactcttcaacctttgccattctcgcaacctcaggcttttttcccaaggcttctttctcacttccttcttttcactagccaatttctcatcccctgccttcttttccctagccaatttctcatcccctgccttcttttccctagcctcatcccctgccgtcttttgccttgccaacttctcatcccatgccttcttttcccttgccgttttttcttctgccttcaatgtcctattctgccatgcgccacttctcatattcctcgagctgtttacgttcatttttctcttagttttcttgctgctcttcattttgccttcactcttcttgtgtctgtttgcccctctcatgcaattgtggcgacagaaagcttaccttttggtacacggaaacggtatttcctgctgctgtataggtgaactattacatattgtgggttccatgtagccaacttaacacaaaaaggaccccaaagccatgtttttccccagcctgtttgggcaaattatgcctgacagtccaaccatctacccggccctatcgaacaccaacttcttagtcaagtgtaccttgaatttgtttgttttatttccaacaaagcctggcgtattgctcggcagaattacaaagaaaaagtttgtcatttgatcaacaagtataaaattttcaaaaaagtccttatatgtggtgtgccaactcggttcattttcttcatccttggtccatcggaaactctttgccatcgttgtcgttgccgactcatccttctttttgtgcttcatgatcagatcggtgcagtcaaagttcagctttgcacagtcttggcaaaacgattgggcgaacacaagtcgctgctgttgctcgccattctgattgatgagtttgaaactgctctttccctgccggaaattttcgccacgacactcatcgcacatgaacgtgaacacaccatactaaacattttgctaatttttaacaaaattttgttaaaaacctttgggcgacccaatttccaaaatatggaagggtaatcaaacacatttttcggttgttttttgggcgattcatccactaaattttgcgaatttgagcaaattaacagaaaaagctaaccaccttcaatttccatggccttggctttcttcactgcagaagcaatttcctcatggattttgtccaggcgaggcttccgtccccttttcgaggggcccggttgtaggtcaagcagtgtttgggtgatgttgttgttgttgttgtctccaatgatgctgacgtcatcaccattttgaggggaaaatttttcttttttcagctcatccatatgcaattcttcaaatttaattattattataagaaactcaaaaaaaaagattacttttgttctcaaacaccaattgatcattgatttttctcggggccattacgattaggaaatagtttatgattataattgttaaaaaacataaaatggacctgcgaaagaacgcataattattgattgattgtgtgagtgtgttagcgcgcagcgacctccagacgggcagtcccttcttaatcgataggccacgcccatccagaaacacatggactatagagtagtggttagagaaagataccaaagggcactaagttaaacacacactgtaaccccaagccaacttattgatttttacagactatggtactccctctgactgccgccctatccaaattgctaagctgtaaacccgaaaatttagcagaatatttgaacaaccccgaggcggtgaacaaagcgaacgcctacctgtgtggcaaaaaactcaaaacaacctatcagggtcgtgattgcaagaccaaagatgtcaaatttggcacattttcgctgaaacctgccgctgaaacctacgcctttgagggatttcttggcaagtttccgaaaattctgtttcggtccaacaccatgcgttcagatgtcaaagtccaacagtatttctacataaaacaccggattcgcctactgtaccctcagctcaagtgcattgttgagtaccacaacaagggccattgcaaatactacccattgggtacaaatttttgtccgaaaaaaataaaataaataaataaacccccttaagagttgttggccattgaggagggctgtgagagtgcacccatcgaaaaacctgccgctgaaacggactatctggactacttgaactttcgcagtgggtggcaatcagcactctactgatcaatgaagcgtgcgagacaatcggaaaagttgggcaccttccctgagattgagttcgccgtcaacacaatgggcgtcacggtgtattgcccacggcacctgcaaacgcctcggtttgtgccatgggaccagcccgggcggtgctcgagctgcagaagcggaactgttgagctggactacatcatccagcccgagggggtgaccatcttttcgaatcggctaaagacggacggcgagaactttgtgccatttgacgcaattggtaagcttctgcatgtgtttgccaaaaacctaacccttttcttaagtggattttgccgatcgtgctaaattccgcataagggcacgaaataaggtgttcactttgccgctgcgacacccggaggtccatgccgcaggcccgagcttggaagaagccgtaaaagaacagaaggaaatgactcagatggcataagcacttgtccattttttccattgtttttgttcttgttctgatggattacccaagaataatcgaaagtgaactcgcttttcccatcccttcggggattattgtcagcgggccttcctcatcaggcaagacccagctggtccttcgcctgttacggcacgccaacgtattgtttgatccccgccaaaggcaataggcatgtgtaaaagggttttatgtgcagtcatttttgtgtctagtgtgggcatacggtgagtactcgacgcagattcccgagctagagcggcaggaagttgtccctcacgcaggtgcgccgtctgacgaaatgttgaaaaaaaagctgccaaagccttgtctgattgtgtacgatgaccttatgggtgacattgaggccaagaagcaggctgacctgtacacgaaaaaaattgtaccacaacaatttttctgtgattttcctcacccaaaatttgttcgataaggcactacgggtgccaagatccaacgcccagtacatcttcctgatgcagccgcccaacgccatgttgagcacacgtaatttggccagtcaaatgttccctcgggagcagggcattctgatcgaaacttaccgacatatgtgtgctctaccgtacggctacctgttcgtgaaccttcactgagccaaaaatgtacggcctgtggctaagcgacaacgccaccggtaaggacgagtacaagatcaagctgcgagggaacacccaggacttggggtgatcaggaataactgacaaagaaatttgtatgatgaataccccaggcgcatgtatttgtctgtacaaccctgacctcgatatgaacctgctctcagaagaagagcacgaccccgaaattattccataatttaatttttatttttcaattcatttcattaattttgtaatattttaacataattcctacttttgtcacctaatttttcccaaaatacaataatttcattaatatttttttgaaatctctctcgttctttgtacttcttttcatttttggtatcgtatttgcatccccttgtacgtagtttaattctggcaaataaaatttccgtttcagctttgaccaattggtgcaggggattggtttagtgggccccattcatggtgtacacgtgatcagattaattttggatatggtatacccttaaaattcaaaaaaaaaatttttaacagaaaatgttaagactacagtacccttctcaaaaatgtgcttatgctagggaacccgcacaattttcaggctaagcttttgtatcatattcgttttgttgagtatttcaccgtagaccccgtttaacacctccctcgcacaggggtttcagcagtcagactaagatcagtcgtgcgacagatctaatcctttagggtatttaaatctttggcagcaaattcggtggctttgatacaaaatcctgctcccaattgggtaacagtcagccggtaaaaaaagactgatcgtacacttgtataaacgaaacacgtgcaaagtgaaaattttttcaatataaagccaatacctaagcatgtctaagcctaaacataaagcagttctaagcctatgcctaagcaagcctaaagctgaagcctatacctaagcaagcctaaagctgaatcctatacctaagcaagcctaaagctgaatcctatacctaagcaagcctaaagctgaatcctatacctaagcaagcctaaagctgaatcctatacctaagcaagcctaaagctgaagcttatacctaagcaagcctaaaagctgaagcctatacctaagcaagcctaaagctgaagcctaaagctgaagcctatacctaagaaagcctaaagctgaagcctatacctaagcaagcctaaaaagctgaagcctaaagctgaagactatacccaagcaaacctacaagctgaagactatacctaactaagcctaaaag

SEQ ID NO: 4058 - DNA, 4432 bp, Heterodera glycines
  misc_feature (10)..(10): n is a, c, g, or t
ctagagtcancaagccctatcgagttcgatggatctggaactcctctgcctgttggaccagtgtgcttgcattcgaaaaaacacgagacataagtgcccgaaggcctttggactgaggaagtggcctaatctcgaactccggagctgtcgtgtgagtgcctgtgcactcgaccacgattgctgatgcagctcgccgtacggctcgtctgcttaccctcgcaggacagcatatggtggccccctgctagctagcatccctgtggtgctgacaatggacggccacccggtggatggccgtgtttccgcctatcaccatgtgagctccaacatagggaccccatcaggacctaaagacactatcacaacaaagctcacttcaattttcaagaagacaaccgctcatgaagacgagtacccgcccaagactgagcctttcctgggaccggtggcacaaacggatcgccaacgggagttggaagccgttccggtggtggacaggattgaacggatacccaaagggttggtgaagtgcgaaaatagtcataataaaaaaagaaaaccttttttggtttatccatgttggggtggggtggtctcgacaactaacacgggaaaaagccggccaacttttatgttaaaaatgcaaatgttctggcataatagacttcgactaatggggaatgttagagccatagaattttgaaaaattttttgatcacggatttccagcttctacgaggaaggcgaactgcatccagtggtggtccatgaggagaaggaattgactccgtctgaggcggagaaaaggccaggaacattggagcgaattacgcacttgttcaagcggacagccacagagggagagtggccaatggtcaccgagccgttcactggaccgcatgctgagacatcccgaaagggggagcttgaagcacgcccgcttggcgaactcgtggctgcctatgcttccggccgttctgacgaagtcggtccaatgcaaacgattgagacgcaggctgcgacgacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcagctgagcaacaacaaccagtcgctgagaaagtcacaacgaagataagctcattgttcaagaggaagccacaccatgaggacttcccagtctcggagcccttcactggccaattggaagagacggcaagggtttcggagctgttccacgaaccaatcgacgcaagggtcagcgtctactcggccggaagatctgatgagcatgtcgttgtccagccaacaacaattgctgaggcggagcccgtaccgctcgttgagtacccgcgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcatgaagacgagtacccgcccaagactgagcctttcctgggaccggtggcacaaacggatcgccaacgggagttggaagccgttccggtggtggacaggattgaacggatacccaaagggttggtgaagtgcgaaaatagtcataataaaaaaagaaaaccttttttggtttatccatgttggggtggggtggtctcgacaactaacacgggaaaaagccggccagcttttatgttaaaaatgcaaatgttctggcataatagacttcgactaatggggaatgttagagccatagaattttgaaaaattttttgatcacgacaatcgatttccagcttctacgaggaaggcgaactgcatccagtggtggtccatgaggagaaggaattgactccgtctgaggcggagaaaaggccaggaacattggagcgaattacgcacttgttcaagcggacagccacagagggagagtggccaatggtcaccgagccgttcactggaccgcatgctgagacatcccgaaagggggagcttgaagcacgcccgcttggcgaactcgtggctgcctatgcttccggccgttctgacgaagtcggtccaatgcaaacgattgagacgcaggctgcgacgacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcacctgagcaacaacaaccagtcgctgagaaagtcacaacgaagataagctcattgttcaagaggaagccacaccatgaggacttcccagtctcggagcccttcactggccaattggatgagacggcaagggtttcggagctgttccacgaaccaatcgacgcaagggtcagcgtctactcggccggaagatctgatgagcatgtcgttgtccagccaacaacaattgctgaggcggagcccgtaccgctcgttgagtacccacgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcatgaagacgagtacccgcccaagactgagcctttcctgggaccggtggcacaaacggatcgccaacgggagttggaagccgttccggtggtggacaggattgaacggatacccaaagggttggtgaagtgcgaaaatagtcataataaaaaaagaaaacctttttttggtttatccatgttggggtggtctcgacaactaacacgggaaaaagccggccagcttttatgttaaaaatgcaaatgttctggcaaaatagacttcgactaatggggaatgttagagccatagaattttgaaaaattttttgatcacgacaatcaatttccagcttctacgaggaaggcgaactgcatccagtggtggtccatgaggagaaggaattgactccgtctgaggcggagaaaaggccaggaacattggagcgaattacgcacttgttcaagcggacagccacagagggagagtggccaatggtcaccgagccgttcactggaccgcatgctgagacatcccgaaagggggagcttgaagcacgcccgcttggcgaactcgtggctgcctatgcttccggccgttctgacgaagtcggtccaatgcaaacgattgagacgcaggctgcgacaacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcacctgagcaacaacaaccagtcgctgagaaagtcacaacgaagataagctcattgttcaagaggaagccacaccatgaggacttcccagtctcggagcccttcactggccaattggatgagacggcaagggttacggagctgttccacgaaccaatcgacgcaagtgtcagcgtctactcggccggaagatctgatgagcatgtcgttgtccagccaacaacaattgctgaggcggagcccgtaccgctcgttgagtacccgcgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcatgaagacgagtacccgcccaagactcagcctttcctgggaccggtggcacaaacgaatcgccaacgggagttggaaaccgttccggtggtggacaggattgaacggatacccaaagggttggtgaagtgcgaaaatagtcataataaaaaaagaaaacctttttttggtttatccatgttggggtggggtggtctcgacaactaacacgggaaaaagccggccagcttttatgttaaaaatgcaaatgttctggcaaaatagacttcgactaatggggaatgttagagccatagaattttgaaaaattttttgatcacgacaatcaatttccagcttctacgaggaaggcgaactgcatccagtggtggtccatgaggagaaggaattgactccgtctgaggcg

SEQ ID NO: 4059 - DNA, 2732 bp, Heterodera glycines
tgatctccaaaattgaaggccgaactgaactcgagcttacaatgataaaaactttgtaaatttgccggacattcatgcttggacccctgtaatgttggcgactattcttggacattttgaatgcgccgaagtgttgttagaaaatggagctgatgccaacactcaaaacaaaggtggacttattattttttaattgcttctaattaaagatcatttttgaaaattctttgaaattgaaatggattttatatgtaataatcatggctaggatttttaaatgttaaaaacctagaaataggtatctaaatagttgtgaaacaaaagccaaaaattggaaaaacttgtcaataaatgtgttaattttctaaaattgcctcattctttatttatttcggtggcacatctcaagattttcaggcataaaagttttgtttgtccgcaaattatggccagtatttttgctttatgaaaagtcgtttcttaggggagtatttttggaaaatttaattcggttctcaggggaacatttttatttttattatgtttttcataataattttgttgtttcaagcaaaaaaggttgaaaaacagtttttaaaaatttcacaagccaaaatagttggtaattgcccaaaaccgttgcgctctaattcgaaaactgttcgtagaaagtgtgatattggtgctcttctctcattatgaactatttcggcctttacttgccctaaacatttataatttttttccacaaatatggcaacttaaattagaaaagtactgattgacatttttgctcagagatgtggagcctgtcacatgaagcaattcaatggaaggaccacaactttctcaaaaaagttttgactttcaggttgatcgttttattttcacttttttaatcattttttcctcagggattatcaaagagcaattcaaaccataaatgtgcttcttgaattaaacaaaagtcttcaagtaaaaacaatcattttaccttccctttaccaattttcacaggattcttctgattttttcgtcgaaatgagatgggaattcacttcttggctaccttttgttaagaatatgtgcccttctgacacttacaaagtaaataaatcactttaaattcgtttctttttggaaaactgatcccaaagatttacaaaagtggcaccaatgttcggattgatgctaacattctcgagattggacgtggggaaactccgtcaaatacgcgtcagcaatctttcatttttcgatttgttaacaatacaaccgcggaagtcatttttattgacccaaatgaacaaattgtgaggaggagaagtccagaatggaaaggggtaattatcgcacaaagaaagtttagcgcttttaaggcttatgcccagacgatggacttgcaaagtgaaccgtgcattgaagacttcgttcccgatgacagtaccgttgccgaaaaattcaggtcgccgataaatgccgtgagttttgtaaatttcaatctctaaaaaattgaattaattggtgatttcggaggtaaaatccaaagaacagggtttctgtaagtatttgtatttgccagacttatgtcaatgtcgacaacgttggctttgagcgtaccacaaaatcgaccggtctcttttcttggattggctccaatggaaaagaggaggaggtcgaaggcttcacttgccgtttgatgaacgcatcaaacgttgaaatcgtgaccaagacgagacttgaccatctttcgattgcggacagagaagcagcggagaaagaggtgcacttttgacggacttggggggaaatgagtgggaaattttaaacttccggaatttctgatcgctgaaaatataaaacttttttgacctcataagttttatttaaaataaatgaattttcgttcagagttcaatcattaggaaatttgagtaaaatattgccgattattactaaatatttaccattttccaaaggtttccgacaataagacgctttctttgttgatgagtttatttgagaagaagcgggtgatgaataactctttgcccgaaaatacatcgaacagttcggcggacgatgtttatggcggcgtctccgccattgaatatctttcgagaagagtgggcaactgtcacattggttaggctttgctattttttattggctcctttacaccaataattttcttcgtttttaagggaaacggagtgaggagcaaataaaatccaacgcattcaatgcaagcctttggctttccgaaacttttcctcttaaattgcatgaacaaattttcccggttatcgatttgttggccgttcggaatacaaaattttcaagactgaagagctttattcaattgcaattgccttccggctttcctattaggatcaaaattccggtttggacaaacacccaattatttaataaatttttatttccgaattcagattttccacctaatcaatgcacaaattacatttcggaatgtcaatgatccgaaagaagaagctattgaacggattgccgaacactctgaggacgatgggccacaaatgttgcgacttcgccagtcacttttccaaatccccgatggatttgaacgttgtgaattatcaggctccttttctgttaatcgagctggcgaattcgagaggacacaaagaggggcagcggacgaaagatgtaaattaaaccattttttcatttattttgatttgaatgatttt

SEQ ID NO: 4060 - DNA, 1603 bp, Heterodera glycines
aaaaataattgccataattgtgagaaagaagtgtttgttcatttgaaatatttgaatcactgtcgataatgagaccaaacatttaatttatacactttttacatgtgacttttatgtacaataaacaaatgaaaatggatattttactaaattgttttttgaatcgttttgccttttcacttcatattttctcattgtgctctttccacgttcgttaattctgtttctcgatgaccggcacatttccttctgagcccacttttgctgctgcctcctcaaatgccgttgttgacgatggtggcgagtcgcatcaaacggaacgaccgaccgaaactgaagacacttcggccgccttccttccccataacagttcgttacgttctgttatcgaacggtttggggaggaaaatgtgttgaaagaatggacggaggaagactgtgccggacttcttgtccaattgctcaagtcattggatgcctttctttgttcattatttgccctttcaaatttaagaaatttttgcgactacgaaggagcaaaacgaattgtgcgctgtttccgagaaacatcggttgacgaggtgggcaagcagtacggggagcagttgttacctgttatgttcctgggcttaaggttttaggtaattttattacagtttttggagagggaattagacacacaaatttatgacgggagggattgaatcgggaaaataggacaatttcatcattgcaacatttgatatttaagctgctgatacagcattaccttcctgttgtaccaaatagatacgaaatattcgttttcagattaacgactgtttcaacctttgcaaagaattgaataaacgtgccgcgaatgagcgagttcgaatgggaaattgcgtgagttgtgcgccgctgccccaagagagtctgccgacttttccgaattggtcatcggtgttggcacaggcgaaaaaatcacggggaatccctgacgactcttccgctgtcgttgccaaaatgctctcggaaatttccgccaaatataatgatgacaatttcgcgcccgattcccccaactataagttcatttatgagcatctcgcctcactcgtgcggggatacgccatgagagatgcacgaaggtggggacagtgataacggtactcatggagtttaggtccgccttttgggtcaaattttttagaagcgtagccagacagtgatacagcgaaatatttccttgttttcttgcgcttaataattgaaaaaaagtaatgctggtgtgctgagtgagaggaactgtgttcctccaggcaaaaaattctaagaaaatttataagcatttgaagggttctcagcagtttccctgcaaaatttggtgagcttctgatcagtctagaacgatgggtgataaaatgaaaaaaataattacaaaaaaataatgctggtgtggtaagtgtgaagaactgtgttcctccaggcaaaaaattctaagaaaatttataaagcatttgtagggttcccagcagttttccctgcaaaatttggtggagcttctgatcagcctagaacgttgtgtgataatatgaaaaaaatcattaaaaaaaaaataatg

SEQ ID NO: 4061 - DNA, 3643 bp, Heterodera glycines
aaagaaggaaatagtgcactgtgagtctgtctggctacgcttctaaaaaattcgccccaaaaggcggacctaaactccatgagtaccgtgataaccatatgatccatgattaatttttagcattgatgcagcggttatcctcgagatatttgaaaacatggaaaatgtgatcacttcaatgccaaagttgctcgcctttttcaatcagatgataagggacgttcaacatttttcaaacgatgaattcaaactgagcgaagaactaactgacaagaattctggaagactactaactaatcttttcgaacttcctgatgacatttttaccctctctactttgtttcacagcaatgataacgcataaagtttatcatcacaacaacagtctttcaaaacatccctcttctaattcggcaatcacatcattttgcaactcttcctttgcttctctattcttcgctggtttttttgattgcgttctttgccgttgctggtccaagtttgtctccaactccgagttcctcttcatttcgcatgcctttttatatgctggctctgtgggtggttgcaacacatctttgtgactgtatttgtagtcgaattgcttgaattcgttggacagctcctccaagttaagtgggtaagttcggtctgagtcgaatccggagaggtcaccgcaagccatgaaagggacaagagcagcattcattggaccctccaactgagccaagcattcatctgaaaatggcatctaaatcgaaaacaaaagccagctaaactgactgtagtctgatgccaagattgggttgacgagggtcggtttgtaaccctcaggaggcgaatagtttttgcagacgatgaacgcctcacaactgctcagtcgactgctcttgggcttgcaacacgacacctccttgaaaaagcatttcatttgggcgtagagcaaattcacatttttagcccgaaaaatcttaaaaaattaaatacaagggggacaaaaacttatgttctgcatgcctttgaaacaaaagtgccgccattttggagaatatgagaagtaatgctgaaggccttaaaatgggtgttttgtcaaggtcaaaaagaagataacgaattggtgaaccgaataaacgagttgactttgcatgtattcatcaaaggcgtgaagaccggtgactaaaatatgtaaataaaatctgggaagtccgtcaacctttccttaccatccggagctccatcacaaactacaagttgggccagggaaccatcaaaataagaaatgatttgttgagctgtgccaacctaagcaaacaacatttgattaattgtactacacaaaattagattccatataaaattaaagggaaataaacggaatcgtcaaacctcggtgatgtccccttgtagctgaataactcccggtaatggcgccattggctgcttaaacaaagaagtgagtttaagagggacggggcacacctcggcatgccttaccaaatccaccgcaacaattttcactctcttccgtttttcgtcgtccttctcgctcacatataattttttggacaaaacctaaagcatcgattgtatgcaccacctgcaaaccacttctttccacctgactccaactgccgggcgcagcacataaatcgaccaccctaaagacacctaaaattgagaaaagtgccattgttattagtttagggacacaccgtcgaagattttgcaaagctcatcaatttgaagcaatttataagcggaacgagctcgccagccttcctccttcgcaagtcgataataaatgtcacgtttatcctttgaagtctttcccattaagcaaaaaatttgttatgtaaatgtattacctaatcaaataataaacaggcaatataaaagtaaacaaaacgaagaaatattagaaaggttttgtaatgcgcagtttaataatcagatgttaaatgtggcatcaaaaagaacaaatcgcagaaaaaagagtaacaaattacgcatcaaaaatgttcaacgaaagcgaagtgagatgaatgtgaccaatgcgagaatgagacatttttgtaacatgggcaaggaacaaaatgagcacataccaaaaattttgcggctgatttttacaaggtaaaataacggtttctccgccatcaacgacaatttcgaaagttggcggacgagcggaagcctaaaacggaaaccaagaatattatgggaaaaaaatcatttaccaaacgaatgaaatatttctcatcagccaattcatccggcacaatttgctgttttgtcggttgaatggtggcatgcatcagagccaatgggaactttccatcagacgaattaacgaaaaacacattggaaaatggtttgctgagttcagagacgccatcggaggaaggcgaaatgtgaaagtccaaataagtgcaaaacaaatgccaaatgagctcagtgtcggtcggtaattgcggaccccaaccgatgaagcggtcaaatgctaaagcaaagcaaaaataacacaccgcttccccaagtaaaagggaaatgaatgctcgagtcatcattttaaacgcaatttcttagcaactttcacttttctgcagggccatcccccctttttccaatttaccctcaaagcaatcgtttttggctcgactcatatcttattgttagcatttcctcggttcgacggagaaacaatgcatttgttcatacacttacagtcgctctcatcgcgcactgtctgttcgcctccaccgtcccatttgaattcttcaagtgcaatgttttggcaaagcgtgcgcagtcggctcacaacgtattgctggttgctatgaacacgcaaatagggcaacacaaaaggcagaaatgtgtcggaaaagtgctgtttgtgcgtcaacagcatttccatggaggaagtgccaactttcagatgcgaagacgggcacttttcgcacaattccgcgttaacttcatcaattttggcaacgagtggtcgaaggatggtgttgcaaagccaaatgcgcaatttcacttcatacatttccatatcttgttcacgcaatccgtacgtttccaaaacctaaaatgtctcattgtcacctgtctaaaattgggcgcttaaaaacctccttaagctctgataaaaggtgcacttttggtgaatcatcagcacgagaatgttggaacaatcgtttgtccggccttcgtgaatattttgacaatttgtgctcatcaatgaacgatcgaatccctgaataaatggctaaattttatcgacaaattattgagcatcgctcttttgaaaaaatttaaacttttgaattaccattaaaggctgtgtcctcttccgtcagcagatattgaggggtgccaggctggtaaaaatgacttggaccaggcaaattaaaactgaagtaagcagagcaatccgttggatcaatgattgagtcgcaactgaatatacattttgttttattagtttaaataacaaaatccattaaaaccaatgtaaatttacgtttcattctccagaagatgattgagttgtgaacgcgagtgaacactcgaaactgtcttgttgagaggcgagtcttggtatccgaccaaagaggacaatgaactggcatccatttcagag

SEQ ID NO: 4062 - DNA, 784 bp, Heterodera glycines
ccgagtgccgttgttttgcagtgcggcgccgattctcttaacggagaccgacttggcccattcaatttgacgctgaagggtcttttctgtttccatctttaattttgtttatttcaaaacaggacatggaaaatgcgtgaaatttttccgtgattgcaatttgccgttgatgttattaggcggcggcgggtaatactgcgatttttgtttgacagtttgctttttgaaaaaggtacactcctcggaatgttgctcgatgttggacgtatgagacgtcgttggccgtggacattgacatatccgacggttgttctttgacattcgttcacattaatcataaaacataacgacctttaaaataatcacagtcgcatgaattataattttttctaattaccttagcaattttgaagataattagaaccctttcaatctttcagaacttccttacaacgattattttgaatattttgctccaaattatcgcctccatatcgacgcctctaatgaaaccaatcacaacacagaagagtatttaaggacggttcagtatgtatttcctggcatttcatacatcttttttggcgctactttaaaagtggccgtttttgaaatttttttcacttttttttgcataatttttttttttgacacataatgatgaatattaagtattaacagcataattatggcgaataaaaaatatattcacgattttttatctcaaaaaaattttgcaaaacaatagggtcccccctttgattttgataaaactcaaaatttg

SEQ ID NO: 4063 - DNA, 1715 bp, Heterodera glycines
  misc_feature (53)..(53): n is a, c, g, or t
agcgttcaaatgcaacgtgatttttccaatgattatgtaaatttctggttttntcattcttcacatttatagcaattcctcgcgatggcatgcaaatcgatgagtcagtggagcacgacagagcaaacccggacaggagacttccaggtgggacttgtcctgaaatatttccatttaaaatctgattaagccgaagtcagtgaccacatgacagcacatcctggagaattctacgaaggtgaaaatgaaggtgaagaccgcaggaacaggcaagaatacaagcggagaggagggaatacgacgggcgaaccgagcgattcgagggaggacaaacaggacaattcgaagcggatcaaaattgaaaaacaaccgaaggcagagcagcaagaagacggcgaactgcttgaggaagatgctaacaccaactgacgatcagcaggaggaggaaaagcccttttaagcatcaattcgacttattttctcgtctgcgctttgaatttgtcgtccaccgtttcttattgtttcgacaatattattactcataccttttcacagcttatcaatagcgtacctccttcaaattccgaatcctcttccccgtttaaattgcttgggataaaaaaatccgattcattggatagtttattaattgacaattagtaatcatccaacggtcagcttttatttctaattcaagttttggcttttttctaatacaagagaaagtgctttgctgattttttttcagttgaattttccattataaatccactaatggtcaatttgtcttctgattcttccgtcgattattcggaggatccatgtcccggcgaacatttgcaccatggcattttctacgatggaaatgcgtaagtttcagcgaatggaacgcgtaattaatgttcgcctttttcaggaaattttgtttagtttcggggactgaccttttgtcgtttgattcggagaatgggcaacgcttaggaatcagaaggcactccgaccgtgtcgtcggcgtacactttcaccagggaatggtcagtccatcgatagttctaatccgttgttgcaaaataaaatatcattttttccagaaaattttaaatttccataaaattaattttggcgctttcattttaatttttcccgtttcttcgtttgtttagttgctttccttaaccgatgctcctgaagtttacatttgtgaagtgaagtcggagaagttactgtcgaggaggaaaatcgaaatcccccgagggtatcgcatcgtttggtcgtaccaatcgtcggacggagcgatttgccttctcgcgacgaattgcgaagagactgaggaaagggcggagggtcagtcttttccctcttttcttacctgaaaaagcaaaactcagattcgttgcttttgaaatttactctgaatgcattgaccaacgaattcactcaacgaaattccgtcgtcggaggcggtgaccgtccgccgattgtttcgcgttgtgtcgcactcacaggaaaaaggccaaaaacgaagagacatttggatatcgggaaggacttctacgtaaagtgccaggggaaacggctgaccatggccaaattcaacgacatttctgatgatgcaaagcatggaaaaaagggtgacaccgaaaaaacgtaaatggagcggtcggcccgtatccagaaaaaatggcggggttttcgggcaaagggggggggggggg

SEQ ID NO: 4064 - DNA, 3225 bp, Heterodera glycines
tgctgctcaagtacaacatcgcagcagcgaggtacccaatgaagcaaagcggacgaacgaatgccaaagggaaaataacgcaaagtgtcatttagcggcgccggacggtggcacaaatttgaacagctgagtttggagtgccctattcgctcgatggtgctcagtgcggacttcgccttgcttgcgctcatccattccgacaacagcgtttgtattgtccgttccgctggtctttgtattacccacaaagccgaggtaattgaggccgacatttgcggacaatcacttttttaactttcctttttcgtctcattcgcagacagtcaaaaaaccgagagtcaatgcagtcggaattgtgcacgaccccctcaattcgggttgcattttcacaaactcgaagattggttctctccaatggattgacccgctgcagtggaaaacaatcggcgaagtgattagcatggacaatttcatttgacatggcattttgccctctcattgtcaggtggacatttcgcaagagaatgtgccgcccgaggacactttcaaccgacccgacttcctttggctcgatgtttctttggtctgtctgagcattccgcgcattgtaacgtgcgaacaaaggcgaaatgagttggaaaaggtcggtcggatggtcactttgtgggccgattcattcatttttcattgccttcctccacagacttttctcaaattttggcgccgttcttccgccgaccctggcaaattgcaaatggaaaattgcgtcgtcgtccctcgtcggatttcgtttgttcggtcgaccctcgaccaattttgggactgctcggcattgactgttcccatgacaaatggacaagagtttttggtcatttactcaaatggtgaaatggaagtgtacatccaaagtgaaaatagagggtaatttggtttggatttctgtcgattgttccattgtttttccattagttccctttggcattgcgatttaaaaaggcattaccaaaattggcatcaatttgtggtgaagcattgctcaacaattgccagcacaagtggacgttttgccactgtcaattcccttgcggacaattcccgtgttttcctatggcatttggccactctttcgattgtcaaaatgatcgacactttggtcaatccttcacaggtccctccccccccccctccctttgattccattcgaatgttccgtcaggttgaatgggctacaacaccctccgttttgctcatcgcctgtcaatttggcgtcgtttcgttcgactccgatgccaacactttcccttgggccatccatcacccaaacctttcaatcgcttctaatcatttggccactttcgcatacgatggacactttggttggtctcccaaaacagtaaaacctttactaattggtccatttgttcctcttaagttttcgttatcaatgctttcaatgggacattgaaaactgaacctttgcgtttttcggaacgacaaaaggaagtcgttgccgtgggcgaaggagggaatgttttgttcgttggcatctccgaacgggtgggcgtgtccttctgaatttgccgtcctcatgacttctttcagggcgctctttccgtgcttacgccaaactcaccccaaacaattggtcactctgccgaactccccaaacagaagggcaccgccttttcacatttaatggcagctaatgggcggacaacaaaaaggagcggagaacaatcggaagaaaggggaggacggacgaaccacgcggttgttctgctggaaatgccgtccataaaacaattcattgatggccccgcgcattcgcttccgccaatcgcacaattaacgcgacagtttttggacgcttgtttggccaggagaagcgacgccaactgacaaagaagggtcgggtcgatttgttggtgcctttttcattttcattctcttgtccgtatgtttcatttgctttttcattcataaatttgtgtttccaactttaatttggctattagccccggtcagacttttcttttgtcttctaatacgtttttggagtgcgtccgcaagttttggcccactcatcggccattttcttttggaaatgcaattcaatttccgcccgtccgctgtctcttcgcccctcccccatttttcgctgtgccaactttcatttccaacttctcccaatcaattgccatgcttttcctcccccttttccgactgtttgtccccctctcttttttgctttttccctcccatttttcctccgtccctccgattcctttcggccaatgcgtccgccctttgcgtgtcgaagaatcgcattcgctttttgtttgtgttttggacaaataaatgcatacaaaaatgattggttcattaggaaacaaagcacggccattacttttcaaatgggtcaaaggcacgcttttcagtgcatttgccatcgtcgggctttgtcgcctccgatgggtgagatgggagctgaacatggcacaattagcttttgaacaacaacacaattgcagaaaataggggcagggggaggaggaacatagggaggactaatgaacacggcacaatttgtgccgaagcgacatttaagccgcgaagtgaaactaatgaataataataatattaagatttcggtaattttagctatccgaatgggtacgagaatcagaagtgttctttggagttggtcgccactccctccaggcacaaaggcccttttggctttcggttaattttttttcagcggtttggtggtccatctttcgttcgtcgatttggatttggaagccgcttactcccgatcagagcagtgccttcgggattacattgtggtcacaattatcggttggaatggcgtgggaattcgcatgcttttgactttttttgtcagaccgcgacggccgtgagtacaccggcgacagaatttgtggggacagacgcccgaaagcgatgcgaacgatgcaatcgcgggctcgcattctgttcatagcctcctctctgtccccacccaaatggaggggttttcggatgaaattcgaattcgttcccgaatgtcattcattaaccttatttaattgctttaaccatggcatttagccaccatcttggcaccgtccagcttttactatgacacggacagaaggcatttgacggagtgtgggggggtcaattcggtgggtgtttttggttattccgttcactatgaaa

SEQ ID NO: 4065 - DNA, 3954 bp, Heterodera glycines
  misc_feature (3927)..(3927): n is a, c, g, or t
gagtgtgggggggtcattcggtgggtgtttttggttattccgttcactatgaaacccattccaatttagcccactgaaatgagtggggagattcattcgccgggattcccgtaatatttttcggtttcctttctctcacattcgttcgctgtgctttttcctcagttacacttttcctcggaatgtcacgtgtaattggcttctgcgggttgcgcccgaccatcgaataaatattcggcttttggaaattgaactttcgtccgctttcggttcgtttgggctgtgtctccccattttgcttctttttcccgtccgttttctcctttttctctttttagaatgcgaaagggcttcccttcaatttttcgacggctttcggcacggtgaatttgctgtgcagctttttgccgaacacttttcattagatttcgaaatggacgactctttgggcactttctcttttcggcattcccaacagtcaacggacgcccttttctgtgggggcagtgcctattaccgggaggagggaatgaaatcgttcctttcggagagaaaccgagtgtttgtgcggtaagagccaccaacgaagataagctcattaatgatccaattactcgtaaaggttcaccactcgcgagggaccgacgcaaaagcaattggcggactatggggcgaagagaaaagccatcggattccgtttaatttggacggaagtccgtcattttaatgcttttggcagggacagtcccccgccccccccccccccaaaggtccaatctttggttcacacggcagcggacgacccacgcgcacttcgaacttcgctgggcgaagtcgcgcagcagtctttcgttacggccgatcaatgcgcgggttttgtgtgcagcgggggcgaattttgcgtggacgcgacagaaaacatttgcgtagaaagaatgagactttgcatcaacgaaacattacgatgcgatgggatagccaactgcgcagaaaatgacgacagcgacgaaacattttgtgggtggaggggggggggggtcgactgatgagaaggttcatggggggcaactaaaaatgcaaaaaactatatggaaaccgctcttttttcccactttgatcccatgagacaacaaaataatccgagggtttcagtggaccgtaataattttgacgagtgagggaaagtgaatcggtcggtcgaagatcgttctgtcccgtcttaggctttgtccaaaaagtgctgcctttggccactttcgtaccgctgctttttctcctttcgctgcttctttcgctgttttgcttttcctatcgcattttgaagtgtttgaggacaaaggcagaaaagaatgaattgaaaagagaaagaaggaatggaaacaatgaaaaaacggaggaaaaaagggaaagaaggaaaaaagacggaagggaggaagaaatgggaggagaaaagggaggaaaatgcgggagaaaagaggcggaagggacggaaaggaaaagagacggaaagagtcggcggaacaacgaagtcgcagcgaaaccgcacggaggacgaaatgcctttcgcaattttaccgactcaaaaaatactccgagaaatgggtgagttcttactagagttgagcgggaccggggcgggaaatcccgggtttttcaggtcccggtcccggtttttggaaaaacagaaatcccggtcccggttttgccagtcccggtcccggcgggactaaataagcactggtaagaatgggggtctgggtgagaaaagagaagggaattggtgagggaccagaaatttttgataaaaataaaataaattatttattttcatttatagcatgtgttgacatgtataagtggtcaagtgtctaagcctttttactttcattattcgtctcttcggttcaattctctgatggaacagaaaatttttttatattttctttaccattattttaattgaatttaattaataaaaactattttaatttaaaattattatttttttcatttttaatagtctaaaaacccataaattaaccgaatatttggtcatttttgacaaattctgttaataaatctcgctcaaaatttttccgggggggcgcttttcggcacgggcgggacccaaccccctcccactgttccaaaaaagttttttgaaaaaacattgccacaaaaacagcgatttaaagcaaaaatttaaaagattgtaaatttatttaaaaaaataccgaattttgggactcagaaaattccaagaacccccctgaaaacaaaatttttaaaaattttcctcgaactcgtcccccaaaacgtaaatacaaaattttattggtacatttttgaatattggcaattttcgtaacaaagtgtactttcaatttttttcaaaaaaattttcacttgggaaaagtcccggttggtcccggtcccgggttttttcgctgtcccagtcccggtcgaaaaacttggtcccggtcccgacttttctggtcccggtttttgtcaaatttcccggtcccgctcaactctagttcttacaaacgaacgaatgacttttcaatttctttttatttagtcaccccaattttgcgaccaatgaaaagggccattggccgtccattggtccgaacgaatcgcaaggaattttcagagacagcgaagtgtggacaaaaagaacattcggtggcaaaatttgtcagtgcaacggcacggcttgtgaataaaagctctaaagttcattattgaactttacccaatttgtcaatttcgaaagcgcaccgctaaaactcggccaatttcgtttcgtccgcctctttccccagcgaaaggatttgtctttgaatgttcgccaagtcgcaaagaatcagaagcagctgatcgggaacatttgggacagaatttcgaaatcgtctcactttttgaatgtttttcctcgccgcttttacgctttgactctccaaaacgccaaaggggtggaaatccgttgagtgccctccgttcccttccgcttcttccgccccttttccatcgaatgtttctcctcccctccttcgcaaatcatttcctttttcccccgcacattttgaaggccaattcaatgcgaggaaagaaccgcaatcgcttttcgcagtttcaacccttaaaatggcaaaatgcgatgagaaaaagtgccggggatgttgcgtaaaaaaggagacaaaaacaggacatttttgaggaacaaaaataattcatcgccccaatatgagaaaaagagattagcaacaccctttgcgagtgccttttggccaaccaaattgtcgggctcagttccctctgagaggacaaaagggcggtcactgacccaacgacgaagccgggggaagtgcttctgaaaagcattccgacgaattttaaactttacaaaatgcagcgaactttgctttcattatgttgagccgataatcgtcaagaagacattgaacggatttgttcagctcgaagtattgttcgagcagagccaaccgacgcaccgccaaacgatttctgcaggtcaaaattttggaccgagccaattcactatggaccgacataaccaagaaataaatcacaaacggatgaataataagactaattaaaagggaggggaattatatgccttaagcgaaatctcgaaaatagccaaatatggtacatatgaaaaatctttttagaagaataaatccaaaataaagaaaaagttttggaataaaatcgagtaaaaacacaaagatatcattctcaattattatcaaaaagcaaaaaaaaaaagtaaataaaaaacaaaataacgaagacggtaaatgacaaatgacaagtgaaaaaatattttaataatgaatttttatttaaatggcaatgattcacactaattgagaagcgtctctttgaattgttcataanaaaaatatggggatcgcaaagccatca

SEQ ID NO: 4066 - DNA, 3879 bp, Heterodera glycines
ctgacccacaaaatgtccaagccacgaaatgtccaagccacgaaatgtccaagccacgaattgtccaagccacgaaatgtccaagccacgaattgtccaagccacgaaatgtccaagccacgaattgtccaagccacgaaatgtccaaaagagtaaaaaaccacgaaatgtccaaaagtctaaaaagctcataaaaacccggaaaacgggtctaatttagggttttcgaggtcactgagtaagaatacgacctttacataacccatttcctaatcctagacccagatataaacataaaatagcaaaaaaaaaattcaaggcttcgtcaaagggcgctgatcaaaattcgaacaagttttagtgttcctaggtgatccgaattctatttgtaagcattcgaattatatctctgggctctaggcacactaaacttcatacattgaaagtgaataaatttattaaataattcaataaaattcatcatggaacatgaacaatcgaatcatcaaaattttcgaaatcttttaattttcctgcgtatccttcaatttgtagaccgagggccgtcataaggtcatgaatttcaccgttgttgttgtacgacgcgtccgctaaaattcgcataatgagcgcgtcctgcaggatgtatcgcttttgtcgcttgtgaatgaaatggcgagcagatcgggcagcgtccacctgtctgtcgatgctttcattgactccacagatgaagtccgagagtgccgggtgatgacagagacccttctaaatactctttttcaatttttttttactaaattaaaaagaccataaaatgtagatgagtagcctccagtccattgtttgtacgagcgagtgcagaagccgcctgtgagtgcatgttccaaagcggaattgggaaatggggcgcccgaaagatttcttcctcccacacgcgaactaaattttttattaaatataaacgaaagattcgtgaaaacaacgagttttgtgaaaaaatatatgcctgaagaggctgttgaagtcgatagcgagtcaactaattgaacaagctgttcttgtggagtcacagtggttggccatgtaagagttgatggcgccggtgagccgatgccgaactgtattggagtagccgcgtagctgtgttctgagttgatggtcgaaattgttgtcactagttcagcttaaaaataattaaactttgaaaatcgatgcaaaaatacgaaaacaaacaatggtcggtgctggacaaaaaactgatttgagtggccccaaatgcattagcaccatccaacaactggcgctgtgtcaagccgatgtatgttcgagagaagtaaaggaaaaactcatgcattcctgcaggagcagacgccacaataattgagaaagccattctgacaacgctgggaggcaaaagtggcaaagaaagaacacttctgaaaaataattcgaatttcaccaaaaatttttttaaccggaacgtgttgcgaactgcctccccacgttctgtcttctcaccgtacaaatgcacaagaccaagccgcttgaaatttctgaacaggctttgcccgtaatggaacatgcagcatttgatctgcgctgtggggaatgccgtacgcaccgccgcaatttcggccttttcaaaatcacacatgactaaaattcgaaattttcattttttataattacaatgggttaacttttgcttgggacttcagtagagatacgtccacggagaaaattcagtgcttcttcgtagtagcgtcgttgttttccaggcagaaggcaccacaaacagatgcacatcctctgatgcactgatgcaccaatgacgaagcactgctcccacattgctggagcacatttaaaagtgccgtcaaggtgccatgtgccgcactggcgcaaaatgtccagagtcttaaaaaataaaaccattgaaaaacagaatttttatagccaaaaaatgtaccttaacgctgccgaaaataaggaccacgtccttttcgccttgcctgacattgcgactgtcatacaagacgatgtcctcaccgaccttttcgcgtaacgttgaatttaaacaaacttgttgtttctgaggcgctgggaggtggttgtattctttttgacccaaggttccactagttccggtttcgccattgtttgtgatgtttacataagctgagcaactgcgatttgtgcatctccagcgatttcctgagtggtgtgtgaatcgaaaccctgaatagtttaaaaattaattttttgcggcacttcaaacataccgttcaaccataggcaatctcccccaaaattggtttttccgcgctcaaaagcactgttgagacctcagcctctttcaaattcggttgttcaacgctgtcagaagttctcacatcattcggttcgacgagttccactcccaaattcacggcctcctcagttgtgttcaaaatgtcggacaaataacgctttttccgacttttttgtagactttcaagtttattacgaatcattagttcgatcaatgaatagaaaaatctggagtaaaaaaaagcataaattttaaacaaattttgagattttttcttattcgtgtgggtctaggattaggaaatgggttatttaaaggtcgtattcttactcagtgaccccgaaaaccctaaattagacccgtttttcgggtttttatgagctttttagacttttggacatttcgtggttttttactcttttggacatttcgtggcttggacaattcgtggcttggacatttcgtggcttggacatttcgtggcttggacatttcgtggatggacatttcgtggcttggacactttgttgggatgccatttacatacgttaatcaataactttgaataacaaacggatcgagtcagttggatgaagtcgtaaacaaaaaattatgaaatcaggcaaactattgacataataggcggtcaataataatgaccagatcaaaagagacaatgagaacattttcatctaaccttactattagcttactaacaatttagcaatggatatttttgaaatttgttcacaatttcaaaccaatgagcatacaatcgcatacatgcgaaaccttggtctcttacggcaaattgcccccatctgtggtcggcatagatgcccgcggcgtatgactcaagtcaaaaatccaacctttacgtttgacgggtgccaatggcgttgcccaacacacaaagggcagaaagtgtcaatcagggcggggtcattttttgaagaagcgcgttttccccttcgaatcgattctcctttactcatattgtagttacagtactaagcaatgcatcagcaatatttgcaaaaattgaaaattgaattttttcaaatgttcgaatccgggttcggggttcgaaattaagtcaaaagaaggtcaaattcgttctcagcgcaccaaataacccctagaaaagtgttttttgaatttttattccttttttttgtgggaccaataatcttcacaattgccggcatcccttttttgtcgaacctattttttactcattttatgaaaattcataaaaccttactcaggggttccgaatacctatcgtatttacaagcgaactgaaattgatgaggaacaatttctattggcggacaccggcgtttttcaaattcaaggacagaatggacctcaacggtgaaacatcatttatacattaaattctgatcattgaattggaagagcttctacggcggattggacccatcagatgaaagacatttacgcggacggcactttttcattgacgccaccgattttcagccaaatttatgttttgttggcaaaggaaagttaactgtgttgtcacaatgtttaagcttttt

SEQ ID NO: 4067 - DNA, 1830 bp, Heterodera glycines
  misc_feature (64)..(64): n is a, c, g, or t
gatgctcgaattcttcgtctcatccaccgttataacgcatcaataacaatcacctccccaaaantgatcacaattatgcaaatgtcaatgtgaatccccaaaacgttaacaattttctcactggtgtttcccgaaactatgaaatgcgacttagtttgttctgaaatttgttatttttttgttatacttactatgtatttgtttttataaaattttatttattttttccatttgacgcacatccgaccaaactgacaaattattgtagaaggggtactagccgcaagaaataaaaaaaacaaaaaattcagtttactgctaatactctagtttgcccccccatttttcaaaaaattcaaaaaagtgatataaaacattcttcctagggttttcggggtcgctgatcacgaatccgacatccatttcgaccaatttcgaaccccggacccaattcgaacaaaaaggaaaaaatatttttcaacaaaagtcacatttattgtccaaaattttgcgtacacatcccaaaattttaacatcctctgatgacatattttttaaaatttgggatgtgtaccaggggatggcacggaatcccgatttctgatttccgaaattggtaatactgtcgatggtaccccccccctttttgaaaaagttttttttttgttttcaaaagacataaaagcatgtttcctaggggttaaggggccgctgatcacgaatccgtcatctatttcgaccaatttcgaaccccggacctgaattcgaacaaaagttcgaaaattcaaatttttcgaactttgcatttttagttcaaaaccggttaaatacgcgtaataaaacaggaaattattaatatttgaataaaaaattatttaaaccattttgtatcaaaaatctgaaattcgaaaaattgaattttcgaacttttgttcgaattcaggtccggggttcgaaattggtcgaaatagatgccggattcgtgatcagcggcccctaaacccctaggaaacatgctttcatgtcttgaaaacaaaaaaaaactttttcaaaaaaggggggggggtaccatcgacagtattaccaagttcggtcctggaaaaaagcttgagccttaattacgtgtgatctttttccgagccgtaattcttctttattccattcgggcaattattttgcatttgtgcagaaactcttgttatttctcattgacaaattgtggattttctggcaattaatctgcaaaattttcagctaatccttcctttttcccctcttaaaacaaaaacggcgttatcaatttgcaccaagttttttcggcgcaccatggcgacttttacgttacgtcaaggcattgacattgcgaaaaaattggagcctactggggaaaaccaggttttttcttgggggttggggattttccaacaatttttgtaacaaatttcccccaatttttttttcagtttcttctgcttggacgacaaagtgccatcaaagcggcgcagaatggcaccgactgggccaagtcggtggatgccaaattgggcacaatggttgacgagcacattctgaaacgggcgctggaaaaggtggaaaagtccgccggctctgtgccgctgtacatggatttggccaaggtttttaaattcattttttaatttaaatccgaaaacctccaaaaatagttgctattttaaaatcgggaattttcgggttcacggactatgaatctgatatccattttcgacttattccgaattgcttaacccttgacttgttttcgagttagggaggttcctgttaaaaacagtaagttaatccgaaatcccc

SEQ ID NO: 4068 - DNA, 2072 bp, Heterodera glycines
aagttagtccccaaaagtcgggtccccaaatgtcgggttccttaagtgtcgggctccaaagttagtccccaaatgtcgggttccttaagtgtcgggtctccaaagttagtccccaaatgtcgggttccttaagtgtcgggtctccaaagttagtccccaaaagtcgggttccttaagtgtcgggtctccaaagttagtccccaaatgtcgggttccttaagtgtcgggtctcctaagttagtccccaaatgtcgggttccttaagtgtcgggtctccaaagttagtccccaaaagtcgggttccttaagtgtcgggtctccaaagttagtccccaaatgtcgggtccccaaatgtcgggttccccaagtgtcgggtccccaaatgtcagtccccaaaagtcgggttcccaaatgtcgggtctccaaaagtcgggtccccaaatgtcgggatccccaaaagtcgggtccccaaatgtcgggatccccaaaagtcgggtccccaaatgttgggatccccaaaagtcgtgtccccaaatgacgggtccccaaatgtcgggtccccaaatgtcgggatccccaaatgtcgggatccccaaaagtcaggttcccaaaagtcgggtccccaaatgtcgggatcccaaaagtcgggtccccaaaagtcgggtccccaaaagtcgtgtccccaaatgtcgggtccccaaatgtcgggttccttaagtgtcgggctccaaagttagtccccaaatgtcgggttccttaagtgtcgggtctccaaagttagtccccaaaagtcgggtccccaaatgtcgggttccttaagtgtcgggctccaaagttagtccccaaatgtcgggttccttaagtgtcgggtctccaaagttagtccccaaatgtcgggttccttaagtgtcgggtctccaaagttagtccccaaaagtcgggttccttaagtgtcgggtctccaaagttagtccccaaatgtcgggtccccaaatgtcgggatccccaaaagtcgggtccccaaatgtcgggatccccaaaagtcgggtcaacaaatggggggaggtaccatcaacagtattaccgccttttgtgtcctccagccgctgttgccgttcggtcttttgtttacagggggcggggggggggggggttcggttcatcatcggctgtcagcaatcgaatcgtacctatttctcatttctccaaatccttaatccccaaaaatggccttagaacgattccaaaacctaaacctccccaagttctagccgttctatgctggtcttgcgatagatgacaacgaattcgatcaaaatctcgagaatatggggtttttccactcccggcgaacttgtgcgcaatgcggtggcatcatgagctaccgtaatgcaaaggaaaaccgccgttatgggacatggcgctgcacgacaaaggattgcagacgggaagtcggatatttgggaggcaccttttttgaaggatcacatctgacaacgaaacaagttgtacgtacatctgtcatatttgtggtctcgaaaattcggcttcgccatttcaaaccatcacagattggcacaatttctttcgggacatttgtgccgaatattttgtccgacatccaattcaaatcgggggcccgggttagagcctagtgataggagcattgttctgaatttactataaggagtaatcgtcgagatcgacgaaacatgtattgtccgccgcaaatatcagaggccagatgcggggactcatgaatgagtggctctttgggggcgttgagcgtggcaccaatggagcgagggctttcatgattccagtacagcgcagacgagcccaagacctaatccctttgattcagcaatatattgccccggggtccatcatacactctgatatgtgggcggcttatgggggaattccaaatctgccccagggatatcatcatcatactgtaaatcacaatgaaaattttctcaatcccaatgacccaaatgttcacacccaaaacatcgaaggtttgtggtctacttacaagcgcaaattccgtccccaagctggtaatgttt

SEQ ID NO: 4069 - DNA, 2683 bp, Heterodera glycines
  misc_feature (2676)..(2676): n is a, c, g, or t
aaagaaaactcaaaacagagttttttaaaagaaaactaagaaaaatatttctcaataaaatttaagcgattttttggaaaaattatttgaaaaatatcggtaattcaccataaacattttcgaaaatttttttcttagttttttttcttgaaaagtctaggttagtaaaatttcggcgctttttggcatgacaacgttttgtcctgctccatatataaatatcattttcaattattcattttaactaatttttgttaagagcctcaattctgcccaaagagcgtttgctttggaagcaaaatataccgagggtaagtttcaacgagggaatatggttgcttaacagaatttttttaaatacgttttggtcaaaatctttcagcggcattggataaaagcggagcagggcggttctcccccggcatttctggcccaaaccggcgtctccccctaaaaattaaaaaaaaattcaaacaaattttcaagaaaaatcgcagtaaaaattttataattttttcgaaaaatttctgttataattttatatttttcgcaaggagggtggggggacgacgcgtgggggacacagcggggaaagatgaagtgcactcgtatacatgcattccatgaacatttatatttgcatgacagaaattataaaacacgagcgtcatcgtaacgaaattgaacagcaacgaaacgccagtgaaaatcatcgtaacgaaattgaacaacaacgaaacgccagtgaaaatcatcgtaacgaaattgaacagcaacgaaacgccagtgaaaatcatcgtaacgaaattgaacagcaacgaaacgccagtgaaaatcttcgtaatcaaattgaacaacaacgaaacgccagtgaaaatcatcgtaacgaaattgaacagcaacgaaacgccagtgaaaatcatcgtaacgaaattgaacagcaacgaaacgccagtgaaaatcttcgtaatcaaattgaacgcaaccacaaagatgaaatgaccaaactcatcaatgagctcatcaaccgcattgctgagcttgaagagcaaaatggccagctcaaacaacaagtggcggagcacgagcgccagcaacggggtatctacattaatattgggatggcccattccctgttcattctaggcaaaaactaccagcaaattaatttttaaagcaaaaaagtgtcagacatttcaccaaaataccctttttcagccgctggtcgtggtgcccatcggcacgccccgtacccaataagaggcgataagtcaacaaatgttgaccaaggccaacgcggtacagcatcagccgctcctagtgctgttcattaatttaaaattaccttatttgtacaaatgcaatttccagatattaatttcgaagcacaaccaccgaatgccaccgattccgcacaaccggagttgacggcgccagcaatggcaacaaatgacggcactaattatgattttgccgaactttcaccgacttccgctccgacacagtctttggcacgtaatgacggcacgggtggccaactcatgagccactcttcttctggtctttttaataccttttagcagtcttttctacaatgtattgtatacaattgccgtcactcattttgccgcacgtccactgacttccgtcgcttctgctccggcacagtctttggcacccaatttcggccaacaacccatggggcatccttcgggtccctttgtcacttggtcttatcagtgatagacttaatacaaattgcagacattcatcttggcgtacgtccaccgaatcccgtcgctcttgatccagcccagtctttggcacctaattacgtcactaattatggccaccatccattcgaccacccttttggtccttttattcagtggtcttatcaagccataaatgtaaaacaaatttcaggcactcattttgtcgggaatccgccgacttccgcagcttctgctttggcaccaaatgacactaattatgaccaacaactcattggccatcattctggtcattttttcactatcatcttgccgtaccaccgaccttcgtcgcttctgctccggcacagtcttttgcgccctctaatttcggccaacaacccttgggccatctttctggtccttttatcactaatttatcagtgataaagtttatacaaattgtaggccatcattttgccactcgtccactgacttccgccgcgtctgttccggcacagtctttggcacccaatggcggcactaattatggccccttcgcccatccttctggtccttttatcactaatttatcagtgataaagtttatacaaattgtaggccatcattttgccactcgtccactgacttccgttgcttctgttccggcactgcctttttcaccgaatttataccgtaacagccaaggacaatgcttccgtctttctccttccggtccttttttatcatttttttatctgtgctaatgaatcattgcaaagtgcaggcacttttcatttttgccacccgccgcagtgaccaatgttcggtggaagtctggtggattaaaagcagggaaatttgtgtttggtggccttaattaatgtcgtttatgctttaattttgatttacttaattaatttgttgtgagttcaattgtctgctgcttattttttacaaaatntttctct

SEQ ID NO: 4070 - DNA, 3086 bp, Heterodera glycines
tggcttcattgtctgctgcttattttttacaaaattttctcttaccctaactaaacaaagccatttgcatttgtcgccctttatttctcacgctttatttagttaatttttttgttatcaaatctttgtctccttttgtttactcaatttgttttctttaaatcgttgaaggtttgtgcttatgcgttcaatgctaatttaatttaatcgataaattcattttggcgctcaatttcgtccaattattcgatttgaaatgtttcactcgtactgtaactttgaagaggtgctgtagtttattttgcttttactcagtttgtaaaaagtatagttagttattaattatttgttagattaattaaatttttaaaaaatattgtattatttaaaattttcggcaaatgtgtcgaattgcaaaaatttgtcgatggcatgaactcattagtaatatttcgtaaaatttcagatccagctaggaataggaatggtccctgggtccttttaccgacatttcaggtcatgagcaaaaaatcccgttaaattcgtggtttgagtcccgaagatcatatcctgctggtctcaaattctgatcggctttctcaaaattacatcgcaaattcatcaatgttttgccactgtttgtcattttacccgccacaaaattcgtaaattaactgcagctggcaattggcgaggctgttttttgcagacaggtgtagatgtggcagttcgtacccaggcagttcttacaataaaaaattctacaaaataaagcctaaaactaagctgatcgtctgcttcgcattcattaatccttattatgttctctacgaaaaacttttgcgtcttaaaaatttgtatttatttgactcaaaaatgttttgagcatcaaaagaagttaaaacaaaacgaacaaaaaaaaaaaaatttaaatgatgagatttcgtactcgtaagatcagtaggttcttaaaatattcagcatttttaataatttttggtgaatattttctcacttttttcgaataaaaaaaatcctaaaaatataagaaatgcaaaaatagcgcgagttaccttttatattcacatataaatccgcgccatgtagataattgtctttttcgatataatgtaattttagaaactattgtcccattttgggcgtcattcacaaaagaaatacgataaaaaatactaatatataaccttcaatattgcatgaatagaaaaaacttagaaaacattgaattatatcttgtgagcggaattatgaatcattttttgtcaaaaaattttctatttgatggttttttgactaacgtcccagcatcaattcataaagaaagaattttaattgatgttttctgtgatcttcttcgccataataataatgttaatgcttaatattcatcattaagtttaaaatgtgactaaataatacgtaataaaaataaataaataaataataaatttagtggacactttaaaatgcgccaacatttcaatcaattgtgaaaatgattatttgcatccgatttaatcagatattttatatataaacttttgcgttttcgattgggaattttttttagtaaatatttttcaaaactattttttgttgctattaccaatgcagagttaatattaaatattattttaaatcaatttatgaatttattatatttcaatattggccatttcagagttagttttaattataaattttaatcaatatatgaaaatattacatttccatttaaaccatttagagttaatagtaaatcaaatttttttaattaaataataaaatataaatgccaacagatacaattaatcataattttattatagatcatttcaatatatatatatatataataaatattagcactaatatttggtggagatggggggggggggtttattgtacattttattgtattaattattaatagagatgggatttttatgtttttacatattttttgcggcttagttataacgagagaagcccaaaatagcattttcccgaacaattttaatttggagtgacttataaaaacataaaaaatttgcacacatttcggggtttggcacttattttggcactttttcgggtttttagcacataaaaatcccatctctaattattagtgatgcgcagaagtctctcaacttgagaaaactctttggttttctgtgctctctgtctcgaacgagaacaagaagtctttgttcagagtctcgggattggacccagactcaagaaaaggtcttctccgtctcgagtcacgcagtagaaaactcctttttcaggcgtttcgttccaggttttctcgcatttaaatctcgggtaagtcaaggggcttaagtctcgaatctcgagctattcggatttgagcatcactaataatttcaatttttgaacattcgcttggctttgttttgtactgcttaatctctttttctccttgcctctctctctctcgccgttttctccctctctcttctctctctctttttctctctctctctctctctctctatctttgtctctctcctatttttgctatgtctccgccgcagtggacaaccgcaacagcaacagttggtgctgcgactgcttgacgccgacatcgccgtccacgtcgtcgcgctcgccggtgtcgctactgccggcgttttgccgcatcgacggtggcggcttttcccaacacattgtgaccaccgaggggcgtttctgtcgcaatgaattaattaattaataatgggtgttttgtgcattgcatttaatgagcatgattttattctgttcgggctgtatatcatttggggttaaaatacagtcttgtctagatatggtataaccgtttctgctattctaaacgtgcttagatatgccactaaaatatagttttgtacgggtacggtattacagattgacattaaaaaaacatctcaaaatgatgttgccaaaaaaatactgtcgtagatggccacagaatcaaaaaaggttaaaagcttcccgaacctgaatgcatctacgaacgaatagcctaatctgaaatctataaaagccgaattatt

SEQ ID NO: 4071 - DNA, 4210 bp, Heterodera glycines
agcgccagtcaaatgcttaatttttgtaaagttaaaaaaattgtacataagtcgatcgaaaattaataatcaaaataggacacattgggggtgccattcaaatgttttttacaataacaacacaatttgctaatcttttttaataattttcgatgtgcaaaaaaaactaagaatgtttaagtcataagttttcctgaattttaagttctaaattttttatttctaagtgtttaaaagattagtataagcttaaacccctaatcatccaaaaatccacaatttgcaattttttagtgaaaatctattaaaaagttacaaaaatttcaaattttgtgcaggcggcgccaatcggtaacgccggaccctcttcttggtcaaaaattaaaaaaaagcgccctacaaaaaaaagtagcgaggagagtcgcccgccggcggcggtggtaccccctcaaagccgaagtcttgggacgtccctgcaccagatttgttggatttggctttgtttaggttttcggcacaacactacctctgccgccgccgcctcccgtcgccgtgccaccaattttctgcaatttgtgcccgctccgccgcccttttgccgcgatttgccttcagcagtttgtctcgagctcattgatgcggttgagctttccgaaatgtcggacatctttttttaattaaaaaaacattttaaaaattgaaataattcaaaaattaaaattaattttaaattttaaaataattcaaaaattaaaatcattttaaatttaaataattcaaaaattaaaattattttaaattttaaaataattcaaaaattgatcacttgcggcggtgcgctgatttttacgcggagtgcgtggccagcagcagaagagtccaactcgggttgtctgaaatgaaggtcaataatttgagcactttagctcaaacaaatggcgcacatttatacttttaaaaattttaatatttatttttaaaaaaaccaacgattttcgacgaaatttggtgtaaattgatgaaggcccactcagttttacagtattcctgaatgaagtttaacataagcccgatgaaaaaagcatgcattgtatggactttgagagatgttttcgaggctcggaattaatcctcgggagagtcgagaccggtaattgattccccgggattgattatggagaattaatcccgggtgaatcgagaccgagaattgaccccggggttcgagatcgagaatattgaaccagtgattcaagatcagactggtccctggattcaatcttgaaaattgagcccgggacccaagatcgatagattaatccctggattaatgatcgagaattgagtccctagactggagaccataatttactcccaaaactcgagactctcgtacagccggacaaaatgccggaaaaaaggtgcaccacctgctgctaccactgctggcattcaatgtgccggtgccgccgtttgtcccccgccggctgtcatcggcggacgctcggcgcgctttgcgtctgtccgtcgtcgtcgtcgtggcactgcttgcaccactgccgctgcttctgctactgcttgtactcgtgctgctaatggtgccattgttgttactgtttttgatgttgttggtccttttgagtgccatcattttgatgcgttgctcgtccccctcacaacagtggacggtgttggaacggatccgctcgtcctcctccgtctcttcctggccaaatttggggtgcgaccaagagtctcgaacattgatcacatgagtacaaagtgccatttgttactagcactttttgtaaagagaattttataaatagggccgcaacttttagtgacgaaaaatcccgaaatagttaactaaaatagtgtcgaaaaagtgccaaaaaagtgacaaaatagtgaaaaaagtccgaaatagtgacgaatagtgacataatttttagccaaaaatgagcaaaaaataatttttattcactgattgcagttgcaaatgagctacatttcctttataaaattctcttagcaaatattgacattttttaaatcaaaaattttgtcaagaaaaaaaatttgggggaagaatttttgaaaaaattttccaattcttagtggtgtatttttaaaaaatttttggtcgattcttaggggtgtatttttttgaaattttttagatggattcttaggggtgtattttttgattttattgcatttttgttaaggaattttccaaaaaatgttgaaatagtgacaaaacagcaaaatagtgatttctagtgacgaaaaatgacgtccaaatgaaaaaattttaacgcagaaatgcgttttttgagctcctttcttcaaaaaaattgagcaaaaaaaaagttttttcacaagaaatcgcggccctagtgatcagataccgtaatcccctaataggctcacgtggctggattttttaatgtttttcaaccccttcgtaggggagggggcttcactgaggtgggatggcattaatagaagaagaaacggtagaataccattataaaaaacaccataaatgtaaattttttgcggttttggcgctgtgtgccataaaactcttcgttttatcaatttttaagtgccaaaatattggcccatgtctccccataattattgccgggcctctattgctaatgatcaaaaattatatgatcaatcaatcacctcttcgtcctcctcctcctcatcatcatcacagtcctcctcccgcacattgtcgtgtccatacggcgcgctcagtcgtcgcaggaattggccaagtgccagtgccgcggggccggagccacgtcgctgaccttcacaacattttacatataattagtgaccggatttatatgttctttacacattgttgggaatctcgaaaatagcatttttcctgttttcttaccaatcagagcgagtttttagcacacaaaaagcatattccatatttttggctcatttaataatatttttgggccttgataattgtgggcacatattttggcgtttgcaaaaattttctcccaagcccataaaaaattttggaagttggaattccgagcacaaaaatctaagaattccgtgccttaaaaattcaaaactgaagtcgtaaactcattccatccccggtacagtacagtcccaacccaccgtttggtgccgtcgccgcgtagaacagttcaaaccggtgcagtgacagtgtgccgccgccggcgcccgcgttggccaacgaccggcgcagcaccgccgccgatttgcgtttggcgtcgcgccaaatgcgggtgaggaacacgtacagcaacgggttggcacacgagttgatcgggtagaagagcaccaggcaccatttggcactgctcagcgtgatcagcgggcggcccagcgcggcggtaaagccgaaaaaatttttcaaaattttttttatatcgtatgaaagaggcacgcccctctaataatatggctacactaggtgccgcccccgaaaatttttaaagaaaaatcttataaaatgttttcatgcgaaaataaaaattttgaaatttttttttcttgaaatttttttatgaaaaagtttccttaggttttttgaaaattttttgtaaaaaaaaattaagatttcggggagggggaggaaaacgattgctctctaataatacggccggaatgccgtgctccttttttaatgtaaaaaatgccggaatcaaaataattgcgcgaccgacactaaaaattgtaaaaaattcctataaaaataataattttaacaaattccaattgaatttgtgccacaccgaaaaataatgttggcaaccagcacagaatgtcggtgccgatcagcaccagagttctgcgcaaaatttgcttgtcctcctccgccctctccctgttacactgctgttggttactgtaaaaatcgtagaaaatggttactgtaaatatcaaaaaattataccaaatatgcaatttttgaatttttgggatcggtcgccgaaaggcgctgccggggaaatatttgaaaattttgcataagttttcaatagttttgtcgaaggtcaaaatactgaaaatttaaaaatagcactttttaaatttctcagaatgaccacttgaaattcagtacattctgaaaaatctttctttttgattttaatgagcgactgatatgtatattggtcggtcattttatcaa

SEQ ID NO: 4072 - DNA, 1441 bp, Heterodera glycines
aattgggtaaatctaaaggtgatagaaaaaatagcatttggataggcaatttacaccttagtaatggcattggcgccgttgttgcacgccctccgcttgtcgttgccaaaaggtgtggccaaatgcggagaaatttgagtgtcaccgtcattccgagcaacgaactcagagggaggcaaaggctaaaaaagggacaaaccataagcaaacggccgcaagggattttcaaaaacatacaaacaaaattacgaacctccagcggagtgagggtggaagtcggcacaattttgaacaattgcgtaaggattggctgtgacatgggacaattttctgacgaattttgcatcatttccttttaaaaggaaaatgaacagttcgaatgtgaccagaaaacgatgagaaaataatataatacacaacaataaactacaataataaatctgcaaagacaatctttactcagatcagaaaacaatcgcaaaagtcaattagataatgataattgagcagcaaaagcatttggagggttcaaatcggaaggaagcgatgatgaaaagaaagaaaggaagaaaaggcttggtgatcactgatcagcgatgaaaaatgacaatgacaatatgccaaacaaagtgccaaaaagaatggatagtccgaggttaaaactgggaaattcaaatttgaaaaatgcattggttcgtctcggagaaatttccccttgttggaatcgggaagaaaagtgggtggcttttgaccctggctcaattcccttaactgggctagagttgggtcgaaccgagttggttagtagtaccaattttattaaaaaacaaaccaaagcaaataaaatgtgaaaaaaacaaagaaaatgatcaggtgagatgatcacaaaaagatcagttaatccgtgaaaattgaaaattgttcgaaggcagtggtgaagaaaaagcgagagagatgagcattgaagaccgtcctttcttttatagggctcttcagtccatgtggacagtgcaggagggggctccgatggggggcgaaaaacgggaaaatgttcgggattaagggggttagggaatgtgaaagtgttccagtggaaaaacttgaattgtacggttaggaaacaggccaaggtaaaaaaggggataaattttttaaatttaaatctagaaaaaaagaagaaaattttaaagtttatgatgattaaaggggaccaggaaaaaagtcgccagccgaaacgtcgccgggcgaatttttttgaccataacttttttccttctcaaccatattaaacattcttggtattgttccaaagcttatgaaatactctattaacctgcaaattttcaaaattttttattcatatacaaaaaaaaatcaaggcaaaaaaaattcgaaaaactaggtttttgagttacttctgaccataacttttttgaaactt

SEQ ID NO: 4073 - DNA, 1909 bp, Heterodera glycines
taaaagatggaaaattgaactatcataaactgaatacactcaaaaccgtcgttaaacaaaaaattttaaaaaacaagaaaaatctgaatttttaaagttttttttgaaaacctagttttttacttaaaacaaatttgctgaatttcccgaaaaaataaaaacttgagtttttttagtttccttgaattttcttctatttatatattttttgcggccacgttttgtcttgcccagcaaaaaattgccttattccctaatttatgcgtcttttcgcagtttctctgtcttacgcgtttcacgcctccgtctccgtccggaatgttgacgaattgcttcctaattgccgtcacgaatgcgtcgtagcgactgaagcaaatgcgtgccgcccccttcgggtagcgcatctccgagtccacgtcgatgtccacgtgcacaatacagtcacggccaacgcctccaccgatgaggggcatcagcacttggtaaaggtcgacttaacatgggaggaatttgcattttacgactgtgaatgttggcattattttactcgctctggtgggacggggaaggccaccgataaacacctaaaaagggaattattgaaatagaaagccaacagcagcaagtcaaaagtgattgatgagggaattggtggtaaatcagggaaaaacgaacagtccatcggatgttaacgggcaaccccgaacgaggggtgaacacggcgtccgagtgacgccaaggacggacctaaacgaaacggggaaaatgtgaaattggactattcccaactcaaggaaaagtgatacaatttttaccactggtcacaacccccccccccctcattcgtcgtaacgtaaggggccggtgtaaaagagttaggggtagggtaaagaggaaaatttcttggctaatttgctttactcctttcattattaaatccaaaatttttctttctcctgcggcgcctttcgtcaccaccggaccaccaaaactcctaattttcttaaaattgattcaaaatctgaaaatataatatcgacaggcagatgccggagtaacaaaataagagtttgcttctggccgacccccctcccttctcccctcggcctattacttgccgtacggagttcgtgtgggagagattcgtccgtgacttctcggactccatctcccgtcgattttttttaccgttcaagtttcggaaatgagtttcaagtattatgtcacctgtacgggtttgttgtgcaccgttcggctggacagtgtcaggaagtaacgacgcgtcttctccccgggcgctgtcacctcacggcgacatttgctcaacaaaagacccaccgaacgcgggtcagcgaaaacaatgaacgcgtagccgggccctgccggtttgccgtccaatgctgtgaagtgccaccttcggtttccaaattcgaaatgtccactcactcgttttgccctggttcacccgtttggtgggccattctatttgaagttcgccgaaccttggcaaaaaggaaaccatttgggacttaactgagcccatctgtcagctgactgtcgaaaagcgcgagaaagttccagctccgtctgctgcgctatgtccagaggcagtccacctacaaaaacttttcgtgaaaatgtttcgccgccaccgttcgccgctattgtcgtcatttcaaatttattcaaatttaaaagaatctaaatgacaaaagccgcgtacacctttggatacgtttttagatttccggcttcttttatcggtttgactttactttattcgtttgctttataacgtagctcatcaagagcattcgactgccgatttgcttgtccttgtttgaccttcttaaaatgttatgaaattcaggacatttaaaattttttattatatgcaatgaaaaatggt

SEQ ID NO: 4074 - DNA, 2261 bp, Heterodera glycines
atcaagagcattcgactgataccaaatttgtccttgtttgaccttcttaaaatgtttggagggccattttgctcgttttccgcatttttaaccggtttaaatgctttgccgtagatttttctaatttttcagcacgtagaaacatctagtggttttctgaacttttggctctgggccgtcaagtacatatttaccaggcaaaaaagaactgtgtgtgtattgaattaacaaatgtccgcacggaaagtattgtattctaccatataccataaaagtaaagaacagtaaaaaaagaaatgttgaaagctatcatcaattggcttttgttgttcaaaaatcatgttaaaaaaattcgatgttattgagaaaatcaatgacaatcgaacaatttcttatgtaaaatgtatggactaaatcaatatattcttgaggagagacaattggcaggcatttcccaaagtggcaagtgagataaaataaaaatggatcaaatattggatgtcggcaaatatcaaacagagttcgtcttctccccaaagtaatcactgcatttggaacgaacctgaaatcaatttctttcatttcatgtttcattgtcacattcctaatacaattggtctcaccgctcgcagaaattggacccggccccatttcttccaattttctttgcagccttccaccggtccgtcggctccgtcacacggtccccaagctgtttttcgcgaatattcgctgcaacgaatcgtcgactttttgtccgccaacaccagccatttgacaacttcattattttgtgggatggcagtggaggtagaggggcagttctccttgtcgctttcatcagaattcgaaatcagcacaaaacgacccctgcggttagatttaacaatacaaagattgggcattggtgacgacggacctttcctcgcggaattccaagcccaattcttcggccaattgtgcgacatcagtggcaagagacagcaactcgaaatcacctcccttttgaagaataaacctttttgtttttacttgtcatcgactcactttttcgggtgttggaagcagtccctttatgttgattttggtcggctttcgccttcgtaacagtgagaacgaatggttatgttccccggtttggtagagtacctgtctaaaccaagaaaaaaaatgcttggtttcctggtttaaagattgaatgtgtttgtcctccacctttccaacatgtacatcatccgatagggacatttggtcgacccgccgcgttcaatgcaattgaaatatcgtcgtccccccgtcgctttgctgctgctgccgaacacaaggttgaaacgattgatgtaaaaatagagttgcgattcattggtgatgcgttggacaaattcccattgaccaccatttacttgcagcagttccatctccggttttccaatgtccaagcaattctgtgtgtaaaaaacatgaaaattattatgtaaatggcaaactaaaaaatatatataacttttttgaagggcgaagtcggtttacgctgcatcggaatctcaacgcagtttccatcctcgtcgatgcgcagtaaagtccgtccagaatgagtgggcaacgtgccacgtgcacgcgcttcgtcaacttaaattcacaattcacatggtgtacagaaaaaactcagcatatatatatttatattaaaaacaaaggaacatatcagaaaaaatcatgtcttttactggtcccgaaaatttttaatttttaaaaaaattctaataacaagtttctttggtatttcgaggcattgagtacgaatccagcctcatttctggcgaattccgaaccccgcacctaaattcaatcatttttcgaaatcatttttttggaatttaagtttttagtctaaaaatttggcttaaaagatcttttattgaaacactgatgactttcagttataaataaaaaatgaaattcggaatatttgaacttttttcgagttcggggttcggaatttatagaaatagatgctggattcgtgatcagcgactccgaagatcctaagaaacatgttttatggctttcgaaacaaaatttttctagaaattcaagttcgaggttctgaattcgccaaaaaggatgctggattcgtactcagcgcctcaaaatagggaaaatatcgttcatatagtccagagtcacaccaggacgaaatatataccaagacgacgtctctcggtctgtaatggaagaatccgaaaaaaattgttgggcaa

SEQ ID NO: 4075 - DNA, 2675 bp, Heterodera glycines
cccagaaacacgttgctagaatttttagtttaataaaatttcgagaccaataaaagacatgattgcccggatgatcagaattagcgttaattaatttgaataattaaagtctcaccacagtcaaacggctgtttgtgagctgaagttgtagaaatagtcgatgatgaagatgctaatgatgaagttgcttgaccagttaagggttttagtcgtttgcgcgactttttcaaatgtgaaagttttgttgtttttaccatttgtttagcacaggaatctgagaaatgttacaaatgaaaataaagtgaatcatacgctcaattataggtagttaggaatgcaaaagcaaaagggatattttcctcattacgccacacaataaacattaaatacgccaaattgtggactcctatttggtgagttgctctggtgaatagacattcaatccagataaaaatataaaaaacaattcaaaagtggtgaaatcagtcaaatctgaagtctaacataatgaggaatagagatgagatttttccagagatcgcatcgaaaacttgggttttgggcctacaccacaaaatttggtaatactgacttttactggtcacataaaaaatgaacaaaaaggcggttttttacaattattcgttctactcgagggttatcggggccgctgatcacgaatatgacatcaggttatcgtatgacataatctaatctatgattttttgtcaagtctatgatttacctttttaaaattttgaggtgtaggcccaaaacctacaaataccggaaagtgttatattaaaaaaccccggactgtcgtccaattgtcccccttttcgtaaatgccacagtttttgaaaattagtaaagtttcgaatgccgtttttcgcggtggaattcgttggttttatgctaccccatgaaaaacacttacaattagtaatttcataagggaatagtaaaatataaaatggtaatccgcactcattaaagcccttgaaattttcattttctttggaaaatccgaaataaaaaaaaaatttttttttctcacaaaggtccgccaacatttcaagcagaattcgcggattttcttcgccaaaaacaatttgatggccgtggcgttgggcaaatcggcacaggacgaacaggttggagagggaaaccaacctaaaaactgtgacttttacaagccatggcaaaacgctcaatttcaacccaaccccggacacactgacaaaaaaaaaattccaaaattttttggtttgaacaactcataatttgggagtcaattttatgcagccataaaaggcttttattggcagattttttttttttttggtttatctgacgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttgacacatgccagaaaaaattaattagcattttgtttaaaattcgtgcctctcccgccctccctctaaactaatggtcgtgcatctgtttaatgccaaaatttttcaaaataaattacgcaaaaaattcccactttctcttaaggacattttcatattgagcaataaattgaaagttgtaacaaaaagagtgatttttgaatgataaaaaaaaataatagcaattttcagaaatttcctcccccccccccccttcggaagtaatttaaatttaaaaaaaaataacgcactccccaatttaggcaaacgaattgcacaaagtgagcgcacttttgcggggccaaagtggactgatgttcaccaatgcgaaggcaaacgaagtgcaaaggtcggcgggggacaattccaattttttcgtaaatttatttttggtcgttcgggagcacattttgagtggaaattcgaggatggcacgaattcgaagccctttcatttttcgtttttttttcgtaaatttatttctttccttttttggcgggtgctcatttggtggaaaatttttttaaaggttctacgaattcgaagcacctcccttttttccattttgtttgcatttgccgtcccaatttttaaaacagaaaattttttcacttttttttttactttgcgacgctttttttaattcattttttttaatttcaaaggcacttacacagaagagacagtaaatttatagtcagtcgtatgtcctcataattctatgattattcatcttgtagcaaaatttaaaaaatttctgagtaaaaaattttcaaattttttagttttccattttcgttccggcgaatggaatgcttttgggcccaaaaagcggcaaaaattaaaaaaatcttataaattaaattttctaaggtttttcgccgagcacaccgaggctgagtttgcccaggcgggcgccgtcgcctcggcggacatttcgctgccggccgggccaatgccggcggaattgcacttgcacggcgccatggaaccgcagctgcgcaagttgggcatgcccacacggctggaaaatggtgggcattttgggggaaaatgggacgaacttttaattgcaatggcccaaggttttgaaggtgttc

SEQ ID NO: 4076 - DNA, 6792 bp, Heterodera glycines
  misc_feature (6634)..(6634): n is a, c, g, or t
  misc_feature (6641)..(6641): n is a, c, g, or t
  misc_feature (6666)..(6666): n is a, c, g, or t
  misc_feature (6716)..(6716): n is a, c, g, or t
aagacattgtcacagaagcgactttcaatgacactgtagaatttactgtggacgctggcagggccggatttggcaacttagagatggccataagatggaggaattaagacatatttcaattgtttgacatatacctgatagagaccggcgcggacgggatcccgcgcggggttttgcgggatcccagtccgcaatcccacattttttggaaaatgcgggactaatcccgcggaatcccgtcccgcaaagaattttaagttccaatcccgcagcaggatccgctaattgattttttttgcgggattttattgattttttgaaaatttttcaaagacaatgccaaatatttttgaataaattaaataataaatttaattaaatctcatttttcatcgcatattttttagagcgtaaatacagtagaaacgataatttcaaatttttaattcgtaatttgcagtgtaaaataaaagcaaattttccataacaataaattgtttatttttcatgttttgataatctctcacatttttaaaaaaattaatgacttcaggttcgatttattacgtttcaattgtgttttaatataaattccataattattttaatcaaaataattatcatatttgttatagtattaattatcatacctttgcattaggataacttagtaaataatttgatgaacaatttttaaggaacatgcaatgtctcaaggacgtttgacgcgtataaaaacaaaaaataatatgtttgttgtgtcacataataaataccagactaaagtttaatacaaaaaaacgattccgcgtttccatcaaaggttataaaaatatgccccaaggctaaattcgcaaaaataaaaaattgaaggacgtacacctgaaagaccaaaaattttatattaattaccataaaaacatgtttgagaagagacgaattgttgcgtttttaattttttcaaccaatggttttgagtagaattttaataaaattaattaaataaatttattgaaatttgttccttctcaatgtgtcgacttctgccgaacaataattccctacaatactacgaatgcagatgcaacggcattgggtatatttccctacaattaaatactacgaatgcagatgcaacggcattgggtatatttccctacaattaaatactacgaatgcagattcaacggcattgggtatatttccctacaattaaatactacgaatgcagatgcaacggcattgggtatatttaaattttttttaaatacaaaatatttttcaagaacattgctccaatatgcagccattttttacagtcagcggagaattaaggggtattcattatgcctttaatgttcaatatgtttaattttttattaatagagcagtgggtgcacactaacccctgacatgacggttcctgtggtgtctcttagagggaaagaaacttcagttgaaataaatacggggccaatattcatgtttgatatttaaaaaatatttatgccgtaattcaagtttcgaaagaatgaaaacttaggattttgaaaaattacaatgaataaatgttgaaaaatgttaacagtaattttgtatttaatcattcttgcatccttcggtttcaacaatatgtgaaataaatacaccggtcgctaacggttcatttttcggattttaggaattgggtttacgcctacataatattctttaagtgtatttttattgcttaatgtaacctcaagcatttgtttgagtcgattttaaggcatttattttacaataatcaacaaatttattgaagaattaccagaaaacactaaattgttgatatcgattaaaacatatattattcatcatctgaatcatctaattctccttgccataaagcattagtcatgcactcaacaataaaagaatcaagctgattgatggccttaagaattaaataagcattagatgaaaagaagaatatgaattgatcatgaaattatcttataaaatctttatttattgtttgtaaataaattttaaataaacccgaacttttagagaaaagtataccttatctattttaagcatttttaaaacaatccctaaggtcatatttccttaccttatttttttggcgaactgaagaattcgatgagaatagaatattcttaggagcaggtggcgcaattttggtattaaggcgtcggcacactaaaatttggattttaatttttaattttattaacaaacatttgataaattcgggatttgcggtgagccttgacagcacaaattggggcacgcttaggccatttaaggcctccactgtggcattttgatgcgcatttgctgcaaaatccattgcagtgtctagcgcgtccaaatcctcagacaaggtccagctttcacgatctgcatgaccttaatttctaaatattaattttttaaaaataatcattttaatacctttccaatcgatgtaaaatgcgtgccttgtgtgaccgtgtttatcaagcgttgtaaataatgccaagatattttttacacaatatttctggtttttgtccgcttgtacattttttggacgtgggtttgcgtcaatctttaaaagttcaaaggatttatttttgtatttattaccctaacgcttttatccgttccacgacgatgatgttttcgctggcgtcttgctcgaaccccggtttttttatattctttttgttgttgcggcttacgcggtcgtagatttcggatggttggttcctcttggtcttgctgttggctgtgttgtccatcattcccagtgaaatttgattctccatctataacaaaatacgatgggaatgatgatgattatgaagatgaccttgttgttgctgatgcggttgttgataatcttccgtgtctgaatgcacaatcccacttattagttggtcgagaaaatcgttgttgtcgggactcggaaagtcaaattccggttgattcgcagcttcacaattcgctgatgaagaattgctccagttttcggaccgagatggtggtgttcggcccgcaaaattggtgttgtagtcagaatttcccggtatattactctccgtgtcggagtccgatgagaattcaataatatttgtttgggaccataaatatgccctagccgatgcttcaccgaaggtgtccaaaaaatcacgggcttttttgtcagtgagtaattcgaaagcatcttttattgatttaaattgttcgggattgccccccttatccgggtgattttgaagtgcaagacgtttatatgcggagttaatttcagcggatgttgaatgtttgttcaaacccaatgtagaataaatatgactcattgggaaaaaataagattttctttaaataattgtagaaaagatttgatttgatgacctattactgaaaatagtcgcaaaacatggaaaattaaaaataaaactttatcaggtaaaagctgaaaatttcagatgccggccgtaaaaatgaatttaaattaacacggacaaattatacttttgcgaataattgtattttttattaattttattaaattttattataatatttttagtttttaataattaattaattaatttatttatctaatatgtattaaaagagatatgatatggatgtatttgtagttagggactgagctaaatttataactcagttaatccttcgtacaaacacgacgctctaaaggtctgagctatttaataataactcagattttcttaagagaaataaaagacaaataaattattttttattaattagtattaatttaaaaaataaaaatatacttttcttaattaacattaaattagtatttaataaattcattttatttaatcaaataatattttttagctgatcagagttcgtttcagcgttaaacgatttatcatgttttttcgacccgattcattgcttaaataatgaatccaagccttgccatttgggtggtcttgtttatttagcctttctagaactcattaaatttcgctttctactttaatttttacttattcattaatttaatttttcattttattgactcagcttcttttacctaaccatttttcatgcaccaaatgaattaactcgcatggctggccaacttggtggccttaatttttcatttttattaactcagcttctcttcatattcatttcaacaccaaattaattaactcccatggctggccaacttgatggcattaacttttcatttttattaactctcattaagtcttattgctgccgccacttttattttcctcgtcgttgtaattaatttcttatttataactcgcccagccggagggaatgaaaattattattcttgacggttgctgtttgaaaaaatttcctatttgtttcagattttgttttttatagatttgtcatctgctgctgacagaaatcctcaagagtcggcatgtttacgcattggaaaatttgggaatgtttgatcgacaacatagtggtacagcttaaatattcgtgaaaattcagggattttcgtgtaaaagttcttttttaatttatcaagtaaattaatttgaatactattttaaaaattagaaaaataaatggaaatgttttttacaaattttcgggaatcataaatggtaaattttaaaaattgcagttaaattcatcaataaatgaattgtttttcataaaagtaaaagctaacagaattctgaaattaaaaaaatttaaatctcattaaagacaccaacaccgatttggagtgcaattttgctcatttttcaacactgagtaaaaagtaaaaatgattttttaatgtcttttagttcatttttttatgcttttctgctttcatttttgcattatttttttttcttctttcaaacgaataattttttagttagttttagtattttaaggtgaaattaatttaaataaataattgaataattaattctaattactttggtcagatcaaacaattttttctgaggtgcattattctcttcatcagcagcaaatcttgagtaattgaattgcattttttggttattctgcagaaattcactgacaatgcttctcaatttgacgatataatcctaaataataatcattaattaattacaccatttagacattttaattggcagccacctgttccatgccaatccgttcctccaccagtgccatttccccagtttcgtctcgcccactctccggcatccaaatccaccgagttttcggcttcaatggaacgatgccaaagtctcccggcacaaaatcgtccgttttgtacatgccattgaactggttcaacttggagaagcccatcttgccataaattccatgtccaaacggcgctttggctcccaattgtccatgggatgtttgttgttgaacaacattcggtagagcagcaaaccgacgaatcacaccaagtctttccccaatgttgtgcttctgttatcctgaattttatttaatttatgaatatttatttgatttggataattaaatgggttatgatttgttctgggctcataaacagcacatctttcagccaattcatctgctttttttgtctctattctgatgggagtgtcctttcccttgggtctttgaccttttccaccatttcgttaaattcaattttcaaatttcccgccaattgttcgtcgtcaaattcaaattcattttggcgaatcaccgaaaaatgatcaaatgtcaaaatgccatcaaaaattggctcattagaattctgctgcttttttatggaccaattttgtgaggtcaaaacggcaaaatcaaattcagtgcaatttttgcgattgttttcgattgcactttgtgataaaagccgtgataagccacaacagcgggcaaatattcgttgagagggcatttgaaaaatgtttgaaactgtggcgttttgtccacccaattcattttccaaatttatttttggtttaataattttcttttcaattgcttctaccgattttttaggcgctgatttttagaaaaatatttttgagttaaaattattacaaaattctcaacttaaatatgacattttatttgtttgccattaagttggatgatgcaaatcttaacaactaattttgcaatttcaaacaattcatttttttatttttaatcattaaaataaaaaaaatgcaaaaaccataagattattttccataagaatgattttcaagataataatgaagaaattcataaaacaccaattaaattacgaatttaattactgtttgggcgctaacataagattattttccattatgatcttattctgcacaattcatgatgatggagtttttttgggtacttttcggttatgcgtacacagggccaaattttaaaaaaatgcaacaaaggagcgacgtttgccttcgcacataaaaagctaaacaatgatgaatataaattaataaacattagtaaataaaataaatttaattaaaaacataattaatttttacatgtttctgttttggtagcaccgcaggtggccggccacgcattgttagagacggaggcgagcattattaaatgttattgcactctcatttagcgatataatggcagttcattacatggnctatttncaaggacatcccttggaatacaaangactatttcctcccaatcccacaaccccaatttaatactttgatactganttaaatcattgatttcacttcaaaggcatgaagctacttctgaatgagcttgtgccatttgtgctgtaccaaattt

SEQ ID NO: 4077 - DNA, 6483 bp, Heterodera glycines
attttcataaatattttacttcttaagtcaattcgcgctcagagatcattaaatggcccagaaaatatcttaaatcaacatgaggagagagcttctcacgatgatttctataattttcaccgattaattggccctttctgcgcgttgcatttttctcatcggtcggtcgtaccaatccgtcctaccgaaaccaaaagcattttccaatttctgtcccgccaatctttcgaccattcataaaaatggtaacccaaagaatcctttggctttatgtcttgacaaaaaaaaacattggattgcttttatgtactttaagaagcaattggcttaagccaacagaaagaaagaaaaagtatgaaaagaaaatgggagagggaggacaaacaaacggtggaagggaaaagaatttgggcgatggggaaaagtttgacacggaaagaaaatgatggccgaggaggaggaaaagggagtttataagacaaaaagcgagcaaataagtacgactaaactcatcgatgaattgggagcccgacgatgggaaaagggacgacgaattcattactaaaacaaacagaaaattgggtgcgagttattttcgacatattgttagccgtatttcgttcctaattgggttttgagtcgaaaacccaaaaaataaaggcgaaaatggcaaacaatggtgcaaatttggcttttttgaaaattttgacaaaaaacaaaatttggtttgcccaattcctaacgataataccaccggctccaccccctctcccactaaaatgtaattagtttaattaaacattttttcatgaaagccgaatagatatttgaacacaaaacgaagtataaactttaacacaactacaatacaagaatagaatctgatcaaataaacaattcaataattttactattttcttaaaaagtgaagtcattgccctacataaacagtaattgactaaaaatttaataatttaattgtataaaatgaatgtcgtaagaaatcgcaactcattgtcactcaaagactgggctgttccgcaaattcatgctcaggcataatgtaactgatgtcatcccacgggtggcggtacaacggctgcttcagacgacgttggtccaaataatggccttaaacggacgatgaacaaataaacatagctgggtaaacaaccgatgaatcccaaactgcggccgagcacgaacagtccattcagagacccaatctcaatggtttcccgcgcctcttgcggtgtgaacattcccgaatggcgaagaatgtccacgaaaattgtcgcaattgccccatcgacgttcaaaattaagttgggcttctaaacaaattttctgatgaggagggcgtctgggtttgctgtcactttcgaagttgtgatttgctccactttgagtgcgtagtcaaaaagaggcgtctcctgcttgaagaaggtcttgttcttcgctatctctttcagtatttccactcttttgtccgggttgtttatctgaacaatcgccgccatttctttcgtcgctgtgccccccccccagtctcaccgattttactctgtgcccaatccccggaatgagtttgcccagccgcttctgctcattcacaaattgcatggcactcagtcccgtgtccattgcttcactgaaactcttcgcggccccgtccaaagcaccgccaaaacggtcaccctgaaaatgtcaattgtaaatccgtcactgttttcagcctcctctacttttacgacaacccggtgctaggacattcctaaattccgacatgggataataaaataaaataaaattgcttaaagtcaaccaaattaaacaaattggtatcattattctcaatagcttttattctcatcagaatattaatttcaaaaatagagatttcagaatttcattcgaatgataccaaagcgttaaatttggttgattaaaagaatttcataatctctttttattatcccatggcggattttcaaatggtcagcccactgccccacactcacaatggtcaataatccggaaaccagcgacgagatcaagtccttgccagcccttgcacaaacaattgtattgtgggcaccgctaacggcgggcccgtggtcggcggtaagcatcaaacaaatttcgaaaaaacgatttgcatattcgggcaatcgtttctgaaaaatgaagggtcgagagtgagtagaaaggaagggaaagcgacttggaaccaaagaaggccgagcactccgccgacaccgacgttgtcctcaagcactcgcgtgattggcacgccggcgtaaagcaactcctcccctctctcgtcgcagatggaagtcatgaaggaagcgggcttcctgatcagtcctaattcctgaagaagggcattctttttgctgattaagcgatgagttcggaatgctctaaaaaacgatgtgaatacctttgcccatgcgtaatccatcggcaccggtggcgggggttcttcggcacgtggaacgatagaaccattctcgaccaattgcttgtaaactttcgagatcataacaccaaagtcatcgaaagagtcgggcacgtgagcaccagcagacttcaaagcagcgtttttatgtgccgcagtttctttgacggcgttggccgaggccccggcatggccaaattggacctcggaagtgatgtgatcggcacaagtgccaatgcaccaggagattaggggcttatttatgcgtttttcttttaacgcctggacgattttgtactcttcttcgcctcccacttcgccaagaagaaccatcattttgactctaatggaaaactgaaaaaggaaaaggacgagacaaaacacctcggatcatcttgataacgaagaatgtggtcagtgtaagtggagccggggtagcgatccccaccgatggcaacaccctcaaacactccgtcggtgttgtgggaaatgatgttgttcagctaaactatttcgtaattcaaaattagacttcaaaacgacctcattggacattcctccggaacgcgagacataagcgacgctgaaatttttgctagtaaaaagcgttagggaaacaaattccctcccaccttcctgatctgtagagtttcgacgcgagaatattatccatcattccgccagtgttgccaattttgaaacatccgggttttatccccccgacagttgctggcccaatgacagtaacccccttttgtcgagccacctgaaaaccagcattagccggcaaacagtcgaacaaacttttatcagttttcgcgtctgattttcaggaactccttcggcgatgatggcaatcacttttatctgagggtattccaatgcctcgagcaccgtttgaaacaccgaacgcattgacgcaaaagtgaccattacggacgcatcggggtgacttttgaaggccttttccattgacttatacgctgggataagcatttctttctgtccaaagtaatatttctgcttgtggtctccggtgaatgggtaagtcgaggcgaccaccgaaggagcgcttcgcttgcaaacgtagtcaaaatcaagcattccctgaattggataagtcaaacatccattgaatttgatactttactccttttttattatttggaaagtttttaaaaatatatcaaacaaatttttcagaataaattttattataagaaacgttttcagtttcaaagaattttttttttggtaaaatggtgtttaaatagatcaaattttgttaatattatttcgaattttgagtaacttttgaatcaggctaagaatgcccctctaaatcccttcccccgtaagtcacctgaattgcccgctgctgctgtccccagatgatggctttcgtgtccctttcaaaaaggcttcgtatagcttcctttgactgctcttccatcgtttcggccttcgcctttttttccggggtcgtcccattgcttttcgggtaaccatttgcgactttctgctgactggccgattcgttcccagcagaaacagcggcactcttaaccagaaaaaccacactcacagaaggctaatgcaaatgccgaactcacccccctctccggggccaacagaaattgccccgtcgtgtgaggagtcagagaagcttcaggaaggggacgaacgcccaaagcagcgcccacaatgctggtcatgtgagtttcaggaccaaacacgtgaattggcaagtccaatttggtggctatcaataaggcaaactcaaataaaaattaagcaccaatataaccggcttctttgaatttacgaagaccgccttggtaatttgggccaccgcgacggacgtaaattgttactttatgcagtcgaagtttttcggcaaacatttcaagcgcacgaattattccctaaaattaaatggtgaagaaccaaatgcgtcagcaaatgaataccaaccttaaaagtggcggaaacattagtgaagttggcaattgagccgccaattatgagcactttgccctttgggtgggcctctccttccgtcataattgtgagaattgttttggcgtactcaaaagtttgcgtctcgtttgggtctcccgaatattctccgtaattggccaactcagaagcaccgccgaggtcacaaacagtgtccctgaaaaggttaaacgaattgataaatgcaattaaaaggaagaaaattggaaatgccaacgaaaaggctacagagtttgggcaccaaaacaaagatttaaaaatgaaagagaagagcatttaattttcatttagagggggtggcaatatttctgaaaatccaattaatttcttttatttatttatctcacgtgaaaacaacggatgcgcctccaccggccaccatcgtccaaactcggcctttccggttcagtatcgtaagtttgagagatgcgcccgtttttgcgtccaaatcggcgatgtatttctcctgagcgaatgaaccactgattatgcgaagaatatatggaaatttggtcaaatggtgcccacctctgtggtgaggtctcttccaaaacgagcagggaattccacttcgctcccggaccgcgtcttccaattttcagaacagagaaaggcggcggtttcgtccaatttggcagccaaatccaaaatgaatatttttccgtctcgaacaacttgagaaaagtgaaagtcatcatttctccattaaaatcattgagcatacccaaagggttaatctccaaataggtgaaatggtttttcttgtaagtctcatacaactcgcagacgaattgtttgacaagactgaaattcaccaaaagtttaaaagcattgaccaagaatatgtgccttttcttcgtctcttcgactttgctcccaattagttggtcgatggactgctctccaagtgccatttcttcgtctttaagttgaacgggcaccaccaattgacgtgccttcaaatagttcagaattttaccaagtttggcttcgcatttaacaccttggcgtcgacgtccccaacctcaacgccgccctcctcgtaaaacagaatcacatcctcattcattttgctataaatggcgatgtaaagctcatctttggccccgtgtttgcaaagcggctccaaaatgaatttcgaaagacgccccgtggtctttccgatctgaaaatttaagggcaaaacctcttttcacgtgtccatttcccttacctgaacattttgcccctttttttcatcgaaccatttggcgagttcgtcgctcgttccgattttgactaatccgtgctttcccctgcgcttgatcaattgatcgggcttgagaacaccttgctaaaccaaagtctaatttaatgggaaaaattcgaaaataggcctctaattaaagacttttagtttgtttaacaattacatcaataataaaatatataaattaattccaatcgttttatgttgtgcccaccccctctttgctgatccaatcgcaattaattatggcatcttggaaatttgtgttctcatccaattggacagcatttggcttgacgagtgcttggacatggttcagtgagcggtaaagaagctctttgcccgaatattcattcactgctttagccgacattggaagtcaattaaagtgataaacgaaaaactaaattgggtatttgagtgtatattaaaaatggagaacagcgcaagaaaatgagagtgaaagtcaaaagaaaggaacagacacagacgaacatatgcagaagaagtggacaggggcagcttatgcttaaatcaattttccgatatttttcagccggagaggggggggggggggacggaatagacgaaggaagagagaaatacgtaaaacggaaggagaatgtgttttagggtcgaaaatgccaacaatttaaggagagcgaacatccgaggaatggcaagagaaatcttttggatttgaggactaaacatttccacaactcacaaaaatgggttattcaaatgaagaaat

SEQ ID NO: 4078 - DNA, 2464 bp, Heterodera glycines
  misc_feature (15)..(15): n is a, c, g, or t
tatgtacaaaaatantttgccgaaattttggatttttttttgaggatttccaaaaatttccataaaaaatactcaaaatatgtaaaaaaatgaaaatatatatgaaaaaaatccaaaatatgtacaaatatgtaaataaaagtcccggttttaattgacagccctagttattatctttttaatcgatggggggaatctttgtttattttttgaaagtgggtttttggcattatgtcttttatttcatttaaagtttaaaaattttttgtggttttccaaaatttcttgatttacaactgcataagccagggctgtcattggaaaaaatcgtgaaatccaaggacgcataaaaattttatcatactcaatgaaaaattgattaagttttattcaaatggtttgtacttttcgccggaatgaattttttccaaattttttttatttctcgttttcttatttcaccgctttttgccattttgagacaattggcaacgcttttactgaatgtttatttttcaaattttgttttccaaggacatcttggaaattttcaatttttcaatcgtcgacgccctaatccagggacagtaggggtcagttccatctggccagttccgtctcgccagttccgtctggggccggttccgtcttgggccagttccgtctcgccagttccgtcttagtactcaaagggccggttccgtctcaaatatttttggactcaaattttttaaaatcaataactaatttagaaaaaaagtaaaaattcttttacttcgcagcctaccgcagcctaaatatacctggttttttaaaagttgtggttaattaaaagtatattcgaaaataattttttgaaatgaatttaacattgcaaatgtccagtaattctgctcgggattctcagtcttggtcctcgtgtcgggaaatttagcagccttaatgtgtccagcactttgtttgcagcgaatccggcacccattttggaccccgaacccgaatataaagattaatttacataaatttcgtctaattttcaaaaatacacccctgagaaatgaaaaatttcctcaaaaattttgttattttatatccctaaattgaaactttaacacctattttgaggtttttagaaccgaaaacctaaatattttggcagtttttagtttttaacacccaaaaatattaggcatattaaatatcagggctgccaaaaacatgcaaatgtattttttttcctgccttttccatgctataaataataggaaaaacacgttctttttttgtgtttgcgtagaaaaatcggtatttttatttgcatattttgcatatttcgagatttttgtgcatattttggctacttttcgtgcatatttttggcagcactgttaattatatctcaactttctgttcacattctgaaatttaaaaaaatttgggtccaaaaatatttgagacggaaccggctcttttactactaagacggaaccggccccagatttaaagagaaaaacaaaacgtgcaacaattaattcattggccattgtctcttatcggtgttatgaccagggctcggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaacattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgccaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctagttatgaccagggttcgcagatgaaaattttcaaaagcctcattctgggtcaaaaagcttcatttttacaaatgtattcaaaacaagtttaaaatgttcaactgttatatttttgattgtccatgatcgatttgagtaattttttttgttcgaaataagcattttgtgaaattctgagcatgaaaaatcgaagttgatttttgcggcgctttttccaatttttttggggagcaggggggtcc

SEQ ID NO: 4079 - DNA, 3340 bp, Heterodera glycines
aacacaagccaagacataacacagccgggaataaattttttttaattttcaaacagaaatttttcaaaaaaaaatcttacgttgaagattctatgaaaaaaaaagtttgcaagaaattttcaggcgaattttacgaattctaattttcaaaaaaaaaaatcgttaaaaactttttgaaaaattttttcttgaaaatttctttttgtaaatttttttaaaatttattcccggctgtgttatgtctcggctgtgttttggggtgtaccgggtagcggcatgtggccaagggaatcgaaattttaaagtgaaaaaaattgaaagagttataatttttttttaaatcaaggggaaaaaattgaactgctagcgtttttgaattttaaaaaattcgaagttttttcatgaaaaattttttccaaaaggtcactgaatttagcaatttttttgtgaaaattttaaaaatgaaggtgaagtctacaaaacaaattttccgggcagcacctataggcaccgccggatttttaaaaaatgccaaactttttcccttgcatcgcctataaaaatccttaatttttcttgaaaaattgggttaaaatagcaaaaatcttggtaaaaatcttaaaaattgccctcataccttgcatcgcctatcggcactgcctgaccgcaagcccaagtttttaacttttttcattgccatttttgttttggtcatctaacaaatttattatgccccttttgcaggccgttcaacatcaccaagcagcacccgcagcccaaccggctgctgcagcgatgcccgggggcgctggtgccgcgccggccgccgctatcattccgttggcaccgccgccgtccccataaaaagcaaacctaaaaatgcttaatgatttgatgaatatacaacactttttaattccaaatattttgtttcgcttttttgtgggatttccttttgttttcttcacaattttgtgtattatggtgaacaacaaacaaacaaatgcgaatgcttcttctatttttgtgtaaaaagagaaaaacaaaacgtgcaacaattaattcattggccattgtctcttatcggtgttatgaccagggttcgcagatgaaaattttcaaaagcctcattctgggtcaaaaagcttcatttttacaaatgtattcaaaacaagtttaaaatgttcaactgttatatttttgattgtccatgatcgatttgagtaattttttttgttcgaaataagcattttgtgaaattctgagcatgaaaaatcgaagttgatttttgcggcgctttttccaatttttttggggagcaggggggtccggcggtgtcgataggcaccgccgggaaaatttttgtaatttttaatgtgatttgttaacagaatttgcccacaaaaatggccaaattttgcaattttaagcaaaaattttaagaaaataaaggatttttagggtctggcggtgccgataggcgccgccgggggaaaattgagaattttgaccatatttttagcagattttcattaaaaaattctttaattgttaacaatcttgcaccaaaaatagccaatttgcattttgggccaatttctacaaaaataagagaatttggtttcagcggagccgattggtctccgcctcgctagggaaaaaagaaatttattgctccaaaaattttacttttttacttttttgtttgtattttcgagcattataaggtatttttcgtaaacatctatcaacaaaaaaaggttggtttttgcgattattaagctcaattggtaggattttcatttaaaaaatgataaaatatgtatcaatttaaaaaaaactatgaggaatcatattttctttataggaaacccacgagtatacaaaaaaaaaaattgaaaataatctaatttctgtagagggattgaaccaggagaaagaagaagggaaagtcaaggagaatagccactaggccatttgcacacttgggcagttttacttttaaagaatatattaattattattttatttttccctttgactccaattttcttcactaatttttcactcagaccccattcttaccagtgcttgtttttcccggttcccggttgccctaccgggaccgggaccgggacctgagcttttcaaaacccgggaccgggacctcggatgaccgggaattcccggcccggtcccggtcccgtggcaatctatttcaaacacataaaaagccaacaaatttaaatattttttataaaataacttaatttccattttttcatttaacttttttaattgaaatttttcaaaattttcatatttaaaaaaattcgcgatacttcaagccttcaagtgctaccaagaatgtacggattgattaatcaagaagaaaatcatggttcataaacccaaggaggttaaatgatttatttttgaaattattgtgttaataaattgttataacaccaaaaaaggttttaaggaaacattaattttcaaaaaaccaatcacattattaagaatggtaaaaatcattaattatacaattttcagatgcgcataaatagcagtacgcacaactgctttgctcttgtcagtaaggcgttcgtccagctgcgacatcagctttttcatctgctttcgtgcatcggcagcgtttggtccataaagttctccatcgccgttgtttttttgaaacaaattcgtttagcagcatttaaatgtccagtaacgtccatccatgcgaatgttgcggtgctttggcagtgcagggagccacggcgtctcgactccagtgttcgggaaccgcgctaggacgaactcaaatttctccgaacacacggcgcatttgtggacgaggtgacgggctcgctcaagatggctgaagtagttctcgcggctgtcgtcgaacagaagtcgatacatggcgttgtttgctgctccaacagtgtctgcgatgcgtgcccgtgctcccccgggcaattgtcgtacacttgcggtgctgcctgattccaaaaaaaaatccaaaaattaatacaatcattaccattttcattttaattaaaaaatccaaaaaattcagcataaatttgagtcaattgcgcggtggactgaaaaaaccaaaatttgaaaaaaaaatcaaaattttccacttttttaagctgtgccaatgactgttgttgttgtttgcggggggtttgctaaaattgaaaaaaaaactattttaattcaaatttttattgcacacctttttcggtggcattatttttttgttgtttttgttgttgctcggaactgccgaaataatgcttgtggggaaagaacgctgaaaatgtgg

SEQ ID NO: 4080 - DNA, 1455 bp, Heterodera glycines
  misc_feature (1428)..(1428): n is a, c, g, or t
tcaacaaaaatgggtggtttttgcgattattaagctcaatcggtaggattttcatttaaaaaatgataaaatacgtatcaatttaaaaaaaactacgaggaatcatattttctttataggaaacccacgagtatacaaaaaaaaaaattgaaaataatctaatttctgtagatggatgaaccaggagaaagaagaagggaaagtcaaggagaatagccactaggccatttgcacacttgggcagttttacttttaaagaatatattaattattattttttatttttccctttgactccaattttcttcactaatttttcactcataccctcattcttaccagtgcttgtttttcccggatcccggttgccctaccgggaccgggacctgagcttttcaaaacccgggaccgggacctcggatgaccgggaattcccggcccggtcccggtcccgtggcactctagattataccaatatatttatattttttaaaataagcttttagtttcataaatttaatttttttgcccccaatttgagaacataatgggcgaaatgagcttccgttttgtaatgctcctaaaattaaaattttaattatggcagtcttgtgccatcaattacatgaatgacccaatgccttttgtgtactgtttggagacgttactttatgaaaatgtgaaatttgatgacgcaacgaaactttgcttcaatttgatcaatcctggaaaatttgtgcttgatcggatcacgtattatgaaattcggtatattatatttatttcttcttatctttttaaaggcaatgttttgacggatcggaaggcatccttttgcaaaatttagctgcagataaaacgaaaacaatttggccaaataaggtcagtgacagatttaaaattttcttttttgttataagcctgaaaattcaaataaatcgtttcaaaaaagttatgccaaaaattcaaaaaattttcatttcacaaacttagaaaattatcatctatttttttaaaggcaaaagccaatttattttttggcttctggctaattgagtttgtcctgcacttccgaaaaatttcaacaattccaaactttggcaaatatttcagcatcaatttgtgccgtggattttggtgaataatgtcatcattgaaacaatgcaatttttgcgctattcattgccctcattgatctgcgagcaacgggctgagggtgaatatatggccgaatgtgaaagttggtaaatcggaaaaaaacaatgacaaatttcaactgttgaatgatgttgtttagcacattaaacatcacgcaaatttaatgaattgatcaagaaaaaaagaatggaaagttttattaaatccgccaagggataaaataataaaagaaaaataaaaatataattagagaaaatttatttcggcctnaataattatttaattaaaattttttga

SEQ ID NO: 4081 - DNA, 3616 bp, Heterodera glycines
ttggcaaacatcaaaaattgcggagcacaaatcgccctccggggggggggggggaagaggaagagaaaggagagccttaccgcaccggacaacaacagactgagcggggggttggacggtcgagagcgaaccgcacggggtcgagagtggtgggtgcccgcggacacggcgagtgaccgactgaccgaccgcgtcgccgccgacgaaggcgacgacaaagtgcctgccacccgtcctgtcccgtccgtcgctcctcgaccgactgacccgcaaaattttggggcactcgccgcccctggggacagactccgctcgggtgatgacgatgagtccccaaaaacccaaaaaatgtttgagttttgttttgtttgtttgtccgggagggatgggcgggggcgaggcggacaaatggacgacggacggacggaggattaaattttggcgggatcatctcgtggagggcgccggaggggcgacggaagataccctcacccgcccgccgctcttccgtctttcatttcccgtcccaatgtgcggtgacacagacgttttgaggcgcttctctgtaaggtgacgagcccagcaaaagtcgggcgagaatttttgagagccattttttgttgattggaaaattggcccgggtgcatttcagcaattaggcatagcatttcattaaatgccaaaataaagccactccaaaccctccccctcgggttcctattttcaactccgtctatggggggggggagggtgctaatttaggggaagtgggacagtattttaaggaatacagcgggggctataatttggagggggcgggcagtacggtaaggggcactaatttagtggaggaggacagtattttagggaatacggtagttccttattctaatcgaaacttgtttcaaacgaatacggaaattcaggaaaattatactttgtaaattatactgtttatttgcgttttagcgctgtttaaccgctaattgtgaggagagttaatgcttgacgaacaatgtacatcgtcagctacaacgacaacaattgctggcatcaaaagagcacatgggacgacgacaagcagtaacagtatcagcagcagcaggtgagggaaaaaaagtaattagtgggtaattgttattaattgggtaacggaataatgggcccccggattcctagtttttacgttctttttttgcttcaatcagcagatcaacccggggtgcgtcaaaacagcgtcgagatcagatcaatctcgagttggctcaaattcggcaccttttgccactcgccgagtcgaccaaagaacgactgttccaattgcaggtgagccattaatgacaaacgcctggattttaagccgatgatttgccgcgcctaattaaaatccaagctcaatacaataaaattttacctcatttgtccccctcattaacttccaaaaagtaattttgtatcatttgctaaaagttggcattctaaaaatgattatgcttttgtttttattactaactttttttaaatttaaaacaacctttattagagttatacattttgataaagcctaatggacctgggcttgggtcaatgcttgacctggttttcctacacaaaaattcagcaaaatccaggtccatgaaaaatctaggttgctgaaaaatggactggacctggactacgagaaaggcctgggtccaatccaggtcgaactctaggctttatattacaaaattacggccacaatgtttatatcaaatgccaaaaaaaacaaaacaattcaggtgatggcactttgctgtgtgtggattcgaaagcatcatgcgctcaaaaaccgttgaaaacatgttttcatgacttttgaagacaaaaaagtttttcaaaaaatggagggcaccagctttattatgtactattaccggccaaagtcataggcaaaatttttattttgtgaaaattttttcgagcaattgcattaaatttttaggccaaatttgagacaaatttttaggtacgattggcagattgctgctggtgcgttttttcgtggtcctccaaatgggtgggctcattacaattttttacttttttgtgactaaaagtcatctaaattgtgccaagcttttgtctaattgctgcttagcatcgatttcttatgccgaggtggccttgtccaatattttgattttggcttggtgtcaccgttgttcgactttgaaaatttttgagagaaagatttaaaaacatttctctattagtttctctgcaactcgatggaaatttctgcaaatttctgggtgtttcgtggcggttaccccacctttacaacccgttgtggtccgagaattgcacttatgcccgaaattgattaaattttagcaacatattttagtgcaaatttatgacacgacatgaggtcgtacacaggggtttgggcttgggggtctgctttcgcaaatttaactcatgtaccaacaccaccctttgttcagccacaccaagacttgcagaatttgctgaactgcttcgccgacttgggccgggaccgaccgggtgtccagagcaaagcatttccgcaatgtgtacgaatgcctgagtgttcaggtgggcattgccttagcagttgaaacatgcacattttttgcggcacgagactccgtttggttacggactgggatttcacagacccggatttgggttaattatctttacggaccccacttcaattggcttgcctcctctctgtgtgaaacactccatacgcgagttttgtgtgtccagttataaaaaacattccggaaaatctttacaaagtaaccttggcaaatttttgggccgggagaacaacaaaaaaaaacatcgaatgtccctcccttttttttggataacgaccagctttaaatttattcatgtcgctctttgtcattttgcatatttccaattatttgttggcatttttttcatcgttattccaacacaaaatcccttccccactcatttctccgctcatccttccaatttttagtcctattgtgaaggcgcctccatttttgtcccatcctccgccaatgctcgtcatttccatggtcgttcatcagcatcatcgtccgtgccaattttcaccgttggcggtgccggcgccgatggctgcgcaaccgggcacagtctgagcaacatttccaggtacgaaatcaaaaaaaaaatttgtctttgtttggtagtttttcaaaataaagcaaaagcccaaagattgggtgtccctaatttaatgttgttattatgagttaaaaacgaaatctggggggggggggggggggttgaaggtggctgacaagggaatcgccatgatgattggtcatgtttctccccttttgttcatcgccaattgccaaattttaatgcaaaaaataataaaattggcacaaatagacaactcaattttccgacatgaattggcactggcatttgaattctcatattttttccattgctgaatttgtgagctattaatgtctttttttttttgctttaaaagcaattaaaaaaggcgttacaattgggaaacaattatctaaataattttcaaatcaattttcacacccgtacaatttagggagaa

SEQ ID NO: 4082 - DNA, 4867 bp, Heterodera glycines
cactatttcccttttactctgtgtctgtttttctttgtttgttttcatgggcagagattacgaaatttttgccccccacacatgaccatttacagcccgaaaagcacatttcttctgccgattggtcatgttttcccctttcattgtcctaaatacaaaaatctgttcaatcgcttttgctctctccgttggttcactttattaaatatttaccgacaatttcgcataaaatgacaaaaaattttataaaattggcacaaaaaagacaactcaaatttccgacatgaattggcactggcatttgattctcatacattttcacattgctgaattatgagctattaatgtcatttgaaacatttgcgaccaattttccacaatgatttaaagaaaatttgtaaaatttcaaacattgcttaagttttgcttaaacgttggcccatcgctggccaattcctttgaattcataacgaaattttcgaaaaagttcaaatttttaatatccggtatgaatggcatcaaattttggcacattcttaatcaccttcgctagtcttctattcgtcatttacgtgatttcacctaccgtatatgctctaattatagcccagtctctattaatcccgcagtcttcaattatcccccagtctacgaggtgttttgaaaaataatccctctatcataatcccccagtctctaattatcccccctttctgaggaggttgaaaaataatcccccatgggctataattagagcatatacggtaatttgttgtataatattaattcagactgaaaatctaccgcacttactacacaatttctcactgcactgtttcatatttggtgaacgaattgtgtgccgtaccgtcttgtatttaactgttttttatgtatctacggaaagggccgaaatacacatttaatagagaattttcatcatttaggtttattttttagcaaagtccgtactgacgaggcccgctttgctaaaaaaataaataagtcattcatccactaatgcatttagttcttaatgttgatcaatttgcaggaaccgatcactgattggacggcggcaccgatggatgacggcagagatttacagtgcgttggagatgaacattgcgatttgtaccgcaacaaccgcgagcagttcaacagaaatgcccgtgaatggacgcagaagcatgccttttctttttccatgtcttttatttttcgtttcccattttttgatattttttttttgctctcatcatttttcctaggatttgtaattgtttttctttttgccaattatggaatggccagcgacaaccaacagttattttttggaaagtaatcaacgaaccggtctattgcctttattaaagtcgccaaaaaatcgtgaaaagtcagaaaaacgctaaagatacgaaaaaaatacaaaaattcctgcaaaaactgaagtgatagagttttatttcctaaatataaaatggcagggaaatggggagaagccactaatcagtcactaaacaaaaaaatttcaacaaaaaaaggttcctggcgtcgcatataggcgcgcggtggaacaatgtgaaaattttgctcgatttgacaggaaaattatcccaaaaaagccaattccgacagaaatatcacaaataaatggaataaagaatgggacagcgccatcaattagatatttaaatcatttttccaatcaaattttatcaactttttaatcaaaaaataaatgaaattaaaacaaaatgaaaaaaagaaaaccgcccggacggtgtaaaatatgagtaaaatacaaccgcatccgggtgcggagggaggccaaatgaaaaatggaataaagaatgggacagcgccactgctcgcgtaccctcgacctaggccgatcggcaccgaatagcattgctgttcccacgcataaaaagcaattatgcataattctttctctttccagtccttgtccttcattcgttttcctctggctgggatcgcctcaaagtcgactcggttccattcgggcagcaccaggtactgcatgcgcgcgtcacaggcggcctttgtcttctcagcgattccgctgactttcacaattgctccatacagtgccacttgacctgtgattgcacagtttggtcggatttttgctcctcttgccagtgagacgaaggccaccccccccccccccccgccaagccccggatggcccagatttgttggcactttccttcaaaaaaacatttaaattcttaaatattatattacttaaataaataaaaattcaggttaagaggcatgaaaccagggaggtcccaggattttattttttggcagggggaagaaaagaatacagccctgaccgattagcaaataaaaagagagaaaaagatatcgaatggctttcatgatttctttgaatacgggcctgtgagttttatggtccaaaaattcgtccgacgacgtttcggccgaagacgttttgtcctactccgggagaaagacagtggaagacaagcgcgtaaccagggtcgggagggggtgggggtggtattcaaatgaaaaattaaatttaaatgaaattgatgcttttttctggcgacgggattcttgccgattaatccggtgccagcttttcttttgacaatatcctgagacaacaggagtcccgccctgttcgattctcaggttccgaaataaagaaagtgcagagaaaaaaacatctcatttcgggagtcgcgcagattcaattgtgaataattgtaaatttccgggctctaattctccgaaaatgtttccaatatttaagtgctctaagcaacacaaaaagtcaaagttttcaacaagagtcctgtttttcctcataaattagaggtattttagtcttcggtttgggggggggggggggttactctgccgatttactccaaacttcgccgacggaaacgttgccggggcataaactcgccgataaaattaaaataatgcatgaaaaaaacgtgcttttgaaaagtatcctttttaaataatgatttctgtaaatctgatatcatattcgtgataagaagcttcgaaaaaccacgggttagtcttcataacaagcccatattctccagtattatcattatttcatttaaattttattcaatttacatttccatgcgctttttcctcagcggtttgtcgacgaaaaaaattgatgagttggtgaatgtgttggcactgcgtttgttcgtccacgtaacagtcaaaacggtggctgattagagcaattccgaggccaagttgagaaggcgcaagcaaatcgaacaccgacagccaaccgtcgccggagatgaaactgaagaaaaaagaaaagcataattgaaattgaaatttggcatttttaattttacattgcttttgccatcttttcatccgcttcttttcggttgtctgacattttgttgtggcaaattattaagatagttttcgtcggatttaaattagcttagaaaaatcgaaacacaaatttaatatgtgaaataagtcagcagaattccttgtaaagtaatggtaattttaatcgaatcattatacacaccgactcaaaaaacgagacatgtgtaaataaatagagagtgcagagaaaaaacatctctcattttggcgtacttttttttacgtcgcgctttttcaaaaaacttttagggtctatggcgggagtgggtggggtccgacggtgttaccgtccatgattacacactaacaataagcttgagtaggacaaagacgattcgttttagccaattcgtttttgtatttattccgatttttggaggccggtattccaatttctgaaaaatttggcctaggaattccgatttatataaaatttttgagtctcggaatgtcatccctggtggttgacaacttttcgagatttatcgtcactaaaagttgctcataagtagggcgtgtaattatatggatataaaatcacgaaatattccataaaatatggacaacaaatcgcaaaatatggacataaaatagcaaaaatctcaaaatatggacataaaattgcaaaatatggacataaatttttccaaatttagtgtataatttctcaaaatttcttcaaatttattggttgaattgcatataagatacatttacaaattttgaactgaaaaactcattcgattgtcggcaaatttaaatttattcaatatttttcgtgaaaattttgctaaaaaattattttttggaaaattttccggtttttggggtccaaaaggccaatttagctgatgggggccgttctaattgaggttttttggaaaaatcccaaaatatggacaaaaatgggaaaatatggaaaaatatggaaaaaatggatatggaaagtcatcccagaagcttcaaaccaagctaaaaacatgtttttcgtgcgtttcagacctccctcagtccaggaaaaaactatggatttccatataattccaagccctacttataagttttgattttctccattttttctttctctgttattctttttctacatttcgaattgtttttcccacccatctcataattaattgtttccttattcaaaattcgtataaattttttaaatttcttcctttctttttcgagtattttcttcttgttatattcttttcgtttttgaaaatgagacgaatttttacataaatttgttttcaaattaaattttctaaactttattaattcattttgaaaattttcttaaatgaaattattatttacgaatcttattttgaattttggaagagcattttatagctgtttttttcgtttttatctgatttttaaatgccaaagaaattgattatcttta

SEQ ID NO: 4083 - DNA, 2438 bp, Heterodera glycines
agtcggtcagtttgcgcttttccttctttttatgcttttttgaccttcgtcgcggtgctctctgcttccaacgggggctgccctttaccagctaaaaaaccatgaaatggaaaatttttgacaaaaaatattttaaactttgctcaaaaaatttgggcttttttcataattttatgatgaattattaaattttcagaaatataaacgatacatgggggaatatactgcacccgttttcactcattttttgtcactatttcaagcattaaattgacctcttcggtaatttcttgccaatccttcttgtcgccaatgtgaccgagtgacttgtccgtcaacatttcttccgccactttgcccgcaaccgtcatgatgaggatgttcttcagctcgcttcttttgtagcgcttgggtcctgtggtgaaggtgcagccgtcgtactcccctttctttgggatgatcgtcgccttaattcgcaattttccgctttatgtcgaatttttttaaccttttcaataatggcccggtgagtgttttttttggttattacacatttaagccaaagaccttttaatttcaaattcgggataccgcgcaaaattgcggtgtttttgaattttcaatatcggcacttttttaatttgagaaagttaaaacgccaattttaataataaaaccatttgccggtggttggtatatgaaaaaagtaaatcccaaaattaacctcataccatttgaaacatgacgattgttagaagccacgctacaatgctgtgggcgcattcgtggcctgtaacacggccaatgttgtggcatccggtgcgtttggcctcgttaattagatgccaaaatttgttggctttccaatagcgtttggaagccttgctttgcttgttgttgaccatttggtgtatatttcttgctaaaatacaatgtttttatcaaataaccatgccatagccctaatttgtatttcaggggtagggagtttaacaaaataatcaggcaatacatatattttagacaaaactcttttatgtcattttgcttcatttaaatgccgtctaaattttttttttggtgattttctatcacttttgtgagccagtattccggcatttacctttaggcgatggctatgctaactatcctttttttctcacgttttaaccgtgaaaaattagtattttaatccattttttcttgcttgttcatttacgcgattttgcctaaaaactttacaaccgaaagtcttaaaaaagtcggacataaatggcattcagattttgacacttttcatctccttttacaggctcgtcctctccgtcggtgaattggctttccgtgcactgcgcggtggtcgcgaaaatggccaaggaaccggcctatgcctttattttgcccaccttggagcagtacgcggccgatttccgccattttttggagcgggacatcatcgaaattagcacactgaggcgtctggagaattcgcgcccttcggttggttgctgtcctttttgaaaatttgcacactgtttcatatttggtgaacgaattgtgccgttccgtcttgtatttaactgtttttaattctaaatgtgtatctacggaaagggccgaaatacatttatttgatagggaattttcatcatttaagcttatatttttttagcaaagtccgtactgacgaggcccgctttgctaaaaaaataaatcattcatccacaaaagcatttagttcttaatgttgatcaatttgcaggaaccgatcacatgttgcacgtccggcaccaatggatgacggcagagatttgtgccattggaaggccaccatcaaataagcgccgtgtcgccgtacgaacgaggcaccgtcaacatggacatcgtttttcgtcgcgactacccattcactccgcaaatttgtgaaatacaaaacgcccttttaccatccgaacgttagcaagcaggttttgcaaaaaatttgaaattttaagcgttttttgggtaaaattacaaaaaacaactgactgcattttgagtataaaaatgcgaagaaaaattccatttctggagggcaacgcgtccaaaatttcttcaaacatggatataagagcgggtttatttactccgcaatgataccaaatttatacccactttttgactaacagttcgcgaggtttccttgttagagaaatttgtcttataggctcggatcccgacccggaatcgaactaaaactaaaatttcggcaaaattttattggactttcaatttattttaagcccccccccccctgcaggtgtacgagtcgttggagtgtgtgcatgtgttttgcgctcgcgcacattttgtatcggcccatcattgtgtgttggtggacaccattctgcgcaatgcgaaggccgaagaattggcaacgattccgttcggcggcattt

SEQ ID NO: 4084 - DNA, 5614 bp, Heterodera glycines
cagatgctaagagtgagtggggcgattttaattaattaatttatttttatttaaatagagaccaatatattagggtttaatttaaccacaaatgcctaccgtttttcttagcttttgggctctaaactctgttaaataattaattctttcattgatcatgcgtttgattaaccaaaaatcacttttaaaaatttctgattgagactcaacgaagctagagattgattgttaaaggttagctcaagaggagtcgaaacagagacggcacaaaaagaattttccgtgccgaaattagaaccgaacgaaaaagagagactctcgggaatcgcacctaatcgcctttattacttgctaatgacccctccccactttattttcttgtctcaagcaatgcttatgcttataatcacagcttctcctcctttccccttccctccgccttttgtgctttttccccaccttttgggtgtgtaacgaaatttgctgctgcttccaaattggtgaggacgtcccccgggcagcagagcacgtggcctaaattattcaaaagtccgccgccctcccaaaacttttttccctgtgcccaaaagcttttttattgttgtttttgcctcaggggcaaaactattgaacggaggaggagaagcattttttgacgccgaagggttttacggtttcccacgaaattttgtgccctcaaaatgatccctcccatcagaagaggcacttccatcttaagggtaagcaaaactcatccagtggccaagaggcggaaattggggtcaattttcgaatttaaaatatttaataaaccgaaatttagaaaagttaaaaatccaataaaaatttttataattcaattgaagttagtttatctaaaatacacaaaaatctaacttattcggaagctgaatttttttcatcttatgcctttgtttaattcaaaaaacaaacgcatttaaaatttaatttatgccaatttggcatttcagtccttttttgtttgccaatgccgaacattggtgttaagatgagtcatccgggctggatgatcgtctcctttctgaccgaactgctcagttcctacggcggctttggcaaattgccgccctcccataatccggcattttcctcgcgccacgcgtgtgccaacgacacagaagtgatcgacaatttgctcaaggattcgtacaataaggcaacaaaacaaagcgatttaggggattaattaatggattttttgattggaattggtcctttttagcattacattccctcctatccggtccatgtacgggtggacatgtgggtccaggaagtgaccgcggtcagcgaactcacccaggactttgaaattggtggacaaaattttaaatttattttatttttaattattttatgcatttaaaaaagatgtttttagttttttgactcttaaaaaaataaaaaactgttgtttttcccggttatatgatgtgcaagatttatttaaatatgtaatatatttcgaatagaatatttaaaaacaaaattaattaattaattttgttaatgttgggcaaaatatttaaattattatttttgtgtcttcgcattccgtccaaatggtcaaaaatgtgtgaaaaagacaaaacctaaacaaattaaatgttaaacttcagatttgtacataaacgaattctgggaggacccggcactgacttttgattatatggtcggcaattttggcaaaattaaactaaagctaacatttttaaatttaacattttttaatttacaatttcagaatccctgcaaaacgaatatttcctttgacgacaaagtgctacagaagctgtggattcctaacacatgtacagtacctaaacacacaaaagcacattcattttgtgattttctgttccctaaggctttattaactccaaaatggcgcaaatccacgaaagtcccttcaggcaagaaaatccatttgaaagggcattttgaaacattaaatgcctggttttcaaaaaatttagaaatatttttctgatgattttctcaaattcgaccatttggacaaattaccgcatgaaagtgacggggccatgcgatatgaatttgaaaaggtttttcaatgcatttaaatcatttcctttattattattgttattttaaggtttccatttgaccaacaaaagtgctttctgacctttgagtcgtaagtttgtttgttttttaaaaataatttttttttaattattaattttaattttgacttaaaaatttccgattaaattttgtctctgtcaaaaacaaaagaattcctttccttaattggggtgtttcttaattgctttttcaaatagcttcaattacaacattggcgaagtgcgtatggagtggaatcagccttacccaggcaataaagatgctttttaaattttactattttaattaaataattgtttttagtgatgttgctcaaacaaattgaattgcccgactttgtgctcatcaatttcagtgtcattgccatagaacaggcaaaataaaccaagaaatgcataattaattaattaattagggcttttggtcggaataattttacgaatttggcaaaaaattaaaaaaaaattaatttaatttaatgttcagatttacccagcaggcaagcacattaaaacagttacctatttttgttattaatttgtttttattggctggtgggatgagctgaccgtcgcatttgttttcaagcgccgctacggatggtacattttgcaaggcaaattcttatatttttttactacttttattaaactattatttatcaaattattttatttgaatggaaattattttaaacataattatttttcaagcaaaatttttacttttttttgcaaaatttgttcaactgaatttttaatatttttttcatttttttatttttaataattaaatcaatttaatgaaaataattaaaattttttccttctcatttttaaggttacatcccaacgttcgttttcgtaaaaatattatttttgttcacattatcgtcctatttccacaacagttacgtgaccatcttcatctcttggatttccttttaccttggctcgaggtaaatttaataaaaatatcaatttgaaattttccaatgtttaaattaaatttgcaattttcccatttaagggcaattccggcacggacaatgctcggcgtcaattcacttctgggtcaatttttaatgaacttgttgctttacactaacaagctttgtctctgtttttagccatgactttccaattcggtagcattattcggttagtaatttatttttaattaaaaaaatctttcaaaatttgtttattttttaggaatcttccccgggtctcttacatcaaagcaatcgacgtgtggatgctttctgggtaaatcaaatccgccgaatttttctgccgcttttccggaaatttgtgtcggaattcggagttccaaaattcctgttattcggcacttcctttacctgtattttccccattttcccaaattagcatgatgtttatcttcctgtcactgcttgaacttgccgtggttgggttcatgtcgcgcaacgacggcaactcgggcggaggcacgcggcgcagcggcggcaccggtgggacaaaaaggtggcaccagcagaggggaggcgaatacgacgacgaaatggactggaaggagatgccgagcccacgagttgggctcaagcaggtgggcaacagcagaagcagaaatggcaaaattgaaaagagtgtaaaaaacaattaaaaaaaaacaaaattattggctttatttttaaaacccgggcaaaattttatattccggaaaattgataccattttaaaccccaagaaaataagcgcgcattctaaaatccagaaaaagggttctgatttaaaacgagggaaagcccaaagaaagatatagaactgatgaagctgatcagaggtggtctgatcgaatcactgatggcattggaatcggaattcattttcgtgccattgcttttacagttttgggtggacagacagtgcacgctgaacaggacgaacagccgcacagaagcgccgaacagcgtaacagcagcacaaacggtcagatcagctagtcattatcagtagaaataccactttaaattaaacacagcaacagtctgatcaagtttactgatgcattaagtcagaaaaataggagcgacatcgccttttctgaccaatttgataagctgatcaagttgatcacggcacagcagatccgtagccagggatggaagacggaggaattcccgcccccttccgaaatgaaaaatgaaacattttgaagaaaaacgggcaattttttttttggaagatctaagcgcttttcttaacccgacggagcctaacaaatggcaaaattggtccttttttatcgaaaaactacatattcttgcttttttttctcggcgctgaaaatttaaaaataacataggagaaaaaaaacttttgaccgaagagcaaaaaaaagagagaaaaattcctcctccgaaatttttctggctacggcctgtggcccaatgtttcaaactcagatatcagttgagcaactgataatgttcaacattttgataataattcaaagaccaattgatatattcgagaatgcttccgtattctgatcatgaacagtttacgtaggacaatcgcttcttttgatcagctcaaaatgattgccctcattttcattcgatcggtccgttctcagaaaacgctggacgacttccggcgccgctcgcgccctcccttcgcgcggaacagtgtctcctcgtcgccgcgtccgtcggacggctcaccgctgcaccaactcaggcccatgactccgtccttggcacatttggcggactttcggcacccgtccagcatcgaccagcaccacaatgcgcagcactcactcggagcggcgtttagtaatttttgtgccaaaattagtgggggaggaaaattgaaaatccggcataattatggcacgagtttccgcacttcttttgctgcaggcgttgaccaataccctccggcgttcggcaccgagtcacagcagcaagcaatgccaacatcgccgatgcccaaccttcgcatggttccgcggcaaatgctccacgagcgcagcgtcagccgaacgcgtggcgagcgcccaaggcggtgcggaccgcgccaatttgtgcgtgccatctgtcgctcggtgaagagcataacgccggaacaggtggacaaatacaggtctgtcggtggtccgatgaatcgtccaacagtcgccaattggctaatacattatgacgcggcgccagcagcaagttttttgagtggacgcccccacccctccctgacaaagagtgccaggaaaattgagtggcagttttgccattaaaaaatatggctggttagctgacagttttcccttaaggggatggccccgccttttccggcttctttttagaaatggaaatggctataattgctatggctaattaaaataaagtgaagagaaaagccgttttttaaacataatttaattaataaattcagtgccattttcttccccaactgct

SEQ ID NO: 4085 - DNA, 1835 bp, Heterodera glycines
tgaaagaagtgatttgtgatggacaaaaaaggaaagtcctaaattttgtacattcaatcaaatggcagattattaagttttattaaaaaataaatgtcggattttccaacccatcgatttttatgtgcgtatttatcaattttttgttgcatttgtctcatgaaatgaatatttcctaattgtttgtttatttgcttgactatcaaaagcgatcgatcagtcatcgaatcgaaaaaaaaggccggcttcaaaattttttttgtttatattttaaaattaatttcaattattcctaatttttaaattacaaaaattgtttcgggcacttaatttatatcataatttgaatagatgttaaaacaatttttttctatgattcgtcttcaaaacagaaaaatggatgaaataataattgagcagtttctatcgctgtaattccgtcgccaccaccgccttctcctccgctttccgctgctgttgttgttctgcgaggtctttgaagcccaactttggccattcgtcccggtccatcagtccgttgtccatgcggcatttgaagtagccaaaggcgcggtcccggcactccgaattctgtccgtccttttcctggggaaagggaatttgtaattatttaaaaaagtggaaattgattcccaccaccttcaaacagcacaaatactgcagcatctccaggtgacagacctaaaataaaccagggaaaacatcaatgatttaatgcaaaatgagtggcctaatcggtcggcccttcccattgtggtaattagctaattatcccgcaaaatacaaagcaattagttaatcagtgaaatgcccgcctgctgataatcaagtgggaaagagccctttaaaggcggtgtcgctgcagcattttgagcaagtggcgatgtgagcggagattgcatgggataattctgtgccttaggcaaaaaacaataaaaataaattttaattttgtttttagagctaattaaaaaatattcgcggttttgaaatttcaataaatccttacgatcgaatttatgttcatgtgttagttattttagttatccatttattgggttcagcaaccatttgacacaaaagtaaatgtagggaaaacaataaaacagcactaattattttcaaaacctaataaatttgttgaattttgaaataaaatatgcaagtttcaacaatagacaatggaaacaaaacaaaaaatgaaaacaaatatttttctatgacaatgcgttttgctccgtctccgcaacatcattcttttgaaggagtttaagcaggtgaatgtgaccgctgtccagcgcaactgccaactgacgaagaggtacaaggggagcagcagcacaatggcactccgataattccttgaccgttttagcatttggtggcacggcgttgggtcgccagctgacacagttcacttcgctgtccatgcgcaacgcgacgagcagcaccaacgcgcacatttcctggtccacggtgaacagccggacaaaacagtcgccaccgccaaccgctaaatttgaaaaataaccatttaaaaatttaaatttcaattaaaaaacgcacccaaaattccactatcgctccaggccactgtgtacaagggccaacgcgtggcgagcagcaacgaatgctccaccactttttgccattgatcagtcagtgcatttgtggccgatgatgaggtgcaacaacgcttccaaatccgaattgtccgatcggtgccaacagtggccaaatggtcgcccaaaataggctcaaaagaggccgaccaaaccgtctcttcgtgcgcgtcttttatctgtcaattgggt

SEQ ID NO: 4086 - DNA, 5209 bp, Heterodera glycines
catttgcccaattggggaagagaagggaaagtgccgttcttcgcttttgctcttcgtctggcccattacacccatcgatttcctccgccggggctgtgccgttgccaatggtgagggggagggagtgacgaggaagaagcattggtccgtccgtccattctttcttcctcaactctctcgcgtcactgcgctattttcgccgctgctgctgatgagcttttttacccaacaccacaccaccaattccgcaaatccacttcccctcccccctcccttcggcttttcccccctcggcttaaacttccgtccgtcgttcgtcacttttctgagaacgtgtacataatttacactttgaaattgcacttaacaatgccgttgctgcttcttgcttagtttgaatccttttatgagagtgccgtcgccgtcgcgaggacggcattcttttttgtttggtgtgttaatttgcgccgttttgaaagggcggcagttttgatcccctgagggtgggaagacacagtttcacatcatttggcttcctttatgtgaagaggataggggagacaagtccgtcggcgtttacataatatacaataaatggggactaattactcgccaccaaaatgccaaagagtgaatgtgatagatgatgacggaaatttgccccggaaaatagtgccaaaattggagcagagattttggaagtgggaacaaatgacatggtaaataccgttttctgcaacagttgggcatgctgtttccaaatatgcttaatccctccccgcccctctcaaatcccattggcttttccattttggttgctgtcgaagagctttgaccggattaattgttgatcattcccacccaatccgtgcgctttatattaataatatccgcgcgtcatttccgtcccccgcggcgcttcgcatttgttaaatgcttaatgcccttcgtccactcgccgctcttttgctttttgttgttgttgttgttgttgatggtgatgattgacttgtttgattggtggcagtgaaaggaaaacatgctaataatccctcccgaaagcaatcggagcaattctcattcccccggggggagagcgcattttttggtattggaagccctcactcatatcggaggaaaggatttttggcactcatttctgccggatgcataaatttgcccattatttccgggttcaattaatttggcattcattccccctaaaaaaactggcaatttattttacgcttaattttaggttttggctttccttatggatttgttctgcttttgcctccgatcggcactttccaccctttttctcctcctcaatttgttcttcttgccaactgtacaggtcagaaaagaaaccaatgattggcttccatccaaaaccgagaccaatcaaacacaggagagtgagcattgacccaagaataaaacactgaaaacagtaaaatagggactcaaaatgtttccgaaaatcgggcacaaacgcgaaattatcccaggacacattgttgtgtggctccacctcctacgagctgtcgttggatccgacacggccatcgacgggcggcagagcgaacggtggcatcggtggcattggttcgtcaatggcaatgccaacaagttcaggagccaaataccaatttgtggtgagcatcgtaatgatatggtgaattaagacgtcgaaaaaatgtcgagacgaaggctttacttatggccaattcgaacctcaacacgctaacagcgagagggaccctaaggaaatggccagacaaatttatgtgcctttaaatcccaaaatcctaagatttttagtaatttgccaactaaagccacattatgggctgagtttggacttcataaactagaaattttgtggaactatgaatccaaattcaaaaatccgtttcttttttgtgtctttttaggctttaactttgtttaagaattgtccaatcgtcccgcccgtttcagcgaatgaatgtcctcatgcgaaatgtgtgcgatttggtgcctgaacagctcactccggacgtggtcagcagccgactggtgatcacacgatgcgaagaatgctcaaaagtgcgttcatttgtggcataatgccaaacaatccgctcgaatggcattttcagtgccctcaaaagttgcccagcattcagcggatgctcagccagatcagtcttgatgccagcattcagtcccttctcggtatgccctaattgttggccaattatcggccatttggcctttgttcagtgattttggtcaaagacttcgaaagtgcgcgtggcattgctcgtcttgcgcagcaggacccaaccgtcaaatttgtattcctcgaagacgacgacttggactcgccgaccgtttgcgaattgaccgactccaacgacggcagctcgctgaaggacgcggactcgctgaaaagcttctcaaaaacatcggtcagctgatgttgggcataaagccaaaccaatccattgaaaccttacaaaaccaatcattccgacagtgaaccatcggcggaattctttaagtcaaaatggggatcatattgaagagacatttttgtaaaaatttcccgaagttagtggatcaaagagaatggcaccgctctaatcggtcaacccggcattggtcaaaagatcccaacccgagatcactaccagggatgtgcgaaaatcacaaaaaaaaatttttgtatacgaaaacgaaacaaaagaggcattcgacacgaaaacgaaacacgaaacgaaaaaattttggtagacgaaaacgaaactcaaaaagtgccgaaaatgtaggacgaaacgaaaacgaaacgaaatttcgtccctcgctgatcactactctcatttatcaatcgtgattttgtttcaaataaatctatgatcagctaattttgccctaaacatttgccaaagttcaggtgctttttgtcagcatttcgttcatcattttgatggtcatttcgctcgcttggctcgtcttttattacgtccaacgatttcgctacgcacacgcaaaagaccgactgcagcggaggtaaaagagacaaaatttgaaaaaacgacattcccgagattcttttttcgagactctgatcgatcggataatagtcgagactgatcattttttatcccggcttttttgtgctctctcaaattctcgtgaccatttctaaaaggacaaaaagaaaatccgccttttttcagactgtttaacgctgccaagaaagcgttggcccgaatcccaactcggccagtgaaggcgggcgacaaggagctgaactcggactgccccgtgtgcatcgacccgtaccggcagggcgacatttgccgacaattgccgtgtcggtcagtgccaaaatgaaacaacgaagaaaaaatgactaattacacgaaacaaaacagcacaaatgattcccaaattctttagacacatcttccacaaaagctgtgttgatccgtggctgttggagcaccgaacgtaattaaaataaatgaattaaataatcaattagtgcggagcacgggaaccgaggcttttttggccaagacggaccacccaaaagacattggctaatttgaaagtgtcgaaaagttggcattcctaaggccttttaaagcaagagaaagcaaagaaactgaatcccgtctcgagactaaaaccaacattttatcaaaacgaacgaaaatgccgaattctctggcactaattgccgttttattcataattaaccgcttcttctgtcaattaaaaggtgcccaatgtgcaagtcggacattctgaaggcattcggttaccacgtgtgcaatggccgacggcgagcccaattctcggcagggatggaggaggacggcgcgtcgggggaccacgacatgccccggggggatcggctgagtttggacgccaattcgacgggcagcgagtcggccaacccattccccgtggtcaccgaagtgcacgaccctttcggcttttctccgtccgcttcacctcaactcattcaggtgtctggacactgccgttgagggagttggagttcgagagcgagaattcgagattgatctctcgagagtttctgacgtctttttaagagtcacaaattatgtaaacagatagaattgagaagtacggcactcataatgaaaacggcattctgacaaacattcgtcgtgtctcccatggaccatttgtcccattttgacagatggtccagcaaagtccccgctgcattcaaattgtcccactgacggcggtgagcatagtgccaccgcagcatcaatcgcattgcgcacttgtccagcaggcgtccattgaacgccattccattggcactgagtctgcggcggacgaccatcatgaagatggagcagtacaacaaccactacagcaagaacctgttggtcaacaccatcagcaacccgtgcagcacagtacctccagtggtgatcagtacacctcggttacggtagccgacagcgccacaaaggcgacgaaacggcccggcacatacgctggcgcagcatcgtctcctggcacggccaacagcggcggtgcgttggcactgttccgcgcggtgaccgggcgacgccaccacgtggtcaatttggtgcatgtccgctcgcgttcattcagccaatcgcaagaggccagcggcacggcgccggacgctgctcaaagaggtaaaagcgaattcgcacgcgcgcacttccgcttcgggggatgcctttttttacgagttctttttgcgccgtttttgcaggcgaatcggcactacggacggtaattccgacaagcaattcggcaatttacgggttcggcaacggttcgactgatgcggcggcgataatttacttaacggacaaccgaggcggcacggggaggagaggcatcgccccggaggggcgaacaacggggggcgtcgggacagcggcggcggcaagatcaagaccgcaattttggagatggcgctggaaggcggcaatttttcccgtgcgcggacgcaccgagcggattccgccgaaaatttgtggcgaatgcggcgggcacacatcgcccgcaacagcgcgggaaaattggtgggcccaaaaaagggaaaaccggggcccaatcccatgaaacacgacagcggaaggggacggaaaaggggaaaagggccaaaaaaaaacggaaaaaaaaaaaaggggaaaaa

SEQ ID NO: 4087 - DNA, 2218 bp, Heterodera glycines
  misc_feature (2208)..(2208): n is a, c, g, or t
caacaggcggcggacattggtggtcgcagagagggaaaacggggcccaaaatcgcatgagacacgggacagcggacggagcggaaggggcaaagtgacgaagaagagcggaagtaaagagtggaaaaaggaaaggatgaacgggtgaaacagagagtggaagagaaagagagaggaagaggaaggactgacagatgaaaaagtggaagagaaagagagagagagagatagaggaagaacaagagtgatagagaagtgagagaggaagagaaacagagcaacagaagaaggacaaatggataaggaagaggaagaaaggaagtgaaaattttgaattagagaatgaaaggagaggagaaggagattaatgagcaaacaagtgattgattttattgtgtacatatataatacataatagcattagctgatcactgatcactcttccgtcttttcccgtttggcttgcctattcaatggcatagcttgaactttcgtagatggccaactaaatgggggatattcttaattttctttttgcaaatgatgctcgagattgggcttttcttgagtcctgaggctttaagctttgactggaattgatttgggaatctgttttgggaggagggaatcgtaaattgcactgaaacatactttcagagtttattggtttgacgtgggcggatcaaaaattgtgcaaaaaaaacccgatctttagcattgtgccaatgtcaacaactcaccatcagttttgacttcaacgtgcttttgtcccggtacggcggcaagtccaaccggttgaagcacgtgtgcgccctcggcaagctttcgccctcgccccaccgctcaatgcaaaagcgttttggcccatcggaacccctcaacgccctgaagccttcgtacggcacactgcaaaagagagaaaggaaaagctgcagcagagagtgagtgtccatgaaaaacgttttggtctcaaaaactgatcagaaattggcacgaggaaaaacacgatgccaaaaattaggcatacgcaattaatttgcgcataaattactgatcagaagctaaagagtgtctgttacctcgaactgccggtggcaaattggagcagacggagccccccccccccgcccttcagagcacgacaaatatttcacaaaaaatttgaaaaattttaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttaaaaaaattttttctccatcttcctttttgatactaaagcatcagagtgctaaaattgacttgtaaataaaatttggtgcgctttagagcattttctgaaaaaatatttatgaattaatttttcaaaaaataaataaacagttaaaaactcagaatttctaaaaaaatttaaaaccaattacaattgtcattttttcaggttaagttagtcctgtaccggggagtatgcctataaaatttggtacgattttattgcttattgaaagagctagagccgaagaaaatttttttaatttaagcctaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaattttgcaaaaaataataaacagtgaaaaactcagaatttctaaaaaaatttaaaaccaattacaattgtcattttttcaggttaagttagtcctgttccggggagtatgcctataaaatttggtacgattttattgcttattgaaagagctagagccgaagaaaatttttttaatttaagcctaaactttttggcatgtttaaaaagcaattaaaaattttattcatctccctttttgatagtaaaagcatcagagagccttattaacttgtacataaaatttgatgcgtttcagagcactttctgaaaaaatatttatgaattaattttgcaaaaaataaataaatagttaaaaactcagaatttctaaaaaaatttaaaacctgcaccgaangtactcactc

SEQ ID NO: 4088 - DNA, 3282 bp, Heterodera glycines
  misc_feature (127)..(127): n is a, c, g, or t
atcattcgagagcccttccgatgctctattattttgcataattccaaaaaatttgatcaattttgaacaaagttatggccaaaagtacacatgtggcctggttttttgaattcttctagtcataatntaatatcgctttctattttgtttctttctttaaattataaaacgatggcaaaacgaaaatcgaagcgaaaagcgccgaccaaagcgaagtcaattgtggcattggagacgcagttcaattgtccgttttgcaaccacgagaatgtgtgcgaggtgaaaatgtaagtaaaaccaatcccctctctgtttaaaccagcaaatccggtgttttcgttatttttgttttaataaatgggaaatttgttcatttctgccgtcttttagtgccgttgttggctaagcgccgtgcctttttttgtgccgatttaaaaaagaattgacttttagtgttttatgctaaattacttgtttattttgaattcacaccttccaggaaatacgtcattttacatgtttattttaacactcaacttatgcaatttagggaccgtgaaaggaatgtcgggttcattcaatgccgcgtttgcatggaaggtaattatttgactcggtgattactaattgtatggtgacacacaaactatgccaaataagcgtaccgaaattgaaattaaactccagtttaaaggttttcttttttttctccaatagatgttttataggtactttacgattttacattttttggtaattttttagtggttatttctttataaaactgtaattatagtcccaaatcttcctttttacattaatttactacttcaaatatcggaaaatgaaactctcaacaacaaaaaaatcccgtaatattttttgtaagtaagttgcaaacatttttcagacttccagtccaacatcaccgctttgtccgagccaattgacgtgtactccgattggattgacgcgtgcgaggcggccaatcagtgaaaaacaaaagtggacaaatcaccaacagagaacggacattgtgtgcacagaccagggatcaccttattattcactgatcatattggcattattttccaacgcatttttttttttgatttcctttttccattaaaagtcgtctcgtaattcgattttccccatttatgtgtatataaattttgaatgatttttggccatcctttgggaggccattctcggtcttaaattattctctctcccggcttggcccaaaatggccaacaatttttggcattttgatttttgtcaatttcgtctttattacctttcccaactgagctgctgaattattaaattaaaatgagtcattccgtttcatcgtccgttacataattttgtattttgtgaatgcgttgttatcaatttgaattatcaaatttcctaaaatgattgattatttcggtccgatagtttctcgctcaaaaaatatcaattaaattttttcatcccgaatgcttaaaattttcgcagagtttggcatttaaatttcaaaattaatttctgaaaaagatggcggatgattcaccgcctccgtcgactctttgccattatcagcagcagccgaatgcttcacttaaatcgcacattttcgatgaaagcgactgctctttctcagtaaaaaataaaattattaccaaatgtaccgtagtaccccgtgtctttccgcgtcgttaccgtacccccaaccgtccccaaaaggtgcttgaccagcgcctgctcccttccgcggtggaatatgtgcggatccgatcggtccaggacggatacgaagcgatcaaagagatgaaggtgggagaatgaacgaaaaccaagagggatgtttggaccttgctgctgatctgcaaaaatggctaatttctgatcgttttgccgatttcgaatgagtgatcgttttggtcccacccttgatcaagaaactgatcagttttttttcatgcatataatggcttggtccaatcccgatcaccccatctcactcattctctccctgctgagcgatttgtccatcactctccgtttttaggtccgtggcgctcctctgatcggtcagttgccgtcggttgtttggattggcactcctttccaagatttcacttgttttggcactggcactctttcccccaaatgtccctcgtttttgcattggcactccttcccccaaatccctcgttttggcattggcactcattcccccaaatccctcgttttggcattggcactccttcccccaaatccctcattttggcattggcactttcccctaaattccccccccccaccatttttgttcccaaatctctcccaacccaacaaaatccatcctcaccagcaaccgttggaatgttctcattactcgtcgatgtaactgcttcttctactgctactgatgaacgcttttgctccgactcttccgtccaaaaaacatttcgccaatccgtcgaaaggaaatgccaaatgcttttgtccgctcgacctaccgcaattaatttggcaaatgccttccacgaactgatcgactttctaaagaatgatgaggacaacaacagcgatgctggaactgaaacggcggcggagatcaatcggcggcttaaaatacggtggaaaatccactaaaaaaatttaaatcccggagaggagaaagaccaaaaaaatgaggctttaattgggatttaaatttaaaacgaaaaaagcaaaatttgttagagcattcacggtttggaagggctgtgccaattgggcgagttctctttaatgttctacaaaatgccaaaatattttggcacttctccccccccctctccacagactgaaacattttgtgttggattggcagtcgcgcgaaagtgctgaaaacgtggcactgctacacaattcggtccaggcggtactcaatgaatgtgcggcaacaaaaaatgttggacaaaatgacgacgacaacaaaaaattagtggtgatgacaatttgcaacacgggacaattggcaacttcgtcgttgggcaccgcattgggtgtgttggaagcgggcagagggggagaaaaaggtggcactttccggccactgagtgccgttgtcggactttgtcgcaattgccagaacaaggaacaggactggaacatgtcaggactttacgggatctctccatgtttttgctttttgaaaatttcatccggcttcggcatccggaaaacgggggcttttgtacggaagttcagtcccgggtgccgagctgaatgatgcacctgact

SEQ ID NO: 4089 - DNA, 3225 bp, Heterodera glycines
ttagtggccattctcgtcctccatcgtttgtttctcgatgacccctcttccctccgcctaattaggcgtcattctcgttctccatcgtctcaaccgtctcgaattagcgatcactctcgagactcgtccgtacaatcagggctctcggctgaccgcctttgagcttcagcagagcggcgtgccatttcgactgatcgcggacagtgcagcggcgagcgcaatgcgccattttggggttgacgtggtgttggtcggtgggtgatggggatgaagcttggcacaatataagaagcataaagaattttaaataacaattacacccaaaaagaccctccaattgttaagcctgattttggcggatgggccggcactttgaagaaaaggcccggaatgcttaaggtatacaccagggatggcacggaattccgatttccgacatttttggggcctcggaatgccatccctggtatacacaaatctcaatttttattgtttaaaaatgtgtgccaatttaaaaattgaattttcaaacattaataaattccgggccatctgtgccggagagttttcagagtgggtccggcccgaaggaatgtggcccaggccggtgggtcgccccatgcaaagaccaagcggcactcagatcaaacaaagtgtgccaacaaagtccgcgttaaggcgctgatcaggtggcacggaacggggacacggcaaacaaaatcggcacttatgcgctcgccgtgctcgcccactaccatcgcgtgccgttctttgttgtgacgccgatggcgtcggtgaacggacgaattgctagcggctgcgaaattccgattgaggaacggcccgcgcaggagctgacccaatggcacggtcagtgcaggatgaaaaaacatagagtttttttgccaggtttatgggtttcaacaatggcaccttctgggcttttataacatggcacttttcaccgcccagtttcttttaatttattattatttaaagtcaagaatttaaggggtgcccatttgtccgtccgattgttctgtgtggaacccggcatttgacgtgacaccggccgaactgatcaccaaaattctgactgagaagggcaatttcagcccgacggaattaactgatcaattttaatcaatttttaattgtttttttaaatcggttcttttaatagttcatttctcattagtgtttggcggggcatttttaaacaaaatcacggcattttcgctaattagtgaatgagaaaatttttctgaaaacaataaaataataattattaattttcttttaaaagactttttctacttcatcatgggatttgtttgatttaagaatttatccgaaaaaagattttcagggatccttcaaaaattcattggaataattttaattatgattctgcttctctcgaatccattttttaaatttttaattaaaacaaaattaaatacaaatgaattttttaataatcatttaattgttgttgcccaaacgcgccaagaagcaagcatgaagaaaaaggcctaaactttgttaaacaaaaattattttcattatcattttttcaaaccgatgaaaacccatccaaaagaaaaggcccattcaatgggagggaatagaggaaacagctgaacaaaagtgaacatggcaataaccttaacaattaaaaatacctcttttaattgcgcataattagccgttaattaccgctccaattggcagccatttgccctcgaggggatgccgcccaatttgttgttgactgtaataatattgcccacaatcagtggcggtgctaccgtagtccacacggagtcggcacagccatacgatgacggagcatacgatgccaattgaggagacaagtgccaacagtgggagcagtggcagataatcggcactctgaagcacagaagacagtgggtttttgttgaattttcgggcattttccagcaccgtaccgcgttgcgcagtgccgcgtgcgctgccgcgcacaccgccgcagctgagcaggcgagcaacagcatgcgttgtgctgtaccgcacgcggactgctcgtcacgcgtggcggccgcctttgagccgctttcggtgcgacacgtcgcggcggcggctccgcccgcctcgagccaacccgggggcgcgtccgcttcgtaaatgtggggaccttgaaaaattccatacattttttttttggaagttagggtcggagagtatttgtctaaaaataatatttatttttaggcttttttgcaaattatcgcttttttgtgattaaaaaatgaaaatttatcaaaattttcctcgcgttttgtcgacacagtatgacacaaatgcaacaaaaactttcagaattttacatcccatttttggccaaacatattcattgacaaatcgtgactaaatttcaaaaaacctggcaacaaatataaaactaatgaacaaaaataatcgatttaattaaatattaattaattgattcgaaaatgcaccggggaacggtacggtgtgtaccgtacgcccgttgactgtcattgtcgtggccattgagcacgcggcacggaagcaattgtgccgttgttgttgttgttgctgcggttgttggccgccattctgctggctgggcaaatggcacgacgaacggtgggggaagggaacattttgaatgctaaaaattgaaatattaaataaattctttgtgatttgcgcattatcattattattttatcataattcgaataaaattcaaatttaaaaatatttttaaaaaattaaaaataaagatttactttaaatttaaatatcgcatttaaattttgtttttttcgcattttttttccaattttgcctttgatatgtctgttttaatgggttgttcagctccaacaatggcatgtcaatgctttgcggcggttgattctccgcagcactttcggcactttcgagtcgccaaattcgttcgagtaatcgttctctctcgcggcactcgcgaaaccatgcctaaaggggcagcagaaatttcttggccattctcgacaattggtcctagaaaatgccggcttttgtgtggcacctcggcgatgttgttttcttttttttattgctgctaattagtgcccctcttatcgattttctcgcttccttacaatgtttacaattagccaagaatcacttcaaattgctttccgtcatttttcttcaattagtcctaat

SEQ ID NO: 4090 - DNA, 2677 bp, Heterodera glycines
  misc_feature (2573)..(2573): n is a, c, g, or t
  misc_feature (2637)..(2637): n is a, c, g, or t
  misc_feature (2647)..(2647): n is a, c, g, or t
cgcgccaaactcttatttctcattagaaaaatgatacaaaaatcacaaaatttgatgattttttggtgaaaatctgtcaacaaattttatcaaattttcaaaaattttcccggcggcgcctgctgacgccgcctgccccctcttcccaaaaagtttttttggaaaaagcgcgcctcaaaaaagcgttttattgatttttaaatttggaataaaattttaaaaaatgatttttgctttatgattttaactattaaaaagttgtagaaaaaatttcgcttttcgcatttcgcattttcgcatattttggcttttcgcatttcgcttttttttcatttcgcatttttcagtttcgcaaatttcgcttttcgcatttcgctttttatttttcaattaggcccatccctgttccaaataatgaaattgccaaatattttctgaaatataatattaagttactttaatttcttttattttcaataattaccttgaattttaatttttattaaatagattatacttttaataacatgaaaattaatttttatttatttgattaatttatcttttataataaaattaaatgtcgaattgttggttttttttattctgaataattgtagaatttaattatgaaacttagttaatcttggagttatttaatcttcttttaatatacaatataaaatgcacctaaaatattcaaaaggtataatttttaacttcatttttaatatattttaaatgcacccgtgatacatgatttaatttattaatgactaattcctaataaatgatattaaatttttattccagcaagcgattttttgttggaattcttttaatatactccacgtcttcaaacacacaattttgcgatggatggtctcgttttgtgtcgatttgcaactaaggtcatttcaagtatttgtattggatcgtctatagaaaagatatttcaattattttaataaaccgtttttaattttttaaaattatatatttatttggtttccgccatgattgatcatattcagcatttatattttatgcattgagtgagtttaaaatacaaataactttgctttatattttttctaatttttattttattgttttatagcacacgcattattttatgcaatatttccttcatcgtttttaagaggttttgttttctcgtaaaaattatttgccttttttgattcgattttattttttgattattttttaaaatttaatctacaatatattaaaaacattttaaatctttatttattttattgtctatatacacatatttgtattcaaagcggatcaacatttactcaatttttaaacaatttctatttctttaactgaatttgtaatttaggtgctgtgaaaactttgtatttttaaatgcttaatattttacttagcttttttttctctaagtctataatttgttgctatataatacattatttttttaattggggagggggcagtgggaatcgatgaaaagacataaaaaatggaattttaaaatatttgaatatttattcattttatttatttgtaaggatatttatttgtaaattgtattaacatttcgcaatattacacaatattattttttaaagtgaatttgcaaattatatgctctgttaactgtaatattttaatacccaatattttaaagtggtttatttattttttcagtctatcacatgtgttttttgacgaaaaattcatgggtaatctgttttaataaaaaaaatagtgaataattttaaatcacttatgatatttaatttatttttcttttttattatgctttatatgtattttcattagaaagaattaagtttcactaaaactttggttcccatttgaccgttgaaaaaacaactgtttatcccgttactgctttatttaattaaattatattaatttaatattactttagtaattatagtacttttttgagcgttgatttattcaaaagttttaatttttactaaattgtttttgaacggaaatgcttttaataaacttcatgtccttgacacttcttgaatttgtgtcgagagtgccatattggaaactgtgaattgtgctaaaacttttttatttttacattgtatgaatttgtatatttttataaattgaagtaaagttgagattttttcattatcttatcttataataaatattttattatttattttgcgataatacattaattgcttatgtcgcattgaagcagattaacaggcacatttaagcggataaaaagggtcacatttaaaaaattaataaaacggtcaaaaagagaaaatttaggctcaggcaatttttaagtaaatattgtataattttaattattattctttggtctcgatttgaactcaaatccatcatctttttaacatcatcttcatatttcaaatatttaatttcatttataattgtacagattcatagtttttaatttttaataagataaaaataatttggaatttaattttttattattttactcttttctcgtattttaaataaaatatttcgtttattttaactaataatanattaattattattttttattaagtcgttttgcaaattctgttttatttcatttaatcagccaantaaaaataangtttttatctcatacatttaccattataac

SEQ ID NO: 4091 - DNA, 1402 bp, Heterodera glycines
  misc_feature (41)..(41): n is a, c, g, or t
  misc_feature (100)..(100): n is a, c, g, or t
taataataaaagaatttatgtaaaaaataataattatcttntataaagaatttcatatttttttttaattgaatttataaaaattaatttcatattaatntaaatattcaattcttgtacatttcaaaattctctttttaattaataaaaggaataattaattttattttttaaaatttataataaattgcattcaatttttgtacctcttttaatcacttttgtacctcttttaatcacttttgtacctcttttaatcacttttgtacctcttttatcactgttgtacctcttctaatcactgttgtacctcttctaatcatttttgtacctcttttaatcactgttgtacctcttttaatcatttttgtacctcttttaaacacttttgctgagtacgaatatgatgtctattttaagtttcagaatttttggaattttttaaaaatttgaaaatatttgacaattttttggacctcgggtttttggcctaatatttgaaaattcataacaaatcgaagggttgatcaattttacagaaataaagccttaaaaatagataaaaatcaggagaattttcgattggtttggggagatatggagggagttcatattactcttttaacatgtattataatggtgaaaagttccagggaatttgaaaaattattgaaaaaaaatctctttctaaaaaaaactaaaaagaaaaaaaatttaatcctttcaaagaaaaaaataacgtccccgtaagatcgtttaggaggatggtatccttctccatgagagtgttcagagggatgggttccatccccattaggccttgtgttagggtctttgcgtcagccgacatgcacttggtttcaccttgacacattgcaattcaatgcaatggaaaccggaagtgccctaactcgcacgtcatggcccacctgcctccctcagtccagctgtcagcacttttttgaatatgtgtccgttttaagtgcaaatgagaacggggtgacatcataaagtgcgcacgcgctggatttattattgcaacttgagcattttcgttgcaacaatattcagcactttgactccgccttggccatcggtctcccttctgggagcgtacactcggacgttgttcccgtctgttgcccttgaaaaggcagtgtacaattgaccatgggaaaacacatccctttcgaggtcaattccgaccgtgctgattgtttggccttgacctttgagaatggtcatggcaaaggcaggtttgatgggaaactgcaaacgctcatattttatgccgccaggcgttttgtcctcgtagacattgcgaggtcgttcgatgaagaacttaacttggccaccaacagcagaaggttaatgacgcgaccgaccagacgatcgtcgccaa

SEQ ID NO: 4092 - DNA, 2929 bp, Heterodera glycines
ggagccatccccataagagaattcagagggatggagccatcctcataagagtgcttaaggtgatgggagcaatccccataagagtgtttaaggggatgggaccatccccataagagtgtttacggggatgggagccatccccataagagtgtttaaggtgatgggaccatccccataagagtgtttaaggggatgggagccatccccataagagtgtttaaggggttgggaccatccccataagagagttcagagggatggagccatccccataagagtgtttaaggggttgggaccatccccataagagaattcagagggatggagccatcctcataagagtgcttaaggtgatgggagcaatccccataagagtgtttaaggggatgggaccatccccataagagtgtttaaggggatgtgatccatccccataagagtctttagggggatgtaatctatccacctaagtatgtttaaggggatgggatcgttagggtctttgcgtcagccgacatgcacttggtttcaccttgacacattgcattttcaatgcaatggaaaccggaagtgccctaactcgcacgtcatggcccacctgcctccctcagtccagctggcagcaatttttgaatatgtatccgttttaagtgcagatgagaacgggatgacatcttaaagtgcgcactcgctggacttaactcgtttgctttattgcaaattgagcattttcgttgcaacaatattcagcactttgactctgtcttgtgcatcggtctcccttctgggagcgtacactcggacgttgttcccgtccgttgcccttgaaaaggcagtgtacaattgaccgtgggaaaatacatccctttcaaggtcaattccgactgtgctgattgtttggccttgacctttgagaatggtcatggcaaaggcaggtttgatgggaaactgcaaacgctcatattttatgccgccaggcgttttgtcctcgtagacattgcgtgttcgttcgatgaagaacttaacttggccaccaacagcgttgctgttaatgacgcgaccgaccagacgatcgtcgccaagttcttcaagaacgatgcgcgtgccgttgatcagtccttccttatcacttttgttgataaggagaacaacgacgcttccgaccttgagtcgcagacggtggggaggcatcccagagtctgtgcgtcgattcaacgctgccacttcggactcgatttcatcaatatccagtggccgctcgtcaagcggtttgtccgaggacaaatattcgcgcacttgaccaggcacattcgccatcatgatttcgttgatctcatcgcatgtgtcaatgtgtggtgcgaggatcagacgattgagcagctccttgtcatttccaagaatttctgtgcattttttgattacttttacatatttaatttcatttcaaattaaataaatattatattattaattttcattttaataaatataaatagttttgtttaatccataaaaaataaaaatttttaatttaaattaaattattttttttgtgaaaaatgttttaaattaaaataataatttatttacttttattaaagaactcctgtattttttaaattagaatttgtaatattaatttcttaatttcaatttaaataaatattcaatccctgtacattttaaactctctttttaattaataaaaggaaatttattttatttttaaaaatttattaattacattcaatttttaatcttactttttaataaacgatttccttaattatttaattttaaaaccatgattgtaccctttttaaccattattgtaccattccaacaatttttgtacctctccaacaattattgtaccttttcgacagtggttgtacctcttctaatcgctgttgtacctcttctaatcactgttgtaccacttctaatcactgttgaacctcttctaatcactgttgaacctcttctaatcactcttctaatcgctgttgtacctctcataatcacttttatacctcttctaatcatttttgtacctcttctgataaccaaaatttaaaaacgggagcgaagcgccggttcaagcccaaccaagtttaaaaacgggcgcgaagcgcccgtatgagtccaacaaaatttcaaaaacgggcccgaagcacccgtccattccaaaccatatttaaaaacgggcgcgtagcgcccgtccaagcttaacaaactttggaaaagggcgccaagcggccgaaaaggtccaacaaaattttaaaaacgggcgcgaagcgcccgtctgaggccgcgaagcggccgaaaatgcacatcaaaatttaaaaacgggcgcgaagcgcccgtatgagctcaacaatttaaaaaacgggcgcgaagcgcccgtctgaggccgcgaagcggccttaaaaccccttaagattttaaaataaattccaaatctctaaaaaaactcaatgcttatctaggtagcgaagctcccaaagcgcgaagcgctttttcccagctaaatagccgacggttcacgcacccgctagtttagtatttatactactagtccaattccaagccaaatgcttattctgttttagcagatttctttagtttgaatggcgatggagcataatattattattacaattttaagtggtcatttattaataaaataatatatttacaagcataaatttccattctcataagtgtctttattagtttgaatttttttttaatatttttactcttttatttggattataattttattgctttttatctttttaaaattttttatttcttttaagtataataatttaaaaaataccacttttagaggttatgaattattttattaattattgttgttataatattttaatgccttaaaatgctaaaagttttaaattat

SEQ ID NO: 4093 - DNA, 3454 bp, Heterodera glycines
tgggaactcgtacattgtttaggttgggcctagtcttcctcgtaattttgtaaaatacgagttgccttttgtaccatttgccattgacccttaaatttaaaccaaaacaaaaatgcattaatttacaagcatattttatttcgagtaagctttgattaatgaaaataagaaactaactttccattgaattaaacaattcattgagagaaaaataaaatccgttcgttagttttttcatattttcacttgaaaaattgtcttcaaattcttttttcatttttcttatttccgataattccaattttttgtctccttccttcccattatttttcactgtattctgaattttttgtctgattttttgatccttttttaattcatttgtcaatttttgggtcaaatgcgcaacatttttagctgccacttccaaatgtttgcttttgttcaattccaaacaaaatgaattgcgaagtttttgagcatcttccaacaaatggttaatatcaaaatcaaaatcatcaaaattctctccgaatttttcacaacaaaaaacttcagtggcatattcatggagccaattttcaaaaaatttatcttcaattgaaaaattaactgaaagcgcagagtccagcaacaccttttgcgttgagaccaaatctgaagaaatttcaaaatctttattaattgggagtggaatttgtgctggcttttaatgcccgaagcacaaaaaaaaattatttaaaacttgagttacgtctaggacaaatttacattactttattttgatgaattaagaatttgatttttattttagcattttttgaaagttttctttatttaaacaaaatagaaaacgcaccccaaagcattggacataaaatttacaaaaatggtccagaagattttttttgtttttgaataaaaatttctgtgggtagtaagtagaagaacctttttgacatagcagctcaaaaccgtttaccgtcgcacaaaaaaacgcaagagcaaggtgatgaaattgacttttaaacattgttcttaaaaaaataaatttttatttttttataattaaaaataattattttgaaaatatattctttagaaaatttattataaatttttaatattataaaacataaaaaattatcattaaaaattttgttttatattttctttattattataaaaattgccatttttatttccggccaaattatacgttacaatgtgttttattgcaaatcaatcaacgacacgtcataaaactatttttcattgagaaaatttttcgtaggggttcgtttttttacggccgcgacagctctgagaattctctatttatttttaaaatttcattgagtttcaaaaaagttatggccaacaaattctgactcaagacttttgaaattttgtgaccataacttttttataattttgtaaaaaaaatctaaattaatattctgataggcaacacttaaagctattggatggataccatgcaatatttcatttttgttttcttacccccatgacggaatttaagaaacgcgtcagcacgattattagtaatccttttatattttgacaaaatttaggcttatattaaaataacaataaaataaataagcagcaagtaatattgtcgctgtgtgtgttttatggcccgatagacaattgagaggggacatgacacctatgtattaattaggacagactggaccgcaaatgtgaaaaaaacccatttttcataaaatatctctgtcaactgttggctcaatgttttcgatttgcttccacgctctcatcttggccttagccttgcgtgatcagtcaaaaatttgactatttcgttgacaaacacttcaaaacgcgcaaatggacattggacaaaacggaaattcgacgcaaaatttaaaagaatggcgccaaagaaatctgaaatgatcaattccgatggaaaagcattgccaatcgctcaaaatgctttgcctaaaaaagtcatggcattcagagttggccccgtcaatgctcaatgagtgtccatcccttttgcacatcgatttctatgacggcattttccccgaatttccgcctgattacagtgccaatgcgtcggatggccaagcggtggcaaaattgctgtttacgcctcgtcctggcattttaaagtattctcgacgctgcttcccctgggccgagtgtttcggttcgaatgaagaaaattcaaagttttatatattttttatctccgtaaagaactttaaatatacttcggtcttagccaagtacctcaaacttgggtttaattacccttgaaattcttggcttgtataaggtcataaatttcactccacgaaattattaaagtttaagaaaattctctgatgaaggcgttacggattctaacataacatgatttctttatcaaattcttttttgtgtaaatgtaaagcattaatttttgtaaaatttattgctttttagtcataagcaataaaaaatattttttaaaaattccgtcatttttcattgcaacctgctgaggttttttcaacaatttacaaaattcatttgcgtcatcattaatttattcgctaaatccatcattttacctttgcttacatacgcattaagagggatatgtgcccaaatttttgcttgtattgcattataataaatttttacaatgccatttccttcatttttgccacagaatttgcgtaagcatcgctttgccaacgtatccattgattataatataaaagatagattgaaaacatataatacatgcataaacagaggcatatattatgcccatacaaataataataatatttttgttaaacaaataatgataataatcattaaattcacattttaattgaacacaaatatataattttcaagaaatgattgggtaaatttttttattttaaactttaacatttttccagttgagttaaaattttaacagtagaaattatagaccggcgcgggaagggatcccgctagggattttgcgggatccaaatccgcaatttttggaaattacggaatttgtgggaacttaaaatttctatttcaaattggttttatttagtttcttaaatttttaatttaatttttcgaaatttcaaaaatgccgcaccgccagggatcctgcaaattttaaatgcgggcaaaaattttgagttccaatcctcagcgggatccgcaaatttgaaagtaccggtctcaaatggtaatacttaacatttacattttatgaaatgcataaaataattttccaaataattttttaaccaattgtacaaaaccgagtgattcctgaggtccaataattttcagaatccgaattccatcccaaaagatccggaatttcggaatatgaacccacccagacccaatttttagattaataatgactactttgtttgttgtaataattttcgcc

SEQ ID NO: 4094 - DNA, 1994 bp, Heterodera glycines
atgcatggagtgcggcccgaattggtagtccggccttggtcaacccattccatcaaggcatttttgataataatttttacaacaaaatgcaccaaaatatgggaaacaacaacattagcacagaaaaacgcacaaggcatttgcagaaaacgatttcgcatatgcttttgactcggagaacaataacccaaatgaaggaacgaattttgaaaatggcaacagcataattaacaatgacataaagaggtatttatagtaaagccgtgaagtcccatacccagtgcttaatgagggatttagttcagaggagccctcttacgcgtccgtaattaggccccgcagggcttggaagggaagggatgttgatggatgcctgggggcgcctcccaggcggggatcgattggccattacactgaaagactcccgactgatccgactgtcctcctttggctggttatccgttgccttttaagcgcccctcgagatgggaggagccctatcggagagataaaatggggggggggggaagggtaaaggccatttccggtcccggccttacattatatagagcagaattgtaattattttgttcatgaaaacgttttcatggatttttggtgtcacgaatactggtaacttgggttgttgcccaacatacaggagagagaaaagtcggggagagaatttccgacaaattttgtcggggatggcttttgtcggggtatctggagaaatttgtgaccgaagcataaaatactatgatcagcttttcatggattgaaaaaatgatgccggaaattattttttgtacccattgtcatttttttgttttcctttaaaaggcatgaaattttcgggatcgcagattacggattcgaactccgggtcggactcgaacaaaaagtcgtaaagtgaaaattttaaattcatatttatttggaaaaagcaatttaagttatcatagtttgcagtattagtatctagcattttgttttaaactatagaaacggattttgactgttaaatgtgaattgcgaattttttatctttgttcgaattcgagtacggggtaaggaagtggtcagaataaaaccgaaaacaacccatacctattcaaacaagttttaaaaaattatcaataatttttcagaaatcagccaaagaaacaggcgaaaatatccgaaaatgggacaaaaatcacacaacagcatttacaaccaatgaacattaacaataatcatgaaattttggggccgagaaagcgtttaaatgaaaattcgtccccactgcagcgaccccatggaacagcaacagaaaatgttgtacaacaccaacagcaattattgcaaccattaactgttccgttgggcgccagaagaaagtctttaatggacacttcagccattctccagcaggcacaaacgcaacatcatttgcagctaattaaaaagccattaacggaggagcacttggcccaaaatccagcacatggcccagcagaagatgatataaaaatggaacatttactttccaagaaaaggccattaacggagagtttggccaattctccaacgcacggagcagccaaacaccgcgtaaaaacgcaacttttacagccaaagaccaaaaagccaggaatggaaagggtggccaaacagcacacacatggccaagtagggcaaagtgaacatttgccgcaaacgaaaagacctttgacggattacttggccaaacattcgacaactgaacatggtttgcaactgcgacatgtgcaaccaagaaaactaatgaaaacaagtaccacgaactcaattagcgcaaataatttaaataaaaaatggaactcatccaccaatgtgaatcatagtaacagcaaaacaatacgaacaaatcagtttaaccatggaagaaatgttgttcagcatgggaatgaggagataaatgcccctcaaaaaagtagtaaaacgaaattcgtttaatggaaatttgggca

SEQ ID NO: 4095 - DNA, 3512 bp, Heterodera glycines
ggaaaaaaaaattttgaagaatcccaaacgattttttgtaatttttttttttgataaaacaactaaataaaatttgaaaaaatgttagagtaaattgtgtcaatgctgattttgaaaatttcaattgggagccctgcttttaatccaatgaaaaaattgagtcattcttcttgagttatttttgggcctcagttcttatatcattgatgctgattttgattcaaaatttttaaatcaaaaccccaaacgtccatagaaaaatcatcaataaaataaaatttaggtttttcatgcaagtccaattgacgcggtggacatggacggaaaaccgctcataaaatgtgtggcgattaaatccgtcattcttgaatttgacaacgcaacgccggaaataattcagggatttgaaaaggaagagcattttctgatgatgtttagaaacaatgcaaaaatcaaacacatcgttcaccttcattacatgttggttaaattgaaaatatttaattttaaatgtttttaaattgaaaatattttaattttaaatgtttttaaattgaaaatatttaatttaaatgatttaattttttttattctaacaaatctgggtagatttgatttcggttccttattctttaaagtccaagtctttcgtgggttggaatttcagattttaaaattttggaattccttataaatttacaggccgaaaaacttttatttgactttaatgccttcgaattacatagagaaatgacattttgaaaaaaaactgtgcctggacgcgttaacctgggccaacctggctctaattttttggacaaaacccagagaaaatgaagatccagggaaaatccgagttgccaaaaaactacctgggcctgaacaggaaaaacacaggcctaggtccaagttcggtagtgttttacttggagttttttttgtgaaaactcaatgtgttgttaataaaataaaattaatacgttacgccaaattcaggaaaaaagattatgcaaaaaatcgtctcatcatcattttggagttgggcaggcatgaccttacgaaacgtatcaaattgatgcgagaccaatggaaaatgtattggggttcaaccgcagtgagcattgaccgccaaattataaaagtgctgcggcaggtgctcgcggctgtcaatgaaatgcacggaagtgagaattaaatcaaaatctttgtaaaacaaaaaaatgtttttttgaaggcacctcaattatttaagacccaaaatacgtttggttttagttagctaagcagaaaaagtgattaatattggcttaatagtaaaattttcgcccaagcgtcaaaaattatttaaaaaagtccttccggtttttttatgattggcatgatctctattaaaatttatttttatttcgagaaaattgggtaaattataaatttggatactggttgcaatctcataacaagaaaatccactcaactgacacttttgcctaaatacatttgattaaaagaggcttaatagaaaaattttctccttcgcgacaacaattatttaaaaaaaggcattccggtttttttttgtgattggcatgtcctgattaaaatatgccgtcgggggatgtttaaaaaatataaatagaaaataattttttttctttaattcctccgccgttcagaaaccattcatttggatttcaaagcagacaatttgctgtttgttgaagaatttaatgcttctgggcgtaaaattggcgaagttttgaaggtcatcgattttggcggaagtgaaatcattgacccattggccgaaaaatcgaacgaggcctccgcagtggccaatgtgtgtcgcgtgcgcacgtcaatgtggagcgatgaccggtacagtagcccggagcagaacgtcacttgtgccgagcaaagcacagacacgatagagtatacggtagactatttaaatttatttacatataatttacaaagatgtagagagaccctttgcttcgggagggggctaactcaaaaatatggtttttagtgggtgttttttccagaatcccgattagggggtatgttttttgattaattagagtaattttcatattattgtcattcattcaaaaacttaaagcccagacgctttccattataattattacctcttgtctttggtttttaacaacaaaccagaatattcaaatgctaaaaaaattatttacccccctagctatgcccttaataatttatatgaaaaattgaacaaacattaacgaattttgcttctgctctttttgtcggtttaatcacgctcagtttcgcgagacttttttttcaaagctttacacgctacccagtaaataatttttttttttattgctttaggtttccacaaaatccgacatttggtccattggcgtaatgttggtcgagtttttgttgatgacgccgcattttcctgaaattgatccaatcgcagaacgaggatccgatgatgctaacaacatttacaatattgtgattggcatcaatcattttcattattcaccggcagacaaaacaaacgcagtcaacaaacaggccactgattatatgcacaaaattcaaaagcttttcccgatgttgtcgtcgataataaaggtaaataatatatttatgcatgaacaaattgccaaaaaaatgttcggagatttttgcctaaaaatatttacgaatcgcttaatttctcattagtgggctgaatcgttagcaatttaactatttttgctggttttttttgcaaaattaaaaaattgtctatttaaaatcaaaaacttaatgaactgaaagaataaagaaatttaacattaaattagttctttaaaaaacacaattttttaaccaaaatcggtcagcctaaaattaaaatagctgtataaattccaaaattagttccttttttatgtttgcaatgcaaaaaaaaaaagattattggcacactccgtatttttaaatagctgaaaaatttagaaatattttttatataaaattaggcttgtctggtgattaacccaaaacaacggccaaccgcgaaagggattctccaatttttggacggcaaatgccaatttggagagtttgaaaatgaaaaagctgaccactaccaatttgatggaaagcaatacgggcaagagttggagagaaggaaaaaacgatcagtttcttcaatgttagatgggcaaaagttttcattgttttcacatgaaattttggaatcgccgccggaaatcaaattctgtgacattggaaatttgaatggaacgaacaattaatttgttttaattttttaaaatttttatttatttgtagagaccggattttttggtgctaaaaatattcaaataggtaataaaatagttgccaaaaaaagcgcaaaatatttgtgaaaataggtgttaaaaattggaaaattcagtcactttatgcacaaaaattccaaaatgactaattttttctatcaattcgcccgaacaattgcaatt

SEQ ID NO: 4096 - DNA, 961 bp, Heterodera glycines
ccccgttttaagtgtttttgaggtgctaaaaactcgctctaaattaaaaattgttcggagaaaatgtgattttcgtgcttctctcatcaagtactatcataaaaataggtaaaaatctaaaaatcaggtctctatttttttgttatataaaagtatttgtcagagacaatttattgttagtcaataaacttagtgaaatattttaatgcgaatttttccaaatggccaattagccattctgattcaattagtaatgcgtaaaaatccaaactatgcaaaaaagaatagacaaagaaattgataaaataaaaaaaaaaattcgtaattttcgaaatgcatgatatttccatcacaacattaaacaattaaccattgaacacattcgaaagaggaggtaattctccaaaaaaaaacggagaatttaatgccttcagggagcgccaggagctcagtcggttagttagagcattctacggtatggaaacgccgtgggttcgagtcccaccgggcgagttaccttttatgttcgacaaggcaataggtagagaaatcccaaaacaggttaaaaaggtattataaacatgggtcgagaagctccacaatgtgggaaaggtttttttcttgcttatttttgtgataaggcgtaacaattcgccgaaaaaataagtaattatctaaaaaacttacacggaacaataaatataaattttagtaagaaacaggggtgaagcgcggacagaaacatcacgcagtcgcggaccgcgcattcaaattaccgaagaccggccgaaatataggttgattgataatcgaacaaatattttatgttgtattttaaatatttaatacgaattttaatttcaaatattaaaatgcttttcgtaaaaagataggtcattattattactgaagaaatcactttttatcaataaagcaaatagtttttaaagcctctcacaac

SEQ ID NO: 4097 - DNA, 2562 bp, Heterodera glycines
ctttttccccttttgaccccttctccgcttccttcgctaccgtatgtccatcgaccgtacactgaacagcaattgcgtcgtaagggagtgctgcctcgcatcgtggtcacctcaattggctacgcaaacgttcacaaacttttgcatcgcatggacgggccaattgtcccggtaattagtctatcattttttgatttatttgggtatcaatttgattaactgcgctttaagtggtcccgttggtccggtgctttgccggtgccctaccgactgaccggctcactgctcgtccgcctggacgtatggacacgcactgagtatcgaccaattcgaaattttgtggcagtgatgcgcggaagagaagagccggaccgatgggtgatggtgggcaatcacgcggacgcgtggactaaagtgacaattaatggcaattaaaatcccgaaagaacccaattagtgttttattaactaactttagtaattgcaatttaaagggaagcattgacccggggacgggcacctcaacaatgatggagatggcacgagtgttgagcaaatattcagctatgacgggctggaaaccgaggagaaccatcgcattttgccaatgggatgcggagggtacaaatttggatttttaaatattagccataaactaattaaagaatttggcctaatcggctcaactgaatgggttgagcaaaacttgcatttaattcaaaaacgagcgattgcttatgtaaatgtggacaatttgaacggcaacaattcactcgttgttaaggtaaaagcgaaacaatgggaaaaatacagtcatggtcttatgtttatatacacccccatatttccccaattttcagtgtattttgggtgtcctgatcactatgaaggagtgatctggccaagttggtgtaaaagtcttttttgattagcatcaaaagttagcttaacaagaattatttcacattttttaggcctacgaaatactgattttttggggtgttgataaacatttgaccacccataatttttgcataattcatttgataaaatatactgtttaggtagaaaattctttcgagtaataaaatatatcattggaaagcccgtaaaaaatgctacaaaatacaaccaaaatttataattaaaatgactacaaaaacaaaataaaatggggatgtagataaacatatatatgaccatgacttatgtagtatttaaaatggaattaattataaaatataatttaatttcaaaaacccattttgggataataatttgctttttcagtcagtccctttgctgtaccgactgatcgcagaagcagcctcaaaagttgaacagccggtgaaatcggaattgaaaagtgggcgaaacactcttttggattcgtggcaatttcacaaccctcggccgactttgccaggggatcggtgaataaaatattcaaattaatccaattaaaattgtctttcacagctccgtgccccacatcctgccgcctcattcgggctccgactttcagccgttcattgccttcgctggagtgcccgtggcggatttgcgcatggaaagtgccccccaatactcgtacatgctctaccacacggcgtacgaaggtaaaaaaaaaaaatggaaaaagcatagcattttaaatttaagcgatttaaatttttttttttagttccttggcttaacgataattttgtggaccccgaaggggacgcatccgtcgcaatgggccaactttggctggaaattgcgcgaaatttggcggacaatatggtaaaagccgatcagtgttttttgttaatttacttaattgttttgcaacaagatcattccgttcaatgttgaagactatggaattgcgttgaaggaattttgcacaaaagcgaacactcaaatgaagtaattttggtacttttcggttttgtatatacacctcaaaattttaaaaaatatatacaaagttttttcgatggcacaaaaacaaataatttaaatggtaaaaaccctccgaattttgtctttgggcaaattattccttttagacatcaaaaaaatcggtacatcctttgttggcatatttttgaaaattttcggattgtacataaaaccaaaaagtaccgtaattctaaatgatgggcaaacaaaaaattaagtgcaataatataatataaatttcaggatgattggcattgacagtgccatggatgtgcaaatttacaatgaacggataggctttttgaatgattcgatacggcgttttcaagaaaaagccgtcaaatttcagcggcttatccatgtattatgaattcattcgttcgctaatgcttttccaaatgactgtgtaccgttaggccattaacaccggcgaccgacgcgtgccgctgcttcggcgtgaacagctcaaccagcgactccagtcgctggagcagtgctttgtgctggacaatggcatttccgctgatcggcccgcttttcgccatgccattttctcggcgccggaagaagcttcaaatgcgggggtagcaattaattaagactctagaggtcccc

SEQ ID NO: 4098 - DNA, 2170 bp, Heterodera glycines
ctcccatttgtcagatgcttctccccattttgctcgacccctccttcaaatggctttacgcgcagcgacgtgccaaccgaacggaagcgaaccaccgaatggaccaactcaaaatgggcttttcgttgctccaattttgcgtggaatgcgcaagagaagcattgacaattgaccagtgaagaaatcggcagaaaaaaaagaaagaaaatcggacaattgagcaaaaaaaagaaagaaaatcggacaattgagcaagaaaaaaaaagaaagaaaatcggacaattgagcaacaaaaaaaaccccaccacaacagcagcagtttctgttgctggtcgcaaatgtgcgagaagaaagtgtttcggtgacttttatttaatgttttcttttttataattaaaatatgttaaatgtttttcatttaatttggaaataaaatttacaaagataataagtttcaactttcatttctccgaataaaatccatacactttcgaaaatggaaatatttttagactaagaaattttatatgtataccaattgagatatttttcttaaattaggtacatattatattttttcagttttttatgttctcatattttaacttatgtaaattatattggcatttttcgagaaaattttcattttttttaaatcatcataattttgcaactaaaactgatttaaaggtagaatgtattatggcagggtttcaatctcaaaattttgaaaatcctcatttcagccataaaaaatcctcatttgccactaaaatgcctcaaaaaaatactcatttggaatgaaaaatcctcatttttttaaacatcataaaattgcgaacaaatcagttaactgtcatatttttcgtttgaaacaatcaaattcatcaatttcttgtcatttataagcattttgtggattccaaattgcacttgatctcttaaatttttttgcttttaaattgctctttttgtggcgcggttttccaaaaaactttttgggaatattgggggagggggtccggcagtgccgataggcgctgccggaaaagatttgtttgttaacaaattttgtcaaaaaaatgattttgactgaggatttttcgaaaaaatgtttaagatttgaagaaaaagttcgaatattttgccaaatatacctaatttttaaaaaatcatgcgttttgtcacttttttatcaaaagaccacaaaaatcctcaaatttctcaaaagaccacaaaaatacgcaaatcctcattttccaaaaaattctctttgaccctctaaaagacaacaaaatgagtaaaaaatactcagatatagaaaccctgtattatggtgattgtgtccatctaaaaatgaattggtttgcttaaaattaaatggaaaaataattttccaattgtattttgtgcccaatttatcggtgccattctttgctcattgatattgcgctatttaaagaatacaattataaaaacgtttttggttttcattaagtatttattaaaatgtgcatttttgctaaaataaaaaattcaattattttcattgctaatgatatccaataactaataatattataacaccttattcgaagcaaacttacgctaccaaaaaagtaatctatttaattctgtgttgaatgtataaatttaatttacgcctttttgccacttttcattgttacgtcgttgtaactttggcactcgtgccattcattttctgtccaaaatcattctatcgttcccatttttttcgatggaatttttcttttttgacccggtcaaattcgtccgtttctacaactgttcttcctacgatgtgtcaatggttcagctggaccggcgacagaagccattggtcggagcattgacagttgctcttggcaccattctgacggtttttgtgccggatttggcagtgccaactttcccttttaagtgcctttatttgccctgtctgttcgccctttctcgaccaaaactgatcagacagtcgtgctatcagctgatgttctttctcggccttgtcaatgtgacggagctttgcaccactgcaatttgtaccggagcattcgccatttttggcactgttttctgttctcagccgactttcatgttttggcacgatggttaggaacgggtgatttgaaaaattatgtatttaaaa

SEQ ID NO: 4099 - DNA, 4149 bp, Heterodera glycines
  misc_feature (82)..(82): n is a, c, g, or t
atccaaatccctcatcacgggatacatcggattggacacggagtccgaagcatttgtaagccatttaaaaatcaaaaacatnttataataccacacaataaaattatatatttagtttttcccgctttggcctcggtatttcagcgccgcaattctctgttttaccactttgatttactcggcatttttggccatttatatttcaaaacgtaaacaagtaataactattggaatggacaaaaaggacaaaagtgtaatcccattaaatccttttttaattaagtaattaatttttcacagatttttgtccaagtcctttggctctctctgctcagtttttccgtcaatttggcctacacctttgatcgggaagcttcaaatcttccttttggacaaattatcgtcccattttacacttacggattcattctttaccaaggcaaccaatcaactaattaccaccccaattatttatcaatttatccactaattaattgttcagggagtccccccgtgatttatttgctgcttaacaaaacgatcagaagagaactgaatttggacaatacccccaccgtacacccaatagggataacaaatgttaagccgttaccgatttccgtgaatgtgtcaaagaatgggatgatgattccggtcaaatgaacgcctaatgatggatatcattagcattgaaatggaggaagaatttggccgaaagacaacataatgctttttctcttttttgactattatgtaaaaacataaaattgttatcttgcaataaggcctagcaaataaattcaaacggacggagtcaattaatcggaaaatggagggcatttgctaattaagccaaaaacgaaatcggctgcagaagatcaatataacttttctaagttttccgtaaatgtcggagaggcgtggacggggggggcactaatttaattcaaataaataaagtatttagctacatccacttcggcttttttatatgcctttttttgaccgactttttttatatatttttatcgcataaaaattaaacccaattctattctgtatttttatctgtcaattatattgtcataatgtgcttgtgttgttttcactgttggtcattctttgcgatgaaataattgccggcgagtggcgcgcctaaaagaaatttagaggatatttgtgaaaattaaaacatttttaatatttttttccaaaaattccattactaataaaggcaatatttagtaaaggttcattttgtaggggcttattttttataaagccgtaaaaaattaaataattataaatgccaaattatttttatgttaattgttcgctctcttctgcccacccaatttgtgcttttcgatgaattgcttcagcgagaatttcgcccgcgtgttaaacttcggcacggccagccgcttgccctggtgctcaaacagtacaattacggtagcgatgttcgcccgtccgcggctgcggcgccggcgaaccgtacggctgctggtgctgacccccgttgatgccctcctaaagtggccgaaatcagtggcaaatcaacggaagaagaagacaccatccctattcaagaccattagggtgatgggcacaaatttaaaacaaatggcaaaaaggaatgatgattaattcaatgaaaaggcaaaaaggattatctgccattttttaaaattaattttgtctttatattaatgattaattgcatttaaaataaaattttactaattttttttgaattagttgcctttttacttcaatttaaaaaattttcccaaatttctaccaaaatgtttgaagcgggatgttgaccaccagccaatggagccattcggccactgatgggtttttcctcgacaaattgtccggatcttgacaatgcaaaaacaattttgaattacataaatgtttgacaattagtaaattattaaccaatcatcacgagggaaaaggtgctttccgggtcaacgttcagtgtgacacgaggggcattctgcgaaagaaaatataaaacaataaattaaacagagaaatgcgatcgaaaatttaaaaaggaaacgaaaaagggaaatttcatttttttaaataaaatttttcaacaaaatcaagctttaaagtatttttaaggcctccggtaatttcagtaagcaattccagcttagaaagaaaaaacaaaacattaaacatttttatggattttttattagttttaaataccctaacaataataaataaatgtttggcggtgccggttgggccgctagataaattttgaagaaatttttgcatatagtttgatccaaaatgaccatgtatagactttggaaaaaggattctgggctgaaaaaatgtaaatttaaaaaatatattaaattttaaaattttaccttcaaattgcgcaccgaaaattccttgccgggttcaacgggaattccatcgaaaacgacctaaaaagcattattgtcttttttaaattatttatttaaattcaatttataaacatatacatttaatttttgttgaggtgcttctggtaaaatttgaggcacaatttcggcagcagaaaatttacttgcaatttcggacattttaaataaggaaagtattttgtccaatatcagctaataaaataatattaccaacattaattttgtaagaaaaatatatttccatttttcactttttaaccaaaatggaaaattacgtccgcttttaattatgtatgaatttttctttggagaaaggttttaaaaaataaacaaatcatccacccgttcgatcggtcggtcttttgttaatggctttttctttgcacatattttttttgccaatttgtttgttcattaaaatgtgatcagtcagttctgagaatgttcggtgcttttgctcctttctctttctttctttctctcttccgttaatttggtgatcggacgctgtttaaatgatcgaatttcgccgtcgaattcactctttggggctttttgaggttgaaagatgaaacagctgactgactgattgaaattgaatggaaatggtaaatgctgtgttgttgtgattcaaatctgctgaaccgccccaaaaattcattgacacggaaagaagcaaaagggtgtaaatgaaacaaaaaaaaaaagagtcgctgatggactacaatgataaatgatcaaaagtaaagaaatcaatgaattacacggaaatacaaaaaaaattataattattgtaaaataaataataaatatataaagatacctagcctaattacttggataaaatatgctctctaacaaaatgtacgacatgaaagactgtttgctccaagagaaggcagagaagagaaaacgacagagggaacacgcacaacgcggagagcagagaaggcagagtaaatgaaaatattgtgaagatttagctctttctcttcccttcctttcaacccatcgaaaaatatgcttcttattttctctcctttatataattcattgcttgatgttcatttgtgcgatctctgtccggcgccgtttcctgccccggtccagtgcggcgctctcggccagctgctctcacccggcacaaagcgcccgtctcagtgtctgccctcctcctcccaattgtcttcgcccacattctctcgcctgtccctctgaccgtctgccctcctcttttgagaacacatgcacactccctcctcgttgttgctctccctgccctcctcccgtcccgtgtggaatgagaactgactgactctctctggtgtgtgtgtctcctctctgtgtttgttcttctcttctccttcctccgcgtctctgtctgccccgcggcgggtgtgcccactgggaaaagtagctcatgctcgaacctcggctccagcatgctcccgcgaacacggactgacggtcgcggtttcgttgatccggggcggttgcatccggtcggagtcggctccagagatcgcttttttcatttttttaaaattatgtttttaaatatagcaaattcatataatttattttttggccaaaagaatttgaacagtttagaaaactccaattttctcaattcaaaattttgtgtattaaactaatcacttacatacgatattaaaaaaagtattgtggattttaaataccc

SEQ ID NO: 4100 - DNA, 2449 bp, Heterodera glycines
ccccaacaaaaatttgtcggttgattgatgaatggagaaattttgaaaaaaatacatatcggcgagaaaaatttcaactaacctaaattgaaaaaaaaaaaaacatttataaaatgagaaattgaaattttcgacaattcttaaagtcacaccagaataagatttaattaatcagctatcaacaccaactagtgaattaatatagttaatattccatataaaaatccaaattatttaataattaatgaatgcatttgttgttttcggttcccatttccaaaacaatattcattcagcacgctttaatattggacggacatttcatgtaagtgagcgtggcgcctaaatgaagtaattagcacataattaaaaattgaaagtaattaacgtataaatgatcccctaggaaatttggctaattaaatttcttcccgatttaaaattgcaaataattagcgctataattaattatcacctaggcaataattagactattaaaagttcttctctatttgaatacattttctcaatctgatcggaacggatcaaagcattaaattctctgaccggtcgctttgccaacttcgccaccgcgtggctccaaatagttgaaagcatcaatggtcagatcaacatggttcacatcgcattccgggcatttgttgttaattggcacagtcaagctgcaaaaaatagaaaaaaaaactcaaaaaaagacgataaaaatgtaaataaaattaaaactttaaaatacgaaaaaaggaaatcgaatatactttattatatactataatttattaattaatcaattaattaatttgaaagtgatatgagctaattgcttttcaccccaccttttcccattgtagtcaatcttaatgcaaatgtctttgcaaattgggtcgtccagcatgtattgtttgtcggcacggcacgcgtccttccactgcccgtccgacttgaacagtttgccggaaccagctgctgacatttttggctaaatagacgatacggatgatgagaataccgtaaccaatgaatgctcgtgtcattgtaacaaaaagacgcgaccgtaaccgagactgtattgaccataaataagcaagactctttttggccgtaactaagactcatttaattgtaaccaagactctttttggccgtaactaagactcatttaattgtaaccaagactcttttgactgtaactaagactccgtgacagtaaccgttcttaaccgtaactaagactcttgactaaccaagattcctgaccgtaaccaagaatcttttctacttgactgaccacgccagaatcgaggccgcacgccccgcgtccgccgccaccgtagaaagtgaacacactgttgctgatcgacttgccaatgtacgagtcaatgggaccggatgtgccggagctggccaaacagcccatgccttaaaaggcatagcgatagatattcattattcatccatagttctaatgcccaattctggcacaatttgaaaaatttttctgcttttggcatttcataatatgcctaattacaaattacccatataaataaatgttcaaatgaaaccagtacagatttaatgactctttggtcccatattttgtctttattattacatgacgatgatgatgaagaactaccaccgccggacgatgatgatgatcctccgcaaacacctaaaaataaaatttgtatggagataataaatgaaatgaatatcaaatacacaaatcaaaattctttggaaatggacaaaatacaaaataaatatatgaaaataaactaataatactaattaattaataattaaatttttatggacattggctttcattattattcccacccccctctattagaaaccaaccctctgctgttcttttataaaaagcatacatctggttgaaaaaaatgcaaaataaaaataaataactccacctcccctcccattctctctattagagcccaaccttcattcctctaataaaaccaccccctaagaatggagtgaaaattggcacacatttgccaaccatattagagcggtaaaaaattttttttataattttttcttaaaagaaaaattcatgtactgctgctatttcattttaaaaaatatattaaatttaataaatttttaaaactaattttaatacttaaaaatggctaattaaaattgattggtgccctcctccaattaccgttgctgtaatatttggcctcaatcagttggagtgttggcgttgctggtggtccgttagggttggtgccctgaatgttgaggccaccatttgaatttgtggcgcccggtgctatgtcggcattgttggacagagtgtattggttggaagcgccactgaccgcgtcgaagccccacttggccgagatggacgtctaattagtaatttgtgaatgatgaatcagcggagtaa

SEQ ID NO: 4101 - DNA, 6724 bp, Heterodera glycines
gcgcgtttcctaaatccaccaaatgggtttctaaccatgcgcgtttcctaaatccaccaaatgggtttctaaccatgcgcgtttcctaaatccgccagcgcgtttcctaaatccgccacgcgtttcctaaatccgccaaaatggggtggcagcgcgtttcctaaatccgccaaatgggtttctaaccatgcgcgtttcctaaatccgccagcgcgtttcctaaatccgccaaaatggggtggcagcgcgtttcctaaatccaccaaatggggtggcagcgcgtttcctaaatccaccaaatgggtttctaaccatgcgcgtttcctaaatgcgccagcgcgtttcctgaatccgccaaaatggggtggcagcgcgtttcctaaatccgccaaatgggtttctaaccatgcgcgtttcctaaatccgccaacaaaatagtatatatatatatatattttattattattcgagcaaataccttagtcttcattaaaattaatcgatacataaataaggaacaaaaacgttatgattgtgataataacttttgcaatagtttatatgaaactgttgattgttttttaacaaaagtttgtatttacttctattttaaagacttattacgtttagaattgctatgctggtcagtgcatatttttgtgaaaactttaaagaatagcgaactatattcgatcattattaagtatataaaaatacccacattttttgtatacataagttcataaagtcaatttgtatttatttaaatttacacgatggcggatttaggaaacgcgcatggtaaggaggaaaatcgaaatgcccatttggtggatttaggaaacgcgcatggtaaggaggaaaatcgaaatgcccatttggtggatttaggaaacgcgcatggttagaaacccatttggtggatttaggaaacgcgcatgggtggcggtttttagtaaatgcaccagcacccattaaaaccatcaataaaattcacgtagcataaaaaaatattcattttaggtaggcaaattagcggaaatttttccataaatttttttttatagttaaccaaattaaacattccttttttatacattcgatggcgctaaatattctagcctgcatgattttaaaaaatttcaataagtttcaagaaatttacgaggttcaaaaaattgataacaatatttatgcaaaaaaataactataccgtaaatgctctaattatcgcccagtctctattaatcccgcagtctccaattatcaccagtctaggatgtgtttgaaaaataatccctctatcttaatcctccagtctccaattatcccccccctttctaaggtgtttgaaaaataatcccccatgagcgataattagagcatttacggtaaataagtttaggttttttttggcataatgtatgagtacatttcaaatcacaataatcagtcaatcaattctttgttggggttttctgatttgcgatcaaaaattttgaaaattttctgttgaatggtatgactgcgtatcagctaaaaaattttaaaagacttaattctattaaattgaattttaatgttaaacatcttaccagtatctatttcttaaataatgaaaaattaaattttctaaaaaaaattcaattttttaataaaaaacccttaaaaatagtattaaaaaatttcataaaaacgatttaataaaccaaaaatttatttttcctttattaaacaaattatatttaatttttaatcattaataaattaaattaccttttcctctttttgtttataatctttttgaattttgtccaatttgatttgtacaaatttgttataatcactattttcaatacattttttacacttgagacatttgcatggattgtccagtgaaggtttgacctctcgttgacacctaattaaatttaattgaaatctaattaagtatttttttgcacccgcaaaaatggtccttgaatgaagtcactttagattttcggcagcagaaacaatataacttctcacaagctggacaatttaccttaaattaatttcatttaaaaaatttcaaaaaaattttataacgaagatttacataagttgggccttcctctttaataaaatattcatttcgacatgcacattgatgcaatgtcacttctgataacgattcttccctaaaatgcatattttgaatttaaataaatttttaaattttctcttttttttacgagggggtaattagcaaaactcacatttttagacgcatttcttttagcttttgtgctaaatcatcgctgatcacttctgctgccttctgaaatagtgaaagaagggagtagagcaagggcgtagccagacccttggctttggggggggggctgaaatcaaaaattcgatttttaggggtgtatttttgcttttttgaaatcccgaattaggggtgtattttacataatttttcgccttttttcgccaaaaattactattttttgccattttggccttcatttttcaaaaatatggtaaatgggggtccggcggtgccgataggcgccgccgggaaaatttttgagtattttaatgcaaatttgttaagaaaattgcttaaaaatttcaaaaaattaactgaaatttttttacttttttgggtttcgctgcctacgcccttggagtagagataattatttttaattagctaatgaattaacttaattaaagttaattaattcgttaactaagagtaggtaattaattagttaattgagagcatattaataattagctaaccaagagtattcgttaattaaaagattaattaagagcagagctattattagttaattaattgtccatttaaataaattggaattatttgtacctcttttcctttgcgtccttttgtactggtcgatggaatgtccatatttgtactgcttgacggatctttaacatttccatacagtgtacatttgccacacaattgacattttgttgcattgtcctcacaaattattcgcttttcttcaccacaactaattaataaaaaaataaattcattaatttaagttttaaaaatataaaaattatttttacccgcaaaaatgatttgttccaaaaatttcggactttccgcaacagtaacaatgggtacttccgcaggggcaatttacctaaagattttaaattaaaaaaatattattgttaattttataatttatttttacaaaaaaaacaaaaatcatacataattacagccttcttctttaataaaaattaagtggcatttatcacaaacatgaagatcccttaaatgtttaaaataatatcacaaattccattaatttttgtcggattgaaaccaaaaatttctgacgaaaatgtttaaattaattgggatttaaataaaaaaaatttaagccaaaattggtacgatatagctttaaaaggaaaaatataatttttaaatattaataaaacttaatttaaaattttgttggaaaaatgagtaaaaattttgaaaaaacccgagcattaattataataaatttaaaaaaaacataaaaaattgaacaaacttattttgaatttcacaaaatgtcgcttttttatgcttattattccatggcacattgcattttcggcacaaatccttgccacattttggacactgaaatgggcgacttttatcaacagaattgtccatttcaatggcacaattgcaacatggacagctgaaaaatatttgtgaataaaaatgatttttgataaaaaaaatatatataaatatatcaatatgaaattttcatttaacataatttgtaaattgaatttgataaatttaatttggctatttgttacaatcaaaaaaaacaacattgatcgatggtaattgatatttcttgttttttattttataaaatttaaaaattaatacacaaaaacatttttctgattggattttttaagggcccctgaatttttaaaatgcttaattttcaaaaaatttaaaatgaaaaacaaattaatatattgcgggttttcactccataaaatattaaatagatttctgattattattttttaacttactatttcttgcagcaatttccagcgattgtcatacgcatgaagtcgcaatggttttccaatgtttcaattgaccgatggttatcgttcggtaacaattcttttattttttcttaaaattataatttaaaaaaattaattatacaaattaattgtccaaactgcattaattaattaattaattgtccatactccatgtgattggattttcgcattccaacgccatacacttcagtccaagcccactgggcgcaaatggcaccatttcatgtgccgcttttgtgtattcatgaaggcactcaatgcagaaggcatgtttttcttaaaattaaatgaaaattatttaaaaaaatattttaagatatataaattcatattctcgggttttttgggtttcgaatttcagtgacaattttcccggtctctgttcttgagcctcggaaaatttggcttctcgacaagcgcaaaccaattcgttttaggattattgtaggattattgctaaagataatgaattgcgttgtctgtcctgtcgctgttttggactaaaacaaaacatcaccgtaacccagaaaactgtagtgaatttacagtatcacaattacactaatgattactgtagatgtgtgtacattcataaatatttgatttattttattgtaattgatacctctgtagctgtctgtacattaatgacaatttcaaaattaattacttgtaattgataccttgtgcttggcggcaagcagcagttgagctgctgctgctgctgctgctgctgctagcgtcagcatgatcagcagcaacatcacagaaacacaattgatcatttgtgaagctatccgcgcaaacaatgcattcgattggtggacgatgttgatcatcatcattatcattatcatcatcatcatcatttgcattgacatgcttatcacgattttgctgcttagcattagaagaatctgcgtaaaattaaaaaaatttaattacgttttttttatattcaagggctgccaaattttttgaattctttccaaacatgaaaaccgtcatagtttggagcagggatgtatcgtttcgtaatttgttgtttttagggcatttcgtgtccgtgtttcgtatatttttttttactttcgtagttttcatatttcgcattttatttttcgattcgcaacaacccttatttggggcttgcaaaaaaggggcggtcagaaatggtttgaaaaactttaatggcagcgaaaaaatggattaattgaaaaaaaattgtatttttagtaaattcttaaatataaattagtccaaattgtaattcattttttgttacaaaatttattttaaaaatatattttattttatataatatataaatagttaccatttttaaataatttgtgcatgccatcgactaataatccatcttcactgctgctcaaacggctcggatttggggcaccatttttttgggtccatacaaaaaacagagcaatttgtaatgtgcaagcaaaaactatttttgacatttttgaaataaagttgtacaacttaatttaaaaaatatataattatatttgatttctttgtgggatataatttaatatttaaataaatatatatatatataaagattaaaaggagaaaaaaaagtaataatattttcaatgttaagaagaaattgtgccatttaaaaaaattataattttgactaaatttaatgaaattacataaatatcaatattattgacaaatatattcattcataaatgaatattattgatattattaattttttgttcattatgtatgaattggaattttgcgtaagaagattgacatataaaatattaacataaatattattataataaatttaaaataaaaaaaaattacataaaaataaaaattgagtaaataacatttgtttttgttggagaaaacttaaaaacacacaaaatcaattcaagtagcgatcaccagggctgtcaaaaatatgcacgaaaaatggtgccaaatatgcgcataaataagcaaataaagtcgtgaaatatgcacaaaaaaacttgaaaattagcggtgcaaattaattaaaaattttattcctcataaattttatcggttgtttttgcaattgcaaatcaaaatttttcctaagagatttcaaatcggaaatatttgacgaaaaatagcaaaatatacaaaaaaatatgaaaatatgtccaaaaaatggcaaaataatgcaaaaaatttgaaaatatgtacaaaaaatggaaaaataatgcaaaaaatttgaaaatatgtacaaaaaatggaaaaatatgcaaaaaattaccaataaaaaataattgaaataaattattttcatagataattattttttatcctcaattcataaaaatttaaaaaatagaagtggtttcacattttttttatgataagcatttatttctaaaatctaaacaattaattggcttttattgaacaaaatttatttaaatcgggcaataattctcaattttccccctctcagcagaaagcaatttcttttgctttttttttcatatttggtttaatcattcggcatttgggttttgattctcgataaaaaaatcattttaggtctgtctcc

SEQ ID NO: 4102 - DNA, 6048 bp, Heterodera glycines
  misc_feature (6018)..(6019): n is a, c, g, or t
ttaaaagtagggttcgagtcccgtgggcgggggtggcttttcgcgggggcgggggttggcgggggtcagagtcgcgggggcgggggtgagaaatttctcgcccccggggacgggggcgggggtttgtttttaattagctccaaaaaatatcacaaaaaaaaattttttttttttttgaatgatgtgttggctccacattcctttattcgatgtatcgcctcgattcaattcttttttggtataagtgcacagatattgtctaaaaatgaccaaatttaaggattataaattatgccagaatagtcaattttatgggtgtttttgtctaaatccaggttttctatttcaaaattttcaaaataagaataaaggccaaaaaataagattttagggtcaaaaataagaacattttgcaaaattgaattgcttcaaatatttttacattttattcgatcaaaaatgtattctattattatatttttcataaatttcagtgcattcgggatcactaaatcagatttttaacattttttgcggcacatttccaaaaaacttggtgaatgtgcgaggggagaggttcggtggtgctgccgattggcgcgcaagcggaaaatttttaagactatatgaattttgttagaaattagccaaattttttagaaatttcccttttttagatgaaaataaggtactaccccaaaaccagaacatttcttagaataacaacatagaaaaaccctgtattatttggaaaaaaaataaaatcaaaagaaaacatcaaccgatgtcgaactcataacaaaaagtttgttaatgttgaagcactaaccactaaaccacaaatattttgaaaaatataagcaaatttactttatttcataaaaatttgtaaaagatggttaaaaaattcaaaattgtataaatttttgcctttaattccacgaatatgccattcttaggggtggcccccgcgggggcgaaggtcgcgggggcgggggatgcgggggtcagagtcacgggggcggggacgggggtgagccccaaaaacctgtcccgcccccgggtacgggggcgggggtggggtccgaaccctaataataattaacaaattgatacaaagtaaataattaaataattacaaaaaacaaaacaaaatacataaaaatgtgggtttgagtagctgaccacgaagcttacttcgattttgacaaatccatgattactaacccgaactcgaataaaaaataagaaaattataaaaaaattggaacctaagaagacccctttggattttaatatgtaattttcaaaaagtcacttttaaaattgcgcctaacaaagcataatcaaagaagcaatgctgtagagaattaaaattcaacttaaggctgtttttcccttcactttttcattaatttatggggcacattacccattaattgttttgttgtgttggcattcgccatttttattcactttatcggggggagtttcccatgacaacgccttgtcgaatcacaaaacattagttattagtttcaattggttctcatttattcggcatccctttgaacgaacaatggccattttgcacccaaaaaataaggtttaaatgtttaataattgagaacagaagggaaaagcgtctctttacaggaagaacttgaccaaatcatttccaactctggcgaaagactcattgtcattgacttttttgcaacttggtaaagtgtttaaatttttggatttcatttttaattacgctttgttaaggtgcggtccatgccgacaaatggggccaaaattcaatgtttttttaattttgtttttaatgagtgcgaatgggaggggcgcataaataatgaaggaccaaattgttgatgagttaaactcgctttgccatatgaaagtgcggaagttgtagagaccggaaaggacaggatactgtacatgattttctcagagtcctgatccgggtactgtatttttttggaaaatcccaaggacccggatattgttaaatttctgaaaactaacattttacctttgagatataaatctttctccgttcattaaaaaatcaaaaaaattttcctagaaacttgctgccgaataccctgagccaatttacatcggcattgatgtggacgaacacgtaaagaccaacagagatacataattaccaatgccaacaaaaaaaggataatttcctatttttgggtggggaaactgcgaattggccaaatacgaattgggtttttgctgaaccttaagcacaattaattccgctccttttgtctgtttaaaatgctttttgcaggaatcagtcgcggcattttacaacataaatgtaatttgaattccaaatattttaatgatttcatttgattatctcttttaaaattcaggtaatgccaacattcatctttttcaaaaatggacagaagcttgttcgtttattcagcaaaattaatttatctaaaaatttcagcaaaccatcgaaggaaataattacgaaagtcttcggaaaacagtggaaaataataaatgaaggacgaagtgcaaaagaaaggaagggaagggtgaagtgaacgatgggcaaattattgcgatcttttgagacgaccaatcactcattttaattgggggggggtaattagtgagaattggtcagtaaaaaaacgcactcttttcaataggactgtcttctgaaatgtttggcgcactgcactgttaaatacacaaaccacaaatgaagaaatattgaaataaataatccgacgagggcaattgtcgcgaccaaagagacgactaaataaatgactcaattttccagggttttgcccccccccccgcctttcccaactgaatttgaattccaactgcatccgtttggccacgtccgagagtcgcttgttcagctccaactccagctcctggctggcccacgagttcgggtccacgatggccgtgccgagatacgcagccaacagtaccatcagggatatggtaatgatctgaagggtccgatcagtggcaatggcactttcgcgtgaactacgctgagcacaacgaaaggctgaaggaacgccgcgttctctgcgctaagtccgtaaaccattgagagcacagcgacgccgtccacgaaaagaaaaagaagttcgaagtcccagccaatctcggaatagccgacgattttcacaattaaattgctaacgatgcaaaaggaggagacaatcgcaacgacaaaagtcgctttcttaacaaattcagagaagggaaagggcgaacaattcgaagaatgcatttatttacctttatttcagcactaaaacaaaagcaattgcatttttttctgtcctccaaattgtgatcagaatctgtcgtaaattggccactcatttcacacgaataaataatacacagtgattttaagttgccatttcaataaaataatagcagcaataaaagaaacttagaggaaagcattttttagcgttaattttttaaaaagttttcgatacttttccgttttgggcatacacggcaaaatgccacacgaaactgcagctttttgcgcgcctttttgttgcatttttttaaatttgcggtgtacgcccaaaacagaaaagcaccaaaatttccattgggtccataaaaaacaatcagaattattcattaattttataatggctgtgactgatcgatcggaaagggatgtgaaggaaaagcgaatgtttgtccttccaaagagcactgacaaaaggccgacggacaaaagccgaaaagattagcaacgaaatgccgattaatcggcctgacttatcgagaaagccaaagcgaaaggaacagtcattttaacaaatattggaaatttcgtaatagatcccaaaatttataataattcacaaatattaatcggtattagcgaaaacaatgcaatattttgtaataaatactctgtcttgtctatccaaacctaaatttgttgtcttataattgtattattaataatttttaatcacttcatttccccattctctcttttctcattccactctcttcctttttcccgttctcttccttttctcattatctcactcttttctccccctattctcttcctttttcccgttctcttccttatctgcattctctcccccccccaactccccatttgagcaatccaatcacgtaaactatttttccaccggtgacttcgatgaattcgatgcacccgaaaacattgtccatttcctggagcgcatttctcggtcaattagcgggtcattgatccacagcccctaaatccaattttattaacaaatttccctaaaacttgtcacatttttcgggtcgcggcgccatctcagaagggcttcatcgtccccatattctcccgcgccggtgatgatcacttcctggccttggaaatggccaagcgaaatgcaccgcaagggtttgtccgaaactttcagtttcatttgaagtgccattccgagtgaactgttgctaaatccaatcaattttgaatattttcactgtttcctcattattcactctgcttctcacatttccgttgtttccaactcattaggctccccttgcgcagtttcggcagtggcgagtttcgcgtcgtcggcacacaaagaaggacgcctcgaagaaggcgaagtgcccagggaacgggtgaagtcatctgctaattagtgccattagtgtaattgaggtcggaggctcaattgatttgtcggatgtccaccgacctccctccttcaccgccaaaagcaacggctcttcgaagttcaggtccttccgtcttatacgaatttcctcagtcgccgctccgttctcttcggcagcgcattcgtccgcagccaatggacattcagcaccattttttgaaggttttccatccaaagaatgacctgaaaacagtctgccattgaataggcaaagagacaccgactcattgcgatggccatggaagacaactttcgccacgaacggagtcggaccaaccgcgacgggaaacgcttccgttgttcggcctccgttcgctcattgggcgtcccttcgactgattcgtccattctctcggctttctccgtctcattctcatcgaaaccattctcgagaagatcgtcgtttctcgaaggtttgcagtttcggccatggaatgaaagtgcgcgcgttcggtcgatcgaagcagcggaatttgcgaatgagaaaacggagagggcggagtcgatgctttgtcgatcactcggattggaaagactgggagaactttgaaaaggggaaaattcaaaaaaaaaatgacaatacatagagggggagggaaaggagagagtgtagagaagagagagagagagagagagagaaagagagagagagcaagaggagtgagagagaaagagaaagagagaaagaggagaaagagagagagagaaagagaaagaaagggagagagagaaagagaaagaaagggagagagagagaaagtgaaagagagagaaagaaagtgagacaaagagagagggagtaacagagagagagaaagagatacagacaaagagagggagaatgagagagagtttgaaagaaaagggagagagaaagcgggggaaatagagagagtgctagagagaagaagaaatagagtatattggagaggaagagaaagaaacgtaagaaattttttgatttatctagcgcgagggcgcgagcgaatcgagcgctcctgcgctagtttggtgcttatttttgtgcttaatttggcgtaaaaattttctattaatattaatttaaatttatctttaatgggacatttttttacatttctttacaaatttaaataggtatgtaagaatcgtgaattcggttgcatcttgaaaatggtcagtatcgaatttagaatagatcaaaattagacctcttaatagcttatttgttaggatcacaaaataagagttgttcatccacacaaaaacaaagtttgcatttttccaaaatcgnnccctttctttaaatgtctcatgccataaa

SEQ ID NO: 4103 - DNA, 1626 bp, Heterodera glycines
ggccatgtactgctgagagacgctttcctggtggaatcgacactcggcagaacgcgttttggtcggtttgcaattgtttggcgactcgacaaggacgcgataaagcattaaatagcctaaaaaagggtggacaggaggtgggaagacgaccgacgaattcggaaagaatgaccgaccatcgacggtgcccacccaaagctcatccaagtggaaaaggatggagcacagctcaacctgctccaatttgtcgtcgtcttcgtcgaaggatggcttcctaaatgggaaaatctgttgggtcagcagacagtgccagccgatcagtgaccgatggctgtggtcgtagcgaatgtcgaaaagcatttcgcactgtccgtcgcgccaaagttgaataagggacgaatgggcggtgagcagccaaattccgaagggcgaaggtgccaaattacgaatcctttccaaaatcaaacataaatatggggaaaatcgggtgaaacaacgacttttcaaacattggcacttggctgccgactgatgccgaggcaacataaacactcgccacggttgaaagggtgctgcggttgagcacaacaattttgcatgcaactgccaagtaaagtttgtcatcgtcaagcagtgcatccgttatgggagcagctgcaatcggaatgtggtaaaggtcgagagcagaaggcattcgctcgaaggcattctcgagaacagccaaagtgccattggcgagacaggaatagagacgctggggacagttgacctaaacggacgtttgagaaagacacgtcgcatcaaagcgaccaatttcaatgccacgtcattcagcttcaactcccacagaatttcagcctcgcccgactcattaaggtgcagagcgataacgtagccagaaagaagcgagacaaaagccatttccgaattgaacagaaccatggaaatgagtcgacaatcgaactgaaagggaaagcgatgccaatgccaaggcaaaggatgtctctcgagtggacctccaattcgagagtgtccagactggcagtctcctggtgcagttggatcatcgataattttccgcgtttttggttcccggcacaaacgtagcctctgcccggaacgaattgactgaacacgaccacctgggggacaaacagaaaaaatggacaagcaaagggaaaatgttgcctcaatgggaagatcacagagttggtctgattggtccgacgaattctgaagcgaaacccaattaattgacccaattaatggtggcaacacaattcaccgttatgttgagcagttggcggagttgctgcctcttgaaaagctgctcttggagcacgcggagataaagcgattggcgttgacggaggtaagctttgctggggaacggactgagctgctcgaaggcgaactttatctgaacggaaatgccaagaaggaatgatgatgaaacggacggaccagcccatccacgtcgaaggtcagtcggacggccgctttgagcattttgatgaccgaaattgtgtcggaatgggcgagcagttcctcctcatggaaacccaacagagcaatggcaaatcggaaaagcaccttcggtccttcgtatagaaaacagtcccaaag

SEQ ID NO: 4104 - DNA, 1157 bp, Heterodera glycines
acagagcgatgaaccaattcagagtcaccttagggagcaaaaatgccaaagaaacgccattttgaaaaaccgtggtcaaatcgatttcgcactcgtccaaatgctgcgcgagacgggggaacttctgctccacaatttccttcagcacttcctgggggacaaaagctttgttccgttgcccttctccttccaatcacttgatcagcttgtgccccggtgagtgtctggtcaaaataggacgagtcgaagtatctttcagtgaccgccacaagaaacctaagaaaggcaaagcttttgagaaaatccttggccaaatgtaccaaaatgcgtcttcggggcccatgaaaagaagggcagtggccaccaaaaagttcattccctgacaataaccgatgctcggattgtgcagacaaaaggcacggaggacggactgaaggtgagtgacgcctttgcaagaggcggacataaagtgaacgttgctcggcatcgtcctcagcaagtccaaattcacttgcttttgatgggcgctgctgtactgaagcggagaagtcaatctttttctctttttgttttgaattctaagctttgctcacgtgtttttccgccgccgttccctgcgaactgcacaaatttttgtaataatattggccgtgcttttccttcagatcggccacttgctgattgatcagaagacgccaaacgcggggtcgaagagcgcgcggaatgccacggcggcagaggaggcgaatttcacgctgaaatgggcgggggggggcgacgaatggtcgaatggcattcgaaagaccgaccgatcgctcaaggcgttctggttgttcccggagcagcacacgccaattggccttcagctgagcatgaccggtcgacttggactgatagtgctggttcagctgagtggcgatgaaatggacggccaacggaatttctgcgaaagaatggcgaaaaccgtactcatcgacgtggaaagagccgcttcggacaacactaaagcggacagtaaagtgaagaggggacggaacagcacacctttcaaaggtgggcaaagtcggactcgactcgcgcgccttttgcagcagtttcttcactctcttctcatgctgaatgccattcatttgatgaatcattaataataattactg

SEQ ID NO: 4105 - DNA, 1346 bp, Heterodera glycines
  misc_feature (26)..(27): n is a, c, g, or t
gtatttatattctgaattttgacatnntagggcaaatgatgaccaaaattgccgattaaaaggatttatgtatttaaattaatttttacaacattgccttgtatgataaaatgatatttaacgaaagggtgagcggcggactttttgatgagccgaatcaaagctaagctgtttagtaaaggggcggcatattgtaaagagaaaattgaatttggaaagtaaaaaacattttcagattatgtcatgcttgggaatgtctaagtgaaaggccttcaaaaattcaaaatttttttgttaatttgtttttttcttgttttcaattctttcatattttgttaaattggctttattgtcataatattagaatttgccaaaatttgagtaaatttaaatatttctatttaaatattgtagtttttctgagattaaaactaagcctaagactaagccacctaaaaatattgcttctgtcttagggattactagtcccagttaaagcccaagcccctgctggtccctggctataattgatcgtcaaaagattgtcatcagtgatttcaatgtctttgtatatttattggcataaaagtaatttttatttcccctcattttatcagtcatttttatctttattttcattttattcataaaacattcacagctctaattctttatatctttggacatttcgttgaatataaaaattatcgaaattaaaattataagtggcaaatttcttaattgtccattgttgaattaattgcccttatcccaaattccagtataccgtatatttccatgttcataaaatttttcaatcccttacaatcgctagaagctcagaaagatttgctagataaaaaatggtgatattttgtatgaagcaaaagttgaaacaaatttattactattgtaattattttagcatttgatttaacatctgctgtcatttgcacaaataaattccattccaaataaacaaattcagcagcaatttgtcagccaaaaataataaacattcattattcattgggataaaataataattttcattttccgattgccaaatcggcttccttctttatttatctgatctgactttgttgggccgatccgtcagcgaaacgaaaatatccaccattaattaattattcttttcttttgaattttgtttttgcatatcatttccatcatggccttggggggcccccccccctccccccttttttctcctctgcccatttcccattttcattttgcatttttttttccccaattccttggggagaaatttttgattcaaattccaattttgaaaacccaccaaaagttgggtttttttaaat

SEQ ID NO: 4106 - DNA, 4465 bp, Heterodera glycines
ctaattatgttatattcataaaattgacaatttacggcaaaatgatgaccaataattgccgatgtaataaaatttaatattttacagtattcctacttttggaaagattgggttctagttgacatcagtgatttcgatgtctttgtattgggatcaaagtaattttgttgcttcggaattgcaatttcttaacttgctaaaagattttcattttttttcactttttttttctacggctttttaaagaaatagaatttaagcttttgttgttttttgtacttttccattatttgtttttttttatcatttttatatcccctcattttatcaatcattttttaatttattttcatttatccataaaatattcacaactctcatactctttttcaatcccttacaatcgctagcagctaaaaacatttgctggaaaaatgagatgattttatgaatgaattaattgccagcaaaagttaaacaaatctattcttactatattgtattatttttagcatttgatttaacatctgctgtcatttgcacaaataaattccattccaaataaacaaattcagcagcaacttgtcaaccaaaagataataaacattcattattcattgggataaaataataattttcattttccgattgccaaatcggcttccttctttatttatctgatctgactttgttggccgatccgtcagcgaaacgaaaatatccaccattaattaattattcttttcttttgaattttgtttttgcatatcatttccatcatggccttggggtgccccgccccctcccccttttttctcctctgcccattttcccattttcattttgcatttttttttctccaattcgttggggaagacattttgattccgaattccaaattatgaaaatccaccaaaagtttggcttttttaaattaataaattgacacaattaattttgtagagaatgaatgagtgatgcattggcagcaacagttctgcttctgctgatggactgggctctcgcacctccttttgaaaattttacaggcttttcccggcttttccaaagcctcgattcacattttactctaaattgatcatatttgctccactttcatcctggcccaatcatgccgtttgatccggatcgctacggatgttggagaaatgtgacgaagccttgctcgtgtccctgttcgaaactgcgtgccatcaaattctgccgagtaaattcaaaattttaattgtcaaagatgcttaattggcattcattttccttttggcatctgtccgtccgttttatcttcgcttttgtttttcagattgagtgcgatttcatggaccgtgaagccaaggagtggggcaatgccggtcgcgtggctgcgggcgttggctcgctcggcctggcgtttattcctattgtcggcccatttcttgcagtcggcgcaattgctgctcaagcaaaaaattggggcgaaggtggatgctgttgcttttatcaataaatttattattaattaggacaattaaaatgttttagagtaatcaatgcaaaaagaagcgaaacttagcatcccaacttattttcagacatgactcacaccgcgctggaagtacacttcaaatgcgagcagtgtggccaaattgcgtacaaaacttatgaaattttgcgcgaaaatatcacgagcaaccgatggggacgctacacgaacacttatgggggcgagcaaatctgtggaattgacaccacggcatttgatgaaattgagcaagtgttccgtggcatgcccaaggcgtacaacttcgcctacaacaattgcaaggattggacgagcgaaatgaccagacgtctttaggaggggaagcgattagataaagtgatcggagacaatttaggctaatttacttatatatccatattgatttgttaagtcgaagtttgtattggtaaagtattgtatgatgttaaaataggcaaaatatcaatcagtgaaatttaaaaatttaatcatgagattttagtagctagagacagaccgttaaacaaaaattgggggagtccaaaattttgtagaaccgtaatcccgaaaaatttacgcgggaggcctgctcttgaaaattcttaaattctcagctaaacctcttcgaaattggtttaaaaagacaccaaaaatgtcaaggtcaactacttccttaatgaatcaattttttgcatttctttcattttaaaaattaatgagaatttataaattttaaaaaataattaaaaaattagcattaaattatacaatacttttcctattttattattaaaattcatatttgaccgtctaactctttaattttatgcctattctgttctgttgtttttgttcatttaaaccacaataaacaatttgaagaaaagaaaaaactaatttgacagtaaccatgttacggttggtacagtaagcattgctcttttcccttacccttttgctgttgatctcccatttcaatttttcattaaaataagttatgcgttttgccccgataattctttagaaaaattaaaagaaatttcgagcaaatgctgatattttcagctaaagaaattggtttaaaaaaatacatcataaatggtacggccctatttccaaaaaactttttgtcgcagcaataagtcgtaaaaaattcgttcgcatgggtttatggtcggtgaatacaaaaattcggacttctatttcgactaatttcaagtcctcaaaattaaattttcggcttgttcgagttcggtcagggattggttcaaattgatgtcaactttcgtgatcagaaatctgaaaaacaacgaattattcacgacttaatatgacacaaatttttgcaaaccacaggggggccggcccatggttttttaaaagtgcctaaaatttgctaacctttttattttcgtcaacaaataatccagaccctgtcccaattttcgatttagagcgacttaaaaacatagaaacacttattttggcattttggcaaataaaaacatatcgcacatatttcggggtttggcacatatttcgcatatattttggcatttttgagaaaaatttgtatgaaaaatacaagaaaattgaaaaatacacccctaaaacaagtttttgtcattttttaaaaagtctcgggaacataaaaatacaagaataacacaaaaactgacattaagacgaaaaatgacaaatttttcgattattttcatgaaaaaacttttagtctattgcctttagttcagaataatagaaaaacttctatagattttaagcttttcttatttacacccctaaaggctgaaaattatgtcaccatttgtcactatttcggacttttggtcactcttttggcattttcctcactactttcgtttttatataatttttttaagaaaaaatcgttgcaaactgatcttaataaacccaaatttttgcaaacgaagagggtccgtccggcccatggtttttttaaaagtgcctaaaatttgataatatttttattttgttttagaagtaaatgaaaagaaagaattttattaagcccggcaattctctaagaaaactcttgactttaaggaaacagatttcgcagacaaagaattgtagaagaaacttaattttcaaaaatccagtcaggtcctctgaaaaagaacgaatttgacaaaatgctccaaaaagagctcacattaaaagtaaggaattttataaactaaaatattaaataattgatttttctcatttttctttaaaaattttgaaaataagtgatttcgattaatgttgattattgcttaaatggatgaatttttaaaaatttttttggttatcttatatttaaaaaaacgcccttattttactataattttttgcacttgaaaacaaataataaagttaattatttagtaaaaaaaattgctcgttcgtcgtccattcttcgtgaaaatgctccaaataagcaccacatctgaccacgtctagtggaaaatgccagtgataacattgccggcggagttggctttgtatatggccgattgggaccactgctgccaaaaatgccatcgcttcgacacccataactagggctgctaattttatgtaaatacatattttttcctggattctccatagcctaattagtaggaaaaacactttcttttttgtgtttgcgaacaaaaatcgggacttttatttacatatttttacatatttcggagtttttctacatattacatatgtacatatttttatacatattttggactttttcgcattttttgtacatattttgcaatttttgaagattttttaaggaaaatttttagattccccaaaaaaattgcaatttttcgtacacattttcattttttttcatattttgagaattcataaaattttttgtgaaaaaaaaaaaatttgaaaatgcatccctaaaaa

SEQ ID NO: 4107 - DNA, 1165 bp, Heterodera glycines
catcatttgaatattttttataaataacaatttcacacattctgatagtttatagagaaatagtttataaacaactttatagattgataatttacatcataaaaggaaaaacagtttgaagcaatgggccaacgacaggatgctcgggttgtggaacgtttggactaattgcgttgtttgtgagctgcccgatgtggtgaagctggtgatcgctgtaggtattgtcgcgtcaattttgcgcagtccacgagtgtgaagaaacaagatggagcggtacgtagcatatgatcgtaatgccggcaatttctttttgatgctctccaggcaatcgggcagcgacagaacttgttcataacactcattcctagaaagaattaaattagctaggtttactttgactcccaccccgaaatttccactagaaattttatttaaaaaattatggacggttgaaaattaattgactgaactcaagagtttaatttaaggaaaatctaaaataattccgtttaatctaacaagcaattcatcgtattctaaaaaatttattcgatcagattaatgtaattaacttttgaccagggtcaaaaagagataatcgaaattttttagggttttcactcaattctgagttgccttcaacttgctttttggccatatagtttttaccctcaatacctcatgatttcctgaattttatttgcgtttccatagacatatcgataagcacggtacgctctttcctgttgcatgtgctcataacgtgaaattaacaaattaaaaggcatggactcattctgcacgttaatacacaggaacgattcgcactcggggtaataccaatttggccccgtccacgttggtgacagaacaacattgtgaaagacgctgaacatagatgaattaaattggggaagacggaggccgaaaagctacaaaagcaccaggaaaattgaaaatttgggttcaatttgtaaatagtttttgagtgcaaatggtctactgtcgctttcttaaaagttaaagagaatttgggcctacggtgccaaaaaaagaacaaattacttgtaagggccgcgtttgtccaaagcaaattttattgctctcgatgtgtttgtgtcaattccccggcttttgcagttcttcgtatgccttttgcgcataa

SEQ ID NO: 4108 - DNA, 2480 bp, Heterodera glycines
  misc_feature (2444)..(2444): n is a, c, g, or t
ggtgtccaatctccttttagctgctaggggccgttctaatagaggtttttggaagattgccaaaatatgggtataaaatatggacataatgccaaaatatggaaatatggacataaaaacgaaatatggaaaatatggatatagaaacacgtcctagaggcttcaaactaagctaaaaacatgtttttcgtgcgtttcaggcctccaacagtccaggaaaaaattatatttccatataattacaaaccctaataattacccaagaaaatgaaggtgatggcatttttggtgaaaattgaaaaagtgaacaacgtttattgatgagtatttatcatgacaccaaattgtgaaaaatataaatataaggaaaaaaactccgatggacaatgccaagggtggagcgtctgcagaaaaatcccgcggtcgcggaccgccatttaaaagcaaaaaattttctaatttttctttgctaaggagttccggccatgtaagcctatgacttttttttttgcttttcttatcattctgcgcgcttttttcaaaaaaaaaacttttgggcggcggagtcattatttaagaaatcatcaatatgatttgattaaaaattatttataacttagctcaaaagcaagcaaatttttaatttttgatattattcgtagcccttagtgttctctataaatctaaaaaattaaaaaaaatttcgctaagtttcaaaaaagttatggctagaggaactcaaaaaccttgtttgtcgagcatttttcgagcatctttggccctaactcttttgaaacttgatgaattttttttgaaattttgtagactgatagagaacacttagggctatcgaatgataccaagaattaaaaatttggttgcttttgagcaaagttataaataatttaaattgatatttagtgatttaagtaaaaaagaacttagacgcatttatggagaaaaatgagaaattttaaaagaatttaagaaaattttgcatatttttcagctatttaaagactattcaaaaatacgaaaaatattgaaaaaatattgcaaataattcaaaaaatatattggtatgcgattaacaaaaatattctattgcgacattaaaataaataattgcttcaattgacctaaaattattatgaaagtcatttttattaataagttttattatttaattacttccaaatttgtttctaatattttacttgatggaattaaaagcaataaatgttaattttttctaattttttagaggcgttttcacaaaaaataccaccgatctctccagtcgccctgatcattttgcacagcgatcggaatgcatcaaattgttcagccaaatccttggccataatccgctggtgatcactgaataccgcgccgattcactgttatataagcaaaaagcggagcagggcgaaggggtggaaaattcaaaaaaatgcttcaaaaacgaataaataaattccacttttatttatttatttatttattattctgatgttgttttgtttcctttattcagtgtgaggctttttcaacctgttgtcgttaatttaataatatcaatttatttattgaaaaaaaattttaattgctgggtgacataattttgcctaattacttttggttaccaaagccccctataaaaggcgaacatttcaatgcaaaacagcaaatgttcattcatttatatgcactgatgaaatttatttccaatttttcattttaatataaataaattaatttcaattttttataatatatattcgataacagaaagcattttctttattttgaaaaaatgtcatcatcgagcggatccccagattcttttttccgttcagaaattaatcaaggtaataaatatatagaaaaaaattcaaaaaagaattacgaaaaatagaaatgattaaattttattgaaaaataaaatactaatttaaattttatcaccaccagcagaagcagaagaagtgggcaaatatgaagtgttaagttggcacggactttggggtgatcaattgtcagctgaattgttcgtcactgatcagcagctgctgaaggtgagccatctcaaaacgtacaaagagaggtcgcccggttccatgccggacttacggaatgtgccaaaaaccgaaaacaattttgcaaaatttagttcaacatttcaaattcgtttaaagttttttaaattaagcaataacataaaattaataggagaaagtgccggccgtttcatagcgcaatttttgatggcattttgccaaaaacctttcaataaacggacataaaatttaaaaacttccaaattcttaattaacatttagctgaccgtttaacaaatgcaattaaatttcagtttttgttggtcaattggagacatttttggtaggggaaaagcagcagaaggaaaatgttggtcaacagcnagaaaaggaaaacgttcaacagaaattggatgaaaa

SEQ ID NO: 4109 - DNA, 8444 bp, Heterodera glycines
ccctttcgatactattgatcaaattcattagcagccagcgccgctgattgacccgaaatgataatggcacaaatcaagagtcctgatgatttttaatgttcttatgacacttcatcaagtgccagatttgaatggaaatgcaggagcgtactaagtcaatgcgttcttccatcaattagactcaatcagtgaggattgacctaacaaaaagcgtttaagcgcatttaaatcaaaatgctcgggtagagcagagcacgcatacatttctgcagttgtcatcaacccatttcggtatgaaaatatcagaaaggccattaagcagatactcgattctatagatgcgaagtcgtctgatgactgggtttgcagaaggaacggccataccattgatgacatgccggaccgagtttcataggtgtgaagactttacacgggctcagatatgtcctatgtattacgattaatagatttgactcgttatatacgcgtttattgccatcttgggcccatgtcatccggcagtcagcgtctatggtgtaagtctcatagccagcacatgtccaattctccgtttcatcaattgtaagaactgtttaaataataacaatgccaggtttccatataaacattttttcattttcaagcacatagaaatttttgagcacaagggttgttaaatttattaaattttaatgatttatataacattttatatatttatgttgttttatttttttgaaatccctccctctggtgcccaaacttcccggtgcccaaacttcatgtcgccgtttctttggccactcgacagatctttttgacgaaaaatggccgacgaattggtgggccaaacaaaattaaaaaaagcaaataatttaaatttccatttgtcagatgacactcttttttcactacaactcccgtcaattctctgtttccatgcgtttctttgtggactggcgacaaaattgaggccaattttgggccaagtttcaaatttaatttggctactctttgaagaaagtcgaagaaacaacggaaaagggcgattaatcattcattaattaattctttttttcattgttttatttttaatttcactttattttcaattttttatcttattttgtcatgcgtatttgttaacgaatattaatttactgttttattttgctaatttatttattatttgttttcctttttcgtgtaaagatttacttaaaagggaccacagaagcaaatattgaagctgaagaaatagcaatttcaagaaattccccaaaaggtttttaacaaaatacaaagtcgtaggaatatgaaattaaatttaagacaaaataatttcattttcttacaaaataaaaataaaaaaagcttacaacaccttcgattccaaggacgtctccgttccaagtactaagaaggcccaattagaaaaacctcccaatttcaaaatttggttaagaaaaataggctttgctggtgcttttaagaaagtcacatccaccattttcgtgattaaagtcgttcatttgagatgccaatttccattttattgtattccgtttagaaatctaaaaaaccatttcggcacaaaatgccaaaaagggcaaaatggcgatataaagtcaaactaatgttctaaccaaattaaaaatgctttttcaacgttatctcggaaaatcaagagcgaatgaaattcttttcacctgaaggtaataggagaaaaatgaagggcataaattgaaaaatttaatgaattttttaagaaaattaaaattataaagtttagcctaactttttataactgctcttttgaattcaaaatgattctcttaagcctatgcccaacgttgcttcacagatcgtcggacggcattttaccctaattttaaaggtaataaataaactcgtaaaaaccatagaaaaacaatcgctcgctctattatagtttttcttttattaaagctcaaagtttgattaattgcatgagtaaaacattcgaattttgaaagttagcgattctaattaagaatttttgaaaattcacgcccacttaaaaattgtccatctcatttttcgttgttcaactttttaagccctaatcgtagcattatgctttacttttttcacaacttggattaaaaatggtttctcacacattttttagcttatcattttgctcaacaacaaaagtcaaaaaaatggattaattatttatttgaaagagagtaggtaattaattgattgttatatgacacaattttgcctaattacttttgtctacaatgccgccactctataaaaggcgaacagattcagcgcaaaacagcaaatgttcattcatttatttggcactgatgaattttattttccaaacttaaaattcaataaaatttaaaatttttaaaaaattttgaaacattgcacaataccttttctttagtttgaaacaatgtcatcatccaacgcttcgccagatgcatttttccgttcagaaactgatcagtagggctcgaaattgtatggattaacatattttttctgcgcatatgctatgaagaaaggggctcaaaaatagcatttctgcgttaaaattttttgatttggtgaaggtttttagtccatataaatccatattttgggggttttcgagaataaatccatatttcgccatttttgcctttttagtccatatttggccatttttgagctttttagtccatatttcgggcctttttagtccatattttatgtccatatttgacgttttttagtccatataatttcgagccctactgatcaggataatagaaaaatttaaaaaaaaatttgaaaaatataaaataattatatttttattgaacaataaaatactaatcaaatttatcaccaccatcagaagcagaagaagtgagcaaatatgaaaaatgagcccattattaaaaaaaatttctttacattttaaaaatcgattattattagagaccggacttttagttacgaaaatttctcaaacaggcacctaaaatatgtaggcacgaaaaatgtgaaaaaaaggcataaaaaatgaacaaaacgttaaaaaaggcacgaaaaattggaaaaaggcagcaaaatcaacatttttctagcaaaacattttccaaaagataccttttttttgctcttcgggcctaacttttttttcttctcctgtgttattcaactatttcagaaccggagaaaagggaataaatttttggtcttcaaatttcaaaaaccaaggtataactgtgagtccgctgtgccgataggcgccgctaggaaaagtttttaagaaattataagaaatatgatgagaaaaattgcaaacaattaaaaaagtttccatttattttaaacaaacggcaaaaaaagtaccaaaattacgtgcccggcataaggcaccaaaatcgcaagaaaaggcaccaaaaagttctagctaaagctttaaacctagttaaaaactcgtttttcgtccatattaggccgtagcaagctagcaaaaagaaaggcatatgcctcaaaatcctgcttctaattattatggatttgttcggatgagttttgcatcgaaaattagaaaatctatttaaaaattaaaatgtataaatatattttcaaaaaaaataaagccggctttaaacaattaattcatcagcatattccatcacttcctcttactcaacttcatcatcttccatttcttctgcttccccttccttagtttcttcctcgtccgtttcatcatcatcctcatctcccccttcctcagtttcttcctcgtccgtttcatcatcatcctcatactcctcatcttctacctcatcttcttccatctgttgtccctgttgttgtccctcgtgctgttgtccctgctgtccatcttcctgctgatcaggttcctcatcattttcatcctcttccgcatccgcatcataacgcagcacatcatcgccttccttgtctccgcttttttcggacattggcaacgtgttcataacacttaacatgaaataataaggtctttttaggctctatttctgttaacgcgtacagtcagtgatcaacatgtttcttaaaccgtaacttttttctcgtggtcaatttatgcattcttggtattttcgaaagcttgaagtctacagaagttttgtctagcaaaaatctgggataaaggtaacagacaaaaaatttcttgaatatacgcgaaaaattatggatttcggttttcgctgtattttatttgctcttttcttgtatttctaaattccctaaacataaagctttcgaagaaatagcaagaatgtttggattggcaagtaaaaaaaaattatggcaaaatttgtagtgtttcagaaaatttcaaaaaattcgttttctacacattttttctattggatgcttctaaaataagttatggtgcattaaaattcctgtattttttactcacaatttttttgttgtgtttttttaaattatatatttgaaataaacttacccaaaaacatcagttctgtccatcgttcttttgatgaacaactttttaatcagctgaaaaaataaccaaattagtttggaattttatagctctttgataagcatataccgttgcatttttttgtaacatttttatagggttgtccaatgaaaccatcattaagccatataccggttaatcccaaattacattttacttgtgtaccacaccccattttcgggtggtatatgttaaaccagtttttgaatctcgctttttagagcacagaaaaatctgaaaaaaattcatgtgaacgtaacattgatgtttatcaaaagtgtttttcatattaacttgatcagaccagttcttcatggtgatagggacaccctaaaaaacactgaaaatctgggaaatttttgaaaaaaattcctatagggatgggaattttttaaaattttgagtaggcccattggagtgagcacaaaattctcaataatatgcaactgatttctagtcgttacgacttatacccgttgaggtatgagcactttgataagggtgttgatcatttcggcaatacagtactttttgtggacatcgaaattgaaatgcctatacctcagcaggtataagttgcaacgactttcggtctttttcatattgtagattttcagatggacataatgatttttgcaaaaaaaatttcccaaccctattgagttaaagcaaataaaacctttggttataatcatatgaccacccgaaaatggggtataattggttcttgccggtaccacttccaatcacgaatgttttcgtcaatgagtgatatcattaaaaagcccacaaaaaatgcttcaaaaattctaccttttaaccgattgaaatttcaaaaattaaagatttttaaatatatgaccatgactctatttttcattttttttttgttgataaattgggttaaaaatatataatgaaaatgaaaaaatttaccgtctccatcttattcttcaacggttccagcagccgctgcacttcgtttctcgcttccaacaagacctgatcccgtgttgatccgatgatcagggcaatcttttttaaaatagaataattcatttatgataaacaatttttaaattattaataaatgctttttatgtcattttttcgatttacttttcgagccatttttcgggctttaatcaaatccgagccggtgtggccgagcgactcatcaaaaaaaaggagttcagctcgttcgcctcccagcaggcacatgagtcgagcacgaagctcattcaaagtgagtgtgccgggccattcggaagtcgtttcagcgtcatagtcatcccctgaggggatgacagtgaccttaaaaaaattcactatttaaagaaaaaattttgtttcaaaatttttacctcaacaaatacgccagcgtatcgcagataccagtaacagaatatgtgcccacactcgtgtatgccctttttcatcttaaaaatcgattaaacggactctaattgaataaactaacgcaaatttttaagcacacacactaaaatagaacgctactgtatagtttttgtaggcaaacttctcacttttttcaagataaggacgaaggaaacacaaaagaacatgaaaatcagcttaaacaatattttattagcgtaaaaattgaataatttcttttgtttctgctcatcaaaaaaattacaaaaattgcaaaattttgactgttctttaaggcattttgggtaattagactatttgttaacagattttcatcaaaactgacaaatttttacgagtttgaaccaatttttgaaagaaaaaataacatttagaatcaatccaaaagaggcaattttcgcactttgcatatcaaactgcttacaattagcattcgcataaaaaagaaagattcctctttaaaaaatgttattaaatcaaatttgttcttttttgaattatcgcgttaaatttatgccaactatgctatttggcgttatgagcaatttttgtctgacactgggcttgacccgtcgtgttggttcatcgctctttttccggacgccatgtaaatccaaattgaacagaaaatattgtttgtatcaaattgcttttcacaatgctttacaatttcatttctttacaatactttaaatttgtttacataaaaaatcagggtaaaatttgtggggagcttctcacgtctctctttatttaattataagtattatttaaaaaaacgggtggaaatgccgaacttcaactgcctggagcggcccctctcccaactgttctaccggtacgggtgcttcatcacgcgcactccgttcccgctggtggtcaccccgctgctgatcaccattttctccgtatggggcttcatgtcactgaattccatcacaggcaatagcaaaattcgttttttaaataaaaaaataaaatcccatcgcttttcattaatcagtaatttgagaggcatccggtttttttttaattttttcttatttggttttcttaattttttaccgctatggttttgatttgttttgccagaaaaccttggtgaagcttaaaacctttaagcatagacaatggcgggcaatggcaattgaaaatttagttttatgatccctaaaaaatccaatttctccccaatttttatgcattttaaattctattgaaaaaaactttcgttcgactcaattttcttaatttttttccatctcaatatttacttcctcttttaagacgccatttatttgttcacgccgcagaacgcgccctccaaaatggagcgccaggtcatccacgacctgtggccgttggtcaacggcagttacatcccgggccgggccgtcacacagtcgcgggaagtccaggttgttgtcggatgagggcagatggcttatcatgatgcttttgattaggggtggcgtgggatgctatgggttacctaccactcggggggcggggggaatgattttggtagttcgatttaccattagatattggacacacaaaaatggtggcggactttttaagacgcggaccgcgaaaaagtgacgcgcaaacgcgtcccgcccctggccaattgtgcgtgtgtccaaaattggtccaaattcacaaattgggttaaatcccgaatttaactcatttcctggctcactttttcataaatttccgtttcatagatcactgtaagtgcgcgtgagcgaggcgcaaacatccttgaaaagccctactccgaggcggtgcatgtgttggacgaaatcatacaggttttttgttgcaattttgggcggtggagtggtcctagtcaactcctttcataattgtaagaaagaaaataacgaaacaaatttcgcgtaatttccaaatttttcccattttcccggcagcgcctgtgtctgggcgcagccaattcaatttggcgccagcccagttcaagcgttcactattgtttataaaatttcgagagattttaaacaaaaaaagttattgccaaatattctataaaattagatttttgaagcaaatttattaaaattttgcaggattatagacaacattcggataaaactattgaatgatatcaaattgattcaaattagtacaactctgaaggagttctacacaaaaaaagaaagccgggttggtgccacacgtaaccggaaacggaatttgactccatgtgcttatacaattttacacagaaattgacaattttgtgcatcttttcgttgtccggaattgtttgaaaaagcacatttcaaaaaagcggagcaaaaccacaaaaatataagcagattgaaaatgggatccctcgttcccttcattttatcagcgaattttttcgccccccccccctccccgaaaaatgaaaaaaaaaaatttaattttccaaaaaaaaaaaacactaggaaat

SEQ ID NO: 4110 - DNA, 4316 bp, Heterodera glycines
ctgtgcctgccgggccgccgcggtgctgccaacgcgtcgccttccgctaccggacgtagtccgctcctgttcatgattttttaatacattaaatatttaaaagtttcgttttgaataaggggacaatttaaaccaaaatttttacaaagaaaaaatgattaatttaaaaaaaaatttttaatgtggatgctttgtctggaacatgatcagcagaagcgaaattcttgagaaaaaacaaaaaaaaatctatttggtaaaaaatttttataaaatattcaaaaatatgcatcataacacctgttttaagcgaggaaattaaaatttttattttaaatatcaatttttgtacaatttatttcataaataaaatatttacaaaaatgtttttaaccatttttaaatcaattttttataaaaatattttgtaaaaaagaaaatacagtaaaaacaaaaatactccgttaaaaattgatttcaaaaaaaaaattcaaaaaatccattcctagttgttttacaaatatgcctctctcgtattttcaaaaatattcccaatgttttgcaccttcaatgcgcaagccgctgctgccgcctgtgccgccgaccgatccgccgccgcgccgctgtcgtcacaccgtcgccttccaccaccggacgcagttcgcactcgccgctcgtcctcactttgggccgtcttaaaaaaacaaaaattaaactcaaaaatagaaaatattaaatttttgggcaaaagtaaagaattgtggtcccaaaattgagttttcttgggctcaacaatcagtttctgtgggttttcgagggtattgatcacgaatctttggcgcaaaacttaaattcgaagttttaccggaattgggtaaatccgtgtttagaaacatatcaacacccttcggaaactgattttgagcccaaaaaattaaatttgggaccacaattctttcccattgacaaattttgcagatcaaatttcatttcttttttatttataaataaggtaatcaataataaaaaatattgaagcatatccaataatttaaatttttttttaccaaatttgccatcctttttgtcaccaccgccatgttctgtcgctcctcctcgttgttgtccacctcgtctgttgcctcttcgcccgcagcgcaagccgctgctgccgcctgtgccgaccgatccgccgctgtgctgccaacgcgtcgccgccttccgctactggacgcggtccgctcctgttcatgattttttatacattaaatatttaaaaattgaatcattttaaaatagataaaattaaaattttattttttgaacatattttcaaaacttttttgagcaaacatttaattaattttttctaacaagggaacatttcttacagtaaatattcaaatcacgtttaaaccacttttattttgtggagatagatggtattctatcataaattctcgacctttttttggccctcaccaaaaaactgatcagaaaaaagtgatcaaagtttcaaaaatccaaaaaaagaattaattaaaaaatcaaaaaaagctcattttttaaatatttggtcaattttttcggattaatttgagtcaagacaatatgtatatttttatacgacatgacccacctcttctggttcaggtgatgccgccgaaaagtcaatggtggtgcgaatcgatggccggcggacgggggagtgtgttgcaccactattcgaaataattccaatcaaattaaaaagaaaatttgtgaaacacaaatttagcactgattttttggcaccattccaaaattcggtgcaaaatttagtaaattgaaattttagtcacataaaaagaaaattagtgaaatgcaaaaatttggcaacgattttttggcaccatcccaaaattcggtgcaaaattttctgctggcagctgttttttggctcaccgtcgttcagccttgtcgtcagcaacgactggtgggacaggcggatgttgttcagcaggaataaccggctcatccgcacccgactgatcaaactgtagttgttttaataaatgaaaataaataatggcgaattatttttattttttgaaattatatcaattatttaaaatattaatttaataattttttaattagcagatttaaaaacaatatttatgtgaaaatagatttaataaaataataatttttatttttaattaaaaaagcatttctcaccgaatttgttttaaaataatctcaattctttataacattaaaattttgcagaccaaatttcattttttatttaaagacatcccaatgaataaattaaaagtttgcagaacaatttcatttttttattttaaacaatgtaatcaattttattttatacaaattttgtatataaaaaaagtttaactattagttaaaaaattgtattaaattttttcgtcctgctgaagacgaaaaacccaatatttttgataatctttttaccaaaagccatcatatttgaaaaaaaagacaaaaaataaaataaaaaacaaaattttgcccataggaataaactttttaaaataggtaatataaaagtctcgtagacaacccaacccaagcggaaaaccctttattttttgcagtcactcacctctccagtgaagtcaattgtcggcgcagggttgtcatgccaatccctattaaacataacgaaattaattcttaaaaatgttaaaattattaaaaattttttgttttaattaaattatttacttacaacatgtgttttgccgttgacctttttatatccgcggcgtagtcacaataaaggctgaattgtcttattaacaaaagaagaattttacatttttttaccattcaaattccttctttgatccgtgcatcggttggtgtcttgtgtacgcgatgacatgtgtaaaattcgccggacatctcttacagaagaatttggccttgaattaaattggtaagttttcaagaaaaagtcaagaaaaaatgttataaaaattttctagaggatatgtttttttcaaaaaatagaaaaatctctaaaaatgaataaaaattagtcacaaatcattaatacaccaaaaatagtcattctgtacggattctaacataaaagtaaattttaaaaattgctttttgttcgaattcgggtccggcttttggaatcggtcaaaattaatgttagattcatattcagcgcataaaattaccctagaaaaaataatttaaaaaaaaatttcaggggggtgacaaaaaggataagaaccaaaaattcattcaacaaaattttatatgcttatcaaaaaccgttaacagcaacttgaccagatcactccttcatactgatcgggataccctaaaataaactgaaaatcagggaaattttcgaaaaaaatttctaggggttggaaatttttctttgggaaatttgagtaggcccattggagaggacaaatttactaccgatttggcttttgaatggtaggtctacgatagagaccggacaactggggtcggagggatcccgagtcgggatcccgactgaatcccgatcctgatcaatcccgaacattttggaaaaacgaccgggacggatcccgagtcgggatcccgaccgaatcacgatcccgatgaatcccgaagattttttcgggatcccgcgggattatcgggatttgctaaaacccaattttttttcaagttttgtgataggttttgttcaaatgcttatctaatatatttataattgatcaattcgattataaaaatatggatggtaattatatcagctttttatagaattttgttttccaaaattagagaatatcatgcctaaaaagtcagactttaaggtcaagaattagaacatttaacaacatagctttaattttttttttttataatttaatcaattaaggtcaatttttgtattttcgcctcctattatttttagtaattttaaggaaattgtaaactgcatcgggaccaaaaatcagatttttaagattttttttgctgcaaattttttcaaaaactttaggggaacctgggggggaggttggcggtgccgataggcgccgccgggaaaattttgaaatttgaaatgtaatttgttaacagaatttatacaaaaattgtccatattttgtgattttaactaatttataagaataaaatgggttcatgggtcgggcggtaccgataggcatagaaggaaaaatacgcagacagcaatttttattctgattattggacagaattcttagaaatgttgtgtcataatactacctaaaaagatttcgaataat

SEQ ID NO: 4111 - DNA, 3488 bp, Heterodera glycines
ctcgactccgtcccgccaactccgtcccagccaagtttaagaagccataaatttttttttcagtttaccatatccaacaatcttgatatcattcgaaggctctatatgttttgaagacattgaatctacttctaagtgataaatagggagtccaattaaaaacatgtttttcgtgcatttcaggctacggggagctcaggaaaaaaataggtaaaaacctaaaaatatcatccctagtaattaggatgtcccgaacactatgaaggagtgctgtaaaagacttttttgatgaacacaattttaaatatttcagttaaaaatattttatttaatttttttggttttccccattgcattagaaatcgcaaaaattcaaaagtaaaaaaattttcaccggcgccacattcactatcggaattgagggcagaagcttgtcacggcggcagagagcagacgaggccgagcgggacctttgcgtttccatttcattgtgccattttaccaacgtgtcgtcctcgcacttaaattcgggaaaaaatatttaatatttgttgtaaaatgcaattttttaacatttttaaattttttgttgaaaactcattttgtcatttgtagagaccgacttttgaggcatatgccttttttatctgcgaattagtttcgatatattaagcataaacaatgcattttccacttgatttgtggcttctacgttgacttttattatgcctttttttttcctttttcgtgattttcgtgccttaaattccttttttgacattttgccgttttggtgcctttttggcgttttttttcgaaaaaatccattaaagatgcaataaaatcgggaaaatacacccctaagaaataatctgaaaaaattttcagaaaataaactccctaagaacttaaaaattttctcaaaaattgatcgccaaaatttcatttttttcttggtaaaaaattataggtttaaaaattttgcttaagaaaaatattataaaatatttaataatcatttaaatgaccaaaataaagttatttggttattttttaggtgttttgctccataaaaacttaaaaaaatttaagtgccttttttcatgcctttttcaggattttcgtgccttttttcaattttttggtacctattatagtgctttttgtgatttttggtacctttttagtcggtctctagtcattaggtaaaagaaaggccaaaattttttaaacaaaaataatttttctcttttaataaatataagttttcaaagaattcttatattttttacaatcctcatgagaattttggagaattttacttaaaatcgcttgaaaatttgaacatttttctaccgttaattaaaaaaaattctttaagtaatttgttaaatcctcataaaatttattaattacttaaaaaaaatttacctcccagaaaaggtggcccgtacttctgtgtgcgtattcttttctccatttggcccttttttggtcacgctaatcatcaaaaaaaaaatttaaatttttttttcaaattaaaaaaagcaattaaattaaaatttaattataatacccacattcggtgtcatgttggccataggcttttaatgattgaacacagcaaatattgtagaataaataaaagctaaaaaaataaattttaatataaatttaacaagcttcaaattattcaattatatataataaaataagtaaaaaatacaaaaaaagggggggggagcgtgtaattgatgagtgcccttttcaattgcttgggaaacattttcctaatcgattctactaatagggaaggaaaagaaaggaaaggaaaggatagttgtgcattaattatatatttaaaaacattagctatcaaaaaaatattttaggaaaatattaaaaaatacctatatttcttttaattcctcaattcattcccccggtaaagacttccaggtttaaaaattattgaaaataaattccaagaggttttcgaggtcacttgatcacataccgtattttctctaattaaggccctgtctccattaaaggccctgtctccaattatgtccccctttctgaggatgttgaaaaataatcgccccgtctctatttatccccccgggggataaatggaattattattattttttaaatcttatttttaataaaaattaattttaatgaattctaaattgaaattcatttaaatgtttaataaacatgaaaaaataatacagaaaaatcacttactttactcaagtccgaatctaacccaccccggtgctatgtgttttcaatttttgaaatttaattattaatccctaggggtcttatgagacgggggtctggggttcgagtccgcttggctgcggtttatttttttaggtacttgtacagtttacaccagagttgccgcgggttacccgaaacccgacatttttctcgacccgaaacccgacccgatattttttctcgactcgcggcaaccctggtttacaccccataaaaattttctgaaagggcgctaaaaatatgcatacatttaaaaattcataacaagaaaactttttttgcttttattttgaagaaaggagctcaaaaaagcatttctgtattgaaattttcgattctgaagtcactatgcgtcattaaaaatcagactttgtcagcaaaatattaaaaaattttggctttatgtcattattttagagtagagcgggaccgggaccgggccgggaattcccggtcatccgaggtccctgttcccggtcccggattttgaaaagctcaggtcccggtcccggttttgctcaaaattcccagtcccgctctactctacattattttattaactatttcgagatttttcatcactaaaagtcgcggccctagtcattaaaaatctgttgaaaaataatccccccgtctccattaaaggccctgtctccaattatgtccccctttctaaagaggttgaaaaataattcccccggggccttaattagagaaaatacggtatataacattcatttcggttcttttctgttttgtgacccccccccccctgaaattttcaaataaaaagtcatttctagggtaatttggggcgctgattacgaatatgacctttatttttcaaaattccgaatcccgaacccgaattcgaacaaaaattcgaaatttataaattacaaagaaaacacatttctagaggttttctaggtcgctgaaaacgattatgacatccattttggccaaattccaaaacccgaacccggattcaaacaaaaaccgagatttaatttacgacaaaatttaaaagaaaatatccatcatagatctcgactcaaaattgcataaaaacacttttataggttttctgtgtggtgaaaatgcctaaaccatcaaaaaaaactgcgcggcaaaagtgtttaaacaggtttttgaaacggtttaaaattcgaaaatttgagtgaaaaggg

SEQ ID NO: 4112 - DNA, 1352 bp, Heterodera glycines
ttttgttcaaacccgggttcgggttttggaattttgccaaaatggatgtcataatcgttttcagagacccaaaacccctagaaatatgttttccttgtaatttatgaacttcgaatttttgttcgaattcgggttcgggattcggaattttgaaaaataaatgtcatattcgtgatcagcgccccaaattaccctggaaatgactttttatttgaaaatttcagggggagtcacaaaacagaaaagtaccttcatttcaaacaattccgtacccctgatcaaaactcgaacaaaaagtcgaaaaattaaaatttttgaatttcgagtttttgggtcgaaccatattaaaatacataaaaatgaatgttttcaccttaaaactgcaataaaagaaaaagtttgccgctgttttttgctgactccggccacaaaatcacaatcaccgtctgtagaagcttgatcgccaccgcaagatgatgctgttcaggacagattctgcaaaatttacaaaaaatatgacaaaacaaaagaaaaaatcaaaatttttaaaataattttccatagatcgaggaaattcatggaagttggaaaaagatacacatccaaattttttacaaagaaatttttttttctgccagtgctaatattcatgtaatggaaaaataattaaaaaataataaaatttaggagtatagcaaatggaaaaattaaaaaaaagtcccgtgcattctaggagaatcgaactttcatcctattcaatgagaagagactactctaccgactactctattgtgattgttggatgttttaactctcactttcctaatccttgtccataaatttttacagaattaatttcattttatgacaatatgtatacctttttatttgcttagtgatttggattttgaactacaaacgaacaaatcccatggcccggttaagcagcacaaaaaaagaagtaaaatcccgggacggcccagtcgccgggatagacacccggcttagtccggcgctgatattgaagccgatgacatgacaacttgtacaaaggcaactcgtacaaaaggcaatcaactcttacataggcttaaactaggcctaagctttaagcctgcttggtactaggcttaggctttttttgtaaaattattacagtacctttggatctattgcactttatgagcccaagcgacttttatgagtcagaagtattttatgagtccaatcaaataataatacctggtttttatacagcaactttgttcatgtttgaacaaaccctaatttttggtatcattcgaaagaacaaagtctgaacaaggtaatataatactagaaagtaagagaat

SEQ ID NO: 4113 - DNA, 965 bp, Heterodera glycines
ttattaacaattaaaaagttataaaaaaattacaaacatagagattttcaagttaaaaaaagtttaaaaaatttcataggaaaatttgaagaaaaattttttttgaagatttttcaaattttatgaaaatgaatgaacttatttcttacaattagcaataattcataacaaattgggagaaaaattttcaatttcttgaagttttcttataaatatttttttttctaaaactcgcacacctccgttttgctgctgctgctgttccagcacagtggtagtgcgtcgaagcacatcatccgttgtcattgaacatgccattgttgtgggtgtcgtttttgtggaccgtataaaacgttgttgttgttggttttcgtcgcccagccccaaaacctatttttaaaaaatgtaaaaggatttttaaactttttagtttaaatattaaagtagccatccacttaaccattactatgtggatggaaaccatccacatactcaattctatgcagatggtaccatcaacataatcattactatgtggaaggtaaccatccacttaatcattactatgttgatggtaaccatccacataatcaattctatgcagatgttaccatccacataaccgttacatgtggatggtaaccatccacttaatcatacattatttggggatgggtacttatcgaaaacgtactgtcaacgtgtcagacctacctgcaatttgctgatgtgtatagatggaggcggagctaatcatctttttgaagaatccaagcaagaccatggcttgaaatcataggcacgaggccatttttcctatattttgccacgggatcgaaaccttgtgaaaatgatgaacaaggtccgcatgtcctggctcaataccataaccatgaccgcgctattcctggttaatacctggaatgtacatggcctcaaaaatggagcttaccttccatgcactc

SEQ ID NO: 4114 - DNA, 2440 bp, Heterodera glycines
  misc_feature (2372)..(2372): n is a, c, g, or t
  misc_feature (2404)..(2404): n is a, c, g, or t
ccacaatcccccggaggggcaggtccttggcctgtgtaccacaatcccacgaaggggcaggtccttggcctgtgaaccacaatcccccggaggggcaggtccttggccggtgaaccacaatcccccggaggggcaggtccttgaccggtgaaccacaatcccccggaggggcaggtccttggccggtgaaccacaatcccccgaaggggcaggtccttggccggtgaaccacaatcccccggaggggcaggtccttagccggtgaaccacaatcccccggaggggcaggtccttggccggtgaaccacaatcccccgaaggggcaggtccttggccggtgaaccacaatcccccagaggggcaggtccttggccggtgaaccacaatcccccggaggggcaggtccttggccggtgaaccacaatcccccgaaggggcaggtccttggccggtgaaccacaatcacccggaggggcaggtccttagccggtgaaccacaatcccccggaggggcaggtccttggcctgtgaaccacaatcccacgaaggggcaggtccttggcctgtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggagggcaggtccttggccggtgaacaattgcccatcagtcatcaatgctggttgttgtttgttatttctaggataaaaaaatgaaaaaattgccattttgaaaatttttatttttaaaaaaccatcccaataagagtgtttagggggatgggaccatccccataatagtgtttaaggggatgggagccatccccataagagtgtttacggggatgggagccatccccataagagtgtttaaggggatgggaccatccccataagagtgtctaaggggatgggatccgtccccataagagagctaggggataaggggatgggaccatccccataagagtgtctaaagggatgggaccatccccataagagtgtctaaggggatgggatttgtccccataagagcgtttatggtgatgggacccatccccatgagagtttttaagaggatggcatccgtccccattagaattaaattttcatgaaattttttgtcacttataccatttagagtagactcaatagaaccaagcatacttggtgtctttatgtcgatcgcaacgagacgcgtctaaaaacaccaaaaacgctttgttctgttgagtttacactaaatgataagaaaaaatcggtggtaaacaatgtcaaaatttggtgaccaccaatttagcacatattaaataaacaccaatttgacaaaacccaccaaaaatccgcgctttcgtacagaagaaggcaattgttggttgatcaccgcaacaacaaatcctttgaaaatcgaacaccgccagcaacagtagaaacttacaaaataattatatcaaaatcttaaaaaaaataaaagctaattctggccataaaatatggatcaaaaagcgaaatatatagaataaaattgcaagaaatttatataaatataattgattttgtaagttatacacttaaaaagtcagatactgttattaataaagtatttgaataaaaaaaatttagttgaaagccaaccaaaaagcaatacttttcattttttcttacttttgagacagatttaccaactttcattaaaaaaaattagataaacaatgatttcagtaaatgatctgattcttaggggtcaaaagccaaatggttgccgctcgaacaaagtatttttggaaaagcttaatgaagcgatataactaacatatggacataatgcaaaatatggacaatttgaaataggacataaaacgcgtttttctctatttttaaggctttattcctgtaaaattgatcaacccttagatttgttatgaattttcaaatattaggccaaaatcccgagggccaaaaaattgccaaaaaataaagaatttttaaaaaattcaaaaaatcatgaaacgaaaaacaaacatcatattcgtactcagcatatcaaaataccccagaaaaatatttttcacccccattttcgtccgaaaaaaaatttccgaaaatttctagggggcctagctcgaaaatttttgaaaattttacatcatgtagtacaccattcgatagagcttaaaaagctctacaattttgctctaaggccatttttggctaaaaccaactcctgacgangtatgggcccgggactcaaatgtcccgcttangccaaaaatttttctatttccgtgaaaaaatcgaaa

SEQ ID NO: 4115 - DNA, 2009 bp, Heterodera glycines
gagtgtacgctaaatggtgggagtgacagtttaggtggtcacaaattttcatgaaattttttgtcacttataccatttagcgtagactcaatagaaccaagcatacttggtgtctttaggtcgatcgcaacgatacgcgtctaaaaacaccaaaaacgctttgttctgttgagtttacactaaatgataagaaaaaatcggtggtaaacaatgtcaaaattttgtgaccacgaatttagcacatttagtaataaaatttgataaacccaccaaaaattcacgtccttgacgaattcgtacacaagggggtaattgttggtcgatacagcaactccaaacccttttaaaatcgaacaccgccagccaacagtagaaacttacaaaataattatatctaaatataaaaaataataatctcgaaatatggcccagaaaacatagacaaaaagtgaaagatatagacataaaactgcaaaaaatggacataaattttacaattaattttttaagtttgtaaaaacattttaaaaagactgatactgtattaagaattaaagaaaaactaaataactaaaaaaattttgttattgcaaatcaaccaaaaagcgatattttaattttttcttacatttgggagcgctttaccaacaacggaacacacaaaattcattacctacttgacacaaaaatacggaagatttaggatcaaaaatattgttgtttgttattgttagaataaaaaacaaagattcaaaattaggccatccctttagtcaatcttaaagggatggaccatacctttaggccatccctttagtcaatcttaaagggatggatccatccctttagacactgttaaagggatgaagacattatttttaaaatagtaaaaaagacgtatggtcaatcttaaagggattgatccatccctttaggcatccctttagtcaatcttaaagggatggatccatccctttagtcagtggtaaagggatggagacattattattggatccatccctttagtcaatcataaagggatggatccatccctttagtcactggtaaagggatggagacattatttttaaaatagtaaaaaagacgtttagtcaatcttaaagggatggatccatggtaaagggatggagacaatatttttggatccatccctttagtcaatcttaaagggatggatccatccctttagtcactggtaaagggatggagacattatttttaaaatagtaaaaaagacgtttagtcaatcttaaagggatggatccatggtaaagggatggagacaatatttttggatccatccctttagtcaatcttaaagggatggatccatcaatcttaaagggatggatccatccctttagtcactggtaaagggatggagacattattttaaaaataaacctcaaaactcgtggatttttgcatttttttaggaatcttgtctgtgaataaatatattataaattgcaaaaataaatgagcttacaagtcttatcgaaatttttcataattttatcaaaaatatgtgtcatgaaaatctgaagattacgtaagatgtattatgacaaattcttattgtttacatattgctagaataataaaaaaaataaaaattggcattatgaaacttttttagtttctctctttaacacagtctctcgacactctaatagtactgcccccccctcacacaaaatggtagccatccctttagtcaatcttaaagggatggaccatacctttaggccatccctttagtcaatcttaaagggatggaccatacctttaggccatccctttagtcaatcttaaagggatggatccatccctttagacactgctaaagggatggatccaatacgtttaggaggatgggattcgtcactatacgcatggattctgaggccttagcgttatcctaaattaatgctaaccttttggttattttgtccgtcagatttcacgttaattgcagtcttattttt

SEQ ID NO: 4116 - DNA, 1982 bp, Heterodera glycines
ctcgacactctaatagtactgcccccccctcacacaaaatggtagccatccctttagtcaatcttaagatgttgtccatcctcctagcaaacggtatggggatggtggccatccctctagcaaacggtatggggatggtagctatccccatagcaaacggtatggggatggtgtccatcataggattcatcactatacgcagggattctgaggctttcccgaagaggtaaacgaaatctgatttcagattcgtgatcagcgtcctaaataacctctaaagacatatttctggaagtttttgggcgaaaaaatttccccactcgaaaaccatgtgcacccccctatggtcccgaattccaaaatcacttttatttttataactttttactaaaaaatgataaaaacatgaaataaaatttatcaaatagagcaaaaaattgcggatttttgggctatttttattttacaaaatatcttttcagaaccgagtagtgaatttttttctgaaaattcgaaaatttccagaatttctggaataactttttttatattcttgatagaaataccaaataaagggcaaaatttctccgatttttactccattttttaagcctctatacattaaaatagacctgatctaaactgagttatgaattttcaaactttaacccaaaatccagagggcaaaaaaagtgaccgattttcaaaaaaatttaaaaaattccaaaatttcccaaacaaaaaacaaacatcatattcgtgctcagcaccttattttaccccagaaaaatatttttcaccccacttctcgccctaaaaaaaatttttgaaaatttctagggggcctagctcgaaaatttttgaaaattttccgacacatggcacaccattcgatagagcttaaaatgctctacaaaaatgttcaaaggcaatttttggctaaaaccgatccctgacgagttatacgcccgggactcaaatgtcccgctcaggccaaaaattttttctatttccggaaaaaaaccgaaatttttccaaaaatcccaccaatcgatagagctcgaaaaacggttgcttgaaagtggtctccgttttccccggaaaaatcggcaaaaaatcataaaattcaaaaacccaaaaacctcttagggggcctagctcgagaaattttgaaaattttcgaattttttaaatttgaaaaaatcgggcttacaaaactctacaataagtccgctggccaccccccgctcagttcaaacgctaatgagttattcgcccggtactgaagtggacaaagttggtactgaaaagttgccaatttctgcagcccttcctattataggtagaggcctggaattttttttgaaaattagacaacacttcaacttaggttcctaccagcggaaactttttgatttatgtttcggaagaaaagttatgggccccgaactgcacgaaaaaacaggaaatcggtccccggtactcagttggccaccggatcggaaaattcgtatttttcccggatgccccgtctcgagctacccctcggtgcaaaatttcagccttctcgtctgggcaaattatatagtacatgtggcagttttaagtaaataaataataaaattagatgcaacgaaaaactgagctgattacgtaattaattatagctgtagcttagaagataataaacgaaagcgagttgagataataataataataataatttgtaatgaatttcaattacgcaatgagattttaatttaaattaactttttagttccttttatctatcacctttcggtttggcacagctaggggacaatttcaattcagatgatatccaagatatagacgtgttgtaataaatatatgtttcaattatcgcacccaaaaataaatatgaaatgcaataaagggaaaacggaggaggcgcacacggtaaaaaaattaattaattaatggaaaactgatggcataacaaa

SEQ ID NO: 4117 - DNA, 4144 bp, Heterodera glycines
  misc_feature (3863)..(3863): n is a, c, g, or t
  misc_feature (3872)..(3872): n is a, c, g, or t
attttaggtcaaaaatcggtttaataacgcggaaaaaattgaaagccatcatcctcaaataagagatcatccagccggttttgaacaaaaaaaatgctaaattcaaaaattttggacttcagactttttatttgaattcgggtccgaggttcgcaattggctaaaatggatgcatatttcatgattaaagcgacctcgaaaactcaaggaacttgttttatttggaaaaatcgtttttttttaaatatttgtatcattgagacgcattttccgagccgaaaatttttggaaaaatattagaattcttattttagaaagcacgagagcatgctcaacctgaacatatttacaaaaacgcagccaaacacggcaattttagtgctaaaaatccagtgttgttgtcagagattgtgtcagtgatcgatttgttccgaacaatgccgcacttcccaatgttagagccaagtgatcaagtaattaattaattaattatgaattaaaaagccaattaaaaacgaaaaatgattttaacaaaacaaataatgaaagcaatcgaagaaacatataattaattcatggaaatatcaaaagcatttaattatgatcaatagggatgtcaattttatgtatattttttcctggattctccatgctctaattagtaggaaaaacactttcttttttgtgtttgcatataaaaatcgggatttttatttatatattcggggttttatacataatttacatatttagcgattttatatatatttggtatatattttggacttttttctgacctattttcatttttatatatattgatgatttttacggaaattttttggaaaacctcaaaaaatataaaatctctcgtaaatttttcgtagatattttcaatataaaaaattaatttttaaaatattaaaatgtgtttctaagcctatttaggtcattttatgcaatttgtgcctatttcaccctctacaaataatttttttgccaaaaataattatttaaaatttttttttagatattttgatacatattttaggtttttgtacatattttttacatatttatgtacatgttttgaccactttttgcacatgtttttgacatccctaatgtcaatgaatctgatgaatgagaagctgatcaaaaactcaatttatcaataaattattcattttgctaaatatatataataaaaattttaattaattaattttaggcaattcttttgagttttgttgccgttccattaattgatgtgaatgcccgcttttattcatcaaaaatcaactcacagatcgtcacagtgcttccaaacaactcatttagcccattgtacctttattacaataatccgttttatgccggcgataaaacgtaataaaaatttaatatttcggaaaatttttgctaaactttaataattaaattgctaattaattttccatgaatttctcaaactttttttgacattttaaaaataattcattaaacactaataaattttataaatgtttagctaaaaattaataattaaatgtttatttaattttccattaattttctcgatctttttttggcattttaaaaaaaaataatttaagcatccaaacactgtctgattcattgtacgtcaaatcaatgcgaccatttaataaattgcgactttctgacgaagaattccttttggtccgcgcattgatctcatcacattcaggcaataaatcaaattggaacaattttaattttctggaataaaatacggaaaatagcgaggtacttttcggttttaggcttaggcctcaaaatttaaaaaaatcattttaaaccaaaaaggccctatatttttatttcctttcaaaaaatttcaagaaattttgaatttttttataccccccccccccaaaatagcagcgcgcgctaaaatgccttcagctcgccctttgttgaccttttttttataaactttaaggtgtaagtccaaaagcaaaaaaaaaaaccaatagctaaataaacattaaaatattccctcaaaaatcaaaaagaacgaaaaataaattggcataaaatatcaaatttatgctaatttcaattataaagcatttaattgcaaaacttttttaaccaatttttcatccaaattacacaaaaaatgctaaaatttaaattaagaaatctaattataatatatatatatatatatatatatatatatatatatatatataatatatatatatatatatatatatatatatacaatatatattaattatatgttagttcaattttttcagcatttaattgcaaagcttttttaattaatttttcatccaaattacaaatgctaaaatttaaattttgaaaatctaattacaatataataaataaattaaaaatcaattttgtttcaattttttcagcagttaccggtctgtccgctgctggtcgtctcaccctgcagcatttatccgaacattatgccgatctgttgatgcaccttttgcgcatcaaccacggcaacatggcgggcgtacttcgctatgccgaattgatccatctgatcgagtcggtgttctccaccgcgaaacggcaccgtgaatttttcacctatttggccatggtcactgatcagggccgtttccatgccacaatcccgcccattttcatgccgatgattttgcatgggacgatggagaaagaatgaatgagtgatcaaaagccattggcatttgttgtcgcggggatggatctcgtcccacactcagcccgtgttgacgagccataattatgaattcgagaaattaacttataatttttgtatcactttgactaattaattatccattagagtgccggccggcaccatttttgtgcttttcctccatttgtgacaaaaaaaaattctccaaaaattagaaaatatttttattgatgttttttatttttagctttttttttattcctttattgcattactgtatgcgtttttaaaataaaaaaaaatatctgatcaggcgataagtaacccaccaaggaactaatttattggcgaaaaccataaaagaaaattgaataaattatgcgaaacaggccaaaaatgcccatttgtcacaaaagctctcagaaaagtagaaaaaaaatatatacatattatatatatttttttattttttgatcatttattgcattactgtaagttgttatcccacggtgctaccaccactactgtatgcaaatctgatccatcagcaggaacccatcaagcaacaggtttttataggcgaaaatcacaaaagaattaaataatttatgaccaaaagcgacgaaacaatggccagatatgctagaaatttaaaagtatatgaaattttttgaattttttcctttaaaattttttattaataaatttttccttttatattttaatttttcatttttattttaaaaaaataaatagactctcgagaacgaaatttaaattcgtttttgtttattaggtaaacaaattatgccccattaaattcattttaatctcatgacaaacaaatttatctaaaaattacttaaaaattgcataattattataataaatcattattattttatcttattcttgctaattaatattcgcgtgagctgctaaggaattggacaaataaggaacacattttctgtttcctggcatattatgttaagcgaattatacaaattagcacatccattaattagcgtgcccagcgaggacatttttctcatctataatacattgttaatgagctaattaatagaatttggcaaaaactcgggactcactcttaaaacactttcaagaccactaattgacaacnattaacggntcttcttatttatttcaacaaataaataattaaaaagtcaaaaaaattttcaatataattatcgtcacattttgtcatgacttttaaattgccatatgaaaagaaagatgaagtaatttatctcttccgtcctggggcaataaaattattatggttggggccgacgttttttgatgccgaattgaacccaaaaataattctttcttttttttatactatttttcccttttccttccaaccggaaaaggttttttatctttctaaataatttt

SEQ ID NO: 4118 - DNA, 1408 bp, Heterodera glycines
attttcactgggactcatttgtcccagtgctcagatggcattggttcgactttagactttgatcgtcaaaatcttttaaatgataccaaatttgttcggttttggtttatttaaagagtaataaaagccaaatttgctccattttcgagtttttaaccagttcaaaaaccgattttttggcatttccgcaactgctggagacctaattttcgtgcatagctcctcgagacgaatcgaatggcatatcatttgtgccgtttttctggaacgttcgggcgttcactttatttcacccagacagaatattgttaaaatgattctttttgcttttaattggttttgcgaaaggattcatttttttcgtctccttttcatataatcccttgaggggattaacaaaagttgacatgtatttatgatgtcattatgtatgatttaaaacttagcggaagtttatctttaagacaatggaactcaattagtaaaataagctgagaatgatgtcatttaagaaagggaaaacaaaaattgattaaaaaaaatcaaaactaattaatttatgaatattttaatttgttattcatttaatttgcacttttatataggcacagaacgaaaatttgttcggcgcctatttgtctcggggaatgttcagctgcggcgccaaatatgtgggcacattgcaaagactgaaaagaatcattgaggtaaaaaggaggcagaaatgacagaaatttgaaaacaaaatgccaaataaatttaaaatatttaaaatataatttaaaatgttattgaatataaaggaagtgcatgccgactattcggaatgccaaaaatcgatgaagcaaatggacgaggacgagcaaatggcattcggaaaagggcacggcacagagcgatttgcgatgattgacgaactgatcaattgagcccaggggggcaatttgtggcaaaatcacaaaattcgaagcataaccatttgaaaaacattgaaatgatttttcattgtttgtgataaagcgaaacagcaatttgttaataaaatgccaaaatttgtgccaatttattcgctgtccaacaaaaattaattaatttttttcacaattcgtccccataattcgtttttgttttgttcgtcgtttcgccttttttctccatcattttgccctcatcagaaaatgcatctgcgcacttcgcctgcttcggtttggctttgagaaaatgctcaaacactttttgaaggttggcgtggaaaagcaatcggacctaaaaatgaaaaggaattaaaaataaaataaatatgaattagattaaggctaattaattaattttaaaaatatctggcaataagcaaaggttctcgaacctgcacaggtatcttgtgtttggatgaatgtgggagaagaat

SEQ ID NO: 4119 - DNA, 3973 bp, Heterodera glycines
  misc_feature (2096)..(2096): n is a, c, g, or t
  misc_feature (2098)..(2098): n is a, c, g, or t
tccaaatgtcccacttttgtgtctatttgtccccttcccattttctcaccatgcaattcttcgttggcgtgaaattggcactgtatttgttgtccactttctgctgccccgtcgtcttcctcctctattggcacgtgccgtcctcttccctctcctcctcctcttcctcctgccccattttcgtcatcgtcaacgtcggccggtgccatttcttccgcctcacttttttgttgtttttgtcgctgtaaaaccattgcaattgttggccctcgtctcattattttgctgctggaaaatcgttcgttttcatccgccaaagtgcgcacgacggacggcaaaatgaggaggaaaagcgaactgagggggaaaagcgggggaaattaattaaatttagaatagaaatagaaattaaatttaaaaaatgactaacccaaaaaagaatgcattaatgtgagcggaatattggcgcatttcagcagaatgaatgcccaaatttgtgaacgcggcaaatgctcgtaaaatttggcggcgaatggcaaatgaatggcgcggaaagggacaaatgactgaatgaaaatgagagtgacaaaagcaaaacaatcgctggcggcgttctgaaaagcaattaattaaatagataaatgggtggtggtggcaattctcgcgttggcacttaatttattcgccaattgggcaaaaaaagggcaggtgaaatttgatcaaacgggggaaaaatgggacggaagtgggcgaaggagtgcgtcaaaaatgacaaattgacaggcgaatgatttgattaatatgccatcggaaagcaaattaaatttgggcactaaatttaacaaatcaaaaaagggagtgccaatgaaaatgaaatggaaaaaggaaattaggaaaaagagaaaaagcggaagaaaatggcacttttaaatggcgatcagcagcaaatggattaattgaataaaataaaccaatgtgttgctctgtttcttaattgggagcaacgaaatgactaaattgctaagtaaaaatcattttaagtaattgcatttaatttttaaatcttttcctgctccgaattttttttttacaaattccggtccctaagataattaattggtcatttatagaattagtagttggttaatgagatttgtctccatttaaatttgacagtcacaattcgccaaaggaaatgactaattaccgaaggaaattggttctttcatttgtttaaattatgtttacttttttacttttgttaagtctgttttttgttttccattgctttataaaaaatttttggaaatctttcgctccatttcatttttctttgtttggctttatgctttttctttctctttgtttttggatttgaatttgtttaaataatttatcagatgatgtcaaaaattcctctaaccaatatttgttccggcgaattcatcgccattaaacgaaaaaatgcaatttatttgtcattaaatttggtccgaatttctttgagcacgttttcatgtaaaatgacaccataacgaagcaaatttattggcattttttggggtttaaagaaaaaaaaggataaaattggcaaaaatgagcgaactacataaatgacgtttacaattaaattttgaatatttttcactttttattttttattttgcttttttgtttcctctattaattcgccagcagctgaattatgacaaatgatgacttcataattctaagcaaatgatgagtgaattgtggaaacggatgtgctgttaaatgatgtattcagacggaaagccaatgaatgacaaatggcaaatgccaaaatgaaacagacattaaaacggaacataaaaagctctaaagtgccaatgtttttgtagcaaagtcaagactctcgagtgcagattagtggtggaaggactatcatttaaaaggggaggagcactttttattttaggctaatgatgatgaggtaatgaatgggcgcgtggcacccaatgaaatgaatggtcgtccgcctttttgagaaaacggcgatttgtgccgtgttggcccagtgccaaattcagtttcgaaagtggggacaatgggggggngngggggggggggggtttgggcccaccccttccctccattctattgtttttgcccccactcttctgcccgcttgctaattgccttctccttctgctgcgacttttgctgcattttccggcatttaaccgagactctcgacactgtccatttgtttatttttggcacttgacttggcattttttatattgtcgggggcggggcaattggaattcaattggaattcaaagatgacgcggggagcgggaacataaataaattttactacattgaaaatgcattaatcaaatcaaaattcttttgcagagaagaagccaaaaataaatgttctgatctttattcttagcataaaagcaaagcgaatttatttatgattaaatttcaaaaaaaaaatatgaatttatttggcaaagataatccaaatccataaacaaaattaaatatttagaatcctaatgatttcatcagtgaaagattaatagcaatttgagcattttgttagccaaacttattaaagttcggtctaaaaaattatattaatgcaaaataaagcgaatttatttaaaatttaaaaaaagttaaattctttttaaataaaatatttcgacttctttacttttattatataaatgattattgtatgcaatattatcacgaatttgggcattttttagactaacttattaaagttaaatttatattaatgcaaaattaccattatggcgaagaataaatgtcatggcataatctaagactatttggcaatttggaaccacgtaaaaaattattaaattaagaaaaccatacaattataaaaccattaaatttggtccctgctaatgttaattgtttcctccgctttttgtgccccttttccagcatttttcgcttctctaattgatggggggggggttcacttttggcattttttgtgtgttatttttgtgccggaaaacatttaaattgtcatatgcgcaaatttgccgaaattcagaatgatggaatgaatggcgtgggaagtgccagagaggcaatttccatttttgtcaattgaagtcgagcggccggagtaaacaaaaaaaaaagaattgccgggggggagaacgcatgaataaaataaagttgtgacatttaacttaattaagttatgctattttagaatggcaaaacgtgtgaaaatttttgttttctttgttattaaagaaaagaaccgccaaatatggcaaattataacaatgactgatcatgagggctgtggcacaaaaatggcgaaataggcaaaaaaacataagaaaaccaccctaaaatagacaggaaataagcgtaaaatattcaaataactaattaaaatcgaaaagtatgcaattttttcaatttagaacaaattgcacttaaaattaaccaatttttctgttctgttatgatgaattacattcgaaaataaaaaaattatttcaaaatttttttgaaattacaacttatgggggttggttttttaaagtcattattttggtggttgtatttttgaagcgatgcgttaaaattttgacttgccgcttttcctcctacttcgattgcgccgatttttcgtccagtgccattcgcttcgtacaaaggtgaagctgacgctgtacttcagggcaatgacactttcgaacagtcgcgagtggcctgtgccggcgagggtcggctgggcaaatgccgacgacgcatcggcgaccgcggcggatggcatttgttggatgggcgcaaagcgccgcttttggggcgggactgattgggtcagcgcgaaaatggcctcatgtttttggcgccagctgagcgttttgtcaaaaagcaggtctttgatctgccaacgaactgaaattgttgacctgca

SEQ ID NO: 4120 - DNA, 1293 bp, Heterodera glycines
gaacaaagtgctcttgacaccagttgtggcgaatagtgatggtgtttccatgcattataaactgccaacagcgtgcaatgatctcctaataaaaaaagtcaagcggaattcgaattatttcaatgtttttgaaatataaagggcgacgacccaaataatccatcacatcttcgagtacactacgggcccccccccccgccctgcatacctttccgatttttttttaaactcagttttctagtttctgatcttttaaggggttttccactaaaaaatataaaaaaataaattttttctgaaaacatggaatttaattttttgaaattgtaaaaagatgaaaaatttttttaaacgttccactgtctcccaccttcaggttggtggaacttcgatttcttctcatccgctaattcttgcttttctttgggccgatagaaaacattttgcacagaaagcatggaaacaattgtcaaaatgtcgtcagcgcagccaagttcaacagacataatcagcattttagccaacgagggttccaaagggaattcggccatctgtgaattggtgagttagtggtcgatttgctgtaactttttcccacccgtcggccaagcctggtaagcaagccgtcctcgtcaagcgctgacaattggtagagctggtaaagcgccgttatcattgcctcggccggcggcgcatccatgaaatcgaactccaaaagattgttaatgcccatggccttcagttgaagcaaagtactggccaaattagttcgctgtatctctggaaccggcgtgggcaacatttcgtctctgaatgtgcaaaattttccattaaaatattttaattccgaattttgttaaattattgcttcttgcctgtatgctcgttccgtgtacagtctgtaacatttgccgggcccggttcgcccagctcgtccggcgcgttgtgctgcttgagcttgggaaatgggcgtcaccaccagcgagtccatgcccgattttgggttgtaaatcttttgcttaacaaaacccgggtcgaccacatagtaaatgccgtcgatggtaagtgacgtttccgcaatatttgtcgcaatgacaacccaaaaataaaaaccatcaaaatttgtaatatcgacaaactacggcacatacctttctcgtgccggggggagcaggctcgaaaattctggtctgcatttcacttggcaatgcgccgtaaaccgggagaatgatcaactcgggcacatcggaacccaactttttcatgcgctcatagagtatttcacatgaagtg

SEQ ID NO: 4121 - DNA, 2807 bp, Heterodera glycines
ctcgggacgcttcttcaccgccactttgagcagtcccaatagcacatcagtgtgaattgtgcgttcgtgtgcctcgtcgagcataatgcaggaataatgagtcaaatcgggatcaagcagacattcacgaagaagcattccgtcagtcatgtacttgattattgtgtcctggctgaaaataatataattaaaaaaagaacacactgaatgtattgtgtttggatttaaggactgaaagttacataccatgtgcagtcttcgaaacggattgtgtagccaatctcctggcccaatctgcagccaaactcctcgctgactctttttgcgacagacattgcagccacacgtctaaacaaattagtcaaattttcgttcatgaaaatcagttaaatatatttattcttacctgggctgtgtacaaccaattctgccccggttggcaaagccagactccaccaaatattgtgtgatttgagtagtctttcccgatccggtctctccgattacaattagtatttggttgtcttggactgcttgcaaaagtgcggtctttagtccaaagatcggcaaactctcgcgctgttccttgatgctcatcgatgtccgcttcccatatgtagctttccccccggcagtcacatgtttcagccattcaggcatatcctgaatcaaatgtataacataattaaagtctcataaaataaatgccccagatttgggaagttggttgttttgtgagtccatttctcggattagtctcgagtttttgccgaacagtgcaaatgcttacccgtttctgttgagccattgccccgtcgtcgtcttcgtcaactgccgacgcatttggtgccattggatcgtgtattcgcgaccggccaaggccgcttctctgtcgttcggcgtccttttctctttgtgcttggattttgacgtctcttctttcttttgacagtgctccctatgatggtgagagttcaatccaatcagaactgtttaaaattcaatccactgaacctgcatgagcgctgcttgagccagacttccgtccggatttttgaccaccttgaccggctcgagatcagcaacatgtttgccataacccttcagaaagtctgggtcgtcttcaacgagttcaatttcaatgtcttcgccatcgctttcctctgtaaaagagatggcaatttatttataacttccaatgtttcttttttagatctctctagtatcctaccttcgtagtttttcaagactcccaattcctggtcaaagtcaggtagatccatcattgtgattgcaccgccgccttgcatttgacggagttcccatcgctcaggcgtggacagacgaatgcgcgagggcttcgaattttgtgtgagctttgtcgacattttttcagaggacggattaagccaaggggcgtccgggttggtcagaaaactgttgtcggatcccgccacggcagcagcactgatcggcatagcggcgttcaagtctttgccggtctgctggtccacctccttcatcgacagagatactttcgagtcgactgtcttaatgacctgcaaaggggtggaattaccatttaaaatgtacaaaagaatatatcaaaaatgacaactcaccttgaccttcactctttgccctcggcgaagcacatcggccacggcattgacacgctcatttttgatttgtgaaatgtgcacaagtccctcggtgcggcggcgaaaaccttccaactgaaaaagtaaatggaaaaattatgggtttggaatttttggttaattagaaaattcagtaccaacaaatacctctataaaggctccaaagttcgtgatgttgttcactttgccatcataaattgcgttcatttcaacttcctctcgtagcggtttgctgcttttccggggcgaccgcgaccgactcgtccctccccctcccccccttcgtctgctgtgtggcgatcgactgcgtctgtcgtggcgtctcctcgactgggtttcacacgtccgttcactgtagtcacgccttcgccgttttcgcccgtcactgggacttctgctacgactgcgactctttgagcgacgcacctcttcatcctgaactcggattggtcgtgtaaaacaattggcactgaacttgaatagacaccttttttgtctgttgttcctcctcccatttctgcttcagtccctccaattcgtcgagcaaagtgttcgctgtgttcggcatggcaagcgccggcaccatttccttcaacgcacttttctcatcttttattgtggcgacaatggaaggggaattccgttgtctctttttcttttccatgttcaataccaagcggagaatatgttgagccaatgagtcgtcaaactgacaatgaaggcagtttattttttaaaacgccaataggacaattacatttttttattaaaaaaccaatttagtactaaagactgtactcaccccatcagccaggccatgctcctccaaacttttcttgaatttgtcaaatgttgacgatgttcgagccagctcaattataaattctgcaacatcgcgctcactaatgccaaaatgattctccaactctgtgacaactcttgacaccaaattcaaatgctccaaccggtcaagctcggattcaaccatcattaaattgcttctaaattccaaaatttattaaaacgaacaagtcagagagatttggcacaaaaaaactcatataaaggttttgtagtactgaaaatgacataatttatcctatttactgattcacattcgggagatatacatatatgctataaatc

SEQ ID NO: 4122 - DNA, 3885 bp, Heterodera glycines
  misc_feature (3849)..(3849): n is a, c, g, or t
taactgattcacattcgtgtgttgtacatatatgcagttattcttgcatttcttttctcatctcatttatttcccagaagtgacccctcttcatcacagcaaacattttctcgcgcttctggcgccgctgtcttcgcatttgcgatttcgtaattgctgctgccgtgtcaatacggcccattgagtcgaagtcctaaattgaaaggcaaataaatttataattaagttaggtaaaagtcactaagaacacaaaactatgcatttgcaatgtatttacaatgttcggcgaagacgagttgtcctcgtcatattcctcgtcagaaacgcattccgtgtcaccaatttcggcttgttcaacgccaatgtccggctgattcaaaatggcggatgacgacgacacactttgattgagtgtcttttcgcgctttttcgcagtgattttgagcgattgtcgagcagatattgtggagtttgcagcgccactcttttggctgggaagggccgtgttctgctgctgaggcgcagtcgaagcgacaagcgcaggcgaagaattagccgacgaatgggccgctgtttcggcaacttgtttaaattcctgcaagaaaaattggagcatattagcaaccccccgttgttttgttttcaaaaattcacttgttccatgttgaagaattgttgcatcatttgcgctgtcaattgtgggttgaagtcgctaatgccaggcaataattggtcagtcttcgcgggaagtgcttcgtcatttcccatttcatgctcacttctgtccaaaccgaacggcatcctcaaaaaaaacaaacaaataatccatactcaattgaattgttagctgaaaaccaatacgttttagaacgacgttctctgtcgactttgtgtaatgcttgaacatatgaacctctctcgatggaataacctctggcactttcaaatgctgaaaaaagcaaaaatattatttaatttattagaaaaaataaatcatccaacaaaggggtgacgacttaagttagattttagtaataaacaatgtcgagtccaaagagctcttttacagactaaatttcagtgtgactcaatccatttacttttatgttttttgactaacaataagattgtaggggattcgaccagaagaaaaaagcaaaaagattgttattaatagtagcactattataaaatgatcaaaaatttccaaccattcaatgcatcatgagaactccagccaagtcgattgatgagatagttacaaatcaaatagccagaacggttaattccattgctacaacaaaccgcaattagcaaatctaaaggaaatggagaagctgaatacatggattgtcagaaatttgtatagaaccaaccattgtcactgttaagttccaaaaagtcgtctattgtttttatgaaagtttttacggcatcagtacgatacagaaagccgcggcctggacatggtatttctttgtagcaaatcccaagcccttcgatgtctcttcgacaaaaatatcttttagtattattgcagttaatcacaagtcccaatgaacgattagagaaagccaactgaaattaatcaattaattgtcaaaatttgtgataaaacctgttgtaataaagttaaagttgaaaaacgacactcctttgggattgatgtttgcaactcgggcaaaagtggtgttttaaatgcaaaaatcctcgatccctcaatgcttgcaccaagtggttggtattttatccaactaaagtaataaaattaagaatttaccaaattagaaaatgcttgattttattatattcaaaaggtatatcctcataatttactctgtgggtattttccgagatgttctgaccattaaaactaattggaagatgaccaagcaattctaattagaaaaagactgaaaaagtcagcaacggcacaatggctgggtcaacgcctccgcctttgttagacaaaatgatccataacgccaagttgcgtaattttatgcgcgttaattcaaaaaactagtcagattcaaaaaaactggtcgtttttttttgatcacccaacgcatcccaaacaaaaccttatacagaatatcactcgatagttttagaaagaaataaatacttttttttaattttattttttaaattaagataggaaaacgctaaaactctaattttaagggtaatacgctaaaaactaatttgtaagagaggatgtcaataccatggtaaataaatacctatattatatttgaaatttccatattttactctcacagggttgagaaatacaggcctaagacattgggagatgtcattgggaattcggaaataattgaacgtttgattgaaatctcaaaagtgggaaatatgccaaatttagtcatttctgtgagtcattttcactaatacttacttaattacccaattaatttccttataatcgataattaaagggtccgccaggctgtggaaagactacgagtgtttgggcattggcacgggacatgctcggagaaaaagttagggatgcttgtttggagctgaacgccagcgatgagcggtagtggaaaataaataatttaattgatataatatttaaaaaattttattatttaagaggaatcgacgtggtgcgcgaccgtataaaacgttttgcatcgacgaaagtgactttgccggagaacacgcacaaaattgttattttggacgaagcggacagcatgaccgaaggtgcacagcaagcattgcgtcgaataatggaggtaggtttatatttccagaagctctgatagtacttttttgattttcattctataaaacaattttatataacaattatgctcaggtattcagttccacaactcgttttgcgttcgcgtgtaatcagtcggacaaaattattggtgtattttccaaccataatctactgaatgggaaaaccttttagaaccccttcagtcccgctgtgccatcataaaatacggaaaattgacagaccaacaaatattggaaagacttgtttgcgtctgcaaaaaagagagtgtccaatataacgcggagggcctcaatgcgatactttacacagcacaaggggacatgcgacaggtgcttggggttgtcatatagccacttataaacagtgtttaaacatcgtatctaatgaattacgaaaagcaagtttattattaattaaatttcaactacaaaatttaaaccttttcaaggcactcaacaatctccaatgcaccgctgcgggctatggaactatcacaaaagactatgtgtacagagtgtgcgacgaaccacaccccgagaaaatgtgtaatattttcgactgttgcatcaacggtcgtacccaagaggcgttcgatttaattgacgagctttgctgtttggggtattctgtcgatgaccttgttggcgttatgttcaaaacggcggtaaaaaaaaaacattaaaatcctcgtaaacttcccctttagaaaatagcggatattcccgaaattttgcgtttggaattcattacggtattaatgtaccacggtgtagtgttgccacggaaatgcatttattccaggaaattgggaaatgtcatgccttggtggtgcagggggtggccactcgactgcaactcgccgggttattagcgcgtttgtcacaagcgaagaacagactcgagatgggagcttgatataacgagttctttgcataattttgtcagtcaatttttaataaattaagaatatttttttcaattgttatagtaagatttatttcgctttgctttttaaacattaaaagtgtaaagcaacatattatacacataagcaatcaaactanagtccttcatttgtccctcattttcattttgcattt

SEQ ID NO: 4123 - DNA, 1308 bp, Heterodera glycines
  misc_feature (24)..(24): n is a, c, g, or t
  misc_feature (43)..(43): n is a, c, g, or t
  misc_feature (68)..(68): n is a, c, g, or t
atagaagagatcgcagcgacattnttgcacgaaaatcgcctcncaccagaaagttttgccgattcatntaatgagtaaatgtcacaagttgaccctaaattagtacaatgaaaaagtaattgaaaatcgaataaatccacaactcacgactgacttcggatggattttcggaaatgcattcgaattccttgaacagcttcgagttgcgcagagttagcaagtcacaacgatagtccaacttctggaaaacttccaattgtcgtaagaaagacggatttggcctcaaaaatataaaaatttatatgcattacaaaatatgttcgtttaactgaacgcatgaacgtcgcgctttcacaaaagaaaacgaatcgttaacattccatttgtatttcctcatcagataagccatcacaactgttgccgatcggcttatgccacattgactgaatatagataggctactacattttgaacctactaacattaaattcgaataaaaccctaatgaaaaaatataataatatgtatatataatattggtatgcccaactgaccaatgaacaacaatgttgattcctctgttcactgagtcttcgacgtaatccaatgcattttgcagcttctgactcgccaacagctcctccgactcgacatcagccattcgaatgtgtcggtactccacattttgaaggtgccgaatttggggaatatggtcaagtgcaacagtgagaacacggccaatcaaaaaagtggaagaaacaagacacaacaaaacccatttatcaccttagcatcaatcaaatacttttgagcatattcaatccaaaaactgaggaagagatggtcctcaatttgagacaacatttggcattaaatttggcactgaacaaaggttgaggaacaagccaataaaaaagatagcatagtaagtaactgatataataatgcaacaattggttaattagataatgactattttatttttataaaaaatataaggattggcacattaaatgtgtttttcaatagaatgttcgatttttaaaaggcctgatttgagctgaaatgagtctgcctcgtctctgtggactgagcaatgctttttattcattgcacaaaaccgtaactctgtgccatgcattgtgcagcagcccacggacattccaaagtgcgatccccgtctcgggctgtgtgttataagaacggtccgtcgccttgcacaccaattccatccgaccattccgaattgttgcctcggaaatgggcagttccacactccacaaagtccaaccccacattgttctatgt

SEQ ID NO: 4124 - DNA, 166 bp, Heterodera glycines
ggggggggggggttaaagtaaaagtgtcaaaattgctaattctggttaaaaaagaagtactattagaataatgtcttacttaccaataattacttccggtcgcattgctttttcaaatggaattgaagcaccgtaacgagaaccttaaatgactattaataggggt

SEQ ID NO: 4125 - DNA, 3348 bp, Heterodera glycines
attaaaaaagcccgaaatatggactaaaaagctcaaaaatgggccaaatatggactaaaaactacaaattataagttttaaactctcaaaagttccaaaaagtggatgtgtatttataaattcaatctttactaaagcagacttaaaaaatacactaaaacagctaaaaatggattttaaatgccaaatcttatcaaattctagcttcacaattgcaaaccaaatacatttcaaattttgtactaataattagggctaatatttttaggcaaaagcctattttttcctgaactccccgtggcctgaaacgtacgaaaaacatgtttttttggggatgttgttaagctacttttcgagttattagtgcctattttctcggcttttatttttagcgcctaaaaaattttgaaagaacctatcatttgagcagaaaaaatatgttaatccatataatttacgaccctacaaacaaaatatgtgtttattgtggttgctaatcttgttgtcgtcattcatatggatttgatcaaaacgctattattattgttaatcaaaatgcgtaaatcttgattttttgtgagaatcaactttttgtataattttgagtagagaagaaatgatagttagtttgattcgtatcatcatttgctgatctcaaaggcgtcaatgaagatttttctttttaaattgatgattttcaaaactaaaatcacctaaaattgctaatttttagtgaaaatccagaagcatcgatgaattatttaaaaagatgcctttcgaaccaaaagcgagtggtactataaaattcaatggtgacattgttcaccggcgccgccgtcttcccaatttggcatcgcttcaaacaataaatattagagacaggaattttcaaatggccgagactatgcaaaatttggtgtggatttaaacaagcaggaaaaaaagttaaacaggatgaagtgaattcgtgttttctctattaacagagataaagaaatagtacgccaaaaagagatgttttttctatgcacttagtctctatttattggtacatagcagggatgtgccgaatcggaatcgtaatcgtaatcggaatcgcaattaatcggattttgggccataatcggaatcggataatcgtaatcggattttggcttgaaatccgattattacacccataagaattgacctttgaaggaattttttttagcgagaataccaatgaattttgaaaaaaatgttttctgaaacgaatgttttaatcttattttaacataatgactgaaattaaatttttctcacaaagcagtgccgggttaattctccccgatataatcaagttttttgttatttagcaaaaatgtcaaagtctttgaagggttgttaatggtgtcagtttaagaacatggcagccaattcaagtatttttgaatcccggacccgaattcgaaccaaaagtcgaaattttgaagaaaaaatttgttgggacattaaagcagaaaagaaccatgaatgaattattactaagttgcaattttcctatcaggtgcgttggtcatccaccttccaaatgcttgatcgttttttgcaaaacaaaacagttgttgggcttctgtatgcagaagacatttcgtttccgaatctaagcaatcaaaaaaatatttctcagccccagctacatcgactgaaagcgaacggcttttctccaccgctgggttgattgtgacagatctgagaaaacgtttattgcctcagaatgtggacaaacttttatttttgcatcacaatcttaaaatttatgattttgattatgaataaaatttttgggaaaaaattatttttaaaaaatcggaatcgtaatcggaatcgcaattaatcggattttgggccataatcgtaatcggttttaaaaccgtatcggatttttggccataatcggaatcggcgatttaatcggaatcggattttgtctggctcggcacatcactggtgcacatatgatgaatgcgtatgcgtaagtaacggacaagcatctttcaaactgttaaaaaaataattaaaacatttaaaaaacacaaccgtttgatggccgctgccaacgattcaaaatgttcttcttgctgctgtttgaacacaacctcccatccttcgatggtgtccaatacttaaattcttttttagataaaaaaatataattctatatcacttaccgttaatatagtccgtccaaaaattgtacttgttctccgcatgtgtatccgcatgggaccaacagcctgtcacaaagtaatccgcagcagctttccaacaatcaaataaattttgtattatttgaaaacgttcggtatccttcttcttttcctcaggaaattgactaaataaaatggttgctgctgattatagaaaaaaatttaataacacttgaaaattataatttcatgcaaaaatcacttcatccgcttatccgggtgacaaagaagtgcataacgtctatatttacgaacaactgcactcgagccttctgtagtgatgctttccgatgcagtaatttgcccctgcccacttgagggtgactctacaccaagcactttaaaaagcgaaagcatgccaaacaggtggcgcaagtcaattatcaagccgcgcacgttatcaaacattgttggtttttcacaagtgccacgaactctggcccctgccccaaaccactcattaaattcctcctcactcatcactcgctctgtagaagacatttgacaatgttattgcaaatataaatctgtttctaaacaaatttgatttaaaaatcaattttcaaaacagataacacgaaaaaacgcataaaagataatgcttgtaaatgaacgaaataatataatcaaaatttaattaaaaagtcaaattcatcataaaaccacaaagaagcataacacatgctgcactccaagtatctcatttaaaattgcctatggcgcagtaaattggacagcggcggctggtaatacaagctccgtgttggacaacctgaattggatcaatcttagcattttaaatttttttcaaaaaactaaacaaaaaaatactgataagcactttgagtatataatttgtaaaattccttttaaggaggatgtgaaaatttaagaaaaataaaaagacaatattggtgtcccgcaatgtcgaatgcaccgccgggagctatttgtttgatcggtttatactgacttactaactccactttgtaacagaggccgacaattcgtaaatttgcccgctattaagtggtgacatcgccacaacgttcactcagtcaacaaagttttttaagctaaacataattatttctcaaat

SEQ ID NO: 4126 - DNA, 4156 bp, Heterodera glycines
  misc_feature (4110)..(4110): n is a, c, g, or t
ccaaacataaactgaaaaatatgcttttgaaaccaaagatgttcgcatgtcagttttttacaaaatcaaacatttctgttaaagaagtttgaaattatactttagcaattgaaaaataaagaatatttaattattatttttaaaattttattatacagaaattgattattactgacaaataatttttcaaaaaccgttatctaatcagacaaatcaaccagaccagttctgacacgcagctgctccgtgtgaccacaaaagtgcccctgcaaggtggtcaaaacgtgagccttacgcaaacgccgcctagcctggcctcattgccctttcaacaacgttaacagttgaacaacggtcgttcctcattcagaaggaaacaaaccaccattaacatgaattaaattaaaaaaatgtttactcccagtcatccaaaaaaccgtaaatttttaagactttttactaaacaaaatttcgaagagattaagaaaactaaaaatagaatttatagaggagaaacggcattgggcgggggcagtgtcgtgcccctaaacacacagccttttaaattgaaaaaaaaaattgttgtccgactcaccgcattgttcccaacgtggtcatgcgcggtcaggtcagccctatgcttgattaaaaagcggacaatggagtcctggtttgtctggacggccaattttagatgatttttaataaaaatattgtaaatgtaataataaaatgaaagcaacatgctaaagaatgcaccttacacaaagaaaaaatataaatggtttgaatttatatagatatataaaccatctaaaaagcattatgatatagcgtatataccctctttatatgtattaaatgaaaaagaacaaaaaatttaataaatgtcccgaatgtcctattaaattttgttttgttctaagcccctgccatcaatgcgatactcatcgaatcactttttaatcatcagaagacaagtaaatcacatcatccgactcgtcgttcacagagctgccactactatcatgctgatatgaaaaacaatttgatgttgacggcatttttgtatttttctgattctgttgcccatgtcgttgacgcttcttaggacagttcttggcaaaatgccccgtagtgttgcaggacgagcagcttaaaaatgtaataaatagatcaataaagaagaaagatacaaactcacagatttttgaagcaactttgtttcggcgagacggtttacgacgtggctccggacattgattcgttttgtgcgctatactcgcacaattccagcatttgtccggatcccgtgcgcttgcattctcacaaagtgctataaagtataaatgaatagttcctaattataagaagtaaatatttttctcttacggtaactatcgggatgacgatatgggcatgacaattgcgtgtggccgcccctgcccaatggccgttgcacgccacagcaaaaacaacgaattagttgctgcacatcatacttttgcaacaattcaatctcatccgctggtctcgcatttcgcggtaagcgccctagacttatagtacttgaactacgtccctgcctcaatgttggtttctttgcagtcgcgtgcacagatgatgaatgcgtatgcgtaagtaacggacaagcatctttcaaactgttaaaaaaataattaaaacatttaaaaaacacaaccgtttgatggccgctgccaacgattcaaaatgttcttcttgctgctgtttcaacacaacctcccatccttcgatggtgtccaatacttaaattcttttttagataaaaaaatataattctatatcacttaccgttaatatagtccgtccaaaaattgtacttgtctccgcatgtgtatccgcatgggaccaacagcctgtcacaaagtaatccgcagcagctttccaacaatcaaataaattttgtattatttgaaaacgttcggtatccttcttcttttcctcaggaaattgactaaataaaatggttgctgctgattatagaaaaaattttaataacacttgaaaattataatttcatgcaaaaatcacttcatccgcttatccgggtgacaaagaagtgcataacgtctatatttacgaacaactgcactcgagccttctgtagtgatgttttccgatgcagtaatttgcccctacccacttgagggtgactctacaccaagcactttaaaaagcgaaagcatgccaaacaggtggcgcaagtcaattatcaagccgcgcacgttatcaaacattgttggtttttcacaagtgccacgaactctggcccctgccccaaaccactcattaaattcctcctcactcatcactcgctctgtaggcaaaatgccccgtagtgttgcaggacgagcagcttaaaaatgtaataaatagatcaataaagaagaaagatacaaactcacagatttttgaagcaactttgtttcggcgagacggtttacgacgtggctccggacattgattcgttttgtgcgctatactcgcacaattccagcatttgtccggatcccgtgcgcttgcattctcacaaagtgctataaaaggccgcccctgcccaatggccgttgcacgccacagcaaaaacaacgaattagttgctgcacatcatacttttgcaacaattcaatctcatccgctggtctcgcatttcgcggtaagcgccctagacttatagtacttgaactacgtccctgcctcaatgttggtttctttgcagtcgcgtgcacagcagggatgtgccgaatcggaatcgtaatcgtaatcggaatcgcaattaatcggattttgggccataatcggaatcggataatcgtaatcggattttgccttgaaatccgattattacacccctaagaattgacctttgaaggaatttttttagcgagaataccaatgaattttgaaaaaaatgttttctgaaacgaatgttttaatcttattttaacataatgactgaaattaaatttttctcacaaagcagtgccggattaattctccccgatataatcaagttttttgttatttagcaaaaatgtcaaagtctttgaagggttgttaatggtgtcagtttaagaacatggcagccaattcacctatttttgaatcccggacccgaattcgaaccaaaagtcgaaattttgaagaaaaaatttgttgggacattaaagcagaaaagaaccatgaatgaattattactaagttgcaattttcccatcaggtgcgttggtcatccaccttccaaatgcttgatcgtttttgcaaaacaaaacagttgttgggcttctgtatgcagaagacatttcgtttccgaatctaagctatcaaaaaaatatttctcagccccagctacatcgacataaagcgaacggcttttctccaccgctgggttgattgtgacagatctgagaaaacgtttattgcctcagaatgtggacaaacttttatttttgcatcacaatcttaaaatttatgattttgattatgaataaaatttttgggaaaaaattattttaaaaaaatcggaatcgtaatcggaatcgcaattaatcggattttgggccataatcataatcggttttaaaaccgtatcggatttttggccataatcggaatcggattttgtctggctcggcacatccctggtttgtatcgaatttttcattcgccaccctgcccgcataggcggccaaggttttttgtcgccatcgtacacaggttgtagtttgtcatctcgtaggaacctcgtcgaaatcgatgaaacacttgcggttcgacgaaaatacgagcgtggaaggctcgtcgttaatgacgtttggatattcggtggaattgaacgaggaaatccgcagcgttgttttatggtgccggttattagtgatgctcgagaccaaaaatttcccgagactcgagaccgagactcgaccccgagactcgagaccgagacccaaaacctcgagaccgagaccaaaaaaacccgagacttttctcgagtcgagactcgagactctcgagcatcactaccggttatgcgacgcgacgctgccacgttacttccactcattactngaaacatcttgccaggcagcgtcatccacagtgacatgtggagagc

SEQ ID NO: 4127 - DNA, 1710 bp, Heterodera glycines
  misc_feature (1682)..(1682): n is a, c, g, or t
atgatggcattgaactggtggacggcctcttccgcttgttctgcttctcgttgacacaactggacacacagccgacctaaaatatggaaaacagatttctgtaatataaaaaaactgcatattttatggattggtgaaacatgaaggatatatatgggtgcccaaattgaaaattcaaaattcaacccaaaagttatagactaggtttttgccacaaaaaattggaatgcaatggaaaaattaaaaaaaaattattatttttttgtaccttggtgggtggacaacgccgagcatcgcatatgatcagactctccagcaacttaaccctgaaattttttgacatgcttaagcggttaaaaacaagagtgacattgaagtcacagtcatttaggatattttaaaactgaaatcgttagactatcgagcattagcgaatcgtgcacatagcgcagtcggtagttttttattaaactgtttaatttttccaggggcgaaagggcaaggtgctcaaaacgtcgcggtctcaaaaatgggtgaagaataactgacagtgggccccaaaatgaattaacctcaaaaaatcaattaaattactcgttcaatatggcggccaaatgccgtggagtctccccgtgcgcattgttcacgttcgggtcggcgcccagacagagcagcaagcgcgtgatctgcaggctgcgattggacaccgcaaaatgcagtgccgtcattttgccactgtccgcctgctcgtcgaggccggcaccgtaggagagcaggcacatcaccatccctggataatggggaaaacaatttttaaataggcacaaaagtttggaggattggattcagcactttaattaacttatgtatgttcccggaacccaaaaattctggaagattttcaaaaaaacaaacaaacaaaatctttataaatttttttttgattttaggaaatttttttttgaatgccaattttaaagatcatatttttccgttcgctcttaccgaggtcttcacgcatcacgaactgatgcaacggggtgaagccgtccttgtctcggacgttcaggtccaattttcgtcgtcctgctcaagcaggttcatcaacatgcttttgttgaagcaatcatgcaatgatactatcatttttagtctaaaaagcaatcaaccaatattttgacacggcgattcattttgggctccttgtacaattaagttggttttttcgtcttagtggtctgtgcgttagtcaccaaaagggggtctcaggttcgagtccttcttatgttgtgtgttaatttcaatttctttttttacagaagaaggcagaattattttttcattaataaaagttttcgtgtcaacaaaaaatcatattcaaaagcgttggttacgtacaacatcgacaattttatgaaattttcttagcttataacttggtgaatactagagcaaataaaaccattttatgctcattttgaagggaaaattcttgagaatattgtaagttttatttggtttggccttaaatcgaggacttggctaaaaaagaattaaaattattgaaatgttcgtccctttcaaaaaatttttctagctttttaaatttcttaaaattttgcatagaccaatattttgaccccctctagcgatcccaagtttattttgtgaaacttaagttnttaactcgagatcggctcttctattttt

SEQ ID NO: 4128 - DNA, 5741 bp, Heterodera glycines
aatgagagagaaaaataaatgaaaaaaaggcatacagtaataaggaattgggaaacggtagaaaatgcctaccgtaacgattaaattcgggcgaattgtgcataagatagaaggacagactcagttgtttgtcgcccatttctgccctccccattttgcctctgattacaacggtgtccccggcgttcagtgcattttcaaattttttggaccaactttggcgttttgatttgacagcttcaggcttaaagtaaaaacaaattgaagtcgaagaagtaaaatcaattatgtttgatttttaagaaccttagaaaattcgaaatgaattaaaatatatttaaaaaattccaaaaagtccctaatttgtcaattcatttttaatttttttttcagcaaattccaaccctttgaagtcgaagaagaaaaaatcatttaagagttttgaaattttagaaattaaaaaattcgaaatgaattaaaatatattttaaaaaattccaaaaagtgcctaatttgtaaattcatttttaaattttttcagcaaattccaaccctttccttcacttggggctcttcaatactgcttgggtagacatcgcccgcaatctgagcaagtttaaattatttacatttattaaaattcgaatatttaataattattagggcttccttttttacgtaagaaaaatcgctaaatatgtaaataaattatgtctaaaaagatgaaatatagtataaaaccaccaatatataaataaaatttaaatttttttttaattctttgtaacgggtgaaataggcacaaaatgctaaaaaatgagctaagtaggcttagaatcaccttttagtatttaaaaattaatttttgtatttttttttggtaaaatcgatgttttaaaagtaattttcaaaaaaaaaataataactaagttatgaacttttttgggacacaataaaaattccttgaaaaatcctcaaaaattgcaaaatatgtacgaaaaaattcattaggggctatggagaatccaggaaaaatgtaattaaaaaagaaagccctaaataattataattggatttataaataagtgcctcaatttgcgtgaaattgtccaatttgtcctcctccgtccaccactccgatggttttggaaaatatttgaccgactttcggtcgccgattttcacttcgtagaaataattgtgcaccaccaattcaacatccaaatatttgtcctcccattcgttgtcattttccaccgactcaaacgatttgaaatggtggcccgccgaagcttttttgtccagcatttgctttctgataatgcccgcttcactttcttctccatccttaccacctttaatgcgctggtaaccgccggccttaatcagttgtcaacaataattaatatttaattaataattagcgaaatttaacaaatggtgaattgccccctattcggcaatcaatcctagaataagggtccctaatttgacccgaactcgaacacaaaaatatactttaaaacaagtaaaaattttggcgaaaattgcgccttctttatccaattaacaatttaagcattgctttacatccaaataaatagttattaaatgaattcattatttagtattacccttctaatcgccaatttaccgttgaaatattaatgattccatacggcggtttgtccacacggagcatcagcaaatccttttgattttcattgccaaagcgcagctcgatgccctccgggtttttgttcagtcgttgtcgcatgcgaatcgcacggcccacccccacgggctcgggcagtgcaaactgatgtgagtccacttcctggacagtggttgggcagtccacgctgaccacggggtgatccgaaagcagtggcggcacttcgtccgacggatggacaaactttggcacataattttcgattttttggcatttaccttatttacggtatttaaacccccccccccctgaatttgaacccccctctgtattaaaaccccctttttgaggggagttgaaaaatagaacccccgggggttcaaatatcgtaaatatggtaaattattggctaattactgtccctaattgcctaattgccctacccatgcgtgcatttcgcacctgcagtccctgtaaacgtgcaattgcattttgtcctggttgttcatcggcaacacgtccaacccgagcatccaaaggcccgtgtaattacgcaatttcgcgtctcttttgattttgttggataaatacgccttccgaatggcttcatcttttgagaatcttatttctcttccttaattacacatttcaaaattttcactcatttcgttaaattccttcacccgtttcgtccgttatttttgtcatcaaatctttcggatttccaaattcaatgttaaaattttgggtgtcgctcagattgtacctgtaaaataattaaaattaaaaatatttttccaatttcaatggtactatgtcgttatttaaaacatcataatgtgcgttatttaaaaaaccatcaaaataataattttgcttataacttttctctaaagcaaccaaatttttaattcttggtatcattagatagccctaagtgttctctattagcttgcaaaattcaaaaaaaatttattaactttcaaaaaagttatggccaaaaaatgttcaaaaaccaagttttttgagttcctctaatcataacttttttgaaactttacgaacttttttgtaattttgcagactaatagagaacacttagggctattaaataacatcaagaattaaaaatctggttggtttttagcaaaattataaatattttttcatgaaaaattttcatattgatggtttttaaatagcgactccgtcccattccaactccatttttaatttccacttttcttttgcaattgacaattcgatcattatgccgccaaatgctttcggcgcgctcacgcggacgccgtgccaatgacttgcgatttggtttatctttttgtcgaattttttctgatattccaaacactcttcagccactttgctctaaatatttgcaaatgagttgataaatgatttcataatttactgcttttccatttgtgggtttataataaatccaccctctttttctcccaattttcgtgccaatttactcggccataaaacggattttatgatccctgggaatttccgccaccaaacaaagaccacagaaaaccatcattaaatttaaaaatgataatgaaacaaaatttttcaattatagttggagaaaggaaagtaaataattattttattaaaattttaattaatttttcacattatcgatattcgtacccggcatttgattagtgattacttacttcctggtggttcggcacttggaattgaatttcaggactcatgccataagcccaatttgatccgctcgggtccaaactcccgagataacaaattaaaatgctgaaatatgacccgggatttttcaatcgttaagcattttaatcagggctcccagattaaaattttcaaaagcctcattttaggtcaaaaagccgcatttttacaaaattcattcaaaacactcttaaattgttcaaatgttatatttttgattgtccatgatcaatttgagcagttttttagcaataagcattttgtgttttgtggcacatttaattctaaattttcgttttgctgatattgaacctatgtagtaaaaaaaatacagatgcagactttttcaaaatattagaagatatattaaaaacccaaattattaaatgattgtcgaacattatgccaatttatcaaaagtgtgaactttttattgctgtgaatttctttaaatttatgccaaaaatttcagattcccgcggcaattccgttggccatcggcggtttcgctgtcccatttttggtcacattgtcttcaattctaaccttacttttgccattttgacttggtttctgatcggctattcctttttaaatattaatgtttaatgagattaatttcactaattgctcaaagaagaaattaggacaaaaataaataggaattatttaacccataaaagttatttataaatgctaatattaataattgggttgtttgttatcaaagttaattttaatattcatttcttctgatttttcaaagaagccaaagcctatttcttcctttttaccaaatatttctgttgctaaaatattttattctgatttgttcccgtttacccatttgtcttaaatatgaaatttaaatttccattcaaatttccatctgattggcgttttgtttgttgtctttgttcccaaattgttccgcttcggccattagcgcctccttcagctgttccgcctccaatcgttcgattgcttccgcatcaaatccaatcgctttcgtcccgcacggctcattttccgggtcgtggtacctaaggaaagtggaaaaatgccatagaataatcaatcatttgcatgtgtaagcaatgtaacaaaataaatcaaggaaaaatgagttaatctttaaacaaggttcgtaattgagtaatttactcttgattccaatttatgtgccaaaggaccgcaaaaaacggcccatttgatgaatttgcttaaaattagggttaagccccgacccctcggggaagaaatctcaggacgtttgagaggccagattcggtgatcggggagaggcacaatagggcggagagcctggagcccgagctcaaccctaattgaaattgtggcacttatgtctccaagataataaatagcacgaacaatgtgaaagaaaaaaatgcactaataacaacaagaaacatcttatatccgcaaatcaatgcatattaattgaaaaaatattaattaattcattgaattaaattattcttttgatttaatttaatttccagaaaaaggttttttcattgaaaaaaatgatgacaataaaaaaatgtcaaaagtaatcaatgccataaaaattgcaaaagtaataatttgggatgatatttatagttgctaaaaagtgccaaaactcgccctcggcttgcggcggcgttgtggtggttgttgtcgttcggtgatgctctatgcatttccgggctccctctttaatatgctttataacctaaagaaaaaggcacttttaaactggtaagtaaagatggaaaaattttacaaaagtgaaaaaaaataaaaattttgtgccaaaaaatcaaaaaatttaaagaaaaattaaaggttttgtcagctctggaggggaaaaattggaattttgaaacgaattttttgtgaaaaataatccaaattttcaaaaaaaaatttattttattttgaatatttaaaaaagacaatcgcttcaacaaaaatttgtcacagaaaatccgcggcacgccgcgcaaaaaaaaaatcccacagtcgcggattcaaattgccgcggtcgcgaaccgcggaaaaaacgccgccgtcccacccctagtatgaaaggcaaaaaaataaaagtaaaaagtggttgaaaaaagcaaaaaatacaataaaaacagaattagatttttgaatatacctacattaatttgtatgctgtcggcagcctggtcagcatttgccccctgcaggacggctgccactgcaagagcaccaatgaaaatgaacgccccgcgccctccgcgcacagcgcctccacggacagtcaggatgaagaaggacatggcgaaac

SEQ ID NO: 4129 - DNA, 1069 bp, Heterodera glycines
ttcgagaaatttctcaaggaaaaattaaaatgttttctaacggtttttcttttgaattttatgatgaattaatatttttacaaaaaaatttccaaaatcgctagaaaaatttccaattttttgcttgaaaattttaaagaaattttggcatcgagattttgtccggtgcccattggacttttgcctatcattcccacctcgacagagcaccggcggtggctcgttttcttcctcgtcaacagccaatggataatcggccatgtgttgttgttgggaaagatgtttggttggatctaaaacaaaacaattcgtcattaaatcggggttaaaaacaccttggtcagtgggaagcaaagtcgctgaattagctagaatatttttcgaatccgcttttcgtttccgttttggcgacgacactttgacagctaattgtaaggaatttgttttaaaacacattaaaaaataatttgagaaaggtcgaaagcaaaccagcattaggccgtgacgaattcggagttgacccgaccatacctaaaccaattggtgaaaagtgagacaaaaaagcgtgatttatcatgccaactttcaatttcgaggggataagtcagttaaagctagattcatgcgtttatagttctaaaaaatgaccattcttctgcatgtactgctcgacatcgcccgaggcaatggccatcggcgtcgaactgttgctggactgtggcattattcgcacattgccaattgtctaaatattattatcattaaaagccattcattataagcgggtgacccaactggaatgtgctgttgttgtggttggagttggtgaggcggcggcgcctgcaaagtgacaatggcacccgacggagtcagaaaatactgttgctgggaaggggccaactgctggtggtagggcgagtggtgtgacggaccaccgatcatcaccacgggggccgagacaggttggtgggtagaggaaggccctgtgggatgaacaaattgaaaacgatttaaaggtgggcaaaggagggggggggggggtaatttcgtgaatcccacgagtggccga

SEQ ID NO: 4130 - DNA, 3353 bp, Heterodera glycines
  misc_feature (1805)..(1805): n is a, c, g, or t
ctttttaccttttccaatttcgtaaatttggcctctggggcatttcgtaaagacaaatttctgacccccccccccctatgaattggtcccattccgtttccattttggctggctcaccttcccccgttgtctgctgctgactccccttcggcgctatcgctgtcctcgctgccaccgccgccggtggcattccccccttgggctgaatgccgacaaaggtgcccttttgttggggtaagggtgagggtcgatgatgctgttgggtggaggcaacaaaattcgcttgggcgaccgccgagtgttgagaggagggcaccgccgacgaagtcaaactgacattggcaccgctaacaacactgtttgagaccattgcagctaaaaaacataaaatgaggacggaaaatggtcgattagtggttttttgtattcaggcctgaatttcagtaggtgcacccgaagtgctcctcttttttctcttccgacccaaaatttttggcccatgtaattttcctgaatcactggcgccataaacggacaattttggccattttgagacctaatttgtcaaaaatataaggccgggaaatttagaaaatttgggtcagattaagtgaattgagttatattttttggttacgggcctgattttgttggtaaaatcccattagtatgattggacaaagttagaaattacgcatgataaggtcgtttccggagcgaaagtacaaattgcggacttggtgttgctgttgttgctgctgctgaatgaccatccgttgctgttggtcatccgtcgtttgtcctatggaaaaacaaaaatcattccattctcaaaaaaacaaataaacattcagcaaatgcaatatattcatttgtgtctctcttttttatggaagtatcagtcaaaaattgcgagacttttgcaaaatttttgctttagggcccgacttaaattggcacaagcaatcgcttttgcaaggccaactccgtagcggaaataaagcccaaacttttcgtgacgtttgagtcccaatgtttccacaataattctcaaaccttggaaatgcgctgccgttggtgggccatttgttgcgatggcattgttcgggtcgaccgcgtccggcattggtgaaaagaaaaactgttgctgcgacggtatgacggggatcagctgctgatggcccgacgaagtggtctgaaaggaggagaaggaagatgcatttcaaagggaaatgccatggtttataatttaaataacaaattataatcctacccacccgtaataaaaatgccattaaaatttcttatgaagtaaatcttcataaaaacctggcgtatgaaatattgcgtaattccgccgctggcgcctccgttcggatacgccgccatcagactggcactgacagtgccgttgggcgtggcggcgagcgcaaagtttgacgggaaaagcatgccaccacccggggcgttcgatgagacggatggacaaaggggaaacaaagaggcggtggaagacgactgaaaagggaattgtgtgaaggcagaggaatgactcattgccaatcgaaagagggaaatcggaaaaaatgaagagacaaaaaagaacattaacgggacaaatagcaatttttatttttgttttatttaatcatctgtccatttccatagctgtttatattatagaaagcccttttttgtatgcttttttcatgcaccgaatgatatttacaacttgacaaggacttaaattcaaaatggagaagaatgggcctcgattttcgatcttacaaatatgccacaggacnccgccttcagaagccaatttttaccgacaaaagaattatgaaatagggttgaaagaccaaaattgaaaaaaggtaattccatgatacagaatttattccgttgtttccagttttatcccaatagttttcttgttgctcttgcactacaattccctttgcttgcctgttgaagttgttgctgctgctgcatatcgacaactgaaatggtcgttgtgttccgttgctccgccccctcgtcaattccgttcgtcgcgccattcttcgcttttggcgctgctggtgccttcttcttcttgggcgccttcggcttcaacatttgttggcccctctccgtgccgagttgcggcggttgcccttttgccattgttgcaattggtggttgtattgctgctgctgtactgcttgccgttgtcgtcgttgttagtattgccgtactgctcgccaatgtcgtcgcggttgctgccgacgaataggcaacaacaatttgctgttgcatcgacggatgcggtggggaaatttccgttccggctgccactctgttcaccgtgtcggcaaatttgtccagcgacgatgccgacatttctgtggttgtggtgaaagttgtacaggtgatactgcttgtacttgtcgtgtattccctctgcggctccttcgcttcaatgggtggtgtcaatggtgcaacaacactgccgacccgttgtggtacaacagcagcaaattttgttgttgccgaactaatggtgccattagcaagaactgaaattcaaaagcaattagcaatcagaacagccgaaaatgccctcctgccgcacttttctggttgtgctgttgcaccgcatttgttgctgttggtacagtttttgcgccactgaataccattgtcgaaccgctcgtcagctggccacgaacggatgcaccaccaatgcccaacagcccacttttcagagcccccggtttggcggcaattgccattgttgtgccactaatgttcgcaactgtcgacatcgttgtcgttgctgctgtccatgttggacaattggcatttgcggttgttgttgtagtcactgcagtgctgttcacttgttgggtctgcaaaagggacattttattttgtttttagtttttagtcattgcacgaaatttctcgactcttcattattttttttcttctcaaacctagaaatcttaggaaatgtttttgtaagaaattacaagaaaaaaatttttgaaactttttccagcgtattttcgaaattttatgatgagttactaagtttttctcaaaaattttcctaaaattcgctgaaaaaaatattttttccttgagtctttcatataaaaaatttcctaagattttttttcttgaaaatcttttaggtttgagaaatttttagaaaaaattttccgggggggggggggaactgcctagtaaaacaaaacaaggaaatatgactaccatttgaagtacctttttggccgttggccttggcaaaatgcgcgtcaccggctttggttggatgggcgcgcgcatcaacgcgagcgtcggcg

SEQ ID NO: 4131 - DNA, 1311 bp, Heterodera glycines
cagtggttaaaatgcaacaatcagtcaaaaatctcttacagttacgccgcttgaagccaatggcaccgccacccgctgtttggtgccgttttcgtcggtggtgtcactttgggatgggtttgttggtggcgttgttgttgaattagttgaaggagcggacgaagaaagtataatcgcagcagcagcaccagtcgaattcggtgcggatgaagaaacatcgtctgccgaagcaggcgtttttggtggcgctggcgaagtcgccgccgacggcggtgccattggggcgacggaatcggtcggctcgccaggggcgatggcaatcgcttcttctttgtcttcctttacgcttttcgacgcggccaccgttgaagcggtttctttttccgctattggattcggctgttcctaaaaattggcaaaattgtaaaagcgacaaaaatattaatttgttatggctgtactaatgctaaaatttgcgcttttttctaaattagtttaaaataaattccaaataccctaacagggtttatttagtctaaacacggtttggaacagcaatcttttgaataattgttggcagtccctggcacttgtattcaaaaaaccaaagggaagagacccttttgtcggtgctttgcctacccataaaattttagcaaaaaaggcacgcctctaatgcataaaacataaagcgagggatttattgctgctgcgctaatttatgcatttggaaattggacggacaaaaagtttcgcttttttcacgtcaccaaaacggagaagtccctttgattttgtcgacccctaatctatacaaatatgcacagcttcttttttacaattcatgaccccattgttcagtaagtttgaaccgtttgaacgtcctgctccgcaatgtgtcctccttcccctcctcctccgtcttttgctttattcgccatgtcttccgttgggttcgctattggcgttttgtcgtcaccatttgggtgaacaatgcctacaagttttttttgtttacttaattagtttttaaaaaatgccaatatttccaaccacaattggtgtttggtgttccgcgtcctgtgactgtggtcggagtggcgcacccgcttttgtccaaaattggcatcgccagcggcgattccgctccgcttgtgccgcctccgctgctttccgcgatttctagtcgaagtgagcgctccgagtcggcgctggtcgaacggcgactgccactgcacaccgacaaagggttggcgagcgaaggcgacgccgactcagtcccattttttgggaaaatgctgacgctgaact

SEQ ID NO: 4132 - DNA, 1379 bp, Heterodera glycines
  misc_feature (1217)..(1217): n is a, c, g, or t
  misc_feature (1228)..(1228): n is a, c, g, or t
  misc_feature (1298)..(1298): n is a, c, g, or t
  misc_feature (1320)..(1320): n is a, c, g, or t
aagggaaatcaaaaatgcggcgggacaatagaaaatagattcaaagaattaagaaacaagcaaaagaaatgtttgcaaggagagagagtagggtgcgagagaaaaagatcataaacaaacaccagaaccaacggaaggggaaaaaggggggggggggaatcgcacagcggcggcggtcgaattcgtcggcgtcgtccaccaaccaaaattgctctttcactcgccaaccaagcggcgaagggggggggggcaatgttctttctgttctctgtgctctttcttctcttccgtcctcagcagccgcttagactctgctgctgggtaccaccgtccaaaagcaaccagtaaaaaccattcatccatccttccgccccctcccctttccccgctcattagccgaccatcgatagagaagggcggtgatgaataagccagagtttactgcatttgtaaaactcatgaaaaactcatccattcgcatcatgatgagtacagtagaaagacagcgaatcttttcaaacaaatcaagcaaaatcagcatcaacaagacatttacgcagatggattctgactttttcatgattcgcctcatcattaatgtccttttttctcccttgtcaattgtctttccctttttaagaagggaggggattagggaaaatgacaataaatgagagaagcgaaaaatggattttacataaaatatgcctgcacataaatgcataacgaataatgcacattcatttattaaagcagttgaatgcaaaacgctttaaattcttaggtggataggtctaaaggttagtaatagctatttttacagtaatataatttataaaaagtgggaggggaagttaattaagcgtgcgtacatttatgatacaacaaatcgcttttgaaaaaagatacctatacgcctaaattctaaataacgaatgtattcggctctaaggaatcggtcgttcggtcgactccaaacgcaattgcagttaaattggggaagggaaaagagcaaaaacggagacaaacgaatgaatggaatgatggtgcataatgtgaagagatgtgttgtgtatttgcgtaatgagtcggaagtgaaaggcaacaaacactttctccctccaaacggcgaaggaatgaaatgaaatgaatgagaggaaaaagtgagggagaaaagaaagggcagagaagggggaaaggaaaagggagagaaaggngaaagcgaggngaaaaagagagggcagagaatagggagagagtgagtgagacgctttttctccccgcgaggctccgccccnttcagcagcagcaagggacgancagcagccaatcagcgaccggcacacccatactctgcccccgcttgtctgcttctctgc

SEQ ID NO: 4133 - DNA, 1151 bp, Heterodera glycines
tccattcgttcgttcacttcgacgactgtgacgtggtgcgctccttctcttgcgcttctctccccccttcaccgcgttgtccacgatgcgacgcgtgtcgccctccggatgtccatgtttgtgctcaacctgccacaaaatgaggagtggtggtggtcagtctttaaaacgcctgcacaattaacaatggatggtaaagcgagcctcattttggcatcaagagttgaactcagcagttcaaattgtttgtggtagaattcaatttaattttctttactaaatgtgatttccaaaattatagaaaaaactatttgaaatttcgaatggttgggggggggatacgtcccactgagaccgtccctgatcaaaatggtccttttttagaaaagccaatgacgcacaatcagccttattatacaacaaacgatccgacctgttcggacttggtgcgcttgccctggttgctcttgatgacttcaccgtcacccctaaatgcagtaaaattgattaaaacagaaaaaaaatgtaaaacagagcaccaaattaggaccttcaccaaaaaacccacctctcatattcgtcagcgatttgagccgcggattgattgctcattttgttgatgattcgcgagttttattatttttggattctaaaaaatagaaacaatttaatacataaattggaaagaaaacatcgacttggacgaacaaatcaataaataagaaatggaagcaattttcgttgttgataatttatcgtttattgtggggtcgatgagtcatacaaataaatgttcggacttatatgtgaaataataggaaaatttttcttgaaatcggagataaaaatgagaacgcctttccttaagtgaagtgaattccatccagactcgtaaaatccgttttttgctttaactggaaaaagtgttcgcccgctgctacgctttctcaacaaaccaagcaatggaacgaacgccctaaagtgaacacaaaactaatatttgcgattctctttaaattttactttctcaaattttcccccagtaaaaggacggacaaatgcatcataattcattttgctgtcaagcaatttaagcgatccagccagaaaatggcgcttaattttggcaatgttaatcgcgttggtctaaa

SEQ ID NO: 4134 - DNA, 5263 bp, Heterodera glycines
  misc_feature (5234)..(5234): n is a, c, g, or t
tcggtgttctttttcaagttggtcatcttttccttcggtaacatcggttcctacgcgttaaagttaacttcgtctgactgttatgactctgctgggcgtccgcttcccatccgcgaactgctcgccctttatttgaatgacaatgagcagcgcaacgaaaacagtgaaagtgacgacaccgaagcgcaaataaagacgtcgacaaaagtactgctcgagcacaaggatttgctgtgggacttcttctccattcaaattgttgaatatcattcagaagaagacaaaggcgagtcatttttcaacctaattctcaaaaaacaacaacaacagtgccatttcaaggacatccgaagccaatgttgagtgcgttgccctgcattttggaagggtatttgccccaaatggcgtccatccccgcgcttattaatcatttggcaagaaatgttgattactctgacgtaagtcaataattgataaaatagcactaacattgcctcatttctccaggaagtgctctgttattcgtcaattgcgcgagcactcagcgattttttcactccttttgtggttgaaaataactttgacgaagaggatacaaaagtgatggaagagcaccgacgaattcagatagtgcttcgttcaattattttcccaactctgaaaagtcgtttccttcccccgtcttcactttggccatcaattgaacgagtgactgacattgaaaaagccttcaaacaatttggtcgatgttgagactccattctcagggttgtctattttcataatccatccatttgtccaggcctgtgccgggccaactccatcttcaaattttgttttatcgtctctatttaatttttacttgtatgattattagcattataatttcttggaatttgaatttgcgtttgttaccaagaagcgaataatataactatagccaaaatttttgcttttcgttcatgaatttggtggtgtagcaatagtaatttttttttttttctggagatttcatacttacctattttaaaagggattgaaaaaatcatttttaatattacaacaaaaaatgttgattgtctgaattttttgcagagcgtttgcacagtgaacatgccgttgaactatccttcctactgccgtgccatcatttgtgagaacattttttaatgacttttgaagtaaaaatttgtttccgaaaatagagtgggcgggggcaaaattgtgtttctacagtaccaaattttataaaatgctcaggatttagaatcacacaatgaaacaagacaattttgttgaattaaattgaaatatccccttttcagccttgggacgttgccgtgttgaagttgtacgcagaaaccatgggaaatatttgggaccccctttttacgtacctggacgaagtcatcacttcagtgagtctatcatttacagcaaatagttggcattattttataattgacataaataagcaaagtgtacaatcctttattttccaaaataatcaatcagtcttattttatttaacatttagctggaggatcgcacgaattctccctctcctccgacgctcaacggcaccaatttggcatttcgtcaaacacaagcgcaacatttgctatggtgatcaggggccaaaaggatgcgttgctgctgatcggtttcgctctgtcaccgcttttgtcgccattttcccagttgccgacgatggcagtggattaatttgataataattgccgagacaaattcatttttttaatcataattttaatgtgccatcttttcaatttgcctctttttttgctcatttaattcaagtgtgaagtctgcgctagtttttaaccatttcggaacaatttggtttctgtgtacatgtttttgattgattgggtaattttagaagtgaattgttttaaattctttgattggggggtggggcttcgcacatacgtatgtttggggaaccgcccggttcgccgcggccacttcgccgcggccatttcgccgcgggtttttcgccgcggggtttttcgccgcggccagttcgccgcccgaagaaaaatgtccatttcgccgccataattaaaaaaaaatttgttatacactgtgttgcattagaatagggacaccctattttttgggagtttgaccacttcccatgaaccaatcgatctgaaattttaactgtacgtagcaattctgaaaatattaagattctaacaataagaatacgaaaggatgtcggaaaaaaattttacgaatttttttccaaaattggggtgttgcattagaatagggacacctgtgaaaattgaattaaatctcaacaactactaaaaagaaactgataaaacaaactaaataagaaagaacaaatcttttttcacatttctgtttattttgcgtacagaaatatgtcttttggggagagttatgttgaattttctaagttttcaggagaaattaagggccaaaaggcttaaatcgcctctaacatttgaccaaccgaatcaaactatcagccatcaacactaagataacgtacagacatcctttaagcattttttattcattttatgccataaaaaaggcattaaacacaaaatttgttccgaaacgcggacaagcgcattttgaatattatcgaaaattttgatgcccaaaatattgttgaatttctccggggaatttcaaataattgtgttatggacccgtaatttgattttgttcatttaaggttgttaattttttatgaaaaaggattttaataaagcatgattttttatacatagtgggttgtttaacataatttcaaaatttttcgagatttttaactatgacggcgaaatggacatttttcttcgggcggcgaactggccgcggcgaaaaagtccgcggcgaaaaagccggcggcgaaaaaaccccgcggcgaaaaacccgcggcgaagtggccgcggcgaaccgaccccgaccctatgtttgtgctcaattccgtttggtgtcactacaaatttttatttgattcatttcaccagttgtggttgttcaagttgtgtttccctaacgctttatttcattgaatcaaatattttttctttcaatttcacaatgattcattttcgacatggctcacgacacgggataaaaatgcaaatcttatttgttcgactcgtactgccccaattcgtactttttgcctgggggcggtagacactaacaagttagacagttcatatacttaaaaaacacatgaacaaagcgaattggggcaatttttgtatgacaaaccatggtcatgaaaaatcaataaattctctgtctgtctttctttgctttgtttttgcatatgttccttcatttattgtctgtctgctgctgctgaatgaatgaatgagttgatgcaaatgctggggatgtaaaacaatgtgtcttactgactgacccctgcctcttctcattacattcattcatttgtgaggtcattccgtcatttaagatggcacacaaaaaaagaacatgaacaaatgaatatttttggagataaaatttgtattaccatttattgttttttgtttctaaagccaacagtcaattcttcttttctttgaccaaacatttttatgtatgaatccgaaaacaaaacatatgtatgtacctaacaattctaaaccccccccccccttatgtatggttttttcatctgctggtccactaaattgcaaatttgttaaaattagggctgcaattttcgtctcaggtcgacacccgaaaactcggtttttgccggacctattagacggtgcaagccccggtaatactgccaaggctgccccccttttttgaagaaatttttgtttgttttcaaaagacatgaaagcatgtttcctagggtttttggggtcgctgatcaagaatccggcatcaatttcgaccaatttcgaaccccggacttgaatttgaacaaaagttcgataattcaaattttttgtatttttagttcaaaaccggctaaatacgcggaatcaatcaggaactcattaatacttcaataaaacattatataaaccattttggatctaaaatctgaaattcgaaaaatttgaattttcgactttttattcgggttcgggtccggggttcatgccggattcgtgattagcgaccctgaaaaccattggaagcatgttttcatgacttttgaaaacaaaaataaaattcttcaaaaaggggggcaaccatcggcagtattacccaagccccgccctagccttaaatatgttttgtccaatttataaatttagtcttttcatgaataatcaaatgaggacttttcgatcttccaaatatttttctcggttctcttgacttatacggtgtgaagaaaattgggcatttttaattaatttatttatttttaatggcatttcagtaccaacgaaaaatggataaacaaaatgaagtaaattttcgcaaaagggagcatgatttgaatcggttcaaaaaacggtttatacttgtcggatcaacttcccccacccctagatcgatctgtctcaacgagagctatcgattggtaccatattcttcgagattggtccacgagaaaaaaacaccgtataagtcaagatattcaaaatttggaaaaatatgaattttttaataattcaacactcttaaaagtgatcgaattcaaaaaatcaacataaagccaatttttctgcacattgaatcattatgtattggagtaatttgctggcgatggtcacttttaaatattagttaatgaggggaaggcataaaattacggcaaaacaatgacccaaaaaaggtgagtaataaaaataattatttttcgtaatttttattgtgcaaaacgtttatcggaagatggatggatttctcacaaaagagagttaaaatatgcaaatcaaaatcaaagaattaaatgacgaaaaggaaggaaaataaaaaagatatgaattaaaaaaaaattaaatttgttagcccgatcaaagtcaattacggtttttgctcttcataattttacaaaattttgatattatgcagatttaaattataatcataaatcattttacacatggtatgtgtccttgcacgtacttgctgctcaagtacataaacaaaccctttttgacaatatgtaaaataaggacaccccattttcgggcgtttgaccacttcccgtgaaccaaccgagtcggaatcttaanaaatatacttaacattctgctgaaaatat

SEQ ID NO: 4135 - DNA, 2835 bp, Heterodera glycines
cttatacttttctagatcgctgttgacattgctttgtttttttccccagacaattaggaaaggttacatcaattggaagtaaagtggtccacatgctgaagtcgttgctccaaccctttgacgacgacgtggaggaggacagcgaagaggattcgcatttggcagcaatcattgacacggcccaagtgattgcttttgattgtgagggctcacgggcgaggagtgtcctttttgtgtggcaatgttactaaagaatattttcaagaaacttgccgaccgtcaactgtctactgagggggaagacccttccgtcgggactgttgaccgcgcggcgaagccggcctggaaacggctcaagtcgcaactcggccgctccattgcgcgccgttttgaacgccgttgcaaatacatttacgccagttcggtggagtcgtgccacaaacggctgcaacaatcgcaggtgttagtcccgccgagcatgaagtttcgctgctaatttttgtttgtctgtttcaaaaagagtctaagctgggacgataattacgagataatacggtacatgtggagatgcttaaatgagaaaaaaagtgaagaggcatttgataatataatggagcaaattggtgaactttggccatgggaataaatggactttaccaaattattaggaaaaatatcaattgtgatgaacgttgttaaaataatgttgaaaactgttaatgatttgtcagtgtttaaatcagtaattttcctgctctacaaacaaaaaaatcaaccaacgtaattggtaccgaattggcactataaggtatgaatcggttcaaaaaacggtttaaacttgtcggatcaacttccccccacccctagatcgatctgtctcaacgagagctatcgattggtaccatattcttcgagattggtccacgagaaaaaaacaccgtataagtcaagatattctttttctcaatcttccagatattttctccaaattcttctgttgtttttgttcgatggcctttccctacacaattattcatgcgcaagctgatgtatgtttaaattacatatttttgcattgtttatggtcaattagtcaatttaaagtatttatttatatctttcaagttttacctgtacctattatttttgacaataatttattttcagaaaatccaattggcccttttccttttcccccactaatccttttttgcccactgctaatgaaaataaccaacattaaaaacaaacttcccctcgaactcaacgatgaactgcttcattttgtccccgagtttttttgccgaagggttttggttcgctccaacttttcatttttttgtttggtccaacggagtaaaagagcaaaacattggaaacacaaagtacaaaaaaatgggaaaaatggcacatgaaatgccgataaactgctgctaaatgtaattaaatgtgcgattcattttaggacatcaatgcacaggaggagcagaccacgtacggattcggggacaccatttaccgcccgttagtcccgcggcttgagactcatcgcgtgttgacttcctttgtcggcaatctttgtgcgcccaaccattttttccgaccagaccacaacagcggccgtttctgtgtggtgtctatcaacacgcatgaagctaacgtaattataaaattaaaatgtgattaaccgataaactgaattttaattatatatttcattcagccccttggtagttacaaaaatggaaaatgagttgacacagccaacaaaataaaatgtcttttctctacagaatttcgaaatgtttttcgtagtcaatttcatgttagcgttccccgaattctccattccctctgctgaaatggtttaaattggcaaaatgggcaccatcataatcaataattaagaataatattttcttattcgatattcagagagagatggtccgcactttctttcacgacaacgaggctgggttcaccaaaaaatattatttctgcgaactgcaattttttcctatcaatgaattggtaaatggaatttcggcgtttttcgcaaaacttcatttgtccattttgaccaattccggacaccggatccgaactcgaacaaaaagccgaaattcaaatttttcgagtttcagaaattgaaaaatttgaatttcggctttttgttagagttcggacccggtcttcgtaattttatacaaaattttcaggatttagaatcacacaatgaaacaagacaattttgttgaattaaattgaaatatccccttttcagccttgggacgttgccgtgttgaagttgtacgcagaaaccatgggaaatatttgggaccccctttttacgtacctggacgaagtcatcacttcagtgagtctatcatttacagcaaatagttggcattattttataattgacataaataagcaaagtgtacaatcctttattttccaaaataatcaatcagtcttattttatttaacatttagctggagaatggtgacatgccgccgtacatttccgaatcatcgccaaataattcggccaattcactcgagaatctcccgtcggttgaggcaccgcaatcggatgattagttggagtgaagacttttctggcatttctgttccttcaccaaaatgcctttgttgttgttgttggcataataaacaatgaattctccctcgtggattttttttcctctgctcgggttcattatctctcaacattacattaaatgttagcagctatttttttgggactttatctgtgtccagattaaaaaaaaaaaaaaattgggataaaaaaatcattgttcagcaaaattc

SEQ ID NO: 4136 - DNA, 985 bp, Heterodera glycines
  misc_feature (75)..(75): n is a, c, g, or t
aaaaaagaacccattttagggttttgctttttgagtaccaaacaaaggaggcggccaacgcagttttgcccattngcgatggacatcgccttgacaaaaaccacactttctcagcgtatccattcaccgctattcgaagcatgaaggagccggaaaaggactggaagaaaccggagagacaaccttatgtcgatttggtaaattaaagtgaattagaggaatttggccgacgacatttattgcccttcataatattaatgctaatttgttaagggtgacccatggtcttggctgcaaaaccccaagtgtttggatcagttcggtctcctctatgaatcgggccagggtggcactctccgtttggatgtgttttggaacgtcagaaatggcgagccaacgcccgtggacaatgcttctcgagaagtaattctgagtttcaaaattttcgagggccaattatgttcagaattggtccaatgaccttttcaaatggtctccccatgggacttatttggccacgatgaacaatgacaagcggaatcagcgactcggagccgtaatttggggcggcgaaaagttcgacagatttcaacgcttttcccacgagggcgtcaattaccttgacttttcgccaaatgagaagtgagtaattagttgtttcttttttgcgttatcgttcctttaatcgaatgtttttttcgatttgttttacccttttattttgcttttcttcagatttcttgttacttatgcttgcgatcagaacagcactcgtgataatgagaattgcttgcgcattttcgaggtgttcactggcgaactgaagaaggccttttcgccctctctgcgctccgctggccgtctccatgattggccctttctgaaatggtcacacgacgagaaattctttgcattttgccgtctccgtggcaattgcgtgaataactgtagcacggatgacttcatgctttgtgagaacaaagca

SEQ ID NO: 4137 - DNA, 1221 bp, Heterodera glycines
tgcaaacacgagagtataaccccaggcgcttccacgctctctctatgcgcatccgtacaacaacgggcaaaactgtggctgcactgtgtcttccaatcggcgcgtgtggtcctcaccggagtgtccaacccaagcagtgcaaataaaatggcggcacgcgttttgcgtcgcatccaacacacacagagcatcacactgggcatccaccagctgcgtgtggtcaacattgtcggtgttcagacctttccccagcgaatcagtgtggagcgacttcaaaacacgctgggtggcatctatgacccaacaattttcccagcccttcgttgtaaattgttgaatggagtcacgtgcctagtttatatttcggggaaggtcatcgtcactggggcaaagtctcttgatattttgcaccagtcatttaccaatttatcaaatattgtaccaaagtattttcgggcgtaatttattcctcacattattttttacaaatttaaacataaacaataaatatcaaattaaaggaaatattacaaaaaaaaatttaaaaaatattatcaaatcacaataaatcataacatcagaaccacccagagtgtccgggctgtgtgggatcttgctccacaaaatttctctttcgtcgatgcgtccgttgtccttcgttcggctgaccatcatcctccacatagccaaaggggcgcgtctgcatcccaggccgaacgcgccccttggcatagaagggtctgtagtctttgtgggcctcatgcgtgtagagatcggcgtacacattgcgatcaatttgcgggaagttgacgcgtatggcacgatgttcgccgcctccgtacacgtaaaggtcgtcattgtccaaggcatcatcgctaaaattcaatttttaatattatgtaaaagaataatatgttaaaaactcacattgggccgtcaatgttgtaagtggccagcgtcaggtctttcatcgcctcaaaggtgagcagctgttgcgcagtgtaggacagtcggaagctgcggatcttgaggttggcgcgctcgtccgtcccgtcccgagcggtgtgccggatgccgtagttcttggggccacccgcaacgaactcgacgatccgtcggtcggtgagctcgcgcttcatctgccccagcgcctcgccctctgctaacacacggacccaccctcttgttgacgtagtagatggagtcggtatctaaaacata

SEQ ID NO: 4138 - DNA, 5056 bp, Heterodera glycines
catgtagtcgtaaagatgaagccggccgtacgaggtgacgaaggctgccactggaaggcagttggtcggtggtgccctggcgaattccggtcgcttccgcacaacacagcggtccatgtgttcagagacgtggacaaagtccaacttgtccagcgttgggtcgtcgaggagcgcgtggaattcggccggggtccgcgtgtagcgaatctccgtctggcccacgcgctgcgcaagctttcccctgtggatgtcattttttttaaattaagcccccaaaatatttaccacaatgagttggccaatgttttggcgatgaggcgcaggccggggttgaactccattttggtggagtccaatcggatgccttccgtccgctcgaaatcgtccacaaatgcctggcgctgctcatgcgtggcacatccttctggccagcccgtcgcctgcaccttcagcccgacgaaggtgttgacgtagctgctgaacagcgtgccgtcccactcttcatagtcccagacctaatttgtgttttcgtgcacaaaattttttaatgagtgactacctcaaataggtcggtgaccacatagccaagctggagcgccttgttcagctcgacgtgcgtgtaggcggtcacccacgagcgcttgtcatcttcatgtcggcacggccgctgctgccgacggtcagcgcaccacgcacacaaaggaaaggtgaatcgcccgtcctttgtgcggtagccgagcaacggcacccggatgttgcgtggggcaagcacccggacgagcagcaacccacggaagatgttgtttttgggtgctgtccacgggagcggtgtcgttggcggacggagcagcacctcgcgcgtcaggacccgtgggttgccgacggggaagcggttgaccttctgcttttcatcatgaatatgcgcatgttttaaaagaaaaaaccgaccatcacgtatgggtagaggctgacaatgtcaatgcacaatatctcctcgtcgtcactgcacacgtggtgcagcttgaacggttcagtgcgccctcccctcagtgcgtcgttgcgcgggtccagcgggcaagggacgaacacggcatcgtaacggcgtttcaggtccgggtcgtgacggagccgctccgtccactggcaggcccacaccttgtggatttcgcagccgtggtcattctctagctcaaagaggcgccgctccgtccgttcgtacagatcttccgctgtccgccctgccgccaattgttgctgccgatcgggaaagcacacgggacagcctcaattttaagatattttgtatacgagaaaaatccgtttaccgtgaaaatagcatccaagccattcaatggccaggggacggagaggcgcttctcgtcgccaaagtccgtccacgcggtagccgctgtcatcaatgtgcgcctctccgactgaccagctggcgcattgcacttgcgcctccgggtgctccagctcgaagaagcggatgtagcgctgcgattctgccgaagcacggcgtccgcgcaggtatccgccctcgggtgagtgaaccagacgattggcgggcaggaaacagcggcgaaaagttgccagcgcaagaccagcagctgttgacgcgtggaggaatgggtcgaggccttgagtgttgtcggcgatgagttggcggaatcggatgaccgactccctcaaaatggccacgtcgttgacgcagtacattatgagctgctcgcgtagctggaatccattgccgttgttgttggcgtgtcaacggagaaattgcgcccgtttctctgccttcatcgtgtccggtgcgtagaactcttgagccggtagaccgttgaggcgctgcgacagatgttgtcgtcgtatgtagagatacggaaaaaagggcttcaacgtcgccagatggtccggcacttggaagctcttcaccaacgcgtccaaggcacaaaaaaagtagttgatggaatccttaaaggtgattcgtctttggttacgcccggacagacgcatcgagtagatcttcaatccggtggtgcacagatgcttgggtggacggtttcggcggtgtagtgcttcaagtacgagatggaaatcgtactttccaccgttgtgggcgatgcacaccgtgtgtgccttctttgggccatgctgcagcaaaaaatccaaaaattggtccactgggtcgttgccgtcgttgtcaaacgaatggaagaagaagcggcgctggttgaacgctggtgctccaactggcgaagcgctgttgtctcccggtgcattggcaaagggtggcgaagaccactggcgaaacagttgacctctcaccattcctgtcatgcagacgcagccaggagcccgtcttccaaggccatcgttcacgctgatgccagcctgcagacaacgttcgcagatgacttcggcgacgatgagcagcggcacgtgcttctggacagtgcggttgttcagctgtaatggcatatcctgtgacgtctcagcgtcaaagaagcacagacgaagcggcaattcttcatcgtcctcgtcgtcgtcaaaatcgtcgttgtcaacagcaatcgatgcacgttgtcggactgagccgtcgtcaatgggctggatgtagcaaggctcatcgacggtgtggggcccattgcagcgtcgacagattccatcgtcggctggctggtcatgtgggcactgatgtgtggccacgtaggcgatacgtccacacgcacgacacacccggcgccattgacagatgggccgacgttgtcgctgaccacgaccgtccatcggagctggagcgtggttgctgagatggtagtcgtagcacccaccatttgggaagatgaacagacaatcagcgcattttcgagcactacttccaccattcggtagcttaattgggttttttgctattgtttttgtagttttttttaaccttaatctacctgttcagtttggcatggataaccaggtccataccgcaaacaaaggcggcatacaactttgcatccgaacgcgtggtagcgcgcgtcggccctccgctcgcagtcgatgcagtagttgggcacatcaaacagctgctcaacacggccaatatagttgaagtgtccacgctccaacacaaggcaaaggttgaatttcgccgccaatcttcaattaactaatttacccaaaacaagaaaagaaacaaaaaaactcacccatctcctttgaatacaatgcggtattcctgctccttttcaaacaccgccaggcgaatttggcctacaccatgttgattgttgagccactgctggagacgttgtacatcgtccagcgtgtacatgtccctgttcgcagcaatgccggcacgagtcagcatctgcgctgctgccggaccgtgttggtcttgacgactggcgaacaggttgaatgccgctttgccgccaccgccagccattcgtgtctcacggtcatgctccccaagagaacggcaagcgcaaggcagagccggtcgttggggttgtgaatccggacaagtgactgcacgttgctggaaacatggtgctccacgtcacggtcacaggctcctatttttttaaccaaaatgtgttaatgaaataagaatggcattcacctcccctttggggatcagcacgaatggagtcaaggggccagaccgccaagactttgatgactgttgttccggcaaggagatcaatgccggctgccgactgctcattgaaccgctcgatagctgccgccaatgccgctgcgttgttttgctccggcggacgaagcccgatgacatatggacgatcaaatcccggcgggtggagctgtagtccgaccatccatgggcgcgggtgaccagccagcacacggtcgaggagttgctggatgtggcctccatcaaaagatcggactgctgcgcttcctccagcgccaggaagcgcagttcacaaatctctccacgtgtgttgcgtggcacgttccgcatggctgttgagcgctcaatgacaaagcactcgccaatttggcggccagccttgaaaagcattacaatgaaaaaaatttattcaaggcaaaataaatttacaaacggggcagctacggctgattctcagccaagggacaatacaagaagtatggaaaatgtgaaaacaatggagaagtggccccctccccaatcacaaaggagcacatgcaaattgggcagtcaaggaatttttcaatatgaatgggtgaaatgtcaaaattcagcagcacgtctttgtgttgatcgcgcaccagcagtacgactcgcacaattcaacgcggtggccgtcacccgtgcgaagcacacagttggtcacggcaagtgggccagctggcgtcggctgctcagggcgatggtcaatcgaaacgacgatcaggtacagcggtctaaaaatactcgcgcacaatttaattatcgatttgcaacttaaacttacggcaatggctgacccaatgcagaaacgcagccattcaaaaattgaaggttgttcgtgccggccgcacagaaaggctcctgaaaaggcagtttaaaaaaatttaatatgtaaaacagaagaaagcaccgccaattgctgatgtgccccgttgacgagcattggttgcaccaactgggcaacctttaaataattgaaattatttctttatttattttttaattatgacttggccaaagggcggcatttgccccaaaacagttggtatttgttgggccataacaactagccgctctgagggcatgcgttgctctattgaaagccaagcctatcctgtcgagttgtaggcagtaacggtgtagacagtccaggttgttagtgcagtagcagctgacgaaaaatgcgtgtctggatgttcgtgcagcagcagctaccggaagacagctgagcctagttgttaaaaaggaaaagaaaagggaaagtgaaaagttaagggaaaagaaatggaaatggaaaagaaacggaaaaggaaaaagaaagggaaagggaaaaggaaataatgtaaacaattttttttatgatgggtgtttcctggggggggg

SEQ ID NO: 4139 - DNA, 2457 bp, Heterodera glycines
tttgaaatttggacactttgtccgcgggtagtcatgttgtctggccaagtgggacactttgtctgacctactcgggcactttgtccaaaaattttttaatctcatttaagcacgttggcaccacatttcacatccaatggcacctctaatgcaccggcccccatccaaatccaccccattttaccagttttccggacaaatgacctactcaaccttgagcaaaaaacgcaaatttttttttaaatgttcgcctcggcgagctctacaatatagtacaacagcgccgcgcctcccacttcaacaaaccacacttttccccggctctaacttttttagacccccaaccaccccaggggctaaagggggtccgggcacttaacttggtgctggcgccacaaatttttttttaaaagacgcgccatcccaagacgcatctttttcacctcttcgccgatccgctccggatttgataaacccatgcaaaaggcgaaaaaccgccaaaattttttcaccaaattcattcaactaagtgtaaaaaaaaattttttgcttaaaacgaaaaagttgcacggttcaaaagtttctaaattagatcctctttcatttaaaaaaaatttcatcccgctagccctatgggaagtgcacccgcttcccttttgaagtttggcaccaccccttatttttatttgttgggccataacaataaagtagaatttaaaattttgctataaaaaaaataagcaatataatagaaaatagttatggaaatttgtttttttatttatttttttagctttaaaatttctatttattattcatggcttttcgttagcttttatttttaatattcgcctgcttttattttcttagctttaaaaaattttttgatggcttttcgtttgcctttttaaactttttttagctttaaaatttctatttattattcatggtttttcgtttgcttttcttttttccctacttttcttagcttaaaatttctttttgatttcatggcttttcgtttgcttttcttcttaaccttcttttcctttcttagcttaaaatttcttttttcatggcttttcgtgtgcttttctttttttcatacttctcttagcttttaaagatttttttttcaggtttttcgtttgtttttcttcttaatctgcttttcttttcttagcttaaaatttctttttgatttcatggcttttcgtttgcttttcttcttaaccttcttttcttttcttagctataaaatttctttttaatggcttttcgtgtgctttctttttaatactgcgcttcttttcttttcttacctttaaaatttctatttatttttcatgtcctttcattgcttggctttttcgcttgcttttcgattttcgcctgcttttcttttcttagcttaaaactttttttaaaatttataatggcttttcgtttcattgcttggcttttttcattcgcgcagcttttcttttcatagctttaaaaaaaaatttcattttcatggcttttcgtttccttttttttaatactcgcctgcttttattttcttagcttataatttcttttctatttttcttggcttttcgtttgattgattggctttttgttttttttgcttttcttttctttgttagattaattaattaaataatttgttagtgagttataataaactgttcggtccccgaaatgtcgaatggacgaacaaataaataatttatttaagacaattaaaataataaataaaatagtcggaggacggcggaggagagcaaattgggaaatgtgaacacaattataaaactgactgaatgaaatgaggggagggcaaatggtcacaaatacaatcaatagaatgtgtctgacagtgaaaggtcagacacaacaaataacaacaaatgaaatgagtgaatgtgtctgactgggaatggtcagacacaacaaataaatggaaatgaaacaaattaaataaataaatgtcttatcgggttccacccgaacaaatttgttcagtccccgaaatgtcgaatggacgaacaaataaataatttattgaagacaaattaaaataacaaataaataagtcggaggacggcggaggagagcaattggaaaatgtgaacacaaaaatcatgaactgaatgaatgaaatgaggggagggcaaatggtcacaaatacaatcaatagaatgtgtctgacagtgaaaggtcagacacaacaaataacaacaaatgaaatgagtgaatgtgtctgactgggaatggtcagacacaacaaataaatggaaatgaaacaaattaaataaataaatgtcttatcgggttccacccgaacataaacaaaattaatgaacaaatataaaaatattgaacgggacaaataaataaaacggataataaaacaatatgaagtggagaaaatggaaatgaaaatgatgggtt

SEQ ID NO: 4140 - DNA, 1089 bp, Heterodera glycines
  misc_feature (1046)..(1046): n is a, c, g, or t
aaactaacaaataagcaatatttaatatagaaatatttaaaattgaattataaatcatattttataaaatttcaattaattgtttcactgctgaatggcagtcgggagtagaatctcggcaattccaatcggtcgagaaccgatcggggcacctccttcagcagctgatcagtgagcctttccacctccattttgtccaattccgaatcggattcgagcgcaaatattttctccatcaaatcgcgtggcaataaaaaatccttttttaaaaaattaaaattatttaatgccattttatattggcacaaaaaaaacaattacccatttcctctgcacaaaagaaaaggccactaattgatcaattgcaattaaaaggaaaaggacaaattttaatggacaaaacaaagacattttgggggcgaactgttttaatgacaaaatgaccaatttttgtctcggtatttaagcattttggtggacaagcagctcatttgatgggtacatcgttggccaattgatgagaaatggccaaaaaaatatggcagtggcatctgcgcaaataaaattgatggcgctccaaccacaaaatcattccgtcttcattttgtacagaattttatttttggacaagaaaaaattgcttgtgattttcacaaaaatgaataaatgacccagagaagctttttcattttttgttggcagtgaatttaattgaacaaaaatatgtaaataattaattaattaatggacgcattaataaattgtgctcaaagcctttttaagaaaaataaaaatcacacaaattttggtacttgtcccttttgatgtttgtaactcacaattcggacaatttttggcattttttaaaggttcaaagccattttttgtgagttttaaggcatattttagtgcatatttagaaactttcagaatttttaggcgtttttgagggatttttagtgcatagttggcattttttaaatgcattcaacttataatcctgcctgataaccttgtatgatgaaaagcacctataaaatcttggntgttttatatttttcacttcagattcttgattagcgcctaaaa

SEQ ID NO: 4141 - DNA, 2332 bp, Heterodera glycines
ataataaaattattatttaaactatgcgcataaaaaactaacaataaaaaaaagtgaaatgcatcaaaactttagcatctgtttttgtttttattctttagcatgctctgcaaatttcttgcaaaaaggcgaggagcaaaagcaccaaaatgaccatgccgaaaatgaccaatggggcgaaacgccttctgcgccgctgttgctttttcagcttctcttaacaaatgataataataataataatatattgtaatggcatttttttaattaaatttttaaatagtaatctaacggcacatattctacaatacttacacataatgatgatagtacaaaaaaataaaataaataaatattctttaaactttccccataaataacacaattcgggaacccgtaaatctcttagagatggacgtgccaagggacctggcggatgtttgtgccgggacgtgcggacgtgttttcggtaaaataccgttaaaatcattgcattgcataaaggttggaaaagaatttaaaaattactcactaattatatacaaaaaaaatgaaaaataaaagagagagtcctttgccatgatcccctgctgctggtcgtaatctgttgtcaaatcagtgataatcaccaaaattagtattgaaataatgactgaaataatcagagaaaaattaattgttttatgtattcaaatatttaacaaattgggttggtcagaaatcattaccctaattagttagtgcagagcaaccaatagtcaggcccggaatttaatggacgtctctaatttcatgatttttcgtgtcttatttatacagctccagtggcaccaccaatgcaacgccccgcagacagaagacccgactcccgtcaacgaaaatgggccagaaccgaaggatgccacagtgaagacgtttcaaaatcaacgcaggttgacaagacaaacctccaaaacgaaatcccaaattcactccccaaaattgacaattttatatcctccaactgcaatcttttcaaaaacaattcacccattgattcaataaatagttctgcagacctccaacaacatcataaaaattttgccagatcaaacttctcttaccaaaattttcctcaaaaacaaacttctttcaactcataaaaaccaaatttcccgttgccactgcttcacaaatggaaatgcttctcaaaatcccattggaccgggtgctaggtcgttctttaaaaaaccatcattatgatttgatgaaaaattatttataactaattcttgatatcattcgatagcccttagtgttctctatcagtctacaaaatttcaaaaaatttcatcaagtttcaaaaaagtcaaagatgctcgaaaaatgctcaaaaaaacaagatttttgagttcctctagccataacttttttgagacataacgaaattttttgaaattttgtagacttatagaaaacacttagtgctatcgaatgatatcaagaattaaaaatttggttgcttttgagctaagttgtaaataatttttcatcaaatcataatgatggttttttaaaaaacgactccgccccatttgaccgcacttcttatttccaaatgtcatcgtatttcactattacccatttgacctgatttccatcaaaagtgtaagaggcagcttggttattttatttttgaaaataaataaataaaaaataaccaatttgagcattttcttagccaaacttattaaagttcccgtctaaaaaattatattaatgcaaaataaagcgaatttatttaaaattagcataaaaaaattaaattcttttgaaaagataccaaaaaaactaaataaaatatttagacttctttacttttttttttataaatgattattgtgtgcaatattttacataaaataaataagttgaaaataaataaacaaaaattttaattgaaataaacaatattattatttgtagcatcagcagcagaaagccatcatacattcacaacgaaaaaagtttcattttgatgaggttcccattttttgcgcattttttggcacattgaacaatcatcgcctaattcgtacactttttgccacatttgatcaatcatcgtgcctatttaatgtttgatccactctaaatgccttaatccatttatccacaccaattatttttcaacctaattcctgggtttattttttttaatttggtgtccagttttccgcttggtgtccaatttaccggtccccattttactcggcgattaatacattgaaaatgcattaatcaaatcaaaatgcttctgcaggaaaatccaaaaataaaggttctgatcttt

SEQ ID NO: 4142 - DNA, 3212 bp, Heterodera glycines
tataaataagacacgaaaaatcatgaaattagagacgtccattaaattccgggcctgactattggttgctctgcactaactaattagggtaatgatttctgaccaacccaatttgttaaatatttgaatacataaaacaattaatttttctctcattatttcaatactaattttggtggttagcactggtttgacatctcatattccgaacggaggatcattgcaaaggtctcctctctctaattttttattttttgtatctacgtaaataataaataatttatgattttcttaaatttttatttttgtatctaaatagtgaataatttttaaatacttatgcgcaatgtaatgagtttccttcacatgccccttgcctttttccgcctgcttccgccattttttttataaaattaaaaatgccaacaaaatttccatgattaaaaaaacgatgccaaatcaaaatgtgcgtccaacagtgccatcaattttggcgcgtggtggggggggggggggcgggaagcactacaaaacacataaataggagtgcatttcttatcgaaatataaatcagtaatatccataaattttgggtaaacatttatttacgggaattaatagtaaattaataattttaaaatttaaacaatttttaatcatttagcttctaaaaaataaaatgttggcactttgccgcttccttttcccattggatttgggttttttatttttgatcatttttccaattgttaacgctgagcagcagcagcagaatctgtggagtggcttttaccaaaattttgcgctcgaattgccccaagaggagcgatcggacgacactttggcactgtttgccgagatggacgaggtcgacacggtgttgaccgatggaattggcgcagcaattatggcaccgccgagcccagcacacccggcattccaggcaatttgagctaattgacttacaagataaaactgaaacgagtgctaaaatttcgcggaaaattcatttaatggtccattagcagcaattatatttgttccaaatgcctcttacagaaattctatttggacaagaaaagtgtcgaaaagtcggactatcgaacggacgacaatgccggcaaaagcgacgcacaaaatgccagaagtgaaagcagtggggacgtgaagaagcacaagaaaaagccatggcaacggctgcgctcactgtttgccagggcacggctgctaaagcggacggcacgcatcatgcaggtgtaccaacggctgaaggacagtcccggcgggtggggccaactcgtgcgcaaaatgtacaacgaaatgattgtggccaagcggacgggggccggggatgccaaactgttgcgtgagaactctcaacgggctctccaactgttacaacatggcgagtcaggagcagaagggaaagcagttcctggggtaggacaacgcgtcgccgtcgcacacattgagccattccgcgacttttggtcgcttgtgaaaagttcggcacaaacgctgttggcactgttcaaagggccatttgacggcgcagagaatgtcgccgacggggggaaaagcggcagcggcaaaagcatcggagaaagacaaatggcgaccacagaacaatttgtgcgcgtgctgaaaacatttgcagcggaggagaacgaggagggcacaattttcacaagaagtattgtgcttaaaggaggcgaaacggagggtataaaatttcgtataaaattcgaaaaccggaattttttactcctcacccaggcccggacttagactattaccggtactgggccgcctgattaaaaaaagcccgttttaccctggcagcccggccaaagtttttgacctggcgcccgccgggctcgggcttattttaaaattttcaaatatttctttaaaaatttaaatttttcttaatcccaagctaattattagtgataaccttttcacgattttaacattaaagcctacttttttgtaaacattgcaacaaaaaatagttattcttcatttttgaaggaagaacaataaattatctttggtaataataaatttgttattttaattcacggctttggtgacaaatttgaattgacgatatatgcggctggaaaatttttaaatattttggcaacaaatttattaataaatttgtgccaaaaattgtcacttatggaattgaacctgtcccatgacaacgggcttagataattgtccgggaccgggccgctcagtagccaggagattccggtattttaccgaaaaacgagtccgagcgtcccggcaaaagtcctccaggccattaatcactatgtagcgccggtagataattaaaaatgccattacaatatattattattattatcatttgttaagagaagctgaaaaggcaacagcgccgccgaaagcgttttgccccattaatcgttttttgcatggtcattttggtgcttttgctcctcgcctttttgcaagaaatttgcagagcatgctaaagaaagaaaacaaaaacagatgctaaagtttggatgcttttccctttttttgttagttttttatgcgctagtttaaataataattttattatttgtatttctttttcaattttatcacatttaattatttgaaattttgataccttttacgttatgtcacaaaccccttaaaatgttatgatccagaaaaactaaaaaattgtgtgatttttatttcttcttaacaaaaatttgagcacaatttattgtccattcattaattaattatttacttatttttgttcaattaatgaaaaatggaaacgaaatggcaaaaaaaaaaaaataattttttgacgaaaaatgacaaaaatttttgtaaaatatacgccaccctaattcagaatttcaaaaaacaaaaaatacaccactaaaaatcgaattcttggtatcattcggtagccctaagtatcctcaattagccttaaaaattgcgacaaattttgtcaattttgaacaaatatggccaaaattacatccgtaaccaggatttcagtcactattgtaacttttttgtaacttaacgaaatttttcgcaattttgctggatacgagaggatccttagggctattgaatgatatcaagaaagttggatttggttgacaatgaaaaaagttatagttcaaaaactgggctggcgatgaaaacgaccctaccctaaa

SEQ ID NO: 4143 - DNA, 1483 bp, Heterodera glycines
  misc_feature (13)..(13): n is a, c, g, or t
  misc_feature (17)..(17): n is a, c, g, or t
aaaaaagttattncagnaattctggaaattttagatttttcagaaaaaaattcagactccctttctgaaaagtcattctgtaaaagtaaaatactacaaaaatccgcaatttttttctctataatataaattttattttacatttttatctcttttttgcgaattgttataaaaataaaagtgatttttggtttcgggaccataggggggtgaccaggatttttgggtggaaaaattttttcaccgaaaatattccaaaaacatgtctttaggggtattttatgacgctgatcacgaatacgtgatcatattttacttttgacatcgttcagacctcagaatccctgtgtgattggggattctgaggcatcattttgaggggggggggaagttcggatccgggcggtgtacattattttctatgcatttttgggttatttttaatgtttttaattcatttaaaagagtgtttgttttataataaaaaataaattttttaatttaaattaaattatttttttttatgaaaaattttattaaaattaattatttttttaattaaataatttcatatatttttttttatttgagtttttcagaaattaatttcatttcaattattataaacttcaaagtttttttaataataaaaagaggcatttattttacaatttttaaaaattattaatgcatttttgtacctcttctgccatttgttgtacctacttctctcttttaatcactgttgtacctcttctaggttggtaattaaaattagggatggtaattaaaatttttttaaataaataaaacaaatgtttatatttattgcaaaatcttctttttctttaaaagacaattaatttaaaccaaaacacattcatcctttaaattgatttacaattaacggttcccctcttaaaagaacaatggcattttactgagggttttgaatttttacgaaaattaaacttttcagtgttatttaaaaatttaacattgccaaaattgatcggcaaaaactgaatattttcagtatttgtttccaggcccaattgaaccctaataataatttaaaattaatttgatttttaatcaaataaattttatttattttccctgtgaacggagtgaagaaaatgcagagaaaagtgaaaaatatgagagaaatattgtacaaacagacagcgggagaaaggcgttctctgccctaattgtattgtaaaaaatggaggacgtggaagaaatattgatttttaaattttttgtagaaaaattattcgtcattacaattttagtcctacgcagggctggagcgcgcacagaaaaaaaccgcggccgcgcatcgcgcatcgcgcattcaaattgccgcggccgcgaccgcgcatcgcgcaaaaaaaaaaacgcggccgcgcaccgcgcatcgcgcattcaaattgccgccgccgcggaccgcgcatttaaaaacaaattttcaaaattt

SEQ ID NO: 4144 - DNA, 4260 bp, Heterodera glycines
  misc_feature (4044)..(4044): n is a, c, g, or t
aaaaacctacaatttcaaactttctttgctcgtttttcggaacaaacagtatgagtcgaggcctacgagtttcattttatgccctacaaatttctgttttatacctaatttaaaaatttagcatttccaccactcgcgctcttttcctcaactcgccgctgccgctgtgaacaatgggtcaacgcctccgccgccgccactcgcagcgccggtgccacagcgaccgcctcgccattgtcccacgccggcggtgccgccgccatcggtgcccacccagcgtccgccttcacgcccgtcggcgcctcagcgacaccgccaatgtgtgccaattcgttggcccagcacacccaattgttcaacaccggcgcaggccttggagcaatggcgacgaatgccgcgacaacgccgcatttaccgagccgacagcaaattggtagaaaatgccaaatttgggggttgttttcccgattttgttttggttttttccattcaaaaaatggttggggataaccaaattcaaattaaaatatgcaatttgtcgcgggggttaaaaagaaactgtttgtcttctacccattttttgtttgtttgtgtggtcccagaaaattggaaatttgccactggatttttggacatataggttatatacccttcaaatgttggattcttcccgatctcctaattttttgtgccgatttttttccgttatatcacaattcattttgacattttttcgccgttgcaccttcttacaattaacccattgttgacacaattaaatttgtcagttttcttttaattgcatgtattttgtagtacaaagacttggatcctgctgggtaaccgattcaaactatttcccaagaaatgaatgttaggaattccccgaaaattggcactcacaatcagctgctggcattgaattttgtttgccaataattctaccaaaattggtactcaaattgctgagacatttaaattttgtttttgccaattccttctccgccattccaatttttttttctccattcgggcaataaatgtgtgtaattatttccgtttgttcacacctccccccccccccccccctcagtgatgtcatcctcggctgctgccaatgcacaaatgagccatgccgccgccgccaacaataaccaccatcaattcgccccacacgctcccccgccggtgccggtgccaccacccactaatttgttggcaaatcctggcgcaccaccaccgccggcaccaccaatacaacaacagcagcagcagaacacgacaacaacggcacaagtgggagttttttttgaagaagaagaataaatgtttaattggattttgggcttacattttttaaatgcaaaaaaaacgatggggatgagtaattaagttttggggtcccaataacttttttttctacaaatcgcatcccaaaaaggcggtgaagctttggcgactaaacaaataccaaaatgaagcataaaaaagtgccgaaaatataggacaaaacggcatttcatccctcaatctgatccatccctcggcgcatgtctgtttccttaattctctttttaatcgcaggttcttccaccgtccgagttcaattcgttgtccaccgctcatcaacattcgcttgtcgccccacctgttgggcctccaaatttggcacttccaccacccgtcgagatggcacaccaccaacaaatggcaccgccactgaccgcggcactcggcttttccgccgtcacatcatcgtccatcatcggcggcgtcagtaacgggcaccaaacaactttcaaagaaaattttaaaaaaaatttgagaaaattggaaataaaatttaattagaattacatttttttttcaaaaaaaaaatcagaatgatgaagttccctcaactgaaaaattttaattgaaattataattttttttttgtaccaaatgccattgtacgaactgccattgaccctgtggttggacacaaaaaattaaaatttcgcaaggacataaactaaatttccaatgagtttctaggacaaacaagtggatgacagcagcgatggcaaagctggacaacaacaacatccacaatcggagggcgaggacgacgagcaacacaatttcaggcattgtgccgaaacctactcggatgaggagacagcgtcagcaaataatggtgagaaggcgtcagcgtttaatttaatgaaatttttttttgttttaatggaaaaattttttttttcttttaagaagatttttttattcattttattgcaatccctctccagaaataaataatttcggtcggcaaaaattaaaaaatttttccaaattcagtaaatttttttcttttaaaagttgccgagtattttagggttttttgttacgtaattttttgggatatgataactttgttatcactttttaaactatgtctgaaaaatgtaaactggtacaatttattcaattttttttttgtaaaaaatttttgttgctcaatcgcctttattcgaaaattttcttcttttttagtattccattattttattgattgctttcacaatttcagtttggtgggcaacgacgtttggatggacattttccccgtttttaaccatgctcaactggcctcaaatcggcgcccttttcaatgcgctggtgggcaaacattttgatggcaaaagcgaataggcgcccaaaaacattctcggtttcaaaaaccgctgcgaaataaaaaagttttcaaaattcagcaatttctttcttttaaaagttgccgggttttttagagtttttggttacttaattttttgggatatgataactttatctcagtttttaagctgtgtctaaaaaatgtaaactgctacaatttactcaataaaatagtcacaaatattatttttttctattttttctaaaatttttttgttactctatggccttttttaacaaaaaatttttttttagtattccattttttatgattgctttcagaatttcagcttgatgggcaacgacttttggatggacagttccacttttgaccatgctcaactcagtctcaaattggcactactttcgcactttcaatgcgctggtggacaaacattttgatggcaataaaaattaaacgcagtgagttccaacccttattactggtggaatgtaaatttttttataatttgccaatgaaagtttctgctttcgaatgtttttcatattttagtatttgttagaatattaaacatccaaaaaactgaattaaaaagagcgccgaaaaaaagttttggattgattttttgatttgatttttcaaatattattatgattttttatggcaaaatgattttgaatattcatctggcagctatgattttatactaataatttatcaatgcatcttatatacgaaacaaagcagagactttccatccgtcttaagacattgaaaaattttcagagttctatttattttaaattataccttgctatatataggaatagtttttctgtcccaaatctgaggatggaatagataataaatataatatagcagaggtacgccttaagttctttcctagaataatcaagaacaattaaaactgccaaattgaaaaaataataatttttgcaaattcttggcatttttaattgttcagtcctttattaattcccaatattgacatttatatttgattttttgcaaatatggttcgctgacttaaaaccgattttgggattcgggaccaaaggggtgagcataggatttttgagtggaaaaattttttcaccaaaaatcttcaaaaaatatgtctttttagggtttttgcttatttgctgattttttatgttagaaaatcacatacatttttaccaactccagctagacagatttatttacctttttcatgtaaaaatagtaactttttttagggttttcgttaatcatatttttgtattttataaagtatttcgttactttttcagcacataagcaacgacgtttggatggaaattttcctttttttgaccatgctncactcggcctcaaattggactgctttcgcccgtttcgattagctggtggaccaatattttgatgaaaaagcaaaatgactgtgggccacaaatcgaaaagactaactaaaatgcggaaagtatttaaagttttctcggttctaaaaatggccccaaaaataaaaaaatcaaaaattcaaaatttttttgattttttttttgggtcggtttttttta

SEQ ID NO: 4145 - DNA, 2713 bp, Heterodera glycines
  misc_feature (37)..(37): n is a, c, g, or t
  misc_feature (42)..(42): n is a, c, g, or t
  misc_feature (50)..(50): n is a, c, g, or t
tgctctaaaaataaaaatttccaaatttggcaaattntaatntattttgntaaatgaatatggcacttctttcgccatgtttcgaactttggtggacaaacatttcgatggtaaaaagtgattgttttttatggtttttgttgttttttaatgattttgtgcaaaaaaggggcctccaatttcaaacactttagcctaaaagcaaaattcggtttttttgtaaatgtgaactattttagtgtttttgctttttttttgtaattttatattcttaagattttcagcaaccgccaaaatgtttggatggacattttcccactgttgaccgtcctcaactcggtttaaaattggcactgctttcgcccgtttcgatgttttagtggacaaatattttgatggcaaaaaaagtgattttttagggtttttaattaaggattttgtgcgaaaaggggcctccaatttcaaacgaattttgcttaaaagcaaaattcggttttttttgttgtaaaagtgaacctttttttttagggtttttgcttatttgctgattttttatgttagaaaatcacatacatttttaccaactccagctagacagatttatttacctttttcatgtaaaaatagtaactttttttagggttttcgttaatcatatttttgtattttataaaatatttcgttactttttcagcacataagcaacaacgtttggatggaaattttccttttttttgaccatgctcaactcggcctcaaattggcactgctttcgcccgtttcgattagctggtggacaaatattttgatgaaaaagcaaaatgactgtgggccacaaatcgaaaggactaacttaaatgtggtaagtatttagttttctcggttctatggcccgaaaaataaaaaaaattcaaaattcgtaattttttttgatttttttttgtgtcagtttttttagtgtcttattgttacgtatttttggatttaatgatttttaagctgggccttacatttatatttttccattatagtcataaatttctttgtttggcaattacatggcataaaaaatttttttggaaattttgtatgtttttgcatttttaatagaaaaatttttgtttcgtgtaaaattgctcagagtttcggtcaacaaatttttgtccaaccctattgcttccctttccgctaaattattaactttcataatttcagttggtgttcagcgatgtttggatgggcagtttcccactttttgaccgtcctcaactcggcctcaaattggcactgatttcgcaccgtttcgatgttttagtggacaaacatttcgatggacaaacgcgaattttttcaaatttcggtaagtcttttgtttttgctttttttgtaagtgattggttttttttgtttacttaattgaagtcgtaagtttcatttttttcaaaaaattgaaccttatgaatttaaaattggtctctaaaatcgcagaatttttaagtttctgtggcaaaatcataaattatttaagaaaaaaatcaattacaattagcagaaaccttgcttgattttaaattatcacgtaattatagaaactttaatttttagaaagtttttcattttaaaagataatttagcaattttttagtggaaaacccccataaagccagaaagacaaatatatttttactttttttcatttaaaagtaccaatttttttatgtttttgttaatcattttttaaaatttttttggattttaggagtttttcccttttttggcattgctcaacttggcttaaattagcaatgctttcgctcggtttcgatgcgttggtgaacaaacatttcaatggcaaaagcggattgctgcgcaagttttttttcacgaattaaccggttaaatatttttatgctctaattttttggatgcattcggcaattaaaaaattgaaattttcaaaattgtattttcaaacatgaaaatcaattattgtgaatttttgaaaatctcaacattgttgcggtgatgctgtttcaatcccgcaaactttttgtgagattaaaacaattctctcaggatattgctgtatttggccggttaaaatcaaattcatcgatttgaccatgatttgaataaaataagaaaaaattttcagatgcacatatatattaaattatggcaaagtgtacactaagtaaatagttttagtaacccaaatctgaggttacttatgaaataagtttcgtacactttggcacgcataagctccacaatagtatttaagaagcctttactcttgattaatatttaagtaaacatttttgttttaaaatatttgaacaatcatttgtaaaggcttctgtcctcttattcattttgagattcacattttttatttgtttcaaaatcttatcggtctgctttgcgaccatgatgagatttttgcacgtgccggtctgcttagcgaccatggcaacatatcggtcagcttagcgaccatgatatgtagtgcaaacgccggtctgctttgcgaccatggcgaggctggtctgctttgcgaccatagccaaccgtgtcggtctgctttgcgaccatgactacagtgcggtctgcttcgcgaccatggcacccatatcggtctgctttgcgaccatgatatggaaagcaagcccagacttgctctcgcctagagatgcatgtggctgggccgctc

SEQ ID NO: 4146 - DNA, 1709 bp, Heterodera glycines
  misc_feature (1644)..(1644): n is a, c, g, or t
atattcatttctgaattagaaaaggtacgtccaccccctttttctttgcgcatttctgtcttgggttatggcgacacttcttagggtccattttacgttcaatttttcttaataaacaaattttaatactaataaacacaaaaaatgaataaatgaagtatttacccatcaagttttgaaagaatcttgtcgacctcatctattttgtcgtcaggattagacggaagcatttgataagccaataaaaatgaagaatataaaataagatataaaattgcaaaaaagtttgataaaagcttttctcaaaaacagtgagatttttaaaggaggaaagtttcagcttttttaaatatttttttaacttggcaaaacgtctttttattttttttaacttctgacattttgatttgtcaaaaattcaaaaacgtatttacctagtttttttttgatttacttttcccttacttttcaaaggcttttacctgataaaataacataattttttttaaacttttagagtgaggatgccttcagaagtgggaatttcgaagcatctcgatttgttacgcaaagagcacgttcgattgcaggttcgccatgccgagttacaacggtcctacgacgctttggtagtgcattttcaatcaaacatttttataaaatgcacgaaaaatgtttttcagttatcagcgaactctttggggtgcgccgatggaattcgaagtgctcaaaatgtttccacttcaaattttatccacgcccttctgcacattgtcacccaactttacgacaaggatttgtacaggtcgttcattcttaagtcgcttatggactttgtttttttgtggatttagtgacattaccattcattttgatggtcatcaattgcgtgggcatcgaattgttatcgccgcaaggaccgacttttggggcgacctttcgacagttgaacgtttagagttgacgggtaaatttcaattgggcagcagagattgtctccactgatcttagccttttgaaatttcagaaatccccggcaaagtggcaaaagtgatgatgaaatggatgtacacaaacattttggacgaaagcatcggcgactccgtccttctgccgttgttggaagcggcactcaaataccattttgaggaccttaaaacgcggtaaatggtcgaaattatgaccaattatttattcatttaaattttttttatttcaaatttgatccaactattttaaaactcttttaatttctcttgaagctgtgaagagattctcattgtgcgcatcgatgtggaaaattgtgccaaggtttaccaatttgccgaattgcattcgctggacagaatccgcgacttttgtgccgaagtcgtttccgaccggtggagcgaatttacgcctgaacattttttggatatgccggcccaactgttgtaccgactgttgaagaggtgagtcctaccaacaacaaaaaatgtttgttttttttcctcaaaaatgcggcaataatttttttttttgtctttatttgaaaaaaattttaaggaaaagcggtgccaatttgctcggctctctgatccgactgcagcgcgaagatgtgctttttctgtttctgattgagaacgacgcacgggtaaaatgtgngaaaattcaagacaaatttaaaagcgaaaagcataattttccaggggaaaaggaattcctcttaa

SEQ ID NO: 4147 - DNA, 2986 bp, Heterodera glycines
  misc_feature (2961)..(2961): n is a, c, g, or t
cgttcattcttaagtcgcttatggactttgttttttcttttggatttagtgacattaccattcattttgatggtcatcctttgcgtgggcatcgaattgttatcgccgcaaggaccgacttttggggcgacctttcgacagttgaacgtttagagttgacgggtaaatttcaattgcgcagcagagattgtctccactgatcttagccttttgaaatttcagaaatccccggcaaagtggtaaaagtgatgatgaaatggatgtacacaaacattttggacgaaagcatcggcgactccgtccttctgccgttgttggaagcggcactcaaataccattttgaggaccttaaaacgcggtaaatggtcgaaattctgaccaattatttattcatttaaattttttttatttcaaatttgatcccactattttaaaactcttttaatttctcttgaagctgtgaagagattctcattgcgcgcatcgatgtggaaaattgtgccaaggtttaccaatttgccgaattgcattcgctggacagaatccgcgacttttgtgccgaagtcgtttccgaccggtggagcgactttacgcctgaacattttttggatatgccggcccaactgttgtaccgactgttgaagaggtgggtcctaccaacaacaaaaaatgtttttttttcctcaaaaatgcggcaataatttttttttgtctttattttgaaaaaaattttaaggaaaagcggtgccaatttgctcggctctctgatccgactgcagcgcgaagatgtgctttttctgtttctgattgagaacgacgcacgggtaaaatgtgggaaaattcaagacaaaatttaaaagcgaaaagccataattttccaagggaaaaggaaattcctcttaaaacaaattaattaatattaattggttttgttgttcagctgaagacaattctgaacgatttcgattgcgacggccaattgcctttgggcatcgcttttgagttgaagcaattgaaaatggccaaatgtttgcttacgcatggggccgatgtgaacaaattggacgaaaggggcaattcccttctttggaaagcgatcgaaaagggtaattacactaattaattaattattgccaactttatcttccaaatttaattttacgaatgccagcatttccagggaacgccgatgtgtgcgattttctgattgaaaatggtgccaatttgaattatgtgcacgaagagagcggagaaacacttttgcacgtgttggccaagagcaaagcgaagtcacaatggacaccaggagaacttaccaattttgatgtgaacgcattgaacagaaacggaaggtggtgattggggagcagctcgttttaaaaaaattattaacttcgaaatttttcaagaaaaaaatattaggttttttatatgaaaattcttcgaaaatttttttaatttaaatttctggggggtggggctgatacggggtggagaaacttggtgccgatgatttcatatggcatggatatgttgctgttctgtccgttttcacctcctcccaccattgtcagaagccctttgattgtcgcggttgaacatgaaaacattgccgtcattgacttacttctgcaacagctgcccaagttggacgtgaacatgcacgacaacgcgtcacggagtgcacttcaaattgctctcttggaacggcacaatttggaaattgccgaaaaattgcttgccatcgatgggttggatttgctctgtgccgacaaaaagagtcagttgttgttgagttattgcatggattgtttgtgtttgattcaattcgaattgctcttctcatttcagctggtcaaactctgattcacaaaacggttgccttttccgatcaaattgctgcccaatttttggctgccaacggagtgccggttgacgtgccggatgccaaagtaaattttgaggaattactgttagacaatctatggcatcatattgttagtcctcactttcctttaatttttcccaattcaattccacccccaagggttcaactccgttgcatcatttgctgaaagcgttgcccgcctttgatgagacaacggcacatcaccaccatcaacaacagtcgacaattgacccatctcttttgtccatccttcaaattctgctccagtccggtgccaatccgtcctccgtcgacggcgtttccggctgcaccgcgttgcattacgccgtctcaaagcctcgggctgtgctcgacgcgctgttgccccactgtgacagcgccaccatcggcaccaccgaccgggacggccgttctcccctctggtgcgcgttgttggcctccaaattcgacactgccgcccttctgattggggcgggcgcggatatcaacgaaaagtcggcggatggtgtgccgttgttgatcaaagcgatcgcgctaaaacgtgacgatatttcgcgctttctgctggccaacaaagcgattgctgcagttacttctccggtgagtgtgctaatgagtcatcccaattagcatatcggagcgagggagagacaaatctatgcaaattttgtcttaactatcttaaactattttcgctcgtatttttcaggatggctttacccccctcaatctcgccgtccagaatggacttacttcgacggtggaccaactgtgcaaattaggcgcaaatttgaaccatcctaacccattgaatggactcattccgttatggacggcactcgaaaacggagactttggcacggccgaagttttgatagcacatggcgctgtaattgtccattccaatgcacgaaagttcgctgtttgtgctttttctgtaggatacagaaggattgtgcgccaacgacgaacaaacgatggatgagacgcttttgcaccgcgcaattgacaaaaacaatcaaaaagccgctgtcttttagatcaaaaggtgnagttattcttcatctaacaataaga

SEQ ID NO: 4148 - DNA, 2904 bp, Heterodera glycines
aaagagaatggagatggttatctgactgaaggcggttagagattaggagcacaaacgatggacctaatggtcaagatttggggggtatgaagggaaaaactatggaataagaaaagcgaagcgaaacattcatttgaatgggacaaaaaggaagcgaaaggataggcaaaacgacgaaagaaacagattaaacagcgttttcctttcatttcaacaattactttttgcaattcgttttggtagattccttttaaatttatttttctctcatttttgtcaatttctatttttctccccattttaagcggttgcaatgtgaatgcgttgcgctctgtccgcgattcgccctcctcccgtcaacaacaaaacgcgtcgtcttcgtctcccaccccctccacccccgtggccgagctgtacgcacgcagcaaacagacgccactgcacaccgccgttcagtggggcctcacagaagtggcacgggcactgatcgccaatatgagctgccgcatcgacgcgcaggacgcggacggacgaaccgcggcacacattgcggtgctggagcaggatcagcacactttggaactgctcttggcccaccccgacccatcgccgctgggcgtccgcgaccgttacgggcacacgccgctggcgttggcaatgcgtgccaaacagaacaaaatggcggaagcaatttgcaaacggttgccccatgccgcgctgcaaatgaacggaagcggcgaaaatctgctccattgcgctgtcaaaggcgctgaccttgaatcagttctttttctgctcggcatccatgtgaatttcaattctttttcatggactgtactgtttaacttttctgatcccaaattggtttggtacaatatttccaccccccccccccaagaaatattttataaaaaaataatcacttaaaaatttttcaagaaaaaaaaattagaaaatttttgttacaagaaaatccaacaataaaaaggattttttgatcgttataattcattataaaatttttcgattttttttttacaattagacaaaaattctctgggagggtaaagagctgctcccattggttttgtcgctttcaccacattcatttcacagattgacgtcaacattgcaacccaagaccaggaacggatcacggcactgcacatttgtagtcgcgtgggcgaggaactcattctgcgcaatttggtaagtgttttttacactttaaaatgctcttcattttgacaattttgccatagattttggccggtgccgaaatcaatgcgaggaatgcgagtggccaaactgcgctggccattgccgcgatgcatggccatgacgaaatatgccgcgcactgttagaaaacggcgctgacccaaacattgtcagttccttttgttttcatttttacattttcatttttaggcaaatgatgacggaaacaatggtccgtttttcatccatcccaatttttgccatttaaaatccgtaacattttttgttagctttgcatgccgcagtttcccgtggttcggtgaaagtcattcgtctgcttctctccgagtcgcaagtggacgttttggcggtcaataaacggtgggtcatttgcagaatctgaattgtttttccatgctaatttggttgctacatctgtggagagcaatgcaattttccgtcttcaattgatcactttttcaggcaacaaaacattttgcacctttgtgccattaacattggccatgtttcggcggaagcgtttgtggagattctgagggtacacccaaactatccgctggaggtggccgatttgtacggcaacacaagtaaaactatggcatggcaacagcagcagccagtttctggtcttgccatttcagtgtttcttctcgcttttatcaacggcaattcggaattatgcaaattggcactgaaaaacggtgcgtgtatgggaacaatgaacagccagggacagaccgtgttcaacttctccaccccaacccaacagttgctcatcggactgctcggtacggatggtttgccatttaatggcttattttgtcattgtaaaaataagaattggtagtcataattaaaaaacacataatttttgaatgtattaaattttgttggaaaataattggagcgcttcattaaaataatgacaaatgaatgaatggcggtcgattaatgccaattccaaaatgtcttgggattgggctttgaaaaaagcaaatcctttgtttgtttgttttttataatttcgccctttgcacagaaagcctcgagagggagcccaaatgggcggagggcgacgcgtgctccgaatgcgccacgaaattcacgctgacaatgcgcaaacaccactgccgccactgtggacggctcgtctgtgcaaagtgttcggaccagcagattccgattctgaagtacaacttggccaagactgtccgcgtgtgccaaatgtgcttcggcgtgctgactttgggcgccgcccctccgcagcgaaaataatttaaaaagtgaaaaaagtgccgaagaaccaacgaaattgcccaacttttacagtttaacttacgagacgcaatttgtaaaaccaccaaaaagcaatagcatcaaaaacatatttatttatttttaaattcccacttattttcttataataattagttggcggttttttcaattgcgcgcctctttttcatcatttattttttcactttgttattattacctccagattctatgtgttatgtttttaatgttagtctcttacaatcacttgtatttttccgtgtgacttttccttttcgacttttttaaattaaagagagattattaataatcaagtctaaatggactcaggaaatgactagggaattccttgatattttcacgtgtgc

SEQ ID NO: 4149 - DNA, 1095 bp, Heterodera glycines
  misc_feature (72)..(72): n is a, c, g, or t
cgttgaaaatttttgattcctaatttatggaaaatgatcgggctggggattttatttcaaacggcccgaacnaaaataggatttttttccaaaaaatcaaaccaattaactcgttttggaaacatgtttccacgtttttaaaacaaaaaaaattcaatttgtggaatgaagcagaaggcttccttcccgcctgctttttatcaggattttaagagggggaatggcatgggaaattgggctaaggcaaaaactctgctttgccaaccactttttatctcctacacaagcacagagaggaaagcaaatttgaaaagtatttattggtgatgaaatgacaaaactgtcttacagcacggccataataagttttttgcatcgtcggcttccgttcgtctcaaaaagtcggatcagccgctcttaaacaaaagaatggccacttggcccaagtagaagtaaatgaagtgtttggtctcgtgtctgaaaagttataaaattttgaataggtcttttctctttttttgttggaattattcggtttttcctctcccctacttaaaaaagattcacactttccgaccatttgtccaaaattcgtgtaaagtccaaaagtgtcatttaattttggtttgcctctattgcagtttacatgtccaaccattgaccacacactaatctttttcttgataaaaaagacctacattcttggtatttttctaaagtttaaagtctacaaagtttttgtaaccaatttgtgtcaaagataataaacaaaaaattatcgccgaatatactcgaaaagctgacttttgatattctcattgtgtttttcttgtatttaagattccctaaactttaatctttcagatgtttgtagcctaagaaaataaggatggtcactgattaaacgcgtaaaaatcgtttggcgagtaaagcctttgggttttcacgccgtaaagccattaaattcaaaatcccccccccatctaaaaaaactcacgtgacgtaagagccgaagttccgtccgacgatgcaatgccatgtcgggttgaacagatggtcaaactcctttttgatgtacgcagacgatgtccttct

SEQ ID NO: 4150 - DNA, 3812 bp, Heterodera glycines
  misc_feature (39)..(40): n is a, c, g, or t
  misc_feature (99)..(99): n is a, c, g, or t
aattaaattcgagatttcacttgaaagtcgaataccacnncggtaaaaaagaatataatagccgatgtcttatcgcgctcgtttgcttcaccaaaaacncctgaaatctgtcaaaatgacgaagagatcgcaattatcggacaaatccgagaaattgagtcaaattgggacgaattggcgcacaattatcagggttgggtcgaagaaaccaaattaagcgaaatgggtgcactttatgatttcctagaacgtaggattataccgaaggaccccagggaacagcaaagcatttttgataagtgtcataaatattcggtcatcagtgggcttttgtatctgtttgaaagtggaagcaatatgagattgttcgtgcccaaaaagtttcgtgaggaattagtcaaagctcatcacgaaggaaactgtgctggccatatgagtggaaaaaagttgtgtaaacaactttccgaacaatatttctggcccaatatgcttgccgactgcgtcaagaatttgtgcgcacactcgaaatccgcgtgctaatgagccgccattaaatgtcgttaaatcaaccgaaccattggagttgatctgtatggacatcttagatgtggggccaagtcattcaaataaaaaatatatttgtgtaattgtggatcatttcacaaaatatttggtcgcagaaccaattccggataaatctgcaggttcagtggccaaaatttttgtcgaaaagttcatcttggtttatggtacgccaaaaaaggtccattcggacagagggaaagaatttttgaattcaaccatggaagaaatatcaaaaatgttgagcataaaaaggtcatttacggcagggtatgacccgcaggcaaatggtcttgctgaacgtgtcaaccgaattttaattggaattttaaaaaggtcaactgcaagcaattggacgtgggacgaaccattaggcttatgctactttttcatataacatcacaccttcaaataccacaggattttcaccttttgctctcatgtttggaaggattgcgcgctttccccttgatcaaaacgtacctttttccgtaaatcccgcttatacggtggattcggacaaatacattcagctgtttagagaaaaccttctaaatatgcttgaacaagcaaacaaaaatgctttagaagcgcgcaaacaaaataaattatggtttgactctcaaccacgcgtaacagccaacaaatttaaagtcggagatcgcgtaatggtcatttttcccgggctccaccgccggaatccacataaaaaactcatttggtcaaatttcggtccattcttaatacttgaaattggcgaatcttcagctaaagttgtgccaattgataagcaaaaagatgaaccaataaaagtgcccattgaacgattggtcaaagtcccaaaagggataccggacatctcaactttgcctaagggaaaaaacccgttcaaaaatgaactcaaattaatggctctatatgctggcataaattggaaattcaaaaacgcctacaaagagactaaatgttgtaaaaatgaggccccactgcaattggggacaattgcttttgattgtttgggggtggaattgggaaaaccaaaattgatttcagctcgagtgaacgtcgaaaaaggcatcatgattggctttggttggtcatccacttgtgccggagacatcccaggccatgatctgtgcgaaccaatcacccttggcagcctcgatcccgttctcggcctcacgaagcttggatcgatggtggccaagactcctctgcaagcgctcctcggcatcttcctccttcgctcgggcgttgcttcttcgctgacggcagcacagacgttggttgaagtgattgtaaaggctcagccaaaattggagctttgcatgtattttggaaagaggggtgatcagatcagttcgggcaaatacccaacggaggaagaccagcgaaaagccctggagaagtgggctgggtcatgttatgtggccagacaggctttggcagccaccggattcaacccgctggaaatggaggagccagaaggagtcaattcccttcctgaatccgaaaagctgaagtggaaagaagtgtttggccaaagcgcttgggccctcgaatgtgtgcgggcgacggttgtgcacaaagcgggccgctttttggcacaccagcgcgttttgctcggagattcatcagctgccgccctttcacaatatatccccaattcattttgcattggacaggaggggtcaatggcagacatcattcgacaatttcagccgaccattttgtcaagtcgagtaaaagcgatgcttataatcacaggccgtgactcgcttgtcgccggagaaactgccgaatccattgccgaacaattcgaaatggtggtggagctgtgccgtcgcttcagtcatgtcaaaatttattggtgcccgcccccgtatgtccacaacaaatccgctgaatatgatcaattgatcgacaaaatgagggccttaataaataatggacccattatttcaatttgcatcacagaaaaaggccgctctgttttggaaattttccgttttggaggagccagaaggagtcaattcccttcctgaatccgaaaagctgaagtggaaagaagtgtttggccaaagcgcttgggccctcgaatgtgtgcgggcgacggttgtgcacaaagcgggccgctttttggcacaccagcgcgttttgctcggagattcatcagctgccgccctttcacaatatatccccaattcattttgcattggacaggaggggtcaatggcagacatcattcgacaatttcagccgaccattttgtcaagtcgagtaaaagcgatgcttataatcacaggccgtgactcgcttgtcgccggagaaactgccgaatccattgccgaacaattcgaaatggtggtggagctgtgccgtcgcttcagtcatgtcaaaatttattggtgcccgcccccgtatgtccacaacaaatccgctgaatatgatcaattgatcgacaaaatgagggccttaataaataatggacccattatttcaatttgcatcacagaaaaaggccgctctgttttggaaattttccgttttggggatcatttcaacaaatatttggtcacggatgacggtaaaatgcgcaattcggggtgcaaaatccttaaagcttggattttttcccaatcgtcattccccggagacattgagctgagtgtgcgcacgctcaagtcagcggtaggagtcccttcgagagatcaggccgatcctcgttcggacacgaccacagctgttccgagagaccgggtcggtcctcgtcgagaccaaaatccgtcgttccgaattctccatggacgccgtggatcggtgcgctatcagccgtaccaaggacatttgcacggatctgcgcgagtgcgtgactccgatcgccgaaatgatggccgcccccatcgtcgttgatctgctcagaggaccaccccttttggttttcaaggaactcaaggctaaaggcagggacgccttttttgattgtttgggggtgttggactttttgacctttattttattttttatatttgtttggcattatgtttaattatttgtgaccgttttttcccaccttttcttgtattcgaattttaattgcattagttttatgttttgtcttctccaaagaaaattgattgtttctttttttaatttggaataaataaactctctgagaagccttgacaccttccttgaatcccgaaccaaaagtgaagaaaaatcccatt

SEQ ID NO: 4151 - DNA, 2166 bp, Heterodera glycines
aaataccctctcctcccctctccttccccccttttcccctcccctttttcccctccccccgccctcccctaattctgccctttccctcccttctctccctccacttttctcccgtcctctcccactttcttcgttttcccttcactttatttttctcgccttcgttgttcccttcccaagtttcattcattcccacaaatgttatgctttctttttgttcattttgtgccgctggagtgttaagcgttgcggccaattgcccctagcaacgccgccgaccacaaacatttctttttttataagcggacccgtcccccaaatgaatggcactcatttgtcacaataattcaactgataaatcaccccttacctttttcttcatttcattttcattttgatctctccattacagtccaacctcttttgagtggattactgtaatggcttcttcggagaacgtttgtttggttgcgcgtgccatcccattgaagaccgtctcctccgatggggtactcactatatttgcattgtttctctccccccatttccatcaatagaaggatcaaattgtcgcagtaaattccttggccgctcatttggattcgctttcgttggggttaaaacaaagtaaaaatgaaacggataaaaagggagaagagagccgaaagaaaatgcgggaggaagcgaacatttcgccggccgatcatttggcactccaatcacttcgatcgtcggcattggcaaggaaaactaacacaaccacaaaactgacacgtgattgccggaaattgttcgccgatttgatgacgggagaagaagacggagaagagaagcagaaaaagtcgaatgagaaaaaggaaaagccgaaaatgaaagaagcggacgaaaagaaaaaggagcaggcgaattgtgagaagaaagagcaaaagagagaggaaaaaggaggggagaatgagcgggagagagggagtggcgcggaactgatggctcgtggtccgatcagagtgccaccggtggtgggccggtaagcgtttattaccatcccccccccccaaccgatcgtccatttcattccgtcactgttctccttcagcggtgctccgtccgccgttttccacccttacgcctcttctgctgctcatcccaatgcgcagtcttctcccaccaacgactttatgtccgcatccgtctccttcaacgccactgcgcttcagtcaacagtttttgatcaaagcagttacaattccatggctgctgctggctatggctacgagtgcgggctgccgagcaattggagttgcgggggagggagtttcgggtgctattcgggcctttcttcgccgagcactacgcctgacacagtgtcggcgatgtctccgggcgatcgtagcgaaaaggtcggtcgagaagtggagaagggtcggcgtaactgatgatcattggttgcagagcgagttgcctgacgacctttctgacttcattttggaatactcgcgccgttattcgcccgaactgtcgcggaagtgttcgcttggctcgcaaggaattgccgggggcagtcccctgtcggactcgtcgaccgacgacgaccgactcagtctgtccagcggcaattcgccgctctgtgccccccaaacgtattccacccacaacctctctttctccaaatttgaccgaatgctttttgagttcgcccgcagcgcctcggggcggaattgcaaataatgaaaattctccgcagttcaacacaaaaggcacagcgaaagcgaaggaaaagccgcgaccggcgaaagaacggctgagagcaatgattcgaagcgaagacatggacaacgcatgggcatggacatgcaaatgcattcaggtgagaaaggcacggggagccaaccaaacagacaaaaaaaaaacatacgaatggacagcgccatccgatggcattgcatttccaagacggcgatggggacacactcctgcacatcgtcatggcacatttggactttgccaagatttacgcactcgtcgagcaaatgcttaagacagaagaggcgccccaaaagtcattgcttttcgacattccgaacagaatgggcgagactccatataagtcatataattaacatagaaaaattgcttaaatgtaagcccaatttaattacaatggagaat

SEQ ID NO: 4152 - DNA, 3306 bp, Heterodera glycines
aagtaattcatggggcactgagtcaaaaagtttctgaaaatcaatataaatacagtcaacatttttccattttattattgcctcgtcccaatctttctcaaatgttattagttgactcgtagtagacctatttctaacaaaaccaaattgaaattccgaaatttttttgttttttaatagaaattgtaaaatatttttgcttaaaattctttccattaccgtgcagagtgagcaggttaatggaaattggcgtatagttttcgagattatttttgtcacccttcttaaaaagcggaaaaacaattggattcctggcagatgtctggatgtgagacagtgtataatgagatcgtaagcgagtcagtaataacagttgccagagaaggagggcaaatttttaaaattttataactaatattatcgggagaagtgccatttttattcggaagttttttcaggagattttgggtctcgatgatgttaaaatttatagttgatatataagcatacatcaaattctataagattggacgccgtcctggaggtgtgttttttccacttttcatttatttctaaatgaatttcccttaggccggggcttcgccaaactctcaaagtttccgcctccaacgcgacatgccattgcatttcgctgctgcgcatggaatggtcggagtttggcgggggcggacactcaccgaccttctgacatttccagactcaaatcgtcaacattttgtgcgctcactcttcgatttcattgaatgctcagaatggaaatgtaagtatgggggggagggacaatccgtccgaaattacttattttgttttatacttaatttccattgccttgcaaagccttctcatttatcttttccatccccagggccttacgcctttactaaacgcgttcaaaaatcacgcggagcgtagtgaagagtcgcagagccaaataaacaactttggcacaatcgaagctttgctccgtttcggcgccgatgtgtcattagccgactcggccagcggaaagactgtggtgcattacgcggtggaaaagatggatttacaactcattgaggtggtgcattttatccattttataactatacatagaacttgcacaaagaaagtcaaataagaaggcgtaggggagctaaattaaatgttaagtttttttgtctaaaattttttcggattcatacaatttagactcagtggaaccgaaaagtataatgtaaaaacgtcgtcgtttagctccttcgttcaaatgtcagtgagcatcgaatggcccaattggttgatcagaaaaatttttgtggtgagacaccaatgaacaatttgagcggaatgactgaccgcgtggaaaaatcccaaagggaacaaatgtgtttggcactgatcacttgcggagcaaacactggcactaagcaatgacaatcccctaaaatcggaaatcccactcgtttttcagaatatcccttgaaccattacttacatttcatttatccaaacattgtgacccttctccatttatttcctacaattcatacataggtagtttaataattaattatatttcaattatccatttccattttgttatttttccattcgtttgcgatttttaacatccattttattatttaaaaaaattaatagattctagtgcagaataagcgccccagggtgtaccttagaagtggccccgttaaaaaaacgcccaaaacgtgttccaatcaatctcttatgacctctaatcatcgtaaaaaatattcccgaggtgcggaaaaatcaaaaaaccggtttttgagccggtttaaatcacgaaaaattgcaccaaaaatcagccaaaaacccatttaaattaaaaatttccaaacaaatttggtatcattcgaaagctcttgacgagctaagtctaaaaatttgggatggagtcaagacgaggccatcagagcactgggacaactagtaccagtgaaaatggacacttaagtaacaaagaaataaaggatgaacaaaaataatttgataagctagtgtgaacaatgattaaaagttaatatgccctcatttaattattatgcaaatcattcaaattgattgtttggatcgagaaatgggactctgaagaaaccctcgaaaaatatgatttaagcttgaataacttatttatattcagaataaaactatttagctcatggaaacgagatttcttggtaaaagtctgaagaaaatatgagaaaatttttctaaattaattattcaattatttgatagctgcctctgaaatttcgaattaaatcttaatatgccctcatttaattattatgcaaatcattcaaattggttgttgggatcgaagacctggattctggagaaacactcgaaaaaaaaattatgaaatatttgaaattaaatatatgattaatatgatttaagcttgaataatttatttatatttaggacaaaattatttagctcttggaaacgagatttcttggtaaaagtctgaaaaaattaagcgaataatttggaaaatttttaatttagttataaaatagcagcgctaaattttgaattgaatctttatattgcctcctttaattattatgcaaatcattctcctaattagttggggtcgacgacctctgttctggagattcattaatttttatatttcaatgtattcgtaaacaaacctataatggctttctttttaacctcctgttgcataagagcatgaaaagtaggatggtcaattgatttaaatgtaatgttgttacagataatgtaatgcattatttttttgtcggcaatggtaatcgttcctaattactaattactgatactgaataaaattaatggataattctaccggaggaagtcatgttcatcacgttggtaatttttggctgttccttctgttgcttttgtttggcgcttttccattctgtctcaagttgttggaattttttgtcatattccgatcctttatgaagcgacgaattgaggtggacaattaggctcttcgtggagctgtcgttgattgagaattcagacttttgtctattttgctccttgcacactaagcaaattccaattttgccatttttactttttttgaacaaccctatattcaaaattaaagaattcattagtgcctaaaataaagaataaaataaagaattttaaattaacatgtccaggtttttcatgcctggacctggatttccaaactgacctggatttcctggacaaaaatccaggaaaatccaggtccaggaaaaatccaggtctgaatcc

SEQ ID NO: 4153 - DNA, 7336 bp, Heterodera glycines
agaatgcagagagctgatagaaagccggaccaaattttggtccattttggcaggcgttggttcctatttctgtgccggcaatgatttgtccaattttacgcgcggcgtcaaaacgagcgacgatttgcgtgctatggccgaccgtggggagcgcgtgttggagcgttacgtgcgcgcgttcattgagcatgaaaagccgctgatcggactgatcaatgggccagcgattgggtggaggaaaaatattatttttcgagcaaaattaaattcgactttatacgacattacatgccccgaatctttcagaatttctgtcactgttttgcctctgttcgatttggtcatcgcttcggataaggtaacaaaaaatgccggcgatcgaatcaaaatatggcatttttctcctttttcactcgctttaggccactttccacgcgcccttctcttcgcttggccaatcccccgagggctgctcctcctacacttttcctctgattatgggcacgtcgaaagtgagttttgttgaattgaattgcaataattttgctgcactttttaatgccattccgtttaatttccattaattccttaatttgttaggcatctgaactccttttgttcgacaaaaaaatgtccgccgaagaagcattggagcgcaatttggtctcccgcgtcattcccaacaacagttttggcaccgaaactgaacggatggtacagcacttgatgatgagagccatttttcttttaactttttggaatatttctgaaaaattcattaatctcgaaaccataactcgagtttcactaatctctaactgccccacccccatctaattaaggtaaattcgctggcgtcccttccgcccgagtcgctgcgactgaacaaatcgctgttgcgggacgtgcaccgcgacgcattgctggcggtcaacacgcgcgagtgcgcgctgctcaagtcgcgatggttgtccgaggagtgccaaaacgcactgcgaaagttcatgacacggaagagcggtggcggttgatgggccaattgtaaaaagtcaagggcatgacaataataatgataattacctatactgtaagaaacagggcaaattttactgaatttatgtgtctataaaaatgtatataatttttgctcacggatatgcattttttttttgtctgccagtcgaataaaatgatgccaaaaattgaaattgtgtttagaacattatgtcagattttattaccgatgtgatacgataaaaagtctgttaacaataaaactattagcatttttaaattgctttttgaaaaattttcaaaattgataattctttttagaggcttttgggtcagaaaaactgatttcaacacctatttcggcccacttcgaacccggattcaaaaactaaattttcgacaaaattcatatttatgcgacaaaagtaattcaaattcacgaactgtcaacaaaactttaagtcattatttcggaaaaacatgtgcaaaaaccaacaacaatttattacaactccaaaacgcttaaatgtctcatcaacaatactttgcaacaccaattaagcacacattaaatactaaattttcatcaaacaaatcgctccgctattttctcatcgacggtggcacgtacttggacttctgaggctgctgctgcgactgtgctgcctgttgctgttgttcgtcctccttcgccttcttgggctgttgctgtgtctgtggcgtttgctgctgctcgacttccctcggcttttgtggctgttgcgtctgtctttgctccttcgccttttgcgtctgcgcctgtgctgcctgttgctgttcggcctcccgcgcctcttttttgcgttgttccttcctgcgctccgctcggtccttttaaaaatggagtttaacagcgaaaatgtgatggacacaatagccagtgccattgcaaaagcaaataaattttaattctcaatattgtcaatagcccaagtgttttacaataataactttctaaattccaaaaaaattccgtcgaattttgaataaatttatagccaaaagccattgtattgctcttcaaatgtgcctcttttcaattaactactctcctcccaccttcaatgttttgttccgagcttcctcaacacgctgtttccacgccgcctgctgttctttgaactcttcggcatgagattgaataacggaacgcataaattccttggccccctctttggcgctcaccaaataagcatatttttcgaatgacaattcgcgctcctttcttcaaaacaatgaatgattattgcttgattaggcatgaaattgggttaaccaaatcactcacaccgctttttcaattcgttttgtttcgtaagcctcatgaagtcccgggtaaattctctggcgttcgtccgacaaatgtttccacagtgccatttcctccaaatgaaatgcccggacggtgtggtcatatttcttctccaagttttgcaatttggtctgctgctcgcgtcgctcagcgtcaaaacgaattcgctgaaaatgttatttcatgaattataaaaataaattgcttggaaatgccttctctctgatgagtttgtcagggtcaactttgtcgaatatcgcctccccatgctctttgaccaactgttggaagaaagggtgcgcctggtacttcttcaacttctcggattgcaactttcgctgaatctcctcctgaaagggatgcccattttactcatctttttgccccttccgtttgtttgttttttgcctgttcgttcagtttgcgcctccgctcgttctctttgttctcctcctgcaacttcttcaactcctcccttctgcgctgttcctcctgtttgttcgcctgtgcctgttccttctgcaatttttcccgcttcacttgctcattggtctctttgtacagctcaattcgcttccttctcgccaaaattcgctcaaaatcggcgtccttttggttttggtaaatgaatattttggcgctttaactgaaaaatgtgaaaatgacaaatcgtgtgccgacaaaatccctactcagccaaaaatgacaaaatccctacatgacaaaatccctacccagcaaaaaaatgacaaaatccctacccgataaaatccctactcagataaaatgacaagtttcaaaacttgccagctctgatagtcttgcacgggagcaacatatttttttatcttaagatttattttatgattcattacgtatttagagcaagagtcaatttcttgaaatgaattgccatgaacaccttgaaaagaatttaaatttgagtaaacggccacgcattgcatcaacagacgacagcattgtagttgaggagcgagcagttgtgcaggtggcagaaatgcgagctgctgccactgacgaccatggcgaaggtgtgttaaaggggaatttgttttcacatttccttttagatttgctccttcagagaggacaatgaaaggagttgtaatcggagggattacgggaggcatcgaaatttgcatcacttaccccactgagtacgtcaaaacacaacttcagttggatgaaaggtcgacaactccaaaatttaaggtgatgatttcacggactttccggcttttaccgcggactgtccgttctgctgtacgttttgccaaactatttccattttttgccctctttctgttcagctacggttccatccccaagtccgcgtttcgtttcggcactttcgaatttctaaagggtcatgcggtggatgagcgcggcaaatggtgttcagccattcaaaagtttgttgtttaaaattttctttaggcttcgttggtggtctccatgttacgaacaatgaaagcgatgtcgattcggaagatgattaagcaaattgataaggtgatgcgcctttttaatattaaaccctatttttcccatcacattatcccgttgttaccatttcactttttttttggtttaaaaatatattcgaaaaaagaacttttttaactgtcggtgtttttggtagggattttgtcactttcaaggttagtagggattttgtcattttttgctgagtagggattttgtcatgtagggattttgtcagtagtgattttgtcagtagtgattttgtcagcgcgcctgacaaatcgcttttcaagtcgtttagaatgtaccttttcttgcataatactgcgttcctttgtattaaattggctcaactccttgtacatttcctccaaatggcttcgtgccttcaaaacctaaaaaaaatgcaatcgacagtgttacattaatgaacaacaaatgtgattgaaattcgtcatttacccacctccgatgtgtttgtgtccacctcactctccaaatcgttcgcaaatccattttcaatatggccaaaacgaacgcatttagttcgatggtcaacccgagctttcaacgattgctgcttgcacacgttcaccagccgatgctcgagttcaatcacttcgtaaaagggaatcagcttatgaagacgagtgagagaaagtgtttcgtacagcgcagacaactcaaagggagggaggagcggattagttgatttacgattggatatccccaacttgtttaaaaacacgtgccgtcacaacatccttcactggctcggcatactgattatactccaaatgtccaagtttctcgatgtccgacaaatgcatttgaacattcactgctgtacgcaatgggtttaactccatctccacacatttgtaaagtgcgtaggcggcgggcgaggccaactcggggatgttcagtcggacaatttctttgaggattccgcttcggcttggcgtaattggcaaacgtaaaagagacgaaagaatgcttaaacaatcaatggtttgtttgagaataattttcattatatgattcacttcaacttttttattgctttgaatcattaccgaatattggccgagtgttgctcctcaatgtccaagtgtttcgtcaacatcgacgcactctccgccccctccggaatgctcaaagttgccaacaacacgcgggttgcttgatccatcgcctcttcaccgccaaattggcggcgcatgtctttgaaaatgcaaaaccgttgaagcagcgaagcggcgtggaaaagaatgttgccgcccttccaaaaaaccaaagaaatctaaaaccaagttgagataatcaaagcatggcacgacttatgcaatgaatggcatgccttctcgtaataattggcatagctagtcggtcggatgatttttttgtccttctctttaccaagttgcataaaactgtgcaaatcttccgcacttttgaacgcttcctgccacaagtccatgttaatcgcggtgtccaattggataagtcgcgtctccagcatatgacccaacgattcggtgttgctcaggcgaattctcaaaagaaaagtataagttcccccgagaggttgtggaggtcatacggatgcaaggcagtcgactgctgggctttctgaatttggaccaaatgttgacgcagcatttcacacaattttcgaaattcattgcgacgctgatatttggtacagaaggcgaatgattgacgggcaatttggtggtacaaattctccacataaacattgttgcgcagcaaatccaaacagtttcgataggcatcccaaagaaagcgaagccacgggctcagaacggtacggtccattcggtcttgtgcaacagcaccggaaacggagagcaatagactgaaaaaaagtgaaagcaatttattttgaatgtttcaaaacaagtctaaaaattctaattctatttgtttcgatgttagggatttggaattggttgaaacagtgcccaaaaccttaatggaaatttttcacaacttattaataaaaccctaaaatttcggggtcttccgtgttttgttaccccccttaaaaattcatatttcggggctttctaagtcactatcacaaacaaagtatcaccaaaggtcgaaacaaacaacatctgcgtggacagacaccgcaaaaatctcccaaaatatgaatttttatattttcaaggggggggggggggggagcaaaacacggaaataccaaatttcaacttcatctatcgatcttttttgagtaatgtgtaaatagaaacaaattgaagactcacttttctggcacatcagcaacatcgaggtcgtcaatttcttctattttttcgatcgagtgcttttgagcttccacagccttttgttcagcaagctgcaaaaacttctcgagcacactttcgagcgacttcacagaaaccttaagaaaaacaaataaaacaatttaaatcaaaatgacgaaacataagaaatggtaatcctctggaattgttcagtcggatctttatcagcctattttttatcctaaacaaactattccgccggaacaccaattccgaaggattaccaaaacattggttatcctgacttttattggtctcataaaaaagaagtaaacagccagttttttacgtttctatataccactcgtggttattggaagtgtcatatgacatagtctaatctgtaacttctttgttaactatggttttccgttccgtcaaattcatggaaaacggccctaataacactcaagtggtatgtaaaatccaaaaagcggttgtttattcttttttagtcaagattaccatgaatttacacaaaggaaacctgctgagtgataattttgtattggtaaagaccatcctttgcaagtggcgaattacgtaagatcacacaaagctcaatgtaaagcatcattatttgctcatatgtttgggtccattgtttgtgacgacggtcctaaaatttcattggaaaaagttcaagatatggtaacaacttttattaagtcatgcagcgcctgaagagcatccttttgcttcccaactgacaaaaattcataagcacgttgcaacgctgcctccggtttctgaccttggaaatttggccgcattttcagaaatcgatctgtaaaaaatcatagtcaaattcaagatgtttcgaattctgtgttcagatccgtaatcagtaaatttttatcctagaatataaaatcgtattctaattttagaaagactttcttttttgcaacccagtccaaaaatcgtcggtggtttttgtaagatagtaaagggaaaaggggtagttttggaaattacatacctacctatttttaaagatttctgccataaaatagaaaattttagtgtttttaaaaccttagaactaacacactaaatggaatggagaaaattgtccatcctatttcacaatttacaattagttgag

SEQ ID NO: 4154 - DNA, 2581 bp, Heterodera glycines
tcccagctcgttcaattgagaatcgacgccagctttactattctctttataaggtgggaaggtgtaaaagggatttatttacaaattgttcaaattttagaacggaaaattgaaatgctgatcatcgatgtacaatttgttgtccttcccggtcggtcatccccaagaagtgcccagtaaagaacatttcgttgtaaccgcccacaaattccattttaatttcactttaatttatttatataaatcggtgctgtgtctgtctgtctgtctgtctctccaattgacgctttttctctttccgcatgtctctctctttattttcctgtcaattgtgtttgttactttctgtcttctccatttctctgtctcttctcggctatcacatgaaagtgcgctttttgaaaagtgtgatattattatatttatatgtttgtttttcttaattgcttaattctcttgatcacttttttgtttctgtgttagcattaattactttttcagtctgttttttatcgcttttcagcatttttatttgttccatttttcgctattaccaacatttgtctttatttttgaatttttgccttgtgaaatcatttacacttcagtgataaatgctcacaactgaatataaatgagaatacaatattgtaatattggttaatggccttctaatcatataaaatctcaatgatcaaggccattaactcgattatcgctaattaggttaaaacacaattaatgatggtgatctgattatttgcttaaacgctgaagagtgagtgagtggaaatgtgttgttgttgtttgttgtccagtgatcagtgcagtttggccaacagatcgttgtattctttggactgcagaaatcgcacgtacggatcatttctgtgatcaaaattatcatgaaataaatccaatcgttttataaaagtgagtcactggggacaataacctaatccgtcgagaattttaaaattaatttgctggaatattttgactattttttaacattggtccacctaattaggtagtttacttcaatatctgttccacgtgtttgaccgcttcgtcgaaaagtgtttcgtccacgtccttttcccgaattctcttctccacccgttgccgaagaccaaacggcaaaaacacctgcggcagaacgggatttaacacaatttccatgaacattcattcctactgtagttggcctacagtacctcgttgtgggcgccttcccgcaaaaattgttgttgtatggttttgcccatgttctgcaaatgtaaatcataatattgaatttctttttccagcatttgcctgcattgcggtgcttttgtttttcaattggcggaattcgatgacggactccttaattagttataagcaaaatccaattaagggtcattagtagggaccggatttgcatggatttccatattttttttttgcacactcatttcggcttaaaaactacgtaaatagtgtttttagctttgtttgatgcttctaggatgcctttttacttccatatttcagatttttgtccatatttgacatccatatttcggcattttcacaaaaaattcgaaaatacaccccttaagatggaaaattttttggaaaatacgccctaaaatcgaaaaattttgggaaaatttccaaaaattgtgcaaaaaatttttcatcagcaaaattcgtgtaaaaattattttttgtaatttactaagttttgttttttttctaagtaaattcaatttttttagtaaagaataaataggaggccacaattatcaaattctatacttcatgtattaaaatgatttttttctttcttgaccggaaaatttatgggtttatgaattttttcaaaaattcaaaccaatttttcagagattttttgtccatattttcgtatttttgtccatatttcagcgtttttgtccatatttcgtccatattttgcgaatttttcaatattataatccatattttggatttttttgtccatataaatccggtccctagtcattagttgtaatgccttagtaattattgctttttattatcgctcgaggaaaaattcaaatttttggcattttttctccataagttcaactttcactcacccaaaagcgcagattttcttccgcgtgaacattgaacaaaaattgacgaaagtggtggcgaccaacctgttgaattatggcactaataaattgaactgatcattttgcttggattttgccctttctttatcccctttgatccctttatcccctctcccacttggttgcccaacaatgcgtcaaatgacgtcgtccaccgttcggcatacgagcggggcagcagcgcctcgagaaagcccaggtaaagcggcgaacggcgaaagcgcgggaattggtcattctcgagcaatttataaatctcctgggaaaggggggggggggaattgaaatgccgggatttggactgatttaacatctttacagcccactgatcagagagggcttatgttttaggacggggttaacaaacttttcaaaagtcacaatatgaaaaatatctgctagtcggcagaaat

SEQ ID NO: 4155 - DNA, 2983 bp, Heterodera glycines
  misc_feature (588)..(588): n is a, c, g, or t
  misc_feature (2886)..(2886): n is a, c, g, or t
  misc_feature (2898)..(2898): n is a, c, g, or t
gctattgtgccattgatcggttgttcatccccaccctcttgcgccatctccaagcacttcgagtcgggcatttcctctctggttgcttcgcggagtttctgcgacgaatttggtgccattcatttccgtgccttaaatgcctttgccccacttacgctcatggccaccgagctgagattgatgtacgcgccgtacttctccagcagtttctgcactccgttgcggatccgctcaggctgcttctccttcttcagcttctccacttcttccacaaaaagcagattctcttccgctagcgcctcgtgcagaaaacagcggaacacttgacggcctgaaaagtgatcagaaccacacaactgatcagcagaagaataagaagaagcatcacagggacaaagaaagacatggaacggcacagaacggtcaaaaaaacaagcactgaccaattgaatcgcgcataatctcggctacggtggacgaactccaggaggccgcacgcgggtactgtaacagcatgtacaattattagagactgagatttacaactctgccgggccgggccggactgacattttcagaagcaacggnctcccgggcccggtaaaaaacggtaccgggcccgacccagcttggtctctaacaattatacagtggtaagttgtgtatggccatgctattcaccggggggtttggagatgccgataaagggtcaaaatgccaagacattgaggttactgagcccgaaaatgctcccacctcaatgccgtcagtggtcggcattattggcgacggtccggcactttttccgttcccttccgtcgggcgctcgaaaatgtttgcgttggcattcccttcgccgttgttgctactgttggcattttgctttgtcgttgcctgtgggaaaattggccaaatgaaatgacttttggtgtttggtttgccgtcatatagtaaatattatgcctcggttgcgcccatttcggcacttccattcgcgtccatcactggcggcatgcttctgctccgctgctgttgctgcagttggcccagcggcggtgttctcagtcggcactcgtcgtcagcactcgcggcactttcctttcgttcgcttttgagcgcggacgatggcacagccaaatgattggtgccgctattgctaccgttagtctaaatggtgcgcaatttggtgggaaggacaattgagggatgaaagaaatgccaaaattccacaaataaagtgcccatttctccgcgccctactcttccgtttgcctgttgattctgcgaatgcttccgcgcgacaaaaagtgccggcggcgaagtccgtcgctgtgccgaatggacgggcccgctgatggacggcgcggtggggtcgaagaaggcgaagttgggcgaggaacggtgggacgaatgggctgctgatggactgggcggagggacctggacagggtggacggacactaatgattaatgccgaggtggacgtgatcaaactctgccgatctcccgactctcccaaatgcgtaatccgtaattgtgcccgctgatacgatgaatgaactcaatgattttagacttggataatttaattcaatttactcttttatttgaactgaatcactttctgttattcatttatttttcgccatttggtcacttaaattcccttttttcattttatcgctttatatgatcacttctgatcaccaactaacttctctttgtgccatttgatcactttctccgattacttccattgcctcccccacctctttctccgcttccgcttcttccgctgcgtttccgttcgcttttccgctttccctttgcttctgctgctgctcctcccgtttgagcagttcctcaattgacgccgagattgaggaggacccgtgccgttcttcgtttgcccaatgcttttgctcggcgctggcggggcgttcgtttgtttcggcggcacgcgacgaatgggagacggcggaaccttttctgagaatgggcacaaattattggcaaattcatttgaaacgaacaccaaaaaggagaagggaattgtttaagccaaaaatgtacataaggaaaagaatggcaaatgccatattttattagcatcgctttttcttttttgataattcagaaaatgccaatttttggcaatgttttccattctcaacaaacggagaatgaaagaatgaattgtgagagaatggctttcgttcgctgttggcacaaatggtggcaaatgaaaaaatgccggatggacggcgcggattattgcggccgataaacgcgcccatttggccattttgcggcgggtaatagcccgttaattgcgcttgtgggccattaatccagccaaaaaaaaacaaaggtaccggaaattatttgtgtgtcccccggcggaggaaaatccacgtcaaatttttgtacccagagggttaattaggcaccaaaattgtttttatttaattttcaaattaaatttaaaaatatttaaattatttgattaaaatgatacctataattattcaagcgtaattaaacagtgcattatacataatagctatgctcattagcgtataattacttggtaattaaattacctttatggcacggccatacaaaaatattttatttccttttttcctctcgtatttagataatacgtacagcaattaaaataattttttctctttttaatggtcaattattttaagcacccaataaagtaattttaagccaaaaatttaaacgatcgccggaggggaaattaatagcatcgccgccattttttacccatgggacggacgaccattttttgtgcctttttttcgcgtgtcgaaggaaaatacaatattggcattgtgtttaatggcaccaattttncaagtaacctgngcaactgctgcgctaatgataccttttcttaagcgtaacaaacaatgaaaaggataaccgacgcataatttgagagggggggggg

SEQ ID NO: 4156 - DNA, 2444 bp, Heterodera glycines
tttggggaaaggtaaatcaaggcaattaaaaattgagcgaataatgagacagcgagataatatggtaggtacatcaatacggtaatgaaattggacggacatttaattgtcggaaaattatcaaaaataaaaaaatgggaggaaaaaagtatttttgattttttttttttgtattcgtttgctcggcttttgcagcgctcacttcgatccgatccgtcggtcggcctttgaaatggcaattaccgacgccgccgtgcctttgccatgtcccccactgctgctccccccccccctcacttttttctcattgccaccaattcccgtgccaattccctcgcccattttcccccattaatttgtcccccaataattaccatcggcccaagggaaaaactcaattaccattttataataattatccatatttttgtattattagctgttgcccatagcgatgcaaaggcaaattgggggcaaaagaaaggaaaagaagggctgaaggacagaagaaaaattgaaaaatgaaaggatgaattggaaatcgaaatttgaaaaacacaaaatatttaaataatttttaaaagaataattattaattttattttaaattaattgtttaattatcttaaaaagtacttttcgctcgagcattttgttaatgatccgagcaaagggggggggggcgaaatcagaaaaaaaagcgaaggaaaaggccaatcgaaaacttaaattttattttatttaaaaataatattgttatttttaattaataattaaaaaaaataaatgattttttttactcttttttgttatttgccattcccgtgatacggcacataaaacgctggcattgtgccatccttcccgtccccagtcccaaatgacaaatttaatccattcgtttttcaaatatttatacaataaataaatatgaatcttcgcacaataaatacgattatacaaaaatattttaaacgattgctggctggggaaaagcaataaatgtaaatagaaaagtaataattagcataattaacactaattaacatcaaaaagtaatttaattaaatttttggaatgagagaaaaagaacgaatcgacctgctgaaaagagaatggacctgtattataataaagtaagaagaagagtcaaaccggtgggataagaaaattgaaatggattaggcaaagaaattagaaactaatggaataattaactattaatcattgctaatttgtgaaattattagaaataaacgatggacggacacgaaaagtgaaaaaacaaattgggagttggagttgagaggggggggggggggctgtagaagaatgggccgagaactcgtcttaatttccgtaatgtccgctttatctctctgcttcaccattttccgctttatcttttcgaggcttcatcgtttccttttccgcttctccctttccgcctcattcctcctcttcgtcctcctcattttcaaagtccgactccgtgccgaattcggaaaggggccgtgggcagacgaagtccccgtccacgaggcgcacttgctctcggctttccgaagcattaacggcacaacttttgttgaaatagtaaatgaacggcgcttcaattggcgaacccattcggcccaaaatttcttgcgaatggcgagcctcggaaggcggaacctgcgcaaaagaaggcaattaaataatgggagacgacggtcaattagcagagagatcggaaaatgcgatgagacattttttaggaggaggggggagactacaaaaaacaagttcaaaaagcatgtgctaatgggccaaagctttttaatagggtaccgccacttacgtagacaattcggatgccgaagcgccactgctcgcgcaatgggccgcccccgcggccctttggccgttttccgccgctttttctgtcgctgtcgccgattcgctcctccgccaccgccacaattgtgagctggcggcgtgccaatcgctgctgagcagtgtcgacgccattgtcgccatcgccgctgccgctttgcgatgcgtcggccgtgccggtgctaagcggcgacgggtgccggaggcactgccgcggcggatgcggcacacattcgctgcttttacggcatggcatgggacggaatgcgcccaaagtgcacctggaaaagaagaagcattgatcgtaaaagataaaatcttatatgaaatgaagagggaggggggcttcggcgctatgataggcgccgtcaaaaaaatccaaatttgtttcaaaatttaaatttcggtaattagcgacaatattctttcgaaaatggggacccggcatgatcaatttgaccactcaaacactgaccatgtgctcgagacggacattgcgttggttttttctgtgccgcgttttgccggctagtgcgcgcaccgtgccgtcgccacccaaagagaacgat

SEQ ID NO: 4157 - DNA, 3221 bp, Heterodera glycines
aaatgccaaccgctgactgtccggagagccgccggcggtgccatggctaaacaatgtgaacaccgagcggacggactgtgccggacgcggacttggcacatgggcggagaaaaaagaagaggaggagggcgcagagaaggcagggaaaggcggatggccgagctgggcaaagttgggcatccgatggacgctgtggtggacgcgcaacgcggtgatctgatccggcagatgaagctcaatgaagcggaacagaatggacgatttgaaatgtctgaagcggaaaaggagacgctcaaaactcggtgatggatatcgggacatttcgacatttacagctaatgaccccccaatcagtcagtggcacagatataggcaaatgcgggccattttaaacgggcccattgtctaatcaatttttataattgatcaaaccaaactgatcattcgaaagcaagtttctcgagtcgttggtccatccaacgcttttttttggtcagcggataattaggataattacaatgctaatagggggaaaattgctgattttttgggccaatttctcgcctgaatccgatggccttcagccgcgtgagttgatcaaacagctgctgcatttgcgggtcgggctggtggtggtcgaccaggcagaagaggaagggcggcaagtccaagtcggccagcgcatggaattggctcaactcgcgcaagtacagctcgcgcttgccctcgctgccccacacgcagccgatggctaagcggcgcagcgaaagggcgcaacggaggcgcaactgacggagcgcactgagcggcaaacggcacgcggtcagctgcaactcctcgaggggctgaatggaaaatggcacaaaatttgaaaaatgatggcagaattccaaaaaaggtaccgctttaatttttttcgccaatgactcggaaaagtcgggaaaatggtgaccaatgccctcgggcgtttcggtgtcgagaatgagcagctgacggagttgaggcagtgcgagcagagcggacagaagcggacgtcgggggcgaagtgaggccaacggacgacggcgcttgccggaggaggtgaagtcggacagatagcgcgaacagttccacaagcgcaaggtgcgcaacgcgggcgcacagcagcgactgagcaccccacggaatctgtacaaagggggagaggtactgtaaaggacaatgaaatgcatgcgggacgaataaaaaaagggaatacgaaaaataaggggtgaaaggggtactgtataaggaggggtactgtaaagagaattgaaaatgggggtagagggagtactgtatggggaggggtactgtaaatggaaacgaaaaacatgctgaaaacgacccgccgtttccccaccatatcagttcccccccagctcggttccccccgagaaattttttttttcttttgctaacttagaaattttaaatcttagcaaaaatttaaaaaaaaaatttctcggggggggaactgatatggggggaaaaaggggtacagtggaggtactgtaatgaaaattgaaaaacgagggcagagaaagcactggttgggaggggtactgtaaacggaaatgggaattaagtgggtgtattagtgtaaaggaaataaaccatttaaatggggtaattaactaaatgggagactgtagaaagaggagactgtttgtgttggaaagagtatggtcggtgaagaaggattgaaaaaaggaaaagataaattagcagtccttccatcgactaaattgtgtaaggttaattaagggttaattagtaacaagtgccctcagctaattaactggcaattagtccccgacaacagcaaccacctgtcggagaggcagccgttccaaatggtcagctcgagcaatgcctcgccgtcaatgcgtcccaacagcgtcttcagctgcttttccgcgtccttcgcgccttcctccgtgcgcagtcgaaaggcgcgtccgtccgccagtgccatttggacgcggaataactttcttgtagttgaagcgatgccgccgcgaagggaaacggacgcggcggaagacaacgaagaaacggagggacgcggacggagtgaggcggaggggggcacagctgaagcggtgggaagggtgagggaagagtgaccaagagcaagaaagggctcccgattccggcccggatggatagtgccgatatattccggcgggagtctcggtacccggccgatctcaaaaacttttgatcagtcccagtaagacggatttctggggtaagcactaggtgtgtctgtccactttgatcacacgcatctctactgccaccgtttatgttcgccgttggcgccgtttcgtccgtgccaatcggtcggattgtcaacgccaccacatccgtccattttgtgctgcccatcgcctcccgtgtccttttgctgcactgtccgatgcgaattcgatccaacggcgatgcctaaggcaagcacacacattaggccaaatccagccaaaaatgttaatggcccaccattaagccaatccgttgccaaactttcaacggaaaatcgtccccggtcagcttattcatttggttcagctgttttttgggctgttgggtcgagtttggcagctcaacgactgcttttccttgctgctgctgcccttcatctgaaatgcattaattagtctaatcagtgattgcgtttgatccacgggaatcgcttttttggcaaaacgccaagcaaaagaaaaaagtgccaattcaaaaaaaaccctacccgacgcattgccatgatctttggccaatgccgacgatgaaggcacaatactctgttgcggctgatggtgccgcagctgttgctgttgttgttggtgctgttggggttgatgatttggcatttcaagaaccaaagttgcggagggtcgccgctgtgccacgccgccagcggcaccaccgcccaccagcaaagcggcagtcatttggcaacaattaaaaaaagcaataaaattaaaagctaaaatgtaaaaaaagaaaatggcatttaaatgaaacaaaattgaacattaatttgaggagaaaatgtgagaattgtgaatgattattaatgattgaattatgctctttttctgcaaattttgcaaaagcaaagcaaaaagaaagaaataaattaaagcattttttatttgaagaagcgaagggaaagccgagtcaaatgacgtcataaa

SEQ ID NO: 4158 - DNA, 929 bp, Heterodera glycines
aaatttgggcatttgttgagatttgcttattcatttgttctgttggtgctaaaaaaaagtcacaaatttccttcatcatgatttgccgtgctcatacttttgcctgtttcacctcattatttgatgccacctgcttccaaattggaacaaaatgtggcgcagtgccgtgacaaaaatggcactttcattcattttcggcaccaaagagcagaaaattaaaaatgggaaagggacgatggtaatttggcaggttaaaagttcaaaaataattaatgaaaaacacgaaagtgtcaaacaaacaaaaaaaaaaggaaaattatttttaaaaacggaaaaaattgtcaaaaaaatgcaaaaaaaaaagaagaaaaagaaaagaagaagcaatcaacttccttattagatgacggagaggaattaacattaatgtgcatctttttttgtgtctgtaatcctccgctaatgataataagcgtatcgccaaaaaacaaacccccggggaattcaatttttaatcaaataggaaattggaatttttggttcttatttggccaatatttactgctgcactttgccatggcacgcgaatgccaccattccagcagcagaacacattgaccatttgaaaatgacgccattttcaaatgcttttgcaccgttaatgggggggggggtgggtaatttggtgtcgaatgctttggcattctgtgtcaaaaggcttactgtacaatagcattttgtaggggagggaaggcatttgcaagcagcacaaattactaccatcacacattgttaataataatgaaccaaaaggaaaagcccttccgtgtgtgcaccggaacgaatgaatgaatgtaattacagcggcgcctcgggggaaatgaaacgaaagggaaaaaaaggggggggggggggaatttgcgcagaat

SEQ ID NO: 4159 - DNA, 1788 bp, Heterodera glycines
tctctattaaaatattaataacattcattaatttaattggattaggcaaaggccaactgatcattcatttgttaatcgcgtgaccacgtgcatttaaaatgataataataaaaaaataattacttttccatttgaaccacccaaaaacattccttatcactggtataattcaccaaattcgtccttcaaaatcaaaattttacattgtatcgtcatatcatgtcatcttcgttgaattggtatatccccccatatatcaaccagaacttttttttattttcatatacatatatttccagggtccggatttatacattttttatttttcacaaaatttgaaaatggatttttctattcatttcgtagttgtaagaatgacttgaatattgcaggaaaataccttgatatgaggactttctatatgtaaaatttaaaaaatttgttaatatacaaatttaaaaatttataaaacttgataaatcaaattcagacactgccttgaagagttttatctaacgaaacgaacagaaaaatcgcatttcaaatttggtaaaaaaaaaaaaacgaatccgggccctgttaatttccatttttattttcctggcgcaatttaattaaaaattagtttattttttcttttaataaaatccattaactcctgctgaaagcaaatgcaaataaatatccgagttttgatccatcaattactttaatagtaataatctcttttgactggttctatttttcagttgcgtctccccccccccccccttattttatttttccattgtttcgctttatttcgtcactcttttgtccattttattgcatttatctttaaaaatatgaatattttatttcattttcaattcaatttaattttttaattaattaattaatttccttttaaaattgttaagcaaatgttattgaggctgttgtgactgactgttttttgttaacaaaagtgcaatttactacacactttagccacatttatttcttgttatgatggccatggaagctcagcaacaattagcaattaatggtgccattttgggaatgccgaaaaatgaagcgagttttaaaaataatattgtaaattaaattcaaattgaaatattgtcaaaccaaccaaactttttagcataaaaagtaatttttttaggcaataaatttaggtattaaatagtttttgctttaaaaattcaattcaaaatttcccgacagcgcctaatgcaattttttggtccttacttaaaaaagggtgacctttttctccctttcctgtcgttttaatcgattgtgcctaattaccttaattaactataatcaccaaaaataagtgttgcaattgcaatataattgaacaaagcattgttcactttcagattgggcatcatcatttgtcacttgaaaatgggttcggccatcacacgacaaatggcgaccaaaacggtgctgatctgtgcattttgttgtacaatttggaccactccccaaatttcccaaaaatgatttttgttcaaaagaaatatatacaaacatcagcaacaaagctatcagttgaaacctaagtggtcaattataaaaaaatgtccaatttcaggtgtttttccgttttgcgcctacaccacaaaatttttagcgcgcgccgtcattttggcggtataaatataaaatctgaagcgaaaatttcttcagaagttgcgtcttttgcggtcctcgcgacgaaagaactcgcggggagtggggttgcattttttaaaaattttatggtgtaggcgc

SEQ ID NO: 4160 - DNA, 5353 bp, Heterodera glycines
  misc_feature (4022)..(4023): n is a, c, g, or t
  misc_feature (4025)..(4025): n is a, c, g, or t
ttgtgtttgaactcccatcgaaaaaacattaattttgaaaaatgagaagaaaaaataatactcggaggggaactgatccaaagcaaaaatgaagacatgaccaagaacacaacccactgagccacgcacactattagggtaatgaagcaaaaatataccaaaagtatatttatttctaacttacaaaaagccgatcattaggggtgtaaaaaagtctcggtctcgagtctcaaagaccgagaccgagactgaaaacccgagactcgagaccgagaccaaaagaaaccgagacttttctcgagtcgagactcgagaccgagactctcgagtcgagactcgagaccgagtctctcgagcatcactatagagagctatcgaacaacagaacaacacaacaccaagaatgcttatggttatgaacgaaaaaaaattatggtccaaaaaaccttccgccggcggcgtttttagatgcatcggaccctcccccattttttaaaaattttccataatttttcgctggtttatccacttctctcttctttgttcagcctcaaacggtgcttcgatgagtaagcctgacttggattatttatcccaactgctcaaggacaagaagcagctcagtgcttttcccaacatttttgcgcacgtcgaacgccttgtggacgaaggtggaaaattttttaaataaaaaatttccgaataatttaatgtgcgtcatttacaccagggaggatggacggaattcctaattcagacatttttaggatcggaattccgttttccgaaaatttgttgggcctcggattgtccgccaactctaattcatccccccccctttatgaaaactttaaaaaattttaaacttttttcattacgtcatctcatggaattccctttttctgaaaatgtcctctttttttcattaacttctcatttcttcaatcattggtttctgtggcccggtagggaaaaatgccgggttccaagtctcgggcttctggccgcatccctgacacatatattttgataatttttatccatttttctgccaaaagcaaattttaaatcctttttctcttcgtaagaattttaatacaattttttttaacccggggttttgggtacaccccaaaatctcgtcgaccgaaatttcgccgggacaaaatttcgccgcagaaatttcaaattttttttttcaaacttcgaaattttttcttgaaaaattttttagaaaattttttataagaaatttcaaaaaaaaaattatttgctgttcttttgaaaatttttcgaaaaacagtaaattatcataaaatttcaaaaaaaaattgctgaaaatttttctttaaattttcttgtaaaaaaaattttctacttgttttcttttccaaaataaaaattggaatttattgaaaaagcataaaaatttgaatttaaataaatctgaaaataaattttgtccccaatattttccacagaaatcaacagagtccgcgtgtccattttccagtgcgagttcagccatgagccgttgcaattgcccgagcccattggcgaagtgaccgttcgccaggagaaagtgttcgtgcccgtcaagcagtacccggaggtgggggagagataattacaaaaaaattgaggacaaagaatttttctaaaattttaatttatttttcaaaaactaaaaattattttaaagaaaatttcaaaaatacaatttccaaaattctgcaaaacttttaatttttcttaataaaatgtcgtcaaagcaaataatttggtttttaatactaaaaatttttaaaagaactttttaatgattggccgagaaaattaatttcaagattttgagaaaattttgtaaaatttgaaaaatctaccaaataaattttcaatattccccttttaaaaaactctcttctttacaggccttttttcataaattttcttaaaaatctaaaattacctaattacacttttttcactacatatttttcccaattatttttcgcttgtttccatgcacaatgccttcttatttacaatgcaatttatttttcacaaattcaattttctttaattaaataaatatttatttgtttgtttgtttgtttatttaattaattaatttgatttgtcagtataatttcgtcggtcgcattttgggcccgcggggaatgaccgccaaacaattggagacggagacgggctgcagaataatggtgcgcgggaagggctcaatgcgggacaaaaagaaggaggaaatgaaccggggaaagcccaattgggagcatctgagcgaggaattgcacgtgatcatccaggtggaggataaagaaaatgctaatcaaatgtattaatttaaataaaaatagaaaaaaaatgtgggggggggagtcaatcttttttcttttttgctttacaaaccgcttttttacatagaatttgggtgtttttgtttaggacaggagatgccaatatgcgccgccggcaaaattttaatgttcatacttaaatgggtcttggctgacccattaccagaaataaaagaaaattgagtaaaattttaaaaaataccaatttttcttggaaatttttttaaatttttcgtttcggggagtaggggcggcacgtgccccacttcctcccatacggacgggcatgggtcttggtgtcagaccatagttggacaaggagggaggcgtcagaatagttagggtcctacgaagtacgaaattgttagccaacaaaatttattaattcaattttttaatgtttttattgtgtttaaagtgtgaggacgcgccaaaccgtgccgaagtgaaaatggcacgtgccgtggaggaagtcaataaattgttggtgccagctgtacgttttcatcaatttttaaacacaatataaaacgcttattgttttttgttggtccgtttaagcccgagggcgaagacgacttgaagaagaagcagctgatggagttggccatcataaacggcacttttcgcagcacaaatggcaccgcgggcggtggcgcgtcgaaccgcgcgagtccgtcgtcatatggcaaaggcggcgccgtcgcgtgcaatgcttccgccgccgcagcggccgcttcattgctgcgtgagtttggcggtggcattggcattttgaattgcgaaattgtgccgatcgacgacgtttattttgttgaggattttagattaaaaaattttttggaattatttgacatcgcaaacttaaaaaaaaaagtaaaaatttgcttttttcctaaaatcgatcactaattaatttaaaattaaaatgccctgcggcatttttcattttgaaaattttttgaatttcctaattatatttgaaaattttcaaattttcttaatttgcgcgatacgtcttttggccgattgatctatgcgtgatttgtccacacaaacaattcttttggcattcagaattagatccccgtctgctcggctgtccaactacggcattttccaacacttccgctgggctcgccggcactccgctgattatgccttcggctgccgctgtaagccttggcggccttaaggccagtaattagggcattaacgcgcgactgtttttgggcaatgccaattggctgactcatagagcaattataggcccttccttttattgatctcgagacccaataatcgatattaagattgatgagacgggcgcaaatgtcccccccccccaccctcccaccgccgttttctcttaccgtcccccctagtattttttctttaaaaaatttttttgtttttttttctgaagaattactaacaatggttttgaaattaaaaaaaaaatttcggcggtgggaaacttcgggggagaggaacgagacaagacccctattttttccgaccagagaccgagacacttggcatcactataattaattattctgctacttgatgatttactcttctgactggaactgacagacttaaaaaatgggtgtgttatgtttccctccgagtcccttcccnncnctatcagttccccggaaattttttttaattttcaaacttaaatttttagaaaaaattcttgaaagttttttaagcaatttttttgaaaaattttgaaaatttattcaaaaaaaatttatgctcgaaattttttttaattttcggggaggaaacgacggggggatgaactgctctcaaaaaaatacagttaccgtatcccccggaaatcctattaaagaaatatttctgctgtaactgcttgtaaaattttaatataattgattttattttcaaataaatcaaatgattttaagaccagccccgtgctgtcgtttcagtccgctgctgcgcaaccgtcgctcgttgccgtcaacaattcattggcggcacaggcattggcacttcaggcaaatgccattaaaaagcgaaaacttgcgaaacaatttttaaataaatgtggcgttgtgtttacgtgttacagtatttgcagttggcgtcccctcacacctcggcagcccaactgttcgccgcatcgccctacagcgccgggttggcatccgttgcgcaagcggcgacggcaccgaatgccattgactaccagcaacagttgctggcactggggtaaacggaaattgctttgtcggcaaagcctagtaaaattcaaaaagaaaaaaggcttcttacaccaaaaaagaattaaatttttatggcatcttaaagcgttgtgatgaaaatacgaaaaaatctttaagagaaaatctggcaaattaataaatcgatattaaaaataaccgaaaatttgaaattctttcgatcgattttttcgctaaaataccgaaaaatatatatcgacgataagtcaatcgttcttgtctaattaataccttttttttcttaaaaacggacaatttttgggccaaaattggctgagaacttggcaaaaacacatattttttgttgtttcggcgaggtttgatttataaaattctatttctccattacagctgttttgcaaaatcctctaccatctcttggtcattaaaatacagtatgccaagcattttcagccaacttcaacagcaacatcagccccagcagtcacaacttgacgttgccgctcagtcccaacaactgtccgcactgttccagcagcagcaactcgcactgtccgcgcttcaacagttcgactacggtagcggtgccgtcgtcggttacggtggcggtggtggaaaaacggactcctccccgtcttcttcagccgctggtcagagcctcggccaaaccataccgtacctttaggctctctcatagtgtttttaagtcatcatattatactgtgtgttttacaa

SEQ ID NO: 4161 - DNA, 2537 bp, Heterodera glycines
gtttttaagtcatcatattatactgtgtgtttttacaaaaccgttaatttaatttattatttttattatttcatcgttttcaagttttttatttatttcactattaatctttcttcaaaaaaattctcggtctccgcccgatttctatatcataaaatgatgccaaataatcatatcattttcacttttcaatcattgtcattcaattcttgctcagggaagacttttctttaatttgcttcggtttaaaaattaaaatttttcaatttgtccttttacataatttaacctttttttgggtgtaagcatttgtactgtcaataatgccatttttgtcctaaccatcgtttttctaatgaacaacaaacaacatttttctttgaaatattttctgtacatatattgacgcactaaattttcaaaaaattctttaactttacacttttcgcacttactacgggttaattttttaattttaattttttaaataaaaataacttcaaaaaacgcttcaatttcatatttatttatttatttttaacccaaaaacattggcaatatttggtcaccacaaatatctatttttcttattaacatttaacaattaacaatctgtctgttttcacaggcggtggttacattttgtcgacccatcgccgcttcgtgggccacagtcgggacagcgctcatccgtacggcggcggtgggagcggaaaataaaacaaaacaaaaataaataattcaatttattaaatttatgtagcatttcaaattttaatgttggtttgagatttaaatctaaaataatattttttgtttatttttatttcacctttttacatttatattataaattgatgtttttgtttgttctccatctcacattttgtctcgttttgtcgtcctattacttaattactaatttttattcatacatttttacttttttcaatcattttttgatttttataaagcaaaatcataaattttaactacttaattatgctgcgctaattatacactttcgccactagcaaataatatttcaataaaaaagaattagcacgtaattatgacttccgaatcactaattattttataacagtctaagtgtgtaaaaccgaattccaacttttttaggcttgaaactccgactttccaaatttttttcgagcctaattctatgaatatatatatgtattatgacatatccgggcatatccgatttttatggacattttaatacgaaaattcctgggcaaggcaccttttaaatataaaaattcaattttttttttttttgctttaatacttttgacgcttataattatctttttttcttacttattattacattcattaacgcttctaaagtgatttatttcttgcaaaatttagcataattttaaaaataatatataatccatcaatatattagatattaaatattttccagttttatttttttctgttcctcactttaatttcgtcgctgaaagatcaatcccaacttttcatgtctcaagccttaactttttgccgtgattgtatttgctgtctccgaatggcataatttttgtaatcttttgacattaaaaaggtggaaatttatttaaatgaaatttattaaaaaaagatttattcaaaaaaaaacaatttccatttttctctgccaatgtgccttcttttcccccttcattgtgctcattgtttttggtttttattgttatgtaatgtaatttacccttcttttgaatgatgcgcagataaaatataacaaatgatgttgttaatataaaatgaaatttaattcgtttaattaaatgggtttttgttaacctaaaataagttgtacgacatttgcggcagaactgtcaaaaaaataaatgcattttcaataaattttcaatattccaaaaactgaaattaatgactatttctcgccatgagatatcggcaccttgtaacaagctctttccacatgaaatatttgtcggaaaatattctgacaagagtttaagtctgggactgaggtatattataaatttaaattaaattgacaccatcagtagggaaaatggaaaattttcttaataaaattaaatcatttgccaatatgttaacagtttatcaacagtgttttcaaatcgctaacaactacatcaagcaaaagtgctcaatcttagataaacaaaaacaatttaaaacgttcgtcgtgggtggttgggaatcggtagtgactgtaggcctcaatcatactgtaaccggaataattggtgaattggctgaaggacagtcccacgggcaccacgcaagcttttgccgtcattgtactcacgtgggcaattacataggagtggaacaaatctggcgaagtcacagggccaatttccatttcaatcgctcgcatcaaagtgccaagatcgggtgttttgtcatttttactaaacgttattttgtggattaaattaatagctgcgacattttcaattttcttattaattttacaacttatttggcctattataatattagta

SEQ ID NO: 4162 - DNA, 2018 bp, Heterodera glycines
  misc_feature (42)..(42): n is a, c, g, or t
  misc_feature (91)..(91): n is a, c, g, or t
tttttttacaaatctcacgtcacgaaaatattatttattacntcaattcaaattctaaatttcaatacagcgcaatgtttcatctcatacntcacaggatgatgtcgtacattttgtcacgttttctttcaaaccatcgctctgccttgtgggcccttgtcaaatgccccactttgtgccgaaacaatgaaaaattgatccctttgtaaccttttacgaccgcgcaataactcgcagggcacctctgccagaaattttcgattctgtcgaagtcattcgtgaccaaaatttgggagacgtaactgaatattaaaaaactgttccgaaaatttgttttttcggttttaagccattttggtggcggtccgatcacctaaggattggtttgatcaagtttatataaaagtgattcagagcgattattcatagaaatcaatgattattggtcattgtttcacttacccgaaaggcccacgtggcgaaacaatgtcatcgatcagatttgcggtataattgtacgaatatgggtcgatgattggattctttatcccgatcttgacatgccgaattatttccagtggccaggagttttcctgtaattgacgcatcacattttagacaaggatgagtatttgcaatattcttttttttaattgaaaagtttatagagagtccgattatgatttaaattgagaaatataaatctcgtaaaaaattaaaaaatgagaattcaatatatgaaatcgtaaaaaaattaaaccattttgtcattttttaatcccagctataatcgcataataattttaattgctacttacgagttccgctcttatccattgagttgcattgcccgtgatatctttcacaaattcagaaattttttcaatttccctcttaatcaagtgttcatcgcccgaaaatgtgaagtttgcgcacattcctccaatcatagccttaagaagcatgcaaaagtaaggaatagcttataaaggaggatcctcaggtgcccgttgggtttcggtatgaaattttatgggtgggtagagcaccaaggattcttaagaaaaggacttaaaatatttgccaaataagcatgtgtaccgagataaaaaatgtcaaagattttaatgggaagataataaaagacacaattttaaatagaaaataaaattgcataaaaacggactcgaaccgagcagaaaaaagtaacccaagtcaatttgtttttctttttttttaccgattaaaaccttacaaattaggaattttttgccaatgcaaacatgctcatttggcaaaaattgaaactatttttcttaagattttttcggcttttttggcgccggcgccaaaaatgatcagaaaaaattcattaaatgaaaattacagcaaaaaatggatttttttttctcttcatgttattgcccacagtcgtgggttcggatccgctcgacagatgctgaattattttaaattttttaaaaagtgttattccaactagcatatttttatgcagttatttaaatttattttatgatgctatttcatagagaattgtttgcttatcattttaaattaatttaattgctctatcattattttagaagtttttatgaatttttaaaaatttgttatttttatcgatttttctaagtgatctaggtggttacagtttgaaatgttcccttgttggatattcaaccactcataaatttcataccgaagccccctgaacccatgtggataattcaaagtagcatttttcaattgataatgtaaaaaaatctttacgattttcatggtgtcaatggaaataatttcggcaagccgattgattggatgcctcatcgacgagtacttctcgtagacgctccgaagcaagcacctaaattgaaaattaaaagttaataattattagggatggatttttatacataaacataaacccagaattggactttcaaaattattaaatttattaagaaaatttggtagaattaaaatgagcatataaacaa

SEQ ID NO: 4163 - DNA, 1882 bp, Heterodera glycines
ttcgcccctcccttccccccgttttctcccttattttccctctccaacttttagatcggtctccactccgaccatcgtccccctgggcaacttcccatgccccccgcctctccccccacctccgtgtctccccattcgctgccaatggccaaacgcgccaaatcgtcgtcccccgccctctctctgtcccattgtcagttgtactgctcgctgcttctgttcctcctctccatcctcctctccgtcctcatcacctttcttctcacccggaatgccattcgatctcaaatagaaagggtcaaccaaaatgaagcggtgacggcaaaactcgtcgccccccacggggccattgcttcgctgaacgcgggtcatgacatgtgagtttttggaaggagttcaacccgtaatttgatcgatcagaacacggctacgcatgccgggaaagtcactgttggccaacgcacggccgcgcggaaacgaaacggcggacgaagcgaaggaagagcggccggaaaagcggaaggagccgggcgcggaggagctgagattgtccggagaggcgcgttcggccgatgcttcttcgttcccttattttgccatttcagcttttccccatttggtacaatttgtctctgaaagttttcgtccccggctttggtgccgaaatttcgccccaactcaatttgacctttaacggagatttgcttctgaattttgccgttaatcggacaacccgaacaattgaattgaacgcgttaaaactgcgttttgatccgaataatttgatggcgtacgaattgaaaaggacggacaatttggcaactggggacgaggtggacagaacgccgaaagtgatcggaattcgggtggatgaagcgcgagaaaaggcgagcaaaagggcgggcaaactgtcgatcggagtgccaacatctgttaaaaacggtccttttgaaggtgttcttcgacttggacggcgatttaaccctgggaaatcattacgccctgcgggtgatcggagccaacgaatgccccgctaatgctcacctttctctccttctcgtcagattccttattcgggcccaatcgcctccaaattgtccggcctttacctgaccacgtacacaacgctttccggagagcacaaatgtgcggcagtcactcaaatggagccgacggatgcgcgcagaatggtaaaaaaagggggagggtggaagaggtgggcctaattggacaatttggaagtgattagaggcgaatccatttgtggttatggttggtgagcctaattagtttgctaatgaaggtgccctccttcgatgagcccgaattcaaagcgatctttcggctgagtgtcactcatccgaaagggtcgcgggcggtgagcaacgcgaaggaattgcgggagcagcagcaaacgtgggggaggggtggacgaatttgcaaatggatgaagcgttttccagggaagagacggaatggattcggacggacttcgaggagactttgccgatgtcctcttatcttttggcgttggtcgtttccgacttcgaattcgtcgagggaaacacttcccgtggcacccgcgtttgtttttcctttccattggcactttgttctcattttgtttttcatttagtttcgcatttggtctcgtaaagatgcacttaatttggtcagtcccaccatttttctttggcatttcgttttgctttgctcagacttcgtatgcccttcgggcgggcataaaagtgttggagttttacgagcagtactacggcattcccttccctctccccaaacaggacatggtctgtctgtcccatctcaactcttttctattcgctttgtccttccctttcagatggctttttcccgattttgc

SEQ ID NO: 4164 - DNA, 1328 bp, Heterodera glycines
aatgtttgtacaaattgaggggtctgaagaaaatgtttgagcgcaatgcgacggcactttgaaattggaccattggcagtgccttttggcattttgtcggctctttcagatttacctcacccgcttcaaataccgaaacgcggaacactccgacctttgggacgcactgaccgaagcggtgccggagggaatgaaggattggaagggcaacaaattcagcgtcaagcaattcgcacgccaatggacagaacggacgggctttccgattgtgcaggtcccttcggccaaaagccaccaaattccgtccccctctttttgtccaggttaaacaaatcgacgggcagcgagtccaactgagtcagcagcgattccgaatgaatgcggacgcggcagaaacgggcgcagggggaaacagcagcggcacttgggaagtgccggtgtggtggagcaaagacggacagaacggccccatggaatggctgaaggacggtgggtcccccgcctccgtttgcattgatcacccaattcattgtcagagtcgtccatcaacgcgtccgactccgccgttttggtgctgaacagccaatcccatggcttttatcgcgttcattacgcggccgaggcgctgcaacgcattcagagacagctgttccatgaccacaaggcaatttagaggaacccccgccacttctcatggccttccgtccccgtagaatttgtcgttggcctcgcgcactcggatcattgacgacgcgttcactttggcagaagcgggttacatagcctacgaagcgccgctgaatctgagcagatatttggtggcggaggaggagtacccgccctgggagatggcattggccggtttttcgaccattcaaaactttttcgaggatgagcccgaagcggggccaatgcgagtgagcaaagggaagggccaaacgaaggccaactgaccgaccatttgcaggcgtacatcaagcagataatcaacgcactgttcgagcgggcattgccccgaattagcgaccaaagggacgacgagcagcactttttcgacaagtgagcgaacggactgaacgattttgcattttggcgagtcatcggactgtccgagttgttcagcttgttacggcaacgggtggtgcaaaggatgtgcactctgcgcgacgaccgttgcatttcggccattttgaacctttacgccgatggatttgtccgcccgtgccaatctcagcccgacccgccgatggcttccgcgtgctcacgcgtccctgcgcctttccggacatggcctattgcgaaggcattcactacggggcggagcgcga

SEQ ID NO: 4165 - DNA, 1216 bp, Heterodera glycines
aaaagccccccgcttttgctaattgctcatttgtcagattgtcctcgactttttcattgaccattgggacgaaatttacaatgacttcaaagagcagcaaacgcttctccgttcgatcatttcgagttccgtcgttggcaagtcgaaacgggtcattgaccaagtgagcaaaaaaatgacagcaaattaagtgacacttgtgatttgaggtggaacactttctccgggagaatgaaccgacgacaaagaatttggacgtgttcaaacaacgaatggaagtgctgcagacgaacaggtcgacggaatcccaactttttacgagtccaaatccttttactgattgattggaatgtgcaaattaatccgaaactgctggaataagatttagtctctaaactgaacccaatgactgtttttgtgttaaggcgttggatggaacgaaacttttcgcccctcgctgaatggttcaggtaaaacgctttgaatacttatggccaattttcatggtaactcattcatcacccataggcaacagagtcttcccatggaaaacgaagaaatgttcaagccaatcgaaggtcccacaccatcgcctatcgcttaggcaaagttccaaaacattccatctcagctcaatgtgatacttacagatgattttcatgtacattaatcagaattgtttgttgtatattgcctatatctctaacaaatcattttctttactaaaatttaaataaaagtactggtgatttcccgttaattcctaatcttgtcaggttatttatgtcccccccccccccttatgctcttagttgtattcgtattcacaaccacacgcccctggatagcaaaacagttgatcaaagtcagaaatgaaattgacaaacaaaataaaactagaacaataattaaccaaaaacaaaggtcgggcggacttgtaaaaataagtcaaaaatcttatcactgctgtccctcgccctttttcttctcctcctccgtcggctgttcagtgcttccgctctcagtgctgctgctctgatgttgctggttcttttctgccatctaaattaattaaatgtcgtttgactgattcttccacttagttgttagcccactccatcacaccttgcgataggcaaaagcgaacagcttaagcgatttctgctgcagctcatttaggagagccttcacttcggcagatttcaaaccttcacgg

SEQ ID NO: 4166 - DNA, 1929 bp, Heterodera glycines
taagcgattctgctgcagctcattaaccgactcctttcacttcggcagaattcaaaccttcacgggttgccaacttcttcttcaactcttcaagtttctctttgaccacattaacctaaataaaagagagttaagcattgacaattctcagtgattaaacttcgtctgcgttgagatgttccgcgtattccgtgatctttgactccgtgtcgtgcagcaccgactccgcatggttaattgcctcgatcgtctctttcttttctgcgtcggctgctgcgtgtctttccgcttctcgtaccatgttttcgatttggtctttattgagtcccccggacgattggataataactggaacaaaccaaaaatttacaattcttcatatcgaagagtcaaactttgctgttctttgccagttccacggtctcgtgccgacacattcacaattccgttggcatcaatgtcaaaagcgacctcaatttgtggaacacctcgaggggcaggcggaataccaacgagagaaaactggcccagcattttgttgtccaatgccatgtcgcgttcgccttggaaaactttgatctccacttgagtctgcccgtcagcagccgttgagaagacctttatttaagaaagtagaaatcaagtgttgacagcaaccaacttggctcttcttcgtaggaatggtcgtattacgcgtaatcagtttggtgaacacaccaccaagcgtttcaattccaagtgacagtggcgttacgtccagcagcaacaggtccgtcacatgtccagcaagaacacctccttgaattgcggccccgatagcaacagcctcgtcagggttgacagctttacttggctgtttgccaaaaacttcctgtacagtttgttgcacctgaaaaacacaaatgcctaaacttggtaataatataaagaacaaactttgggcatgcgagtcattcctccaaccaacaaaatctccttaatgtctgagggcttaacttccgcatcgtgcatagctttcttgcacggttcaatcgtccgtttgataaggtcggcggtgagttgctcaaatttggctctcgacagcttcacgttcatgtgttttggtcctgatgagtccacagtgacatatggcaaattgatatccgtttgcgtagtgctggacagttcgcattttgccttttcggctgcttctcgaacgcgttgcatggccattgggtctttggtgaggtcaattccttgttcgcgtttgaattcggcgacaaggtgatgcacaagcacattgtcaaagtcctccccgccaaggaaagtgtcgccgttggtggatttaacttcaaagacgcctttttggatctccaaaatcgaaatatcgaacgtcccgcctccgaggtcataaacggcaatgctaaaatatagaatagtcaactttttctttgatattaatttgtgtcagtaaaagcctcttgagacatctcctttcagtacttgaaatttggtaaatgcttacactttgtcttccgccttatcaagaccataagccaaggcagctgcagtcggttcatttatcacgcgaagaacatgcagtccagcaatttttccagcatctttcgttgcctagaaacaaaaaagaaagtaaacgatcaattaatttgaaaacctgtctttgtgagtcattgaaatacgccgggactgtgacgacagaattcgcaacggaagtgcccaaaaaactttcagccgtctccttcatcttcatcaaaacaaaagcgccgatctgagaaggcgaatacaactttccttgagcttcaagccaagcatcgccattagacgccttcacaattttgtacggcacaacttttctgaagaacattgtgtggttattgcttagtgcttttcattacatgtccttctgcacttcagggtcatcaaagcggc

SEQ ID NO: 4167 - DNA, 4627 bp, Heterodera glycines
  misc_feature (38)..(38): n is a, c, g, or t
  misc_feature (2804)..(2804): n is a, c, g, or t
  misc_feature (2809)..(2809): n is a, c, g, or t
agtggtggtaccaattcactgtctctctgttccttctnttcactcgcttttccgcttcttcctgttcgcgtttcatctttttctgtttatgattcaccttctcattgagaaagtattcgcccgtctccaattgttcgtccactttccgtgctttttgcggtggtggaaatggtgtgtaatcggcctttgtcttccatttggtttttgatttttgcttcgtttttcggatatctttagcattttgcacctaaacacagcggatatttgtatttaaatgcactcagtaaattgacccagcctccttttttgtatgttcattaccttctttttgaactttggcagaaaacgttcccaattttcgttcctcagtttgtcatccttcatcagctcctttttgatcattagcgtttttatgttgtaaattggatgaatgtttttcatgcaatcttccacaatttttctgtgaagttaaacaaatgagttgcgaatgaattattctgtttgctttcgtttcacctgacttgcttcagtccaaagtgtgttccaatggacgagacggtgccgcccttaacaaagtcaattccaaaactcaatacccaaaatcagaaaacgttttgataatttataacaattccatccaacccggtttaagcaaatgcatacaaatccaattcccatcccatgaaaattgatgtggccacctgaatgtgcacaaaacattccgtgaggagttcgattgcctttagcgttgctccgttctgtccaactaatcgggctcgcctcttcacaaaacgctcgcgatttgggaccatcgatgaaattttgataatatcgcagaaattttggtcttcgatcactcgacaagcctgaaaaagaatgcaccaatcaaatttattgtcagttgtcttttcttagtttgaaagaaactattaaaagtgacgacctgatcaaatggtacactgcgggccaacagttttatgaggtcacgcgctttgtacagaatgaaagggtcccatgtctttcgcgtcgttctgacggtcattgtgcctaaattggtgacatttttcattcgtcttttctcgccccctttggtgccaccttcaaaaacgtccaagtccgccttcacgtggtgctccaccaaagccttttgcaccaatggccacgcttcccttatgtatttctcgcgataacgcggaaaaagagtggcaaacgacgactcacagaccattccctgggggttgtcgtcggggccgaaggtgctaatgtctaaaccgaaaaaatttacgagaaattagggtgaattgcttaccccaccacttctcatccttccccttaggcaatttgggcgcacttcgtgatgatgaattattctcctgttgactctctttgccttttcgatttgccattgcaaacttaacaattaatttgtagtgtggtcatattgtttgaattttaataaataaataatgaatccgtttgaattactgcaaaaaacatcaaagcattctttgcccataaatttattgatcaaacaaagatgaacaatttagaaaatttacagttttgaattaaatgaatgaaggttactttatacgtaataacaaaaactgcataaatggcgattttgccaaaataaatagtaaattcattcaacaatcttgacaatttttccaattgcgattgttttcccctcgtccctgagcataaaccgtcccatttgcggaaaacccttgaataaatccatgcaaaactgttccgccgattcgagcctcagaatgcatttgtcgtcctgcttcacaaactttgtcctcttcttgttgctcgggtcttttttgtctaccgtacaaattacagcctaacgaacattaaaaagcattacaaaggccaaacgaattggtcggtcaccttcactgtgacttcctccacagcttcgtgaatgtgcagcacacagccaaaacccgaagttattattgacttatagtccaaaataagcacctaaaatatagtaaaacatgaaatacaaaagcagcgtaagctatcagtttatttattttttacctccgcgtcgaatatgcgaccaattggacacggagaatcggaagtacaaagcacaaagccggacattatttccgtgtcctcgactccttttattttcagttggaaactatcaccagcataaacaagttcggtctcaacatcgtttacaaaggaatttagaacttgcacagacactcgatttggcattaatgtcagcgtttgtccttttgaaattgaaccggactcgagttttccagaaacgactgtgcccatgtcctgtaaaatcggctctaataaataagaaagtaaaattatacagagaatttgttcgctattatgccgcgcactgggccattgaaatccctcgcgatcaaagggagggagtcgatgtattccaagaagcacatcccggtgtaccaagggcataagtcggaagaaggccgttccttaaggaaggcgcctgtgagtccggagcatggcataaacatgatgtcattcttcgggttgaagccgcacttcctcaagaaaggcgtcagctcctcctggatttggctgtaacggccaacatcccaattgaccgttgggtcgtccattttgttaacaagtattatcatgtgcttcactccggttgtttttgccaacatgacgtgttctcttgtctgtccgccacggtcaaaacccgtctcaaattctccctttcgagcactaataacctaaaatggtaaactcgggtcagggagaataacaggcgaaatattcattaatanatttngaaaccctaaaagtatgtaacaatttcttaaatattaggatatttaattcgctataattttcaactcaaaaattaatgctaaatgctctccattttgaaataatcaaaatactaccgaccaatactgccaaatcggcttgtgcagcaccagcgatcatattcggcacaaaagacctatgaccaggggcatccaaaatggtaaaatgtttctgatccgtctcgaagaatgctctgccgacttcaactgttttacccttttcccgttcctcttcatctaaaaaacattacatcataaaactgacaaaatgaataattaattctctatcgaaaaaactaccaataatatcttacttgtgtccagtgcccaggataagtaccaactctcacggcccttctctttcgcttctttttcatacttttccaatgtccgtttatcaaccattccagtcaaatacattaattggcctccaattgttgatttgccggcatcaacatgtccaatgaaaacctgagaatgcataaagttagagtgttgatttaaaaaccggtcgggatttaggaaattttataaaggacgaggaaatgttgtagcatatttggtaaacataaatacttactatgttgacacgctctttccgaccttctgctgacattctgtgaagacgacactgctctatatataatatagaaatgaaaatagacaatattaacctaaaaaatattaaaatttattttttcttagcatctttagtagagggtgaaaaagattcagccttggatggggtaaataatgtaaatgtgagaaagaaagtttgtcattttttgaaactcctattcatggattttccaagaacttgattttattccataaaatccaatcaatgtgtataaaaaaaaactcaggtccttgtaggcactaaaaacctggattttttgagatatttttaattacctattattgtcagttagatatttagataaaattaggtaattaaatacataatttttttaaactatttaaaatccaagtcgaggccaggtcccacatgggattcttgtccaggctttctcaaaccaccgaattctagttacatacataaaagtttttaagctctttgttcatttattttgtttgaatgcgattctatgtcaaaaacatcgaagaaaaattttgtgacaaagcaactcgttaaagaaattgttattccagccgacaatgaatttgttgggaaaattttagcttcacgaggcaacaacctccatgaagtagaaaccgatgaaggggaaaacttccttgtgtaatttaaaatttgttttaaaatacttttcaattttttaggagtatgcccacaagatttcgaaagaaattatgggttcgtcgcggcacttatgtgattttacagtcaattgaagaaggagacaaagtgcgagctgaaattgttcatgttttggacccggaaaacattgcgtttttgatggaaaaagaagtttggccggagagatttattgtagaagctgcgcaattgaccaagcgagggcagcgaactgaagaaaatgacgattcggacctattccccgcaacttcggaatctgaaaattcggctgaagagagttcttccctcgtttctgaagatgtagctttgaatggacagacaaatgccaaagatgaaacaacgatttaaaagaaatttaattttgttgcaaagaatttttaaataaattttttaacaaaaatgtttattagaatgactttgttgacctcaaatgtatttatttgtagcgttattattgcttaattaagaaattgtcattattgga

SEQ ID NO: 4168 - DNA, 1250 bp, Heterodera glycines
  misc_feature (6)..(6): n is a, c, g, or t
  misc_feature (49)..(49): n is a, c, g, or t
  misc_feature (56)..(56): n is a, c, g, or t
  misc_feature (110)..(110): n is a, c, g, or t
aatttntggtggattcgaaatgagataattcgccctcaccaggtaaggngaaaagntgtaaaaaaaattttgtaaaccttcaattatttaagcaaatgtcattctgcggnagttttcaacgacttggtagatcttcaaaagatgctcctgaaatggttattgattgggcgaaaaacggtatattatttataaccatttagttattgaacatattttgaaaattcagaaatatgtgcccatttttccattcccatcgaaattttcgacaacgtagaattcacagaaaaaataaaaactgtgtatccaatgttcaaggatgtcaatactgacaaactatcgacccatcgccaatgtaatttttgtagttttttatcttttcactttgaatttttagttgtgtctgacatttgcgatgaaatagaaagacgcaaacgaatgggttgaagacgcgaaaaaaagatcagccgaacgagttcggtgtgaagtgaacggactgaaggtgctgttctggagcgagggcatcgaagatatttacttttatttagctgttgtcactttgaattttgtaatttatatcgttaactttgctgacataaaaattaacacaccgtttaaaaaattagttagtgcaaagaaaaatctcatttagcgagtcacccccaactcatccaaacccaactcatccatacccaactcatccaaacccaactcatccatacccaactcatccatacccaactcatccatacccaactcatccatacccaactcatccatacccaactcatccatacccaactcatccatacccaactcatccatacccaactcatccatacccaactcatccatacccaactcatccatacccaactcatccataacgctgcgagtcatcgtcgtggcatggcattttctgcttatgtggtcttgaccgtggacatttttgattatgccggtcttgaccctggcattttttggttgtacggtcttagtcgtagtattttttggttgtacggtcttagtcgtggcattaaatgccacggcgacgactcgtatcgtgctatggatgagttgggtatggataagttgggcatggatgagttgggtttaccccgtatttcacaaatatttttagtatattcgcttgaaaaaattattcaattattttatcaaaatcttttttgtcatttttcattattttagaacatttttgggaaaaggagtgactatttacacgttttttacag

SEQ ID NO: 4169 - DNA, 5287 bp, Heterodera glycines
  misc_feature (5177)..(5177): n is a, c, g, or t
  misc_feature (5192)..(5192): n is a, c, g, or t
aaaaaaaaactcacttgatgcgctcgaacgatgtagtcgatgcggagcaggttgcgcacgctctcgaccacgttcgcgccgaacatgacgccggctcctctgctgttcggggcgacgcctgtgatgctcgtcgacgggtcggcccagaggaggtcaatttccagcgaacgaagcagtggctcggtctgcgggcgaagcaagttgctgagctggtccaggctgcggatctgatcggagatgccaccgtgcatacctgaaaatcagttggaaaacagttatttaaccccaaaaattgccctcccccaaaacttacagaggatcttctcgccgaccagtccgacgaatggcatccaggcgaagacttgattgaagaggtcgaagagtcgacgagcgcccggtcgcgggtaacggcggtcgatctcctcgtagaagccataactgaaaatgggggggggggaatgattaatcacaaaaaaacacacaaaaaactttttcacttacactctgttgatgttggcgcactcgtggttcccgcgcagcagcatgaagttggaggggtacttcacctgaaaaatgggaggaaatgagtttcattttttggggccccctccgcccaaaaaccacaccttgtagcagaagaggaggatgatcgtctccaacgactggggtcctctgtcgacgtagtcgcccaggaagacgtactgctgctccggcgggaggccatgcgttgagaagatcttcttcaggtccgcgaattgtccatggatgtcgcccacgatgacggccggcgggtggattctgacgagcgtcggctgcattcggaagacgtccgttgccgctttgcgagagctggcggatttcatcgtcactgatctgttggggaaaaaaaagggggaaaattaatttttgaaaaactcaaaaatttttctacctcatccgtgaagcgatgagggggcgaacggttgaccttcgtgatgatcgcgtccacgcctcggctggacagccgcgtttttttcagtttaagtgtcgattccttctggatgttgtagtcggccagggtgcgttgcatatgtttaccaaacgcacaaataaatggtgcacatgtcttttatttctatgcttgtttaggaacagaaacatttaattgttttatttagtgtctgtattttattggaatatctcttccagaaagttaaaaaatttgaaatgtgaccggaaatgccaaaaatttcaatctttttaataattaagagaaaaaaattttcatttaaaagatttttttatttttcccatgatagtctgctaatatgaagactgatttacataaatgtgatttatcggcacaaagtataaattaattaggagaaaaaactgttgcgaaaagaaatctaaacccaaattacattctgttgtcccaattgttgactgtgacaaaagggtgggagattaatgaaaattgcatatatttaccaaacgcacaaataaatggcgcacatgtcttttatttctatgcttgtttaggaacagaaacatttaattgttttatttagtgtctgtattttattggaatatctcttccagaaagttaaaaaatttgaaatgtgaccggaaatgccaaaaatttcaatctttttaataattaagagaaaaaaattttcatttaaaagatttttttatttttcccatgatagtctgctaatatgaagactgatttacataaatgtgatttatcggcacaaagtataaattaattaggagaaaaaactgttgcgaaaagaaatctaaacccaaattacattctgttgtcccaattgttgactgtgacaaaagggtgggagattaatgaaaattgcatatatttaccaaacgcacaaataaatggcgcacatgtcttttatttctatgcttgtttaggaacagaaacatttaattgttttatttagtgtctgtattttattggaatatctcttccagaaagttaaaaaatttgaaatgtgaccggaaatgccaaaaatttcaatctttttaataattaagagaaaaaaattttcatttaaaagataaaaaattaattttaaataaaaaattatatttctttttaactaattttttttcatcaaaagctaattcgaccgttgctgtacgcttttgtcgccatctcagcagtcacccaattaactttgggcacagatgaaggtgtgaatttcactctatttatttataacgtttgcccatagtcaatagcgtgcttaattaagtggctgtcatttgcagaaatattgtcaatcatccgagatgagaattgagcaatacattcggaaaagatttatttggatatttaattttgccaaatatccatataaaaatgagcgtagtaaagtgaataaattgcaaaagcccttataattaggatgttgcgaccaattaaattaatcctcttccactaattagcaggaaaaggatttccaggatttttatcttttttttcgcggattgcattttacgacgtgagattcacaaaaatattttctccaatttcgagaataaaattcaaaaaccccaagtcggcgcttatcacaccgccgaacccaactgacaatactgattgacatcatattaaattatgaatccaccaaaatgtctcctttaattgattcaatttgttaaatataaatttatttataattgtctctattccatacaaaaatataaaatatatttaattaatttttttttacgtataggaattatttggttgtgcccaactgctgagagcgcgtcacctgttgcaagcagttcacctgcagcagaacaacccaaactgggaatcatggtggtaagtgtaggaaaatttttaaaaaattaattttaaataaaaaattatatttctttttaactaaattttttttcatcaaaagctaattcgaccgttgctgtacgcttttgtcgccatctcagcagtcacccaattaactttgggcacagatgaaggtgtgaatgtgggggactgatttaatccagaaaaaaattgttgtggtactgtcatactgtaccattacagtaccgcagcatttaaatttatttgcaaattatcttcagatatcgacacatttcgaaaattgatgaacgagtacaacactttgagcgggccagcatttgatgttttgggcaacctgctcagtgttagtgaaaacagcaaattgttgatgaagctaactggcccagccggaagtttgcttgcggcatgtattgagatcgcctttaaggtcaacaaaatattcttctatgccgggatggtcccaggattttgatttgggcgagtggtgatttagccaccctctgggcgaagaactttttttaaatttgagtgcaatttgtctaagaaattttgtccaaaaaataattgtgaattttttgaaaatttcgccaaatttttttatttgttgagaacaaaaaagccgggacatgcgggaaccgtaacataaaaaagtggaataccgtctcggaaccggggtcattttctaccctaattaattaatttggttaatccattcttttcaagcccgaaagtcccactctgaaagcacttgcaacatttcacgactgggcggaccgaaaattcacggaacagaacaatatggttgagattgccatgaacagcatcagagtcgcgcatgacttaaatgattttgacaatgttagcaaactcgagttgttaataacaaataaatgtttttatttaattagaatgttgatgtcccattggcatggttgtccgacatttttgaaacagtgaccaacccaaagaccgtgagaagcgccaaacaagaattcatctcagcgtgtacccaaatgttctcgtcgccgaaaaaaattttaaatgtgcaatttaaataaaaataataaatatatttttcatttttagtatattaatgaaaaggtgaacgacaattgcaacacaatgccacggagaattatgccaattctaagcgagctgagggctctttttgctggtgttttttggcgttacgatgaacagaaactgacgattgagtacaatgaattaaagaaaacgtatctcagtaagtcaaaaaatttagattaattaaaattgttcctttcatctagagctggtcgggaccgggactggtactgaaaacaacgggtacaactgagtacccagtcccggttttgaccagttttgaccgggaccgggactagtcccgggtttttcccggttttccagccaaaaagtcccggtttttcaacccgaaaattcccggtcccggtttttgtcaaaaatcccggtcccgaccagctctactttcatcgaataaataaatttatttattttttaatattcaggagtgctcgaaaaatttgcaattgcttctgaagaagatgcacgagaaatcttcatccaaattcgtgattgtatgttttatatattatcattattacattaattaatgcaaaataagcctaattttaatgacattttggaaatcctcaaaaatccaatggcaaattttgagaatgttgaaaatttatacaaatttttatgaaaaaattattttttatttttttgaaaatataccattaaaaagccaaaaattttttaatattaaaatgtaattctaatatataactaaattactgtctgaccaattacttaaatatgtacatttagtcgttggtgattcaactctcaatgaaactgttcgtttgtcggatttgacactttcattaaacaaaatgtttaaaggggcattgcccgaaatgtaaaattatttaagaaaattctttaaattttatgtaaaaatttttaaaaatttattttagatgcttactaaggagcgtatatgaaggatatgagacaaagcgcgcaccgattctaaaaatggcagaaattgtaaaagtcagcacattaaaaacggtaggcaaatcaacattaatttataggggttgaaaatttcaaacaataggaaactctttttttgtattgcaaacaaaagttgggatttcatttgcctttttggttatattaatatctaaaaatttatacctatttttgatattatttttgcattattttccctacatattttaattttttttaatatttggagattcttgaaaatttatagggatttcttataaaatcaaagactttttanaaaatgtcgccctanaaccgatttttcattcttaattcttttttctgcaaattttttgtccaaaaatcatttaaaaaatttatttacatattttttatataaattatttt

SEQ ID NO: 4170 - DNA, 2442 bp, Heterodera glycines
  misc_feature (2339)..(2339): n is a, c, g, or t
accgaccgaccctcttgtccggtctctattgtttagaatcaaaaatttagtatcatctaccacgtgttggtgagccaaggatttgagcgcatggaaaacatttggtttgattgtgagccgatctgttgccaccgtgttaggcaattccatggcattaattttataatttttcgacatgagatggggagcattggacgcgcgagaaacgctaaaagatggtttgacaattggcggttgaatatcagcgaaattataaggtgttttattattaaaaataaaataattatggttaataccgtatatgctctaattatagcccagtctctattaatcccgcagtctccaattatccccctccccttctgaggagtttaaaaataatccccctagtctccatttatcccccatgtgggataaatagaatttttaatttttcaaaatttttttaaaattttaataaaaattaattaatttaaaatcaaaatcatttaaatgtttaatgaacatgaaaaaataatacagccgaaaaatcacttactttaccgggatccgaacctgacccacctccccctcataataatgcctcagaatccacatttatgcagggattctgatgccttaacgaagtcttaaccaaaatctaatttcaaattctctatcagcgcctaaaataatcctaaagatatatttttggagattttgggacaaaaaatttttccactcaaaaatcatatgcaaccccactttggtcccgaatcccaaaatgagtttattgttaaaacttccttcaaaaaagaaaaatattaactaaaatacctaccccttataatacaaaaaattgcggatttttctagttttttaatttataaaaacatcttttttcagaattgagtgctgaattttttctcaaaaatgaaaaattttcaaaatttaaaaacaaaatcccattttctgaaaggttcatatgtgtatctgaatatttttgagggttttgtcaatgttttgtaaatatctttggaatttttcaatttttcacgcaaaattcagaaattttttaacaaaaatgcaacaaaaaataatttttttgacgcgattacatttttggcgacatgttcaaaacaaaatgttttttattcataaatcagtcgaaaaataatccctcagtctccctttatcccgcagtctctaattatccccccttttctgaggaggttgaaaaataatcccccatgggctataatcagagcatatacggtattttattccaatctcagtaccaacgacaaagcccctgaattgggcacattgacgaaagcgattgttgagaaagtgggcccaatcacttccgatccattctaccacagttttgtttttcttcacgtcagcgctttttcttcatcaaactgcaaaataccgaccggaatttcaagcggttcctatatgggacaagaaggatttagttttttggaggtcaatgaccatcactgggcaccgcgtaatgaagaatgttttaagttattcttttttctatgaaggattaaatttttgcttaaattagatgttattttaatgattctgaattttagaccgatttatcagaaatttcgacaattttgaatgcatttttccattttattttaaataaatgttaaaaaactgaaaggtgtatttatcgaggtcagattttcataaaatattatctgtataggatttacaaggaatatttgtctatcaacatgaaaatcagggatatgactgggcgtcaataacaaaagtctttaaagaacctgtgatcattaataatagattcaaaaacatagtgatcaagtgttattaaaaagaatgtttttgaattttttttataatcaaaaacccaaattgtgattatgtggacatggcgcccccacaaaatgaccaggccacgaaatgtccaaaagagtaaaaacccacgaaatgtgcaaaaaattaaagttaataaaaattcggaaaaaagtctatgtctattttagagttttcggagtcggtgaacttattttccggatttttataaaatttaattttttttctggatatttcgggtttttactcctgtggaaacatttttattcaaaaaacttttccatgttattttcattttcgtccaattcattctcaatttctgtgtatcatctcattatccattcttttccaagtaaagtttgtccaatttctgaacgagttcaaacagcggtaggccaattatgttcgggaaactgccggaaacgcttttcacaagtgcggcacctttgccttggattgcgtaagcaccggcacgacccctaggaaatattgtaatttanatttgtgagaatttgttcattttattttatgggttagcttaatttcatctcagcaagggactaacaaataagttcgaaaaaaaataaaatcagtttgaaacta

SEQ ID NO: 4171 - DNA, 5434 bp, Heterodera glycines
agttgtgggggaatggaagatataatatgataaaaaatgcatttccgcgcggctagggggggggggggaggttgccatcgtcttttcggagatggtccctttaattgatccacatggaaattgattggaaaattaaaagatgagaaataaatgacaaaaaataattgaaatttaaggaccaaaataacgacacaatatatgtaaatttgaggagaaaaaattaatcataataaaaatttggagaaactttatttattttgaccctttcggctcattgtcagcagtggctcagcagaggcaggaagtttcaccagaatatatatttagaaaatgataatcataaataataaccaatttttatttgattagctcagtaaaaaaaagatgtgagaatggaagatataatttattacaaaaaatagatattttatttgaaataaaaatccgctcgggtatgggggcgcgcgctaacattctcatttcggagatggtccctttattagatgacaaaggaaaagagaaaaataacccgaaaatttttgaaatttgaagaaaaagaaaataaaaaatttaattataaataattgtttaaatattttttatgagaatgtgaaaaaaaagaatattcaaaattgtttgagttttgagaaaattattcattttgcctcccgttataatttagttcttgtcgacttttttcgacccccctcccaaaataaaatcgaaaagttttctgaaatgaatctcaccaataaaatacttatccacctaaattgaattagagtgcccacgtgcatcgtgaggtggtaaagagtagcaaattagcacacgcattgtcggctcacaatcagttacattttgtaaaccccccctcgagcacacaactcatattcaaatgaacaaaataaaaatagtaaaagcatgtaacaaatgaccagatagattattagtcgaacgcgtatttcctatcagggtaaaaaaaacatttagaaaaatctaaatatatttttatgattcaattcctcctatagggactataaaaaatttctgataattgtccatgtataattcggttcctacgatatggcgtataaaatatttcattttgatgattttcattttgctctttgataggttcttctggtggatttaaataatttatagctaatgatacaatattttggaacaaatcatctatttctatacgaaattttctcagctgcttccggtatttataacaggttgccatgctatgttttgaagagttctcattttcatgacatctttgaatgtttttatattttaaacaattctcaaattcaccaagaattttcgaaatatttttatattcatttgaaatttgtagatatagttgtctaatcttttgtgctaattctaaaaatttttcataaatttcatgtattcctggagcactaaatgcgatgatcatatatgtttttgcatagaaagaaattttattacaatatgtcactaaatggtttgcgtcttgaacaatttttctttcccttttccatcttttaacaatttcatttttgatgaactgtatttcttggtcgattgttgtcattttttatgttaatttttttattctcttttattcgtgaagcccaataaaatcccacactacagattgaattctgttttccaactccaaaattttggtgtgaatccgccgagattctaagtgtagaatctttgcttcgcttaaacccttaagtactctctcctccagcttctttacctggtcgtaatctttagaacgttcggcctcacgccaaatagactctaccgtttcaaactctgcattcatttggtccaaaatggtgaaaatttcccagatacaatctgacattttaacgaaccactcacgaaccccgggggcatagggggccttttctcgggatttaattgcccgattaagggctccacgggcggatttcgcatactcatccgcttcatctgccaatactgaaacttctttccttgccctttcagcctcttttttgagcgcttccaacaaaattgctgttcctttttctgttctttgaatcatttttaaaaatttattattatctttccattctcttttatacattaatcagatataaattggtctttaaatgttggtcttggggaaggtccggggcggtataaatattccttcattgtttccttaactttatcggccaattccccaatcccgaggtcagattgagtataggcgttacggtacgcagtaccgacgtcctgtctatactgcttaacaatttcaaatgctcccttcgcttcgtctgccaattcacgacacattaaaacatcttttcggtccaaacacttatccatttcttttctaatgtggcctattttctgcctttcttcgttaattttttcggaaattccttgtacttttctcaccccttctaataacctaccgaaccacgttttcatacccggtgcctcaggatgacgaactttaattttttctgcctccgtaattgccctatgagaagcagcagcaaaatcccgtgcttcgttatttaatctggtggtatcccgaaatgctttttcaatggtttttctcgcagcattcaattgctgtttttcttcattcgaaagacagcaacaattgccatttgtttggtcaaataccaaaccaaaaactacgaagaaaattattttattcatttttatttattttttagtcaaagttcttttatattttatttatttgatttttcgaaacttttaccaactcggcatcataaaatattcctttaatgttatctccatttaaatcttcaattcgataagcgattgggtctgatttaattattttataaattttaaaaatttcttccgtaaaattcggaagatatcccttggcgaattttcctttttcttttgtaattcggactaaatcaccatttttaaatttattctttttttctgtttccaaatttccaaataacttatcccaaatatttccggcattttcaaaagtaattgaagacggcttgacccccagtgtcctatttacactgttgttaatgtttgttattattttgtctattacatcgacccatcgtagagtgtctttctttgtaaaatatctgtacaaacgctcttttattgtccgatttgccctttcaacgactccggcgtgcagatcaggactatacattacatttttgatgatgaatttttcctcaaaatattttttcatttttcctgcttggaattcaagcccactgtcactatatatcttcatcgggataattttcgacttttcgaaaacccgatcaaaagcctcgatcatgtcctcactcttctttgacttggctggtgcactaaagatcattcgactcagcacgtcgatgcagaccaataaatacttgtaaccgtcgttatgttttttcaattgatcaaatatgcataaatcacactgccaatcggtgtggaagccactcggtattgtctttagtctagggaatcttttcctgatgggcttgtgaatcgtgtaagttctctgtttttctaggaatttatttacgtcatcggtcgttatgtctgggtcaatctttttcgcttcgtttaaaattttttgaatccccgcaaaacttgccggagattttaaattataataaatttttgttaaaattttatttttattcattttattttttcatttttgatcatttttgttttatatattcatttctactttttacaatattttcatttttttcgcaaaaaaaaatatatgaaactccttatttttatgcgtattttgctttttggtacctatcttatggacatgaatacctacaattacataccaaaacagcaattgtacctgcacctgcaaacaaacgcacttgcacctgtatctgacatacacacatttgcacctgacatgcacctacacttatacttccaggcacaacatcgtatttgtctttgcattaacttttacacaacaccacatgagaacgcacgcatgtacgtacacggaacgcatgcacatgcaaacaaacacacttgcacctgtatttgaccacaaacacatgcctgcaccaaaaatacactcacacatatgcattttcaccttacgtatctgcacctacacatgcagacactcacacattgcacaaatacactcacacgcacagcatttgcacatacgctgaacgcatgaacctgcaaacaaacacacttgcacctgcacctgagacccacacacacatacctgcgccatagcacgcacacaaccacatgcattcgcatcaaacttgtatttgcacctgcagttgcaaagaaacacacttgcaccagtacctgacacacccacacatacctgcctagacccaaaacgcgtgcacataacacacattttcacctaatcttgtgtctgccctgcaccgaaaacacgcacacatttgcacttaacaaccacctgcacctacactttcaggcacatcacatgcattttgcaccaaaattttaacaacaccacacactcacgcatgcacacacacacgcacgcacacacatacccacgcacgcacgcacgcatgcacctacgcacatacacacacacacatgcacatctaaatgcaaatgcgcatacacacatgcacgtgcacgcataagcacattaacacgattactcatacacaaacacatgctcactcacaagccccatcacatcacctacaaatcattaagatataggggccgcttgttattttgatcattcattcgcactctgatcatcttctgatcatttgatcactcattctcactctgatcattttctgagtatattttctctttccgatgattcacacgcatttgcacatggttatctgatcattttgataattttttgatcccgatcacttttggtctctttgtcctagtctgatcatattatgatcactcaatcctacttatcatcttctgatcactcactcccactctggcagcttctgatcactcaatatcacacacttcttactctgatcaccccgattactctctctctctctctctgcaatcatttatttgtaatccctcactacttcaatcacactctcactcgcacactgataactcttctatctctctttgatcatactctcacttgtaatcactatttcactttataatgactcattctcactcctaatcatactctaatctacattcactcactctgatcattttctaatcattcagtctttatgatcacactcatcccgatcactctctctcacatgtgaacactcacacagtgattatttttctgatcacgcaatcacttactcacataccctttcacactaacttgtgatcacttattttttctctttgatcatttattagttcccaatccactattctgacctctaac

SEQ ID NO: 4172 - DNA, 2399 bp, Heterodera glycines
  misc_feature (108)..(108): n is a, c, g, or t
tcaatatttcgtcactctcagtctctttgatcatacatttgcttctaatcactcttgatcactagactgtttcctaatcagtcactcgtctcttgtcagtcaatcacncacactcgctcgcacttgataatttcacaaactacgctcccatgtatccataggtacctagcaatctgatcaatgattttcacctaaccttttcactgtttgagcatatgatttctcatttttaatcagtaatcaccgcttattacatatttttcactaaagaatatctatcattatttgaaaaaaagtttttttaattattatggtttaaaatataatatttttatagtcttacataaattggaggaagttttattttagttggaactgaatttgtactgttttcagtgtccaattctatttttcttcctttaagttttatcttgggccttagaattttaattttttctttatgaggaatttcttttttctccaagttttctttttgaggaatttctcttttctccgtgtttttaggtggtcttccccttgacttcttttgtttatccatgttttattttattttttattcttttaatttcttttatacatttcataaatgaaaaaatattaagagcaaaaaataccaacaataaataaaagacaacatttaaaatatttattcaaaataaaaaatcaccaataaccaaaaggcaaaacagttaaattctcatcatccaaaataatcctaaattgaaatattattttggtaataaaaacctgtcaaacaaaccccttcttttgaattggtcgataatccttagtaatattacggctgatcacgtaactttctcttgtcggcctaaagaaattattatttttgttaaagtttgaaaacttacccgaatttgtttgggtgtgtaaaccgaattttcttttcttcctcataattcaaaaccatgtccttgaactcttcgtaatcgattttattatttttattttgggtcattcctctaatttttgtcttataccaaatttcacctttttgattttgtaatttcaaagcatattgtttaggccctaaaattctcaattaattttattaatttattaattcttacccgcacaaactacttctaatatttttgaatccgcatattcttttgacatttcactaaaattaaatttaaaaaaaggatttttggttatttacaaaccctaaaaagcttccttccttaatagggcatgttcctttcggatgaagaaaaaacacactgtctaaaacttaaatctaaaaacattttattttttggttcacctgtgtcggtataaattagtttacaattttccgaattatttattttttccatgtatgagtaaagtttaagcctcgcttgtgcggtagtcctaaattattatttagttgtgataaaacttcacataattaccatatcgaaatcataatgtttgagcatttatgctccttaacatactcgtcctttttgcaaaatatgacccgtaaagtgttgtcgttaaatctgatcggtttacccatttcaatagtgtaatcattaattaattcaaaaaattctgatggtttgctaatcatttttgttgaacataacttattccgcatactaaacttccccctaaaataattttttattattatttttattttttcttaccataatgagtttaatgctaatttggcaatatgtcttaatccaggattaaaattcatattgtttgggtccaattcaatttcatatgtttctctatatgttttcacaaattctattttttcttcttcagttttaacatcctgaggccacccggtagcctcaaccttcaattttaaaaattttctcacataattcttaaacaaatttccatcaaaattttcgtaatggtaaccgcgataaaaccgatcgatgactgcccccaattctaatgctgaaaaaaacgagcatgattcattttaattatttatttcaccttttcttaattctaaagaacaaaattccacggttagtgcccgctgttcggcactatgtctacattttttggaatttttggcaaaaacaaaatcacattttgattttttggcacacgaagtacaatttgtaaataataataaatcatcctaaaaaaggtcaccatttaatcaaaaagtttcttaacctacagtatggaacggtaacacaggcaacaattgatttttggggggaatgactcgtacttttaaaagtccatcgtaagggatatcgtcgggggttgtcctaaaattccatttaaattgtatttttttaccgaaaaattaccattttactatatattgcttcggaatgattatttttgggataccaaccggatagggggtggaataattcaccccaagggtacagact

SEQ ID NO: 4173 - DNA, 5691 bp, Heterodera glycines
  misc_feature (9)..(9): n is a, c, g, or t
gggataaanttggatgaacaataaacaagcactatattatttttaaatgttaattagagtataataaattaaatgggaggggaacataaattatgtaatgtcatggaaatgaagagaaattaaaatttgagaaataaaaaataatttttaatatttaaaaaaatgatttttttaatgatataaaattacataaaattaattttttttttttcattatgaaatttttatattcataatttaatggagagggaacataaattatgtaatgttagggaagtgaagagaaatttttgaaatacatatacaaagaaaattttgagagcgatcaacaattaatgcgaaaaaattctctcgggattttttgatttattaaaataaaatgctattaatgctaagcaatcggttaaattatatcctcaaaaattaaagaattttaaggtcttcatgatatacaaattagtgaaattaaatttttgagattataaaattttatagaaataatttaatgcagggcaaggaactgcgaagcctcgatgcttttagtgaattttctaacccggatttcggctccaaatattaaaaatattgccttataatttaattagtgtgtgccataattcaaataaaatttaaataaatgaaatattttatttagtacgaggctgaggatggtcacctgccggatgggaagaatgttcgctatgccattgatgacaacgaattccccaacttttcatggcgaggctttgtcgtgttctccacaattcaggagggtcagtcatcattcagtttttgggatggatgaggatttaatgccaatgccaaacttggcattttgtaaaagatttcttcaaataaaaaacagggacaatgtctgtcaaggtaatgcaaatggcactaaatgatgccctaagcaatctgatcgcaattctttcattgattaattcgatttgtggtaattaaattgtccaatagattatgaatgatcaatgaaaattctgatgatttcgcaaaaaattttaaaaaaaaaagtccaaaaatttattcgtattgtcggcgcgtggtagggggagggcgctaatttagtattattttttcaaaacaaaaaaataattatttaaatttttattttttgaaaatcattttttgcagagattgtgctggacctgaacatccacaaatcgtcggtgtacaaactgttggcacactatcgcaacccgaccgaagtcaacgtggaattggaggtcaagctggtcccggtgcagacccaaacgccaggtcagttaataatgttgaatattatttaaaaattttttataattttcaaaaattttattggttcagatcttatataggaaaattctatattttaaatttaaatgttttcaaaaaaatatgactcgaaaaatatttgccaggagagaaaaatttgtcaatttgtcaatttttgtattcttttcatttaaatattaatatcaatattgaaaaaaaaaactcagaacagttcatcgccaagggaaaagtatttcaattttcaaaatttcaactcacagatttaaaaaaaaatttcttttttttatgactcggaacaattcgccaagggaatatcaataacaataaaatttaaaattgaatttaattaattaaaattagcaaacactttgccaatggaataatgaaaaaacaactttcaaattttcagactccgaacagtttgccaaggccgtgttcgcgcccagcggtgggcacccgcaaaatgcgtttgtcgagaccaatcccgagcacacatttgtgctgagcccgggccgttggaatttgcatgtgcgctcaccgaagcggctgtacttggattatttggtgctgatcccggctgactattaccagggcgaggcgctgaccgaacgtatcattgaggtggggggtggcgtcaaatttatggaaaatttgaaaaaaaaaattttttttttttttgaaatttacactaaaattttgttaatacaatttttaaggtctgcattttttaacaatatttactgaaacataagccccggggggctcatattttcaatacacctgaaagggatcgcttatattaacagggcatgaggggtggggggggggttctaattaaatgggttttttcaataattacgataattatgttgtatgattatttttttcttctgattaccatgttatgaatttttttcaaaatttttttttactaaattccaatgctcaaatatgtaaaaaatacaaaattttattattaaaatgagtccttgactagtcaaattaattattattattattttttattctaattatttttgtttttgctttcattttaaattgtctattttcaaatttgtaagaaaaaaatactgaaatttgaaattctttaatgaatttttggtcaattaattcattttaatttccttgtaatcttttttaattgtcttttagccctgtcgtgccaatgaaacagaaaattgtgttgaactgttgtatccaccaatcccaattgcatccaaagtggatgcgatcacggatttggccaaatttgaggaggtggagccgggcacggagaatgtccagaacatcctgagccatgtatgaattaattaaactcaaataataaagaaataaattattcgccttttcaaatccaattattaaatattttaaatgattttagggattaaagttactatttttaaagaattttttttcaaaaaattagatgtattttgtctaaattaaataatttttattttttaaaataatttattattttttgttacattttttctcatttgtttaacagagcccatctgaactgttgccaacaaaaattggacaagctgcacttgttcgcactgacgaccgttccaaggtggacaaacggacgccaattttcaaaaaaaaaacgattttttaaaggagtttcgtgtcacaattttggtgcccgaaaatggcatttattatttgttggtggactaccatggatgggagcgcagtgcaatgccggtccgtgtacgtgtccaacaaagtgatcacactgctgaaggcgttttgctggtgcgaaaataatgatttcctcaccactaacttgtattatttcctgtcattgtcgtatagtctgtggatgccagccttgtacctattggattggcatattttatttgggtacaaagacacatcttccggcggggggggggggggaggaggagggagggggtggcacaataaaacagcgaaaagacacagaaaatttaattgcgcctcgagggacaaatccgagagtgaaaatggcaatggtattattggggggggggggggagaaactccctccggggatgaatttggaactgaaacggacaaaaggtgaaaaagggacggattgagcagcagaaaggcaatcgaagcctgaccaagtcaaatcggaaaataaaagtagaaacaaagtccaaataaaaagaaggaggaaagacattgatgaaaggatttgataaagacaaattctaatttaattaagagatttaattattattataatttaattaattgatttgaccaatgaatagcaaagacaaagggaaaattatgaagtgttaattgctccggatgaggccatgcccactccttccaactgtgaatctcgttgtcttccgccttgtccgtgccatgccactcactttgtcctctttggcctatcctcgagagtcgagagcggttgcctttgcgcgggtgcttttgttcttggggcggttgtctgctcccgccccattccctccttttctctttctctctttctttctttatctctctctctctctttctttctttgtctctctctctctctctttcttctctctttctttctctccccctctctctcgccttcttattccttccttgtttttctcttctgccacttccttccgctgttcatcataatctttctttcttttccatacactttttctttttttcttttcttcctcactctttctcttaccgtatctttgatgggcggagtaatttccatgccgtggcaatggcaaccattggctttgcgttaagaaaaaaacaagctttatcggacgaaaaagaccatgctttttgcatattatttagttaaaaataattaattaaatgccaaaataaataatatgaatttaaaatttattattttattgatttaaaaatatgttcattgtttttaaaaaaatgcgatttttataataaaaaaatttggccgacggcctttttaacatttatttaattaggaaattatttaatttcaatgattatttaattcaatgttttaaaatttaaataataaaattttatataaaaaaatacattgaatttttcaccaaaccgaacaaaacaaagcgataatattaaaaattttaatgaaagaaaaaattaaataaaatgaatatatttttcgcatcgcaataatatttaaatttataattctgctgctggtctctctctgcccggctaatccgatttgatcccttcctttccccccccccccccttatttctttctccgccctttctcggctttttgggtgtcatttatttccgctgatgcgcggctcaatttccatgagcagaagcaaaaagaagcaggcagcagagcacggcatcggcaacagcaggtgtaacaccggtgggggggggggtcaaaaggcaaaggcaaaaaaaggggggaaagagggagagggggggggggaatcggaaacgaaagggcaaacggaaaaaggaccttgggttgaaaacactcttgaaatttaaattatttcaatgaaaagtattttacttgactcttcaacgagcaattcatttcgtttttttccattttgtgtcataatttttatttgatttttcattttccttcgtttattttattttcgcctttcctcgcgacgtttcggtcaatcacttttttgcccaattttacattttccttctcaatttcacttcgaatggccttcaaatcggcgcgtgcgcgaaaattgaatttgttgcccgaagctggcgaattttgagtgtaaaccgcggaagaggcgccgctttttgccgcgtcagaacggggcgggcacgggcaataattgccatcgggcgacggctttccaggagagccgctctaaagaaagacaggtcagttacgcatgaatccagctctatgacaaaattaactgtcacatttcaaattatttattttcttttcacttacattccccggtttgcctggcgtcccatcgtcgcctcggagtcttcaaaattgaaaatcacatttaattcgccgtttttgcagtttgattttcaccaacccaacttgtccgggtggaccggactctccgtcttggcccggttcgccgttcgttcccggctgtccggcatctccgggcgaccccggaggaccagacggtccttttacgcctttagtaccaatactaaatgtaaaaatgggttatcaatccatcttatgtttagttcaactcccctggcccagctgtgcaaatctgtgcccggggggcctggcggtccgattggccccgcggggccggctgggccataatcgccgggaggccccttcggccccggctttccatccgcccccggtcgcccatttttccctcgtcttccgatcggtccgggaacgccttaagca

SEQ ID NO: 4174 - DNA, 2448 bp, Heterodera glycines
ggcccggctttccaggtgggcctggcactgaacagatttatgaattgcaatatttctgggcaagcattttcttggccacctccgggctcgccctcttcgcccggaacccccgggggtccggacggacaattctgaacactcggggcacattctgtcaaagtttaacaaatctcgtaagaactatttatccctttaacaattattccttacgacatttttgcgcgggaaatgaaagcgaagggaaataggcgcttcttttggcgactctttcgccgccttcgctttgcgcgtcgctgaagaacaaaaaatgccaagagcgatcagtcaaatcctttatttagcaattattccttttgtttttgtaccattctcttttactttgaattcttccgcccccaatttcaattcttcgtccatttgacaaatttcggagtataaaaatagcgaaacggtcaatgcaacaaagagagtgacagaacagaagaaaccaacaaaaataattggaacatttttgcgtcgtattgttgcgataagttgatgaattttgacttcctcgtccgaaaggccgaattttggggccacggaagcggacatttgaaaagagagaagaaaaataaggacagtgtgaaaaatgaacgacggactgatcggaaaaagataaacagggcagtggaaggggattaatggaatttgggagtaattattcctttttgcggtccgccgcctcttaatggacgggaaattagcattggccaaggcgcaaaaccggtcgatgaacctattgcgcgatgcttataaatggattgctgctcattgtgtggttttggcgatatgctctcctccaccgatcggtgatcgccttccttaccggttcccagaaagcggcttctttcctttacaattagctgactaacttttaatgggaaactcatcttttaatttcatcaatttcagatgaaattagcatatttatcatttttctcatttaatgttctttaatcacaatttaattcagattttgcacaattgaaacataatatttaaaaaagcaaaagaatgaattattaaagaaaaataacgaaatacacatattgactatgggaatgatcaaagattgttgagtttataaataagaaataaaataaaatattaatgaacagtaaattgccaaaatttgccacgggactgagctgtcccgtccccttccacccgtccattttttggccatttcaacgccattcgtcgccgcatttggcgttgtccctttgagggtccgggtgggcaattcgtggcctatgatttgatcgtgggggagaagaacggaggcggtgaccggacgatgtccgataacggaacccggagaatgtggggaagagaggcgcgaaaagtcaccgagcgcagtccgagtgccgttccttgcggcgggagagaagagtccgcggggggcattggaaatggcatttttgccaggcccatcttaaaagcaaatgaagcattagaggtggaagatggtttttgttttatgttggcatttcgtttgaatactttcaccggcgtttggtcgtccttctccgacgaattcctccgaatttggcatttttggagtgacccgcttcagctcttcaatccattctgctttcccactcgaaagttgccgtgtcaaattggcattttgcaaaagcaataatttgccattgctctccaaaatttctccactcaaaggaacgccttatcaaattaagcaatcattattgaaatatttatttttgcaaattcaccacctcctccgaccatgcaagttttgccagcccatccgggcggacacgcgcagaaaaacaacgattgcgcccgcgtggtgcggcaagtgccaccatttttgcacggattgtcctcacatggcccttcattcaacaattgtttatttccagaggaatattgcaaaaaattttctgtaaaaaatcgctgactgaattcgcagtgccgccccgcgaatccgcgagcgcaaaagcaatcgaattcggtgcgctgagtgcccgcaatggctgagcaagtggcgccattttggcacggatttggggagcacgggtcgaaatatgaaaggaaaaggcatttaaaattaaattttttgatttattttgataattggcacatttattcattaattttatattccatttgcatttttctcttctaattttggcatttttccgattatttctgaccaattctctctgtgcaaaagtcgttggtaaatggtgctgcgcatttgcaaattgacttctcggttaattcgtcgtacacacaaacgccgccgtttcggcacggattccttcgggcacaaacatttttaggcgcgactgaaggagacggcggtgagaagggaacggaagcggacggccgagttggggatgaagcggcggcggtggaaagtgcgttctttctgagcgg

SEQ ID NO: 4175 - DNA, 841 bp, Heterodera glycines
  misc_feature (681)..(681): n is a, c, g, or t
tgaaattgaactatcgatttaatttactaatattttttgttttttaaaaagtttggaggtattcggccggtctccgtccctctaattgccgtgttaattaattattaattaattaattaatcacttcaattgtttctcttcctttgcaatgtgtttgattttatttgctcatttctttcttccttttgctccgtcattcttctttcattcatttcgaattattatttattttttgttgtgctaatgaaacaattccttctcctttcccttcttttgtgctgtctgttttttgctgttttctctctttcttttagtaatttatttatttaattgattaattaattagttaattattaattataattaatttttagattttttactaatttttattttttcagatgatcaagtcgaacttccgaccttttgcagtgggccaaacaaagaaaacgcgcgggtgctcagctgttgcgaggcggtgaaggcattcgaaggttcggaaatgtccgagtcgggcggagcggcgccgcccgaattgaaagagtgcgttcagtgcggcacggaattgtgtccgcgcgagtgaaaagagcacgaaaattgggcaaaagcggaaaaagcggacggataagaaagcaatttgttaataaatacactttcatttgtggaaaatttgctcatttntgaaacaactgaaatgaattgtgaatgaatttattaggcaaataaaataattttcgtaaattttgtccacaaaaaatatttaatttaattacctttcaatacaaaaagaaattaaattaattatttttttctcgttgttcttcactccaaatatttgctc

SEQ ID NO: 4176 - DNA, 2185 bp, Heterodera glycines
agccatgtggagacggacaaatggcatattagtgaaaactgtggttaaatggcataagttaaggctctattacagtttacacggccataaaataatttggcaattttaatgaaccatattaatattcgagacattatttgatagcccaaagagtcttctctattagtcatacaatggaacattcccaactgatgagtgtccaaatcactttaaaaccacttatcgtgtagagcatagtcgatttgctactgtaaattttcggcttttttttttttgctcttacccccaattcatcagaaaaattgatcaaatgttttttagttatttattttgttatatgatagaaaatttgaacgatttttgctgatcagttttggcgatcagggccaaaaaagccgataatttacaataaccaatcacctctatacttatggttaacatttttaaaattcaattttttgaggttttctgaccataacttttttgaacataacggaattctttgcaattttgcaggctaatggaggaatataagagctaccaaatcatattcatccaacaaattttatagtcgtgtctctttttttatgctcgcaatagagccataactttatgttttttcaatcatcattgtgatcaatcaccttctgcatcaagaaatatttgaaatgaaatactttttggatttaaaaggcggaaatgggaaaagaatttgctttatccaaatccaatcgcttaatttaaattttggatttcaagcaaactaattggaccaatattcccgacaaaattattgcgcagtaaaaacatacttctacacatttacaatcaaaaagtaccgtaaagtgtgacggatgggtccagcagtaagtacggtaaatgtcgcgcagcagagacagtgacgcggtgcgacggcggcgaccgctgcggcgatggcggcggtagtggcgccgtttgctgccaccgtcgtcacttcggcacatttgtcgccgttctgtctctattttttcgctaaaattaattattttaaaaattaaaaatgtataggccgccaaggttgaaaaggctccggataatccgtctgtagacaatccgtcagtgatgaacaatccgtcaacccttcagcaaattttgtatttaaaataattgaaaaataaatttaaattgaaaaaatcaaaaaataatttattttaattttacagaagtaaggaataagcattttaaaaaaattaaagataatttctataaaaagatgaattaaattaaattgttaattaaatagaaatgtgtaaaaagccattcaattttttttattaaatcacaatcgcaaaatttttgatcatttctcataaatgaaatttgctgacaaattatccactgaccaaattgtccacttacgaattgtccggaccccgttgaaaatagagacaaaagggcaacattttgaacgtaggaacagaaacttacaccaccactccgtgcttccgtacgcttcccgccatcggcggtcgcgtcactccgtcgccgtttcctctacgaattgcgcacgcgcgtcgcatcaaagagcgcgcacaaaggcgctgaaacggcggcgcggcgggcggcaaacgcgcggacggaccaccggcaaaatgagaaaggaataattgttggttccgatcactttgatcagcgattttcatccacattaaatgcttttcataaccatggtaattaggcacatattataaatttgctaattataggccgtgaagaaattcatcggtcggctaatttctaattagtccgacctccgccggtgacaatgcgaaatgagctggtgattcgtgcggaaagcatccgctttagtcgcgtccgtgccgtgacctaaggcaaagatttacaagaaattgctttgccaaacaatcgattgatttgttaattgcttattgattgtttcgtctaattgtttttatagattgccatgtccgcgttgtacgccatgcactcgagcaccagcagattgatgcaggcggagaagatggccaacccgaacagaatgaagaacagcgtgaacagcttgaaattggcggaataaattgattctcgtaattattttcttattcatttgttttcaggggcgtagccagcgagggtggctgagggggctaaagcccccctcctccttgccgaagtccgaattcgt

SEQ ID NO: 4177 - DNA, 3406 bp, Heterodera glycines
  misc_feature (616)..(616): n is a, c, g, or t
atttgtttgacgagttgccagagacttgggattggcgcaatgtcaacggaatcaactacgcgtccactgatcgcaaccagcacatcccacaatgtgagaaaagagttggaaaccgaagaaaataggggaaaaaagactaaattaagaaaaaaatattcagataaatttaatctttttgcctttttgttcaaaaatgtcaggaatttttgggttcaagttttcattcaaaaggattggcgtgccgatgccgacgctgtcaaaaggcgctaccgggataaatttttgaaatttttggctcttttattaatagagatttcacatcaaaaattgccaattaaaccaggggcgtaggtctaaacaaatgcgtccgtttcttgccaagattgtggctcatgctgggcaatgggtgccacttcttcgctggctgatcggatcaacatcaagcgcaaaaacgcgtggcctcccgcctatttgtcggtgcaggaagtgatcgactgcagcgaggccggctcatgcgaaggcggcacgccggacaaagtgttcgagtacgcgcacaaaaatggcattccgcacgaaacgtgcaacaattaccaggcgcgagacggaagtgaggggncggggggggggggggggggaaattggcattttgtaaaaaggaaataaggaaatttaattaaaattttattttacttaaaacatttagcattttgagaaaaatgtgggcataaacgaaatcatttgaatatttgttagtgatttataacttaattagatttaaaattaatgtgtaaaatagttatttatcttggttaaatatttttggaatttatcaaatgatttttggaattattttatttccgaaataggtctatttcatttttggtcttcggcatcatccaattttgacttgccgagagacccaatccgttcaaattcaagctgatcattggctttataatttgcattatgcaacagaatgtgacccgtacaaccgttgtggttcgtgttggcccgacaaatgtttcaccgtccaaaattacactttgtacaaagtcggcgacttcggctcggccaatggaatccaaaagatgaagtaaagcaagcatacataaattaaaataatttttaaacatatttttagggccgaaatttaccaccacgggcccatcgcttgtggggtggcggcaacgccgcggtttgacaattattcgggcggaatttacaaagagcgaacgaatgaggtgatcagaggagagactgatcactggccagaataactaattttaaattttaggatattaaccacgtcatcagtgtgagtttattaaaaatttattagagtctttcaatggcggtatttttggccaacggctcaatttttgttttttataattatttatttaattctaaataaataatgaaaggttgtcggatggggcaaagatgcggcttcgggtgtgccgtactggatcggccgcaacagttggggcaccgcgtggggagaacagggtaattaattcgttaatatgactaatttgcataattgaaccctggacaataatttaaagctaagatcattttttcattttccagggtggtttcgtgtcgtgacgtcggagtaccgcgacgcgggaaacaaatacaatctgaaaattgaggaggattgcacctggggcgagccaattatcatctgaatgaggagcgaacaatccgagcactgttcaaacccgatgccaaaattttttccatttttgtccaagcatttttaagccaaaataattacggaatttgacaaattaggcaaatatcaatcgcctttctgctgttgccttatttaatccaatttttaaataattacaacgacaatttattttagtttatttcgctaaaatatttttttataatgtttatattattatcgttagaaaaatcagatcagtaaaaatttttagaaggatgggagacacaaaaagaaacggaaaatgaaagttgaaaaggaaagaacaaaacagaaaaaatcaaaaataatttaaaaataatattaaaaaaaagaattaagcaaatagtaaaacatcatctaaagaaagggtgccagcgtgtttcttaatccaccacccaacaaatataaataaccattttttcattgaattttaattaatatacttttgaaaagataaattaaaagcaaaacttttgttcgaaagaattcagatttttcataaagacaaaaacaaaaaaaaaagaaataaaaaatttattttactgggaaatagttgaaaataaagaaaagaaagaattctacataaattgaacaattatttataaatgacataaagaataattattcaccatataaaaaagcacaaattattatatttattaaaaaattaaagatgtacgaaaaagagtagggttaagccccgacccccgacccgagacgttatttggacctattccccgacccgacaacgaaattagccaaaattgtacgaaattgaagtttgtccccttccgtttagttgagaaataatttgttttatggggcagaataacggtgaaagaaaaaaggaaaatctttgcttggttattcttaaaaataaaattttttaaaattcacagcatcctaataaaagcttaatcgttacattaataagataattgaatttcctgggttttttacattgtcacattactttttttccaaaatcctaaattttataatttattttactaattaattgtcattttgctttttacaatatttaaagccaatatttgctgttaatcatcccaaccgttctgtttcctaaaccctttaattcacaaatgtcacattaacaatccctccatttaaaatggattacgcatttatcggttggcaatctttgaaataaacaaaatgttaaaacattcatgaaatttgctataaaaatgagcaatgtgtcacaatgaaagagcaaaatttaacattcaataaaagataaattaaataaattttattataaaataattttcaaattaatttttcccctttttacccaatgaaaattaatacaataaagtaattgggttgtccgtttggttttcggggcgactgtaataatttcgggagggtttcgggattcgcatattcgaaagtaaggaaattttaaatttgaatttagatgctatttttgacgattcttctatttctttttttcttctccaatgctgaacaattaacgtttgttggcggacattcattcaatggtttgtttctcaaatgaatcgtttaatttatttttagaaatgggtgaatttcgtgtgaaatttcgtcaattggaggcggacattgaggaactgaaaggcaaaaatgttagcgcattaaatcaaaaataaataaattagatataattatattaccata

SEQ ID NO: 4178 - DNA, 4070 bp, Heterodera glycines
tgaaattgtttactacgaagtgaaaatcttttcagcggagcaaaaggattttgatgggttttatttctttttaattgcaattccttttgagaattttccaattttattacttcaaaacaaaatttaagaacccaaaatgactcaattggcattggctttgcacccaagtcgatgccattaggcaccaaggttggcacgcaccccggcacttttgcctacttcaacgatggcaatgtacgtggccacagaattgtaggcagcaccaagcaaaacttggccaaattcgatgccggtgacgtcatcggatgtggactgaatttgaccagcaaagagatcattctgacgaagaatggcgaacgattggggaaaaaggagcagacgtaccaccgcttcatttcctctcattacggcagcgaattgtttggtgggaaaataaataaattaattaaaaatcgaaaaataaaatactaattatcccccccctcatcccttctcacaatcagataccaatttcttcttcgcatcaaaagacgccgacgatttatatccggcaatttccttgaacaaccccggagacgaagtggaggccaattttggaccgaacttcaaatacacacttaattaaatgacatatccctttttccgatttatttatttgtacttgaaaaattatttgttaaacagtggcgaagatttaatggtatttaaaatgttctcattttgaagaaactgaattttaagtattttaattaaaccaaaaggcacgataatggcaaaaaacgtgcaaaaaatgagtaccaattttataaatatggtcatcgtttttagtgcaaattctgctgtaatgactttcaaaagtgtcaattcctagaaacacatacgagatgacagctcccaaaagacacagtaattcttatgaaaggtccaacctacagtagtaggtaattactatcgaataattgatccatatttttgggggtgtatcgcagattgggttcagtcactgtgaaggaatgagtgatctctgctcaattatttactttgctgatcaacaccaaagttccccttgatctttgcagttatgtggtcgcttcccactatttatttggtcatgtctatgcaaaaaacatagccgccggcgctgcgattgattatgtgagttattaacgtctcaaagaaaaaggagatcaacaacggcggatgaccaattcattcattctctagcgaaaacaattctgcgaaaaggccctccctcataagtctaagaattcagtaacaattttataaacaaattagaattttttgttaaaatggtttttttataaaaatgcagtaatttatttattagcatattagtattttcgaattcaaagttaaaatttttgaaatgcccttttgttaattttggtgattatttcgtccgatctgcttattaatcccgaagtatcatactcgtaattttccgcattttataattttgaagcaaatttaccaacttttcttttctctgaattcaataatgggcagcagcagcagcagtagtagcagtagtagttcaaactataccagcagtagcagcagcagcagccgcaccaccatcaaaatcaactttatggacttttcatcgaatgacaacggcagcagttctggctttatcgaggagggttactgttcatgtccttggtcgcatcttcgttccatcagcattactctggtaagtagcagtttacttaatacggtttttcgaggttctgaccatcacttcctttcctaattgcctgtatttcatatgttaatctgtttttataataagtcgtgatattccatgtttcagttagagtatcattttgctggcagtgacaacagcagaagcccaattgaaacagcaattggcattggctcttctttgcttagttccattgttccccttatcgatgatgaggacaaagaattgaaaacaattggaaaacttttgggaattccttcagtaatttgtggtaaagtttcgaaaggtaaaaagcccgtgtaaaaactgtatgaaaaaataaatttctctttttgaacagtgtctgaaggttcgacttgttgggccgtggtggtggagtacaaatgcgacgggtgtggccgagttgtgcacgtcacttatggcatcacccctcaaggaaagtttaagcgttttggacggatgaccaacacagaaaattcgaccgtctggatggtgagcagcgcttatccggacatagagcgtgtttatgacgacatgcattcgaactacaatttcggcaccaccagggcttgggcggaggaaatgattcgccgtgttcttaatcagtgacgggggaataattgtcgaatttcgaagcatcccagctcattatgatcatgttaaagtggtcattgtcattctgatatattatcgaatttatgcttttgttcttttttataaagaatgttcgttttctgagaatgcattcaaattataaaatatttttgctgaaacattaaactaacattaaaatttatggtatttttcttttaaatcattgctgatagttgttcattatgttgaattaaatctttctataatgcaaaattattaaacttttaaatgaaaattgggcaattttatatgacagctatttaaattaatccattaatcacagtacttaagtataaactaattagaattgaatcaaattatttataaatatattttgaaatatcattaatatattttttacgaaataagaagataataccaataatttaattaatttataaataataagtttatttattatagtaatgactaaaaaacgaataaatttttacaacaaaaaacatttaaaatgggaaactgatttatttcaataaactcattaacggatttttagaaataaacattatctaatagtgtcagtttgttataattagggaacggattttaatcatgaatttgacaattttatacaaaattttaagcaaaaactgaacagctgcaaaaaatttcaaaaattttctcgaaaacatttgcaattaataaaattatattattttaaatttatttcatttatttgaagaaacccatgccttttgcattgattgccttgggaaatatacaaatgcggcacatgaaacgatgccattcgcacacagtgcgcttggtctgaaatgtatggcgaagaaatgtgaaaatccaattccatggcgtaaggatataatttaattaaatttaatttattgatttaatttcataaattaaagaagaaataaaaaattggctcccgaaagaactcaagtcaataggagctttggaaaattattgtgcagaattaagtgtggaaatggctggtcttagctatttggaacggtaattttgaattagatttattcaaatcattagtttattcacaaaaggaaaaaaatagttttacctaaattataaattttcgggattttgccttttctttaaacttaatattttaagcatttttatgagaccataagcaaaaaagttgtcagcaaaaaaagtgccaaaataggtgtaaatagtgctagaacttataaaatagttgaaaattgccggctaaaaagtgttcaaaagcaaaatcgaagaaaatgtgtattttttacttctctcgtcataaaaatacttcaatgcgctttctgttgttgttgttttttttgtgggtgcgatgcgatggtgcccaaatttgtctacggcttttttttttatttaaaacacttttttcacctttagatctgtggctcccaaaaatttttaacagtttttataatgcctttcatcttcccctttatatttcttattaataatagagtaggacttccaattttaatttttcccgggggaggctaaaaacgcaaaaaaaatgtttttagcagacaaagggaatcaatctaaaattacaaatatcattaagctgcccacattgcaattttattgttgaaatgggcctttctgcggatgaaaagcgcctctttcattgtcctcattgtgacaaggaaaggtgaagaaaatgcaatgtgccatggacagacgaccattacaa

SEQ ID NO: 4179 - DNA, 1683 bp, Heterodera glycines
tttttaggagaatggcacttttgttgggaaggcaaaattcattcaaaaaaaatatgagaaaattttttatagaaatttcaagaaagaaaaaaattgaaaaattttctagcgattttttaaaatttgtgatgaattaatactctatttatttcaaaaaaaatttccaaaaaattactgaaaaaattgacaaaaaattttttcttaaaattttctcatcagacggctgaagcgactcgagagtcaagatcgattcaccaaaaaaatgaagaaatttctcaacttaagactcccgtaactttaattgatttgatttaaaaaatgaatttttaaaataataaaaaactaaatacaaaatgggaattttaaaataaaattttacttttgatatattcgattataaaattggatattttggccccggaaattcgggaattcgaattcaagactctctcggcacattgtgcacgtgccaccaaaaaacttgcctgatacacataacagaacaacacggccgcaaatgcgtacagacaaaacagttcgatgcccggcaattcggtgacgcagccgatcagaaatgccaaaatgtcggtgatgttggtgatcgacaccgccacaccgccgttttgcatcatttgtgccatgcgctgatcaggcgaaagtgccggatcggactggtcccagcacgagttcatcacgaacatgtcgtcaatgccgacagcgatgatctgatcagcaggaaaaggagattttgtccgattacatcatagcagatataaattttagaacatttatttatttttaatctagaaaattttttctaaaaaaattttgtgaaaaaataagaaattataattaaaagaattaaaaaaagaataaatttattattattttttaagtttatgtaaaaaatattttaaattaaaatttacgaaaattatttatttttttaaattttagttttttttatgaaaaatggcttaaaaattccattttaagttggcaagattaaaatgtttttcataattattattattattatgttggtttgatctggcctaattgcatgttttctcgaaattttttggccaaaaaaaggctttttatttcggttttattgccgagtccattctcatgaaatgattggtctatgtaccaagaaagggatgattgtgttgatcacattgtacggaatgccgagcaacaacaagaagccaaaagaagagatcagtgccaaaatggtgttgaacaaacctaaataataattgatcaatttattttttgagtgatcagcgagcgatcatttattgattagttggtttatttaaagcggtaaagcatcgatcagggatgcgatggtcaaaaactcggtgcatgagttcaaaaacagctgggaaaaaatcggtaaaaattttcaaaaacacggcaaaaaaccggcacaaaattttttggccatttttccactaaaaaaaattaacggatatggcatatttatttctgtacaaacactgtgaaacacaccggcacatgcgacgtatggctttgagcgaatccaatcgatggcaaatgcgtgccgtgacgatgtgccatcagtggcgggcaaaaaagtgaatgagcaacagatgcagaacagtgccaaaaaggtgaagctgatcacaaagttaggcacaaacggcgcgcattttc

SEQ ID NO: 4180 - DNA, 4538 bp, Heterodera glycines
gattcatgactcttagattgtacgccaaaaagccactgacctgcaatgattggtagtgagcaaatgagatggagatcagtggagactcgaaggcatgcaaaagaaagcgttccacggcatattcaaagtcttggtgaaaaaacggcaaattttcggatttttaaaaattaaggtttttgggcccagcagagggctgtgcaaattgaaccaggaaatttttaaatttcataaaaaatcacgctaattaagcaagacgcattaaaattccaaaattacgagaaattttgtcgagcaaaatcaagttttttgacgagtaaaacaatttttacaaaaacaaaaattttttggcatttttttttgtccagtttttacatattttagcatttttaatgcataataatcctcaccctgaataatgaggctccttaataatctctggcacccttctgtcctttatacggtgtttgaaaaaaacatatttagagggaatttttggaataaacattttaattaaaaattaaaaatattggaatttacaaaaaaaaaaaaaaagaggaatgaatcacccgtggagtactgtcgtacgacgggtgggtcctgtttcaggaagtagaacagctgtgtgacttttgcttccatcaccgtgccgtccgtgccgttcaatgcgatgtcgccaagggcagtgcccaaatatgccggcgtgtcctttaaacatcatttaatatttattttatttttttaaaattaataatggcaagagtggcatttttcttcaaaatttggctctttggacataatctgctaacaaatcacattaaaattttaaaaaattttcccatggcgccttcggcaccgctggaccccctccctgttcccccaaaattttttttttttttgaaaaagctttgaaaaacaaaaaaaaaagtcgccgatttacatggcgccgaacacatcccccttttttcatatattgtccttccccaatatttatttgtccttgaaaaccccgatcggtccttgttgtgttcatttgaccgccttgttttcgccctttggatagcgccggtaaaatttcgaaaattttttaatccatttacaatctatttatgtttagaggtttgggtaagtcctgaaaaaaacttaattgaaaaaattcaaaaggaagttttttttacaattttgaccttttataaaacatattcaatgctacagtactttattttagaaatactgtattattgatgcattgtccctgtgtccttttgtccaccttcatctatatactagtaattacggattgtgttcagaaaattacgcgtcctttcccaatgtttgtccttgaaaaccccctgatcggtccttgagtcgttgtgttcatttgtccaccttgtttccgcccttggggtagcgcaagtcgatcactcgtcccacttgggtcatttgtcggaacatttcaatgtgttcattgttgccacacacccaatcatagctcaggcacaaatcttggtagctcaaattgaagcgccggtccacggttggcaccgtcacattctccgcaatgaatttgttgagcagcgaaatttcgtccaaaatttggggcctcaaaatgttgccgcctcaaaatgggagaaggaaggagccaatggcatttttttgaatttcgcaaaagcaaagagtgagtgattttgatcagtctaatggaaagaaatggcctgatcatttcggaaattttttagaatttcaaaaattaaatttaaaaaaaaaataattaatttcttcgtttgatgtgttgttttttatcaaaaaaaaaattttttttggaatttttttaaaggaaaagcttggaaaattttaaggaatttattttcgattttttaatttgcaaataacatgacaataaaatttggtgtgtttcagacaattttctgcaaaaaaatatttaggaattaatttttgcaaaaaaaaaatggaaaagcaaataaaatttggtgcgattttattaattatagaaagagctaagttcgataaaacttttaaaaattttaggattttttaaattttattagttttttaaaggaaaaactgaaaaatttctaacgaatttttttcgaatttttaatttgaaaatttaaaaatttaaattttatacgaaaaattctaaaattttggtcagtttttaattaattcctggttgaacttttaaacaaaaacttttaaatatctttaatttgatcattccgatcaaatttttgaaatgcttagcttgatcaataaatttaatcaaatttgaatccttaaaaaattaagaacagatctgatcattacggatgaaagtttggcattttgaaaaagtccttattatgtgtcacttgaaatttggttgaaccgtccttggattttctataaaaattaattcgtatggcgtccttgggaatagagcccccaaaaccatgaaattctgtccttatcgttaagtgtccttggaaattgccttcttcttaaaacaatgactcaccgtccttggctttgcacaaaacattcacaaaacgcttcatctcaaatgactttccggggatgaatttgttctcctccagcggccaaagctttgagaaagtgcccaattcctttttccatctgaacaaagtgccaaggttttaaatttgaatgccaaaattcaaaatgatatgaaaatcacctggcatcccgaggagtgaaaacataggctgaaaaaatggtaagaaaattatattgcggatcaaagagttaattgggacaaattattaattaagtaattaaaaaaaaatgttagaataaaaaattatgaatctattggctgcaccttgccactaattttaaattaggtgtgattttatttcaaattctgtaaatgatcaaatctgatgcaatcagatttgatcaacaattgcctgatctgatcactgacttggtgagcataaaaatcgttgcttcgaactagagaccggacatgttcgggatcccgcgggaatttctcggaatcccgacactcgggatccatcccgaaacttttttaaattcatcgggattgatcagtatcggggtatttattaaatttgggttttgatgtacaagctaaacggttacatcagacgaaaatttataattttttggtcagcctgatcaatcacgctaatcagcagccaaaattatcagcagaacataaagggcaattacatagacttacccgggtcgtccatttccaattcactgaaccaaagaaagccgatagataaacagagcgaaatcagtggaggggccttgcaaaaatgtgggaaaattcgggcacaatttaggacgattaattaattaatagggcttccttttttaggcaaatgcctaaaatttttgcatacttgatacgcatagataagcacaaaagacgcgttttccgcttggtttggggtgtctacgatgacttttataatgcctatttttgcctatttcgggggtttttgtgcctattgtgcctattttaggattttcgaaaaaatccttaacaaaaatgcaataaaaacgaaaaatacacccctaagaaatgacccaaaaaatttttccagaaaatacaccccataagaattgaaaaaattttcaaaaaattgatcccaaaatttaatattttttcttaataaaaattttttggtttaaaaatttgttcatattcgaaaaaaacataaaaatatttaataatttcaattgaaatatttaagatttaaagtgttttgttacctaaaaagcgttaataaaaaattttatatgcctatttgaggatttttgtgcctattttgcgatttttttatgcctttttaggtgcctatttcgcgattttttgtgcctaaaaaaggaagccctattaattaagtgtaattaattattaccaaaagcattggccatcgaaatttgtgcacaaattggccatagcgatggaagaagcggcggagaaaaggctccagagaaaagtggagcatctgctaaacgaaaaaaaaaagtttaaaagatgaaagaaaggaggaaaacaagagagagagaaagcaaaaagaaagaaaaacggaagaaaaaagaaatttgaaaacggaaaatgaagggaagagaaagaggatgagaagttaaacgggtgaaatatggtgggagaaaaagaggaaaagaaaaaaaggaacaaaacccggggtccgggctgggaccaaaaaagtcggggattagggcaagaattattgaaatcagaaatcagtagattagggatttgagatttactagatatataaatcgggtaggcagggatttggggttgggacgaaaaaagtcgagctagagattactctgacgttagagatcagtagatcgggatttgagatttactggatggataaattggttcgggattcggagttcgaggttggcactaaaagtcgggtattcggccaagaaattactgaggtcaaagatcaatagatttgggattcgagagggagtcgagatttattggataacacaaatcgggtcgg

SEQ ID NO: 4181 - DNA, 1230 bp, Heterodera glycines
  misc_feature (64)..(65): n is a, c, g, or t
ggggagaggagttaattgcttggattatagcagagatcggctttggattgtgacgaaggacacnnagagaaaggaggaagaaaaagtgatgccggagggcataaaaaattcaatgttttttcaggggcagcgaaagcgccgaagaaaaattgttgtgatcaaatcaatttgaacaggtcaatcaatcaatggatcaaaagggaagtgatcagaagcagcggagtttgttttcgaattgaaaaatggaacgaacgaccaatttttaatgatggagaaattaaaaaaattaaataaaaaacagggaattttttttggagggtgaaaaacgaaaaattattaaaaataaaaaatgccgttcctggtccttaattgtgataaatgaatggatcactctgatcagcgcaatttgtgagaaaaggaagtgaaggaacacattaagccggaggtgatttcgaatgttcgcacttgagttgccgatcatttgacactaaacatgccttagggcattgatcggaagaaagcaaacggacgcaattgacgcagcacatttgattaacggatcagcaatttttacaatgaaacaggaagtaacttttttttgtagcgagtttgttttgattatttggtgaaggaaaggcttcccgatcaaataatttaatcgatatgtaatttagataatcaattaaaaattaaaattagattttctttggatgttttttgatgaattgatcagtttttgtaacagtgcaataagaatgaaagatcaagtttcacgagaaggaaatggctttggtaaatctcacgaatcagatcactggagaaggaggggcttcgaacaaatagcataagtaaattatgaattttggcgccggagagcatgttttgatcaatgatcactgatcaatttcagtcaggaataatttttgaatcattgtaaagatcaaaaatctttcttcagagggaaatggctttgataaatctccgaagaaagaaacttcgatcaaatagcacaacacaaaatcagagagaattttggcgctgaagggcatgtcttgatcaatgatcactgatcaatttcagtcaggaagtaatttttgtgcaggtcagcttgatctgttgtgatcaaatatcggatctcgggagaatgaacacagaaagagagaagcacacaatgtgagtgatgctttcgattagcctacggggaggtgccctgcgggggagggggggggg

SEQ ID NO: 4182 - DNA, 1118 bp, Heterodera glycines
cccccccccccccccccagtaggccgtcagtcagtttggcattttgcctttttggggatttttttttttgattggaaaacaggtgtttaattttttagtttccctctcggcgtgtgggggattttgatttcaataggccgattaatccgcggatccgcccataattttgacaaaaatcatgggctttcattaaaaatctctactgtatacgattgggtgttactgtaacaatactacatatacagtgtaaaattaattgatagttcctataaaataatttaatttgaatatttccacccgctgtcgagaattattaatacttaaaattactaattagctgggctatcaatattttggtatttttttgaattatttatttttcgaattttaaaataaatggcaaaatattaatagcctagaaaattttggcgcattttgagcgtatcctgagaattatgtataattaatagccttaggcgggtgggagaaattaatcccaaaagtaagcccggtggataaatgaaaaagcaattagcggcatttaagccgactttcaaagcaaaagcggaaattgagcgcgcattccaagaatttggtaacaatttgttttgccgcacatcgattttcaattggtggtaatttgtgggagattatgcgggaaagagaagtgaaaagcgatttgatggggggggggatattcgggtggaagaggaggatgaagaagacggatttggcggattagaaatgttttccgacgaaggaatttgggaggcggaatcaaatgacatcaattagggtgtaattagaggtgctaagcacacattatggcattttttgttgttgttgctttttaccgcctctttttacactttattaacccggtcctatttcggtacctattttcggttttaaacatctacatgaaaatacctttgatcactgtttttcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaat

SEQ ID NO: 4183 - DNA, 973 bp, Heterodera glycines
cgaaaacccctagaaacatgtttttatgattttttgaaagttgaaaaaaaattttaaaaaagggggggtaccatctaaactattaccgaaagcacaaagtctgaataatgtaataatacgagaaaacaagataattctaacatttcaagaaagttacaaacgaaaataatcagcaattacttaattaatcgaatcttttttggtaattgactgaacgctggaattttatatattttagcttcgttagactgtgtgctttcgaatgataccaaaaagatagggtttgttcgaacatggaaaaagttattgtataaaaacccgggattgtcaattgattggactcataaaggtcgattggactcataaagtgcattagagcccaattttcagctccaaaataacaaaattaaattagagacatcattctataaccaacattgctcaaaaatattctataaaaagtgaccatcaattcacaccttaaaaccttcactaacaaaaaatgacactttggccatctcagccgaagtaatcaaataaatcttcgtccaaaatgaacctgtagttcagctctttgatcccatgtgcgtaatggcattgttttccgcgcgtgcaaatgccctccatcaaccaaatgttgcacagtgtgctcttatacttggccggcacttgtccgtcagcacctgccaccccttggggttggaattggctgtagtaagcctggagaagttgctgttgttgctgctgttggtaggcattcattgaagattaaaaaaattgacaattatgaaaagaaaactgaaagaaaagacacaaattaatcaggaaggaatgacaggaaattaaaaaaaggagaaatgatcatctttcatctcttttaggggttatatgagatgaggggggggggggggggggtctgggggttcgatccccgcttgacctgcagtcttatctttttatgaataattgatga

SEQ ID NO: 4184 - DNA, 1807 bp, Heterodera glycines
  misc_feature (15)..(15): n is a, c, g, or t
  misc_feature (1767)..(1767): n is a, c, g, or t
caggaaaaattaatntaagataagaaaatatttggtaaatcaacaaatttcttgtttaggtgctgaaacgcaacaaactgaaagactttgtcgtgcattcgcaatttttgggcgtctctcatctgatcatcctctcgagaacagaactttccacgcatttgcgcattattcgaaacccgcaaggcccaactttgcacttcagaggtaacagtgaagaagagcccatcagagggggagggggagagaaagaagtgcacactgaaatggggaattataaatttcagggaccgttggtcataaatccgtatctgtttcaagatttggttttaagcgcaggtgaaaaattacacctatcgaattcccatttcgagcacgtgaattcatttttacaacaaatgtaattttaaaattgatgcctaattcgtgagttgaattcctggaaacctaccaattgatattttatacatactgagaatttgtttttatgacaagagataatttctgaattttaaatagttgaaaaatattcgttggcacgcgacgtgctctccgtgcagaagagaccggtcatctacgaagaactgttccaacacgcgcctttggtggtgatgaatgggttttccagtgaagacggcagcaaaaaacatttacaattggtgcagacggtggtgcagaatatgttcccttccatcgacgtggacagagttaaagaaaagtgtgaaaattggcttactttttgagtttaggtgaaactcgcgtccattcgtcgcactttgctattaaactacgacacagaggacggactgatggagttcagacaatagtaagtcttctctaagttgtgaccttttgcaatgtttctctttagctccataaagtcagtgcccgcgggcgtttctcgttcggccaaaaaactgatgcagagcaaagtgccagacctgtccaagtacaaagacatcagtgacttcatgctcaagtgcgtcatcctcgagattatttgaatcaaatgcaaaaagaaattactaatccaatacatcactttctatctattcagaccggagcagttgagtgacagcgaatttgaaggcgaacagacggaattggagctcacgcaggatattggcggacggggcaaaaaacgaggacagcaaaccaaattgagtaagtgatttctcgcaattacaaaaataaggaattcatcccatagggttgatggaaattggaccacggatgacattacgtttgatgaaaattgaggaaggcgtcaacgcgggcactgctctttggacacactcttcaacataacatcagattcatattccaaacacgtttattttgtttttatgcatgtgcgagaaccgtttgatcaaacattcgagaaaaactttttattattctaaaacagcgatgaaaagtatgcagtatttcaatcacaaatcgcccttccgtccacgaaaacgggctcgaggatcaatgttgtttcgtttgcactcggccagtgaatacatcaaatgaatgcaatgctgaggcaggtccaattcttcgtgacactccctggccttcttccgcttgatctgttcgaaaaactcagttagtgtatatctcaattaaaaagtagaaatagacctagtaacaagcaaacctataagcgcacaagggtacattccggactgtcactgctcagatcgctttaaaaccgcccttatcgtgtagagcatagtcgatttgctactgtcaattttcggcttttttggcacacagcgtcanggggatcagaaaaaagtgatcaaagtttcgaaaaatcgat

SEQ ID NO: 4185 - DNA, 2652 bp, Heterodera glycines
tgtattggtcttcttcgttgggcaactttccggtggtcacaaaatcgcttcttttgccgatgtatgtgcagagttccaattttggtccgcattccaaaatggtttccacaaaatttcgagcagctgccattgacgaaatggtgcccgagcgaaggacaaagattgaaaggaggccttgcattggagttttgacggtaagcgacccgatcgcattgcttccaaggactgggtccaactctgccaaaagcaatttttagcaaaattcatggctttccgatccagggcaataggttgaggtccagccgagttctgtaaaatgaatttctccaattttttaattaatttcggatcgtttcgaatcaggtacttgtttgtctctacttttgtatcgtaaatgaagccatgtctaattattatggaagaattggacatttggttggcttcaatccgccgtcaaaccgtaatgaagctgaagaaatgataattgaagaagatgcaaggcttttgcttgaacaaagtttggatgaaaatgggctgcttgttgatcaatactttgaagaaatgggtttgaatgaagtgcaagatgaaaactcgcatgatgttaattcagaggatggagaagtggatatcatgaattaattcatatgaatttttatatttttatttaacttttatatttgaagatgcttaaattttacattgttgttaaaatacatgaaaattgggtcagaatcatttagactgcaattcattagcgctgagtcttgttttattaagcggtagcgtgtaatacataaaaattttcattgaaaatggtttttaaacaaaaaaaacgaatcgggataataaaaacgaatcgggataataaaaacgaattgggtcaaaaacgaatcgttacaaaaacgaatccgcaaaaaacgaattgggtttttaccgatttgctactgtcaattttcggcttttttggctccggcgtcaggggatcagaaaaaagtgatcaaagtttcgaaaaatcgatgaaaatgacaagttttaaaaattctaaaatacctaaactttttttaaaaagaatcaggaaacaattctctatcaaatagcttcataaaacaaattttaataactgaagaataacacaattctgctgggtttttcatttgatcatttttgacaccggagccaaaaaagccggaaattgacaataggaaatcgactatgctctacacgataaaggcggttttaaagcgatctgagcagtgacagttccgaatgttcccttttcaggcttacaattagacagccttgtacgagttgtaatgacacctatcggttcacccgaagcttttaagcatttttaagtcaaaattttatagtttgttttatatgaagggaacgtgatctagtcgcaaaactaaattatccacctgtatgcaatcagattctttaatgcacttcttcaattgtagtcgtatccgatcacacgcaatcccagtccgcgtaatagtctcatcaaattgcgtctcctgttcgcctaattttctctcttgagtcggtgaattaccaaatgtcatactcaattctttaaattaaaaatgcatttgaattttcaacttgaaaaaaacaagtcatttgaccaaagaagagcaaaatattgaatttcgatgagttagagaattcgtttacccgcaacaaacatccaaagacacgttggaaaacatattaaaaacaatgttccatattaaatttggaagattttatttaataaaaattttcccattttaatcaaaacattgggttgtttcataattattattgtcgttttgtcttaattccaaaaaacaatgaattcaactcattgtaagacattatatggaaacgaaaatcaacaaaggcaccataagattttggtagatcggattctatccacataggtataatgtttaggaaaaacgacaacaattacacgaggcaacaaacaacctaaattgggcgatgttcaaatcgtttaatgaggtcagtcgatcggagaggaggtagaattgttttgattgtcatcatcatcagcagtggtatttttggtccacgagataacacgggaagaatccttaagcgaaatgaatagagcagaagtaaacaataatttacatacctgaagaacattctcatcattgcgatagttccgagaacaatcgccggccgagtcaagcccatggaagacgttttcagtttctcggttgaattcctatttttcaaaaataaagctattaatgtgtgtgtttacggttcaaaaataaaaggaaggatatatacaatctttgatattaaaaactacattgttacaagtagatatttttgaataacattatcccgaaacgaagattttaatttagcaggtggaaaggaatcaaaatgagaccagcgtattttttgtactaaatagatattatttaaaaaaaaattaatttaaaactgcacaagtatcatattaattactaacagccttgtcaaaaagcgccaagtttccagcaaaatcgaagtctgtctccatatttgggtccaatgggtcccccataaaaaactccccacagcgatcagtgtaactgcgatacccattcaaacagtcaacagctggcattccagttggacctttaacaa

SEQ ID NO: 4186 - DNA, 1398 bp, Heterodera glycines
  misc_feature (1337)..(1337): n is a, c, g, or t
ctctatcaaatagcttcataaaacaaattctaataactgaataagaataacaaaattctgctgggtttttcatttgataatttttgacaccggagccaaaaaagccgaaaattgacagtagcaaatcgactatgctctacacgataaaggcggttttaaagcgatctgagcagtgacagttccgaatgttcccttttcaggcttacaattagacagccttgtacgagttgtaatgacacctatcggtttacccgaagcttttaagcatttttaagtcataaaattttatagtttgttttatatgaagggaacttgatctaatcgcaaaactaaatatccacctgtatgcaatcagattctttaatgcacttcttcaattgttgtcgtatccgatcacacgcaatcccagtccgcgtaatagtctcatcaaattgcgtctcctgttcgcctaattttctctcttgagtcggtgaattaccaaatgtcatactcaattctttaaattaaaaatgcatttgaattttcaacttgaaaaaaacaagtcatttgaccaaatgaagagcaaaatattgaatttcgatgagatagagaattcgtttacccgcaacaaacatccaaagaaccgctggaaaacgtattaaaaacaatgttccatattaaatttggaagattttatttaataaaaattttcccatttaagcaaaacataatgggttgtttcactattattattgtcgttttgtcttaattccaaaaaacaatgaattcaactcattgtaagacattatatggaaacgaaaatcaacaaaggcaccataagattttggtagatcggattctatccacataggtataatgtttaggaaaaacgacaacaattacacgaggcaacaacctaaattgggcgatgttcaaatcgtttaatgaggtcagtcgatcggagaggaggtagaattgttttgattgtcatcatcatcagcagtggtatttttggtccacgagataacacgggaagaatccttaagcgaaatgaatagagcagaagtaaacaataatttacatacctgaagaacattctcatcattgcgatagttccgagaacaatcgccggccgagtcaagcccatggaagacgttttcagtttctcggttgaattcctatttttcaaaaataaagctattaatgtgtgtgtttacggttcaaaaataaaaggaaggatatatacaatctttgatattaaaaactacattgttacaagtagatatttttgaataacattatcccgaaacgaagattttaatttagcaggtggaaaggaatgaaaatgagaccagcgntattttttgtactaaatagataaagataaaaaaaaattaattaaaactgcacaagtatcat

SEQ ID NO: 4187 - DNA, 1152 bp, Heterodera glycines
  misc_feature (1137)..(1137): n is a, c, g, or t
gaaaatgaagtaaattcattaaaatccaaccatattcaccatgaatattccgacgatggttgacttgaagtcgcatgggaattgcctgctgttgctctctgaatagcttgaactcgccaaatgtttggtgattcagtggtgctcgggtaggtgtagcagaaattgaagacgtattaagcggagaaaggcttttggtgggctcggaccggacagaatcagctggtgaaggacgacgacgggatggaatagagccagtcgaatggcgaccactaatcggacggtcttcttgacaatgaaaacgtgcaggtgaagcgccgctaacaacagaaatagtaagacgcgaatgaacaaattgaaacttttaaccttacaaaagcggcttgtccaggacagcttatcttaaaaacttcacaaaattgctgttgcacggcctggttttgatgggtcaacccgtaacgctttttgcggaattctcaaaataattttttatgtgttagtaacattaagcaaaaaataaaacctttgttgtaattgacaccgccagccgagttgttgacccaattcccattacgttgatttcctacgcacgattctccaaagcaatccgtgtaaccacgatacccattcaaacagtcaacagctggcattccagttggacctttaacaaaattacattataaatatagaaaatgaggccaattcattcaaatccaaccatattcaccatgaatactccgacgatggttgacttgaaatcgcatgggaattgcctgctactgtgctttgattaaattactatggttaggagatatgtcactcacagacggtattggagagacttgaaaatttggtaatacatagtacggatggttgcccccttttttgaagaattttaaccgatctgatccaatttatgattaaggatgggattcttaggtttttacttattttttctgcggctttaaatcgacgagaaatgcacaaaaaacacaatttttgttcgaaaaactttcgttttaacgcccctatccgaccctaggaatccctattttggatgttcgccctaaaaatccctgttttcctaaaataagtttttatcccttttttggcgtttcgcccctatttcgcgatttttgngaaaattattaacaa

SEQ ID NO: 4188 - DNA, 5451 bp, Heterodera glycines
  misc_feature (93)..(93): n is a, c, g, or t
aagagtaagcataattaaattatgaaaattatttttaaattggagcaattaattaaagttttaataatacccaaatgatttttctcttaagcnccgtaattgacattgaactttggtccgagtcgtccaacacgtcttacacttattcctcaaccgacaaaatccttgccacaacaaccacggctcatccggctttccaacctttggtcaaggcgacacagttggaatggcgcaaacctgaacacgatggaggcaatttataccaaaaatggacagccattaagtgagtcatcaagagcaaaatcggaatttgaaaattgtacccgaaagggttttgttttatgatagagaaccgacacttaaaattcccgaaaaaataataaaaaaaattattgctgagagtggataataaatttaaaatgctaataaaaaagggttattaattctcttttaaacatattttagtgacaaatggcttgttgtacatcagtgaatctgatttatttccacgggttacgctttataattctggcgatgtgatcctagcaaattttggccataattttatgcacaatttcaacgtcgcttcacgaagccaacgtttggtaatgttattaagaaggagcttctgatttatgcagcccccccaaaaaaaaaataataaaaatgaatttaaaacgtgttccgacatttgcgcctttatcctgaatcgggttcaaagttaagtttttaattttcaactgcgcaaatgtcggaccgcaaatgtcgtagaaaaatgaattcagtaattttcagtcgtctcaaaatatgcattaaaaagaaaagttctcaacatttatgtatgtatatataaatatcctttttttgcagaaattgagtacagaaaacaaattgttgctgaaactgagttgttttataagcatgttgcgcgacttcaacaaatttttgtaattttccatagaaaattctgttccaattttgatcatctttaaaggttaacatggcaaaagtcgttatcaaatttttaaaagcaaaaaatgaagacgacatgataagcaagcggagaataaaattgtaagtgatttgtctcaaaaattgggtagtcgtgaaaataaatttaaaataacatttttctgttcattattttagagtttttaaaaattttcagtatgatttttcaatcctttgaatttacatacatattttagtttatactttttcttttttattttttgcaacgggtaaaaattgagccaaaaatctcattgtaaaaattcagaaggaactgcagacaaaagtcgtgaaaatagaggaatttgtgaacacattaaatttggaagaataagcacattacaattgctgctattattgatcaaaattaaatttgatttttttttctttttatttattgatagatcgaaaaaactcattttaaactttccaattaattctaatatttttttgataatgtgaaattgataaaatattaaaaaagaaaaaacaaattaatttattttttacaaaaagatcaaattttcccatcccacaacccaaaaggtacgacttcatttaaatgaagacaagcaatgcttatagcacagtttttgaaagtataggccttaaaaaagttagtcaaaagtgaaaatttttatttaaaataataaattatttcgctaatgctggtatatatatatatatatatatatatatatatatataactatatcattcagaattttcctaccttttcccggtatcataaacagatagactgccgctaatttgtagtatttaatttaacaaattccttagcaaaaaatgaactgtatcaatctattaaaaaagttaatttaataattttaattataacattgtaataccactacatcggcagcttcgcttattccggtttttgtccttcatttttgtaattgtttgatcaatttcagccaattctaataatttactttttaaattattttttgtttaaaattataaaggccaattgtttacgaactttggcttcgtgaagcgacgttgaaattgtgcataaaattatggccaaaatttgctaggatcacatcgccagaattataaagcgtaacccgtggaaataaatcagattcactgatgtacaacaagccatttgtcactaaaatatgtttaaaagagaattaatagccctttttaaccactcacaagacaaaagtaatgaaaaaagaggaatttatggacaaattcactttggatgaataagcatttatttacgtctgcgtattgatcaaaattaaattgaatttttttatttcttttttctttattgttagatcaaaaaattctttaaaatttcaaataaatatttttagataaatgcgagataaaatgaagcattaaaattagttttttttttttgaaaataagcctaaaatcacttgaactcattaattttaattttatatttgagttaattgctgtaagaattcaactgtataaatagtaaatcggagataaaagcaaaaaccgaagaatttattttttcgcttttccatattgaaaattagcaattcaatatttacaaaaatagcattaattggtcactcattgctttcttaggctcttcaaaatccatccatcaatcgtaggcttttaaaattgagctgttttttgacaaattgcgcctgtcatttgaattgcgcagcgcgcgtcgttccattggccatttgcatttatcatatgcacacattcctcatttgcgccagctaaaagcatttggaaatgtaattattagggctgggatttttatgtgctaaaaatcctgaaatatgtaataaaatatgtgctaaaaaccaaaaaaaggcctaaatatgtgttaaaaaatgcaaaaatatgtgctaaaaattggaaaaaccaatggtatttttgcataaaaattccaaaaaactcattctttatcatttttgcccgcacaattgcaaataaaaaacatttggaggtgtttgggggtaaaattagtccttttttgataaattgtttttaaagataatttttccatcagttgagtaagtgccagcaataaacttcgatatccagtaaagaattaatgaagaattcgattttcggtacacgaaataaataaagaaaattttgaaagagcctataaaaatggcaagaaagttgatttttaggggtgcatttttgaattttttgtgtttttcatagatatttttttcaaaaatgccaaaatatgtgcaaaatatgtgccaaaccccgaaatatgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctagtaattaagaataattaaaatgatataaaaataaaaaaacgcaattttttaaatttcttaatataactgtaacaacttgggtcagtgtatttgttggtgcctgatggttgtccttctgcccatgggtattggtttttggtgccggttgtcgttgcagcagttgtaatttcgggctataattataattttggtttttgattattattaattaaacaattatataataattattattaattaggcaattctgttgacttaccacattgccaaacgttgctggcgatccgtttgcccatgtgctttgatagagattgccgacacggacacggcgaagaccgatcctggaaaagatatcattgtaattaggcaatcaattatcatggattaataatatattattagcaacaaaatttaaacaaatatccaaccaaaatgtgttgaaaattgttgatgacaattggtaagtcagaagtgaacgagcaagcggctgggcaatgattcggccaagaagccgattctcggcttcatccgcaatgcttacaagttgcgcttttgagtcctcggcattacaagcggccactgcttggcttaaacggcaatttcaataataaattctttaaatttgtttaagggcttcgcctccaatgaattcatttcgtgttcacacctctgattcatcaatccttcgatcactttgtagcatttgccattgaaaatggtccacccaaagcctccgcacaccgatacactcggattacacaaatcgaaggacgatgacgaggcttggggtggtgccgcggaacttccggcactttgcacacggatttggcccgttccaacgggtgttacggcggcctgtgacccaattccaactgcttgagctgcttttttgcaaattgcgcctgtcatttgaattgcgcagcgcgcgtcgttccattggccatttgcatttatcatatgcacacattcctcatttgcgccagctaaaagcatttggaattgtaattaagaataattaaaatgataaaaaaaaataaaaatatattaaagtattcaataaaaatgcgattttttaaatttcttaatataactgtaacaacttgggtcagtgtatttgttggtgcctgatggttgtccttctgcccatgggtattggtttttggtgccggttgtcgttgcagcagttgtaatttcgggctataattataattttggttttttgattattattaattaaacaattatataataattattattaattaggcaattctgttgacttaccacattgccaaacgttgctggcgatccgtttgcccatgtgctttgatagagattgccgacacggacacggcgaagaccgatcctggaaaagatatcattgtaattaggcaatcaattatcatggattaataatatattattagcaacaaaatttaaacaaatatccaaccaaaatgtgttgaaaattgttgatgacaattggtaagtcagaagtgaacgagcaagcggctgggcaatgattcggccaagaagccgattctcggcttcatccgcaatgcttacaagttgcgcttttgagtcctcggcattacaagcggccactgcttggcttaaacggcaatttcaataataaattctttaaatttgtttaagggcttcgcctccaatgaattcatttcgtgttcacacctctgattcatcaatccttcgatcactttgtagcaattgccattgtaaatggtccatccaaaaccactgcagacaaatgcacaagatggagaagtcgatgtctcttcattgcacggctcttcagtgaccgaggacgaagcttgggaggttgcttcagtggccgatgatgaagccttggtagttgggggctttttagtggatgaagccttggtagttgggtgctcattagtggcatcttcatcgcacggctcgtcattggccgatgatgaagccttggtagttgggggctttttagtggatgaagccttggtagttggggg

SEQ ID NO: 4189 - DNA, 3014 bp, Heterodera glycines
tcagtggccgatgatgaagccttggtagttgggggctttttagtggatgaagccttggtagttgggtgctcattagtggcatcttcatcgcacggctcgtcagtggccgatgatgaagccttggtagttgggggctttttagtggcatcttcatcgcacggctcgtcagtggccgatgatgaagccttggtagttgggggctttttagtggatgaagccttggtagttgggtgctcattagtggcatcttcatcgcacggctcgtcagtggccgatgatgaagccttggtagttgggggctttttagtggatgaagccttggtagttgggggttttttagtggcatcttcatcgcacggctcgtcagtggccgatgataaagccttggtagttgggtgctcattagtggcatcttcatcgcacggctcgtcattggccgatgatgaagccttggtagttgggggctttttagtggatgaagccttggtagttgggggctttttagtggatgaagccttggtagttgggtgctcattagtggcatcttcatcgcacggctcgtcagtggccgatgatgaagccttggtagttgggggctctttggtgactggtgatgaatcttcatcagatgaacaatgttctgctgatgattcttcggatgaagccgattccttggatgatgaggaccccttcccttcatcttctattggtgagcactccaacgttatttttgcctttatctttatcccgcgcatagctgtcatatttttgcttattatttttattgtttttgattgtccatcattgaagacaagctcatttatggcctcccttttcttttgcctgtgctcttcttgtccaaatatttggtcattgtttttgacagaaatctcttcgctttcattcgcagatggggaaaatgatgagaagagcttaacaaaaatgtttttaaattaattttaattaaaatattaaaaatttaccggcaatgagttaacttcgaatatttgcagaagaatgactaaaatagagagaagagtttggggctgcatattcttcaaaggctcttcttttgttaaacgatttaatgaattgatgattattaattttatttcggcttaaatagccaattcttttagttgaaataattatcactaagttcagaattctttgtttgattagtgcaattcaaaataattaactaatgttcatttactcatgtgtttctttatgacgtcctaatcacttttcaattttgttgcattcgttcggttaaagctgttcaaacaggaaatgaacgtaattgagcattaaatatgcatgaccctgatgaatggaacttttttattaatggtcacattagtacttttctattattaaagatttttgaaaagtttccgcttctatgtcaatgtttaaagcctaaaattttaagtagctcgtaatcccgtgatgtttaaatgattttatcctcaaccaattagttcagtaaacttttagttcatcacgagaactttccatcaattcgaattgccacgaattgccattgcgagttgcgagcactctaattaacgtatccattaaagaattatagaagatttctgaaatttttcaattttttttttgcgtaaaatccacaaaaatggcattttggacaaaatcttttaataatctaatcaaattgtcaaaataatttcccggcgttgtatgttggcaccgccttacacccatcttcctttaatttttcatttccgggttactctcgcttggtcgatgtgaaaattgctggttccattcgacgctcatttaatataattttttaaaatttcctttcatttataaatgccttaattaaaacatttatgaagatacaataaatagaggaaaaagattcgttgtttgagaccaattaagaagatgataataataataataatgaaattaatttcaagaatcccttcgcctttgtcggcacagtccgccgcacagaccgtagaggtagggattgatcacggagttgaacacgatcatcccgtgcagaaagtacacctaacacaaagttaaaaagattatttaaaaataattctcctgttaagaatgcttttatcagcttataaatttgcatgataagattttttatggtagaaaatcaaaaattaaatttccaatttggaatatattatcgttttgcagaattttcaatacaaatttatttcccgacttgatttgcgtgccgactgaacaggtcagtgtcgacgaattgaatcagtgcaagaaaattgtagggcaaccagcaggcgaaatagccgacaaccagcaaaaaactgacacggatagcgcgatttctgaagaataattaattagtggtgtaaattgggagtaattagtgacaaaatttgaggaaaatattaatggataaatgcaaaatttagtcataaatgaaggaccgaccgatcacctgtttgatttggcgctataggaggaggactgacgatggcgaatggcagacaccaataattgtgtctgaaaagtggggaaaagttattcggtaattcatttaattttggtaattaaattggactaaaaaaacctttaataatatatttaataattaattagcctattaattcatataaataatggtttatgcctcgtttgaagtacttgaactgttcctctgctgttctttttgctgctgctgtttggaggtgtcggcgtcgtcttccctcattaaagtgttaatagtcggcgtgatcgctcgctgcccattaatcacaatcattggcttattgtcagtggacgggtcatttaaggctaaaatatagttatttaaaaattttgaacttcgtgaaggtcgcccaagtgatttttgtcttaccggtcattgtggtgacctgttggtagcttactcttgggcaacggttcatctcgcgcatttctaaatataaaaaaaaattaaattttatacgattcaacgagttccccccccctcgcccatagctaaatatttcttt

SEQ ID NO: 4190 - DNA, 3549 bp, Heterodera glycines
  misc_feature (3365)..(3365): n is a, c, g, or t
  misc_feature (3377)..(3377): n is a, c, g, or t
  misc_feature (3405)..(3406): n is a, c, g, or t
  misc_feature (3444)..(3445): n is a, c, g, or t
  misc_feature (3482)..(3482): n is a, c, g, or t
aatcagtgcaagaaaattgtagggcaaccagcaggcgaaatagccgacacccagcaaaaaaactgacacgggatagcgcgatttctgaagaataattaattagtggtgtaaattgggagtaattagtgacaaaattgagggaaaatattaatggataaatgcaaaatttagtcataaatgaaggaccgaccgatcacctgtttgatttggcgctataggaggaggactgacgatggcgaatggcagacaccaataattgtgtctgaaaagtggggaaaagttattcggtaattcatttaattttggtaattaaattggactaaaaaaacctttaataataataattaattagcctattaattcatataaataatggtttatgcctcgtttgaagtacttgaactgttcctctgctgttctttttgctgctgctgtttggaggtgtcggcgtcgtcttccctcattaaagtgttaatagtcggcgtgatcgctcgctgcccattaatcacaatcattggcttattgtcagtggacgggtcatttaatgctaaaatatagttatttaaaaattttgaacttcgagaaggtcccccaagtgaattcttgtcttaccggtcattgtggtgacctgttggtagctgactcttgggcaacggttcatctcgcgcatttctaaatataaaaaaaaattaaattttatacgattcccaagttcccccccccccctcgcccatagctaaatatttcttttgaaaaatgcaaaatcccagccaagcaaaaaaatttcctctgcggtaacccaaagtcaaaattctattagaagtagacccgcgcccgctttgttgggcccctcaccggcgcccgcgcccccggcactttcaatgcctttgccggccgttgtcaattcgaacagtgacggcttactattaatgtatacccagcaggagagcagcacgtaacagagcttaaataaactactttagtaaaatagagaaatgaattaaaaattgaatataatataaacaattaaaaatatttgtttttctcaaaaaaaaaattaccaaaatgataaaagcgggcacccaaaagatcagcatcatgtgcgcaatcacgtacagtgattcttcgttttttagctaaaaaatgaacggatgaaaatttaaaatagaattaaatgcttttggctaattgagtttaattacaatagaaaaagtgaacaattaaaattgtgaatgccacaagctgactgaccatttttggagaagctttggtcgttgggtcactttgttgtgccattgcgcgttgaatttcccaaatttgcatactgtaaaatgcaattaggtaatatttttaaatggttatcattttgttgtataccattgattccatggcggattgtcaaaggcttggaaagaacgccaaatggcaaattggggcaaagaaatgagtgccgcggttagccacgcgaccaaaagcatcagtcgcatgcgacgggcagcctaaaaatgggacacaacaaaattaaacagaaattaattataaatttcaaacgaaaattcgctgacatttctcagttaggggagtacctggtcagggtttcgatgagaagcgcttaacacggagagaaggcgatcaagcgcaatacacacaatcacatttgaagaaatcttgaaaggtcaatgaaattaatcaaaaatcattaaaattaaaaattttgcttatttaaatgaaacattcttgacacagtacgatagtgctaccattctctagtagccttcaaaatttcaaaaaatttcgaattaaatttaaaaataacgcaaaggtaccgaccagggttgttccgggacgagaaaaatatcgggtcgggattcgggtcgggtcggccgaaaaatcatcgggtcgggattcgggtttcgggacgagaaaaatgtcgggtttcgggattcgggtcaattaaaatttttttaaatatatgttcaaaaatcaataagaaaatttatagccaatagaccacaaaaacataagaataaaatgctttaaaagaaataaattattaatttttttttcaaaaattctcctttctcaaccaatttctttatctactcaattttcacccagacccctttcttaccagtgcttattttgtcccgaatcccgatcaaaatcatcgggtcgggattcgggtttcgggacgagaaaaatgtcgggattcgggtttctggattcgggtgacccggaacaaccctgttactgtatgctaaaaaatttaatacagaataaattaattttctgcattttggaccctattccataattaaatatataattaattagattcacaattaaataatagaaaatgggtagatcagcagatgattctaatatcaatcactcatttaaaaaaaggcaatggacggttttgtgatcgttcttgactgtgaaggcaaagtgatttacacaagcgaaactgttgctgtacatcttggcttagctcaggcaagcagcacccccccccccccccccagacctagccacacccaaattttccaagaaatgtcgctaaatttttcaaaaaatgcacaaatttttaatgaaaatctgctaaaaatggctcaaaatcacaaaatttggtcattttttggacaactattttttttgctcaattgatttgaagaaaggagctcaaaaacgcatttccgcataaaaatttttcgattctgatgtcattatcggtcactagaaatcactattttggcgacttcgtcactaaaatagttaaaaatcactattttggcgttttgtcactattttttcactattttgacatttttgggcaaaattccttaacaaaaatgcaataaaaccaaaaaatacacccctaagaatcgagctaaaatttttaaaaaaatacacccctaagaatcgagctaaaatttttcaaaatatactcctatgaaatcaaaaaaaaattttctcaaaaatttactttcttggcaaaaatttttaatttaaaaaatttttttaggtaactattttgggttttttggtcttaaaaatcccagtccaactcatttgcaactgcaaatagtgaataaaaattagttttgctcaatttttggctgaaaattatgtcactattcgtcactatttcggcatttttactcactattttagttaactatttcgggatttttcttcactaaaattcacgtccctaatgattatcaatcctttttatcatttattgtccatcagttttcacttcgcatttaaaaatccaatccgtgtccaagacaaatgtgccgccggcagccaccaaatgccaaaatgctcacggcacacgtccaatagaccctccacctccnacacggttgtgngaagacatttgacgaaggaatcgcttcnntccgcgcatatttgacatcacacaggaaacaaatgatnngcaatcgaacacagcagatgacacaaacacaacccanaaatgatggcatagtgacacccacagtaagcttcctgaaattgatgaatggagaaaattactgtata

SEQ ID NO: 4191 - DNA, 5560 bp, Heterodera glycines
cgtcaatttaggtgggctcttacgcggcgatgacctcaaacggtgcgttggtggcggcaaagacaccgccggaggtgcagcgcgagttcgcctcgctcgcccaagtgccggtggtcgccgggacggtcaaccgcggctcggaactgatcggtgccggctgttgcgtcaacgattggatcgcattcacaggcgagtggtggtggtgccgtgccgtgacataccaattcggctttttcattccaaattaaatacttccccagcatttttcaaactggttgggtatttttaaataatttcttcgatgaaacaaaaatctcggagttggggactttatttttcaacgctctcatacggaactttattaatcggattgaagcaaactatattcagaaaagacataaatcccaaaaactgaaactcatcaagcgaattcggccgaattgtttagttttccaggaattggcgacggatgtgggcggggctgtcactttaatcaacaatttttatataattgtaaattccgttttcccatttgcaggcctcgacacgacctccgccgaactgtccgtgttggagtccatcttcaaattgggagacgcggcaccgagcgcaatttccaccgatttgcgcgacactttgatagaatcgatgctttgaatgacaaatttcaaaacgaaggcggtggaggacagacacaaaaacgctgacattttttccgaaatttggtaatagtaccgatggtagtcccccttttttgaaaaaaaagttaatttatttgttttgtttttttctcaaacaaaaaatttaaggagtcagagaacgtagatgatcttagagcgtcatgcgagcgaatgtcggctgagttggaacaggaaaagaaggagaaggaggaagaaaagaagcaaaaggaggaggcaaaagcccgtgttgccgagttggagaatgaaaacgaacaattgaaaaatgaaatcgaacaattgaaaaatgcgctcaatgcagagcggagcaaatcaaaggtataacagaactgattcccttttcattggtgaaacgcactttgtcaggcggaaggccagcgcacaacacacacggacgaaccaatgtctcgcatggagcgagacttcctggccgctcaaaatgtggtcgatacgctcgaggaggacgtcgattttttggtaatcaaaagttttaattgaaaaaatttaatctttgaagaaggaaaaggaaggaaaaacggacgaaaaggaggagaaagagaagcaaaaggaagaggaggaaaagaaaggcggagaagtggaggaagaggaggaaaatgagaaggaacaagacgatgaacaaaacggaggaaacaaacctaagcgagctcgtttcatgtaaatggttatgtaagatcttgttggcatggaaataaatttaaggctgcaaaggtattaatttgttaattgtgatttatgtaaattgaaaagtccaataactctaaaaattgatgtttaaagccgcattttgggaacctaaaaatgattccggcattgggagacgttcattcagaggcgcacaaaaacgagtaatggcgagaagagttggagttggaaattgacgagaacgaggtacgtaggtggacgggaacggacatttgggcccaattttatccgtttcatgcaatttaaaacggtagctacaacgaaaaaaggcatataaaggcgttaaggtggccgacttacaattagtatcatttttcgacgggggagagcggtaatttcgaacaaatgacgcgggttttaagattaaaatatgatttttcattcgtagtcctttaaatctccaactttaattttattataatataacactctattcgagtcgaaaaatataataaaaatagtcaaaaaaaaccaaaatttcaacgccatttcagggacttcgatcggaccacatttgaacacagcgagcaattttcttctactgacaataccacggtgtttcttggtgcatttttgtgacattcatgtgacgagacgattcatttcccctttttacaaattgaggcaatccttacacagcaaggcatttttatatatttttcatggaggagagattttcccaattttagtgacactttcaagaaatacttggttttctacgtatttaatgactttttgaagccatttttggatctcatttataataactaactaactgatttttttataatataaaataactttcttccaaattcgaatcgaaaaattattttaaaaaataggcaaaaatttaaatttcaacgcaattatttcacccctcgccgttcagggacttcgatcggaccacatttgaacacagcgagcacatccaatcgttgcgcgacaaccccaatttgtccgcccaactcggcgttccgttgggctgtgcccgttcctccggcctcccttcactcagtgccaaattcgccgctgccgtacgccatgacgccggcggcatgtcaccctcatcatcggccatgccaaccgcgcaacagctgcgtgccgaacagtcggccaaattggcgatggcacacgtgcgacggggtgccgaactgacgcgggacaacaaatgcttcgaggctatccaggttgtccatggcacgggcatcggataatttttctgggcggcgtggctctaaaattttcaggttcccatttttataacattggcattttgttcccccctcaattttgcttggcccagtgcttcaacaaggcgctcaatgtgtagtgtacgagcactgtgccgacgcgtatgttggccgtggcgcggcatgtgccggctgtcgcaatttccccgccgcactgactgacttggagcgtgccgtccaactgcagccgaaccaccggaatgccaacaagtacaggctggaagtgttgcacacctatgccaaggagtatgttttctccttcattgtattgcatattttgtcctattctgcttttctcaatgaaaaatgtaatcatgttgggccaaatttattgcaaaaatagtatttttttgcgcctaattttgcatttcaggcttgaacgtgatgggaaattggcggatgcccgtgccaagtttggccaactgttggcactgtgccccgacaaggtttaattttttgtgaataaataccgtcaatttacataatttcaataaatatacttggtaaaatgttcatccacttttgggaacctcgaattcaagcagttcaccgctgttatagcctgatttccccccgtcaatttggtgtccagacatttgcgtcccggacatttgcggcccggacatttgcggctcggacatttgcggccccagccaaatcggacatttgcggcccatttcttaagggccattttcggacatttgcggcccaattttttgctgaattttgcggcccaagccaaaatcggacatttgcggctttgccctacatttcatttaaatttattttatgtaattttgaataaatattactattagattttatcaatttaagaataagatattttattctcttcatcataatatttaactttttcaatacatcaattaaatacacaaaaataaattttttatttccaatggcttgctcaaggcccaacgagcgtcattttaaaaaatgcttaaactacggtcatatggacacctaaggcaacaaacacatagcgtcacagttaaaataagtttgtctgttaattgtggtggctctgcttctgacaacttccatgtttgaagttctgatcaacatgcgcagaacatcatcttcatctgtggaaatactctttttaacaatttaaaaattaattttgaccaaggtaacagcaggctggagttattacccctgcagctttttccatcatcaaaaaaattgtgcaagtcttcgtcgttggtaaaatactcttcattcaagaaaaattccgtcttttttggtccccgaacagtgactgggaagaaatatggtgatcgtgcttaagttacgagttggttttgataaatagggggtttacattttgtcctaattaaattggctgcggtctcagccgccgctcccccaacaacgccaccggcaaaatttgttgttaatttcgaagtgcccttcttgagggtatgagctattccgcttttccctgagtttagtgcagcccttaatgcagttctttctgcatgaaccacagaataatggcggccaccgtttcgtaggagatgacgaaaaagcgtgaggattgaccgtaaaatatgcgtctctccatgggtagaaataagagcggaaaagagaatcaaaaggataagggaacaatgcattttgactagttggtaggagacaaattgctacttataagcaaccagaaaagctcagacagctgacgtaggaagtgttttcgacagcctatgtcaaggtcccgcctaggggagaagcaaagtccaattctcactgctgacagctgttcattccttttatttctgacgttgaagatgcttgtgacagctgatggcaactctctgggcgagggctaggccaattctcattgccgacagccgttaaaaaatcttattttttgtcaacaagccatgataaaatgatgcgaattggaattcatgcaactgtctttttttctgcctaatttcaaaaagctttgttgaagccccagccgaccgaacaacaaagggcaaggatttaatcctgtttaatgggtatgagtggcggaaaaaaatgtgatagcggcatgagaagttcaggtcgtttgatgtagtaagacttgtccaatcttggtataggtctgggtttgtccaagaaaaacttgtccaggccgcgctcattctgccgttggatcgatcgagcttcgcgttgttacagcacataaccatttaatcgattcaacgcaacataccgtaattaaaatgataacggtgaattatttggaatcattaggtgcgtgatcgcaaggaacaaatcaagcagagccgcaaatcatgcagatgctcccagaaatattattggggcggcacgggctaatttggatgatgaatcgcttttaaatatgccgtcaacttcaactgctaaccgtttaatttccaggcaaagacatattccaggacgagaaaacattgatcaaaatgacgtcaacgccattgtccttgaagtaattaaaatatatagatattttaatttcttgttaaagggcgaatttattgttggaaatgatgggcagagatttctgctttatgattcaagacagcaagaaccagaattgcctgtttttttatatttgtgacggataacggcctcaggcgattaagacgccacaggcactggtctgcagacggaacatttaagggtaataatttaaagaaaaaaaactatttgctaagttttttttgaaaattttcggaaaaacagtaaattttcataaaatttcaaaaaaaaatactgaaaaattttcaacaattttttctttaaattttcttataaaaaaaatttttctaagaatttttcccttgaaaaatttctgtttgattttttttgaaatttcggcggcgagattttggggtg

SEQ ID NO: 4192 - DNA, 2265 bp, Heterodera glycines
  misc_feature (2139)..(2139): n is a, c, g, or t
cccccccccccccccaagacccccgcggtaccctcccccaacaagaccaaccagcgccccagagagaaaaaggaatggcaaatttaaattaacgccaaattatcataacgaaagcaacatattaattttaaattccaacgccaaattacaaagttcaatttcttcatttcctttcatttcaattccaaaatcaattttccatgggagtatgttttgaagaattttcaaaacttccaaagccgggtcagaaaacatctcctcaaaagcatttctgtaaattggaaaatttttaggggttttttgtttttgaggacctaagcgaaaccaaaaaattttcatgagcaaaaaaaaaggtcgttcggacgaaagcttttcaaaaatacacccctaagaatcgggcgaagaattttcaaaaatacacccctaagaattgacttttcggatcggtaccccccccccaagcccaaatcctagatacgtccctgtgtgagagagagagagaggggataaatgaaaccgatttagatatttatttcttgaggtgaatagaataaagggtacttgtacagtttggaccgggaacagttcaactcgccgacgccgactcgccgatggtcgactcgccgacgccaactcgccgatggttgactcgccgacaacacgactcgccgacgtcgactcgccgataaattgtgcaaaaaatcgtggaaaattttaattttttaaaagaaaaaaattaattttttaaaacgaaattttaattttgccgtacttagataaaaagacaaaaattgaaaaaaattgaattctcgccaataatacgcctcgccaacgccgaatgatgtgcaaaaaaaaattgaggaaacattaaaattgtagccaaatgaaaggccaaaaacccaagccagtataaaaattttgtttgcattcgcgtttttatctctgatcatacagcaatttatttttttacaatgcaaaacctgcaacaaattcaaagtcaacgtgccgaacagaaatatactcttaatgggtatatgtacgtcaaagacaaagtcagtgcaagtggaatggtgcaattctggagatgtgaaattcgtggctgtcgtggtcgtatatggacgaatttggaagatggctttttagtttcagagcacggaaaacatatttgttcagaagccggcgatgctgtaaacgttgaattggcaaaaattcatacagcatttcatggacggcacattttcggcttctcctccgctttttcaacagatttatgtcattctttctcgacgtggtgacttcgtttttccggtgttctcttttgtcttcttcgaaacaaagatgcagctacatatgcgaaacttttccaaatgatcaaagatatttggccacaattcaacccagattccattagtgtggattttgagcacagcattcatttggcaatctgcgaatttgctgagaaattagatgctgttttttcacctcatacaaaacctacgcaaacatttgtcttcagcacatcttttaggtcgttacaatacggatgcaaattttgcacttcattctcgaatgattactgcgattgcattcattccggaagaggatataattcggtccttacaggaactcgaagatcatactcttgatcattatccggaacttgcgcctatttttgaatggtttactaacacttatgttggaagaggaacaagggcacccccaaatttttcctatgatatgtgaactgtttttcagcgtactttggaaggcagcgaccgtaccaacaactatgccgaagcttgcaatcgaaaattgaaaatcggatttggctatgctcacccacatatttgcgttttattgacgatttaagaaaaattcagaaaggtttagatcagattatgaagaatatgttagaggtcaggaaggtccatcaaaaaggccaaggtacaaggaaccgatgagcgaatactgagaaaagtgcaaaattatgaagtcggcaatgttttggagaaaggttgcaaccccgaccccgcccctgaaccccgacatttttggccatttttcggggaaaaccccgaaccccgaaaccccgacgcttcataccccgacaaccccgaaaccccgaccttaaccccgatncgggtcagggttaaatatacacccctaagaatggcatttcgtgggagaaatgcaaaaaagttagacgaaatttgattttttttttacatttgccaaattttataaataaagagatttgctcaattt

SEQ ID NO: 4193 - DNA, 5389 bp, Heterodera glycines
  misc_feature (160)..(160): n is a, c, g, or t
ttttgattaaaaatccaccgtaagattatgttttggtctaataacaaatatttcagtttattttccttgtttacttgtagtttgttggagctgattattgccgattattaaacggattcatcagaaacggactttgaaattttgattaaaatccaccgtnagattatgttttggtctaataacaaatatttcagtttattttccttgtttacttgtagtttgttggagctgattattgccgattattaaacggattcatcagaaacggactttgaaattttgattaaaatccaccgtagattatgttttggtctaataacaaatatttcagtttattttccttgtttacttgtagtttgttggagctgattattgccgattattaaacggattcatcagaaacggactttgaaattttgattaaaatccaccgtagattatgttttggtctaataacaaatatttcagtttattttccttgtttacttgtagtttgttggagctgattattgccgattattaaacggattcatcagaaacggactttgaaattttgattaaaatccaccgtagattatgttttggtctaataacaaatatttcagtttattttccttgtttacttgtagtttgttggagctgattattgccgattattaaacggattcatcagaaacggactttgaaattttgattaaaatccaccgtagattatgttttggtctaataacaaatatttcagtttattttccttgtttacttgtagtttgttggagctgattattgccgattattaaacggattcatcagaaacggactttgaaattttgattaaaatccaacatgtatttatttgttttggtttaataacaaatatattaagttattttcattttttaccatctgaattatattgtgtgttaatttaaaataggggcgcccgtttttccgggagtttgaccacttgccatggaccgatggagctgaaattttgtaacatacatagcaattctgaaaatcttaagcacagcaagtgagaaagcggaacaaggaggggaaatttttttatagtttttttttcaattggggtgttcataaaaatagggacactttggaaaactgagcaaactcagctactaaaaaattatgctgattttaagcccgattgaatgtaaaaatatcatcagcagacaaccgtgaagtgtatgaaaagcaatttaatttaggctcaatagttcaaaattttgagattatttttgtattgtataaacccacgatcccttccaatttactcaaaaactccgggactcaattcgacgaaccttcctcctctcgttattgttaaaaaaattttttgactcttttcttaactaatttttgctttttttgattttgattcaatttggttcatatttatcaatccaaaaacgcaccaaacaaaaaattcgttagtttttttcgcggtgtataaaaaagtcagtctcggtctcggagaccgagactgaaaacccgagaccgagactcgaaaccgagaccaaaaaaacccgagacttttctcgagtcgagaccgagactctcgagcatcactactccgccccaccctgagacccgctaattcctctcacatggattcgagtaattctttagtgggagcttcagaaaacaatatatccggggtttcagctctaatataattttcagatgatccactttcaaccaatgctggttcagatgaagaatactcaattgaatcatattccgaactcttaaattggcgctttctctaaaatatttggggtttcacccttaaattaccgcccctaacttctctaattttctcttcttttcttgttgccgtccctttagagttcatttgaaggagtaaaaacgaaattcgacttaaataatgatctgacacttgttggaaatcttcgtcttcatgaaattttgtttcgaggatccccttaaaaacataactaattttgcttattcattatttatacttcgtattcatcaacggcttcggcaatttgttcgtctaacttcgcataaaacttattctattttgtcaaattcgaaaatccctcttatttgccgattcgcgaagtgccccttttaatgacgtcatccttttttaccaattcaggaatccctcttatttgccgattcgcgaagtgccccttttaatgacgtcatcttatttgccgattcgcgaagtgacctagcaccattcggcgtatcccggcgccggcgcattgcgccgtttgccgcgtctccgacgacgatttgtgtcttaaattaatgtataggtacaccacgttgagagcgggaaaatgcgacactggatttttttgaaaatttccccgattttcagtgtatttagggggtatcccgatcatttaaaacagatattttctaattaccatcattgtcgtcgccgtccttattttgtccatcagcaataaatgcatttgcgttccattcaatttccaatgatcgcgcgtcaaattgaacaatacgccgttctttttggccatattttcctcttcctttttgcccattttctcttctttctttttcgtcgcttttttggcaactttctaccgtaatcccatcgtccatttgcaactcatcataaatgtcaattagctcaatcgaaatttcttttggctccttttccttctcccctagggggctttccagtggaatttggccacgttttgccatgaaaaacacggcatatgccaaactctgtttgagttcattctttcgcgaagataaggtgttgttattttctgaaaaatttacaaaatttcggccaataaaaatttgactaatttttgttttaccctttttcatcgcctcatttgctgaaactacagcagcaaataatccctccaacaattggcttagtgccggataattctcataaatctcttccgagcggtttttgaaaaatttgaattctttttcatccgaataatcatttttctgtcaaaatttaaaaaattgtatgaattcagttatctgaggttgggcgaaaatggcacaaaattaccatttttaatttacctttgaattttgcaggtaaaaaacttcctccaaaaggcacttttttttgtttaacccttcaataaccttcttcacttgttcattgtgtttgctatttttgccaagaattttatttatccatattcttgaaacaaaaaataatctctcccgtcagcgatttgggcgggcattttgccagaatccttagaatgttgcgtgattttgccagaatccgccggcactttgacagaatgttcttgtgttttttcggcaggttttgacattattttgcgggaatccgccggcactttttgtccatggcatccatccattagcaaaagcattgccaaaattagcagagaaatccaatgcattttgccaatcattcgcaaaatactttgataaaaaatggaaatttgaatataagttgttgaaattccctataaaaataaaatttaaaatgagagcactgaatgtcgtgcgtcaccgtagtgcaaccctttgtacccctttattccccattaatacagtaagaaacagtacgcctttattctgggtgaaggacacaatgcttaggccctcttcccgattcggtctcgggagcagagactgccgggggagaagcctgatttgtatataagtgatcgagagtaagcccccgggggcgggggggggggtaatcaaaggtggagggagtgatcaaagaaccgcccactagaggagagagacaattgtttgggaaataagatagatacaaaatgtgacatttggattacaaaataaatggtaaatattgtgtaaatgtgatgatgattattataattattttggtattcagccctaaatgtccactattagccaaaaaaattccgaaaaataaagttatggccaaaaatgactgaaaatttggttgagatagaaaaaagttttagtccaaaaacatggctgtggcctaactgaagtaaaccgtcttattataattatataattattaaacgaaaaaaatttgttataaaaattattattattaaatattaaataataaagatacgaatttaaaacattcgatgatattaataaatttgccaaatctctgaatgaatgaaatgcgatgggcttgtgaccccctttttgttaatattattggtgatatttttttgtatttcgtattttacaaattattataaaaggtgaccagccgcaagaaagaaaaaaacaaagaaaagttaagaaaattgttcgagttcgggttcgcgattcgaaaaatgaatgttcggcacatatccgaccaatttcagtcctaaacaggcactcacgcgaaaacaaccccgaccgtataatttgattaatatagttcataaaaatttattataaatttcatttacaaataaaaaactataacaaataatgagttggaagagtacaagaagaatcagcaaaaagccgttttggaagctatgggaaagaaaagggctcccggacttttcgacagaggactattcgacagcaaaggacatttcgaccagtgatgccgcgggttaagaaaaatttcgggttcgggtttcgggtcgggcactcgaaaaatttcgagttcgggtttcgggttgagaaaaacttcgggttcgggtttcgggttgagaaaaatttcgggttcgggtttcgggtcgggcactcgaaaaatttcgagttcgggtttcgggtttcgggttgagaaaaatttcgggtttcgggtcgggcactcaaaaaatttcgggttcgggtttcgggttgagaaaaacctcgggtttcgggtctcgggtttcgggttcgggttggcatcactgatttcgacagcaaacataaaaacaaataatttttattcaataaattatattgcttgtcagttttactaaatttattttaaattaacctactaatatgtattgataagatattattactagggatacggtttttatgtttttatatagaaaagtttcagaaaaatacacccttaagaatcgggcatcaaaattttaaaaatacacccataaaaatgaaaaattttctcaaaaattcatctccaaaatttattttctttttgattattaaaaattatttatctcaatataaatttggcttaagttttttgatttttgggtaaattttacaattttacaacccctatattttaaacttaattactttttactgtcgaaaagtcccctcctcaatttataatatttctgtcgaaaagcccggcgccccaagaaaaggaggaaaaggaaagaattgaaaaggaaacggaggaggaggaggaggatgattaaaaagaaagggagaaagggaaaaagaaaag

SEQ ID NO: 4194 - DNA, 4479 bp, Heterodera glycines
tgcctaattttcaacacttaccaccatccaaagttggtgcctgtgccgtcgtcctccattgccaacttttccgcatgtggtggttgtggtgccggcgacggtccgcagtttggcggtccatagacaaggttcccaaggctgctgtcgcctgctgttgccgccggtgccatggccgcgaggcaaacgaaaaataaaaaataaacgttcggcattttgttctaaattattttgcactcaaaaataatcccaaagtaaaaagaatgtttatttttatttttttaaatgttaacaatatttataattaaaaaaaaaatacttttatatacataattgatgaatgcaataattatattaatttaatgaatagaaataattaatttaatttaattattttatcaatcactgagtttttttatgcccacactgagttttgttggatcgaccgaccaaacatcattacaatcaaataattgctttgtttgtaatttttcaatttgataaaaaaggtaattaattgagggacaaatactacaaagataacggtagcctatccaaaaatttgttcaaaaaaattttatatagaaaagtttcagaaaaatacacccataaaaatgaaaaattttctcaaaaattcatctccaaaatttacttatatattttctttttgattattaaaaattatttatctcaatataaatttggcttaacttttttgatttttgggtaaattttacaattttacaacccctatattttcaacttaattactttttactgtcgaaaagtcccctcctcaaatttataatatttctgtcgaaaagtccggcgcccaaagaaaaggaggaaaaggaaaagaattggaaaggaaaacggaggaggaggaggaggatgaatagaaagaagtgagaaagggaagaagaaaagagcaaatgtgtgtacggatgatagtagattttgggggaggaccataccatacgaagcatactgtcccctattcgtactgtacatgtgtgtctaaactgtactgtctaacatgctactactctctgtgtctgttcatctcccatgtgaaaacagtacgaatatggacagaactgaatcggcctcgtagaaactgtttttttttacgatttgattctttggaacttttatgtgttagtaaggaaggcattttttaaaagctctatgagtcattgggttgtttttattcttagataattaagtagggaggatgataattttaagtgctaaaaactgccaaaatagtaattttttaaattcaaaattcttttcaagaaataaataaattttgaggatgaatttttgataaaaatttttccattcttaggggttttagaggtgcgccgtgactatagtaaagaaggcatttttcgaaatcaatatgagtcactgcttttttaaaatttattttttattagataatagtgagaatagaattatttttaatgagacagaagaaacccttaatagggacccaaaaataaaaaataaatttaaatggtaaaaattgccaaatcatctttttatttacgaaagtctaaattttgcagtaaattctggattaatgcccattttttatttttttttaaatatacaaattcttctgctgatttcgtgactagaaaaataaggaacaaaattatgaatttcaaaaaagctaaataaatatgtgcatttgtaaataaaatttgatgcaattttattaattatcgaaagatttaagttagaaaataattatttctaaaaattaaataatcacaaaccatttgtatgcagtaatatgtaaaaaaacaatacaaatgtttaaaaattttcctagaaatttttcacttgaggaaaactcgacaattttggcactatgtcttgaaattcagcatcgagaaaagccttttgaactcattagtgggcaaaaagcgacaacaaatgcgccaatgaagaagacccaattttcaatgctttatcctatcaaagcatttatcaacgtcaaattgtccgatgcaaaaaagtggtggaaaatttgtcggattatttgtgatgatttggccaataatttgtaaaaataaatgaataaattacttttgtcatttatcggtgcccacaatctctgctacaaaatgtgtggtcgttcgtccgctttttcttctgttggtgccttttccccacttttttacttttttacacatcgacacagaaaattcagtgattggtccaacgacggaattcactgcttccatcccgacactttcattcattcattcatttgatttgatcatttgtgaaataaatttttttttcataaaataaatcgaataatttttttttattttcattaattaaatagtattaatattcattaattaattaatcaattagcaaatgaattgcttttctctattgaccgtctttctttgcttggtcattaattgttcatctcctccaatacggtagtttcttaaatgaaagtaaattatttttttgtaaatttttcaaaattttcaatttttcagccctttgtcatccgacgttggcatttggaaattatgcaatggcaaaaatggaacaattttggtggaaaatggatgtacaaagtaaaatatttccaaaattttattttaaattaattattttaaatcatttttaggctcctcctctgttaccaaagcgaaatggccacaaacagaaaaattggaaaacgttttggagtgggcaaaggaaacattggcaaactgaaatttgtggaatgtgccgaagagattgccgaagaccaatggcacggtctgatcattacgaagcaccaagacggagtgataagctacgaatcgaggcaaattgagagaaaaaatattctaaaatatcaatttaatgaattaagccatggattcgacgacattttcggcaccgaacaaacgaaacaaacggaaaaatatttggaaattaatttgaccaaaagtaaagccaaattaataataatattttaatagcaattattattttacagatgctgaaccactgggaaacgaacttcaaaaagcgctttcttctgcagcattttttgacgattttatgccatttgttttggcatttgaatttggcgcaacattttgcgcagaaaacggcggaggcacaaaattgtgcaaagaaaaagtccaatttcatatttaaaattctcaatttaaaataattttgatttttagtgcctttcccaaacattggtcgccccaaaaacaaaggcaccgtttgttggcacaaccaaattccatggaaaaacaaaaacaacaacaacaacttcaatcccgaccaccaccgaacggcaaacatttgcgtttgaaccgttttccgaatttgtgtctcattttggcactaattgttcgaaaatcgttttccccgtggaagtggccaaattcattttgaacatcaccgctgtgccctaccgaattgcatgcaatgagtatgaacaagattacgagatcggacaatcggtggagctttatttggcaaattcaaacaaaagttttttcaatgcttgcatggaagtgccgacaaccaaatgcgcaaagtgattgaaattccggcacaaaatttggtgccaaattctcacaaattgtttttaggcatgtggaactgagcgcatgctataaaagcatgaaaacagtggggccaaacgacaatgtcgtcgccaaattatgccaagaccatcttaatgaaacgaatgttgccggattttctgtacaaatttgcatccatcgggatgaaaaggaacagaagcttgtctttgaaacattcttgaacctttctaccacagacgaattgtatggccaaataatgagagatttaatgatgtcattaattaattttacttaattgggttaattaagcatcaaaatgacgcgcaatttcccaatttccgttgaacaaattatggagataaaagaaaccattcccattttctttctcgaatttggcatcgatctccagcaaagcgcaatccgagaaaaagccaatgggaaagtgatcaacggagaattgaatgaaaatgtgaaaacatcgcttttttattaatataaaattaagccaattgcatttgctaattattttttaatgaattaatattaaataaaccaatggcatttgccaataatttaattaaatttaggttaatggcattggcaccattctcaatgacatcaaagcagaaaaattcaatgaaaattcggccaaaatgattcatttggtgtcgccttttgctgatcatatgaaagcgttcttccagattccaacgcctcagttctccaaacggatcagttaccggacggatttgaaaccgtacgaaaatgatccgaaaaaagaggtgaaaataaacaaaatccggcaaagggtatgggccaataatgtatcatttctaattttaaaccgaggcttgaaatggagccgattttttttaaatttttctaaaaatat

SEQ ID NO: 4195 - DNA, 1191 bp, Heterodera glycines
  misc_feature (16)..(16): n is a, c, g, or t
  misc_feature (23)..(24): n is a, c, g, or t
tttcaaagagtttaanagcgatnntcatttatttccagagcgataaaaaacagatagtgaatatttaacaaatttaaacaaagaaaatttgggaaggaacggcgggcgaatgatttatggtctttattttcgtcaaagaatttcaaattttcaaaaatttctttcataaattatttctgtcaaaaatttgctctttattttctttttttgaatttcattttcttttcttttctttcgctgtttcaggaaatttttcggcgaattatttgacatttaaatggcaacggcgaaacctaaaaaaaaaaataaaagacaaacatttaattatttattttttcaaaattttgccgttagtccgtaaattcgttgccgcgacggcggccgatccgtgcggaattcgaagtgcctaatgagcgatgagaagatgaggaacagttcggcacgcgccaaactctcgccgaggcattgcctaaaggattttaatcattcattgggcacggcacaaagccaagccgacccgggaacggcacaattcgcacagctttggcctttcctccacctcaccttttcccgatcgaaaatggcaaaaatgcgtcgatgcgtctcagtgtgccgtttagcgggtcgataaatctttcgggactgaatcggtcgggctcagggaaatgggcggggtcattcaaagtgactgaataagcattttgcaaagagtgaacgaattggcaaatggtgacttgaaatttgcgggaggaccattgtgcccgaggggaaaaagaaggcgtcgagggaaacattttcagtgcaagtgcgaagcaaattaatgggcaaaatgttggccaatcgctgaatttcggcaattgtcgcgttcagataaacgaagcgggaacgatggcgcaattccaccgaaaaacggaataattatgagagtttaagtaaaatagggcaattaaggcgtgccaatgccaatgccatcctcttccccccccccactcgtcgcacttcgccctcctccccgagttgttctatcagttcggcgtggcatcgctgctgcacttcggggtgatggagcagcagcaaaatgccccattttgtggtggtaactgtcgtctcagagcccgcaaaaaacaaatcgagcagaagcattttcagttgcttttcacttaaaaatttaaaatcgaaaaatgaataaaa

SEQ ID NO: 4196 - DNA, 2248 bp, Heterodera glycines
tcaatgtgtgtgtcgagaaaagcccagaaatcgtcgcggatggcgagccattggcgccaagcggagcaaatccaatgggagacgagtggtgaaaggtgcgcaaaggtaaaggcccatcccctgacgtagcggaggccgactgagcaaagcggcgatgaggaagcactcaccggacggaccaccagcgaggattggcggtccaccatttgttggacacggataaatgccggatcatcctggaaggaatggttcgacggccttggcactttgcccatttggtcccactgaccatgggcgtaagtgcaaccgaacaaaatgttatcgattatgttggcgatgccgtaccgccaccggcttacacgatgtccaacggaccactgcagcgggagcctaaacgaatttggaaaagtgccaaaaaaagagccatcctcaaagtgatgacgagttgtgcagatttcggtcacttttttgtccatattttcattgatcacgataattacgctaattaccttccggaatcaatgcgtccaaatgggcgatcaatgatttcacctgaaatgttgacaaatcaaatcactggggattgatcgattggccaatcattttccaaacttcgtcctgaattttcttttccatcaatgcgcggccgagtccaaaatcgcgcaaaaggtgcagcgcaaaccgtcgctgttcgcgccacttttcgccttgaatttgcaccactccgttgtggccatctgtcaaaaaaggaaaaattaaagtgaatcaattaatagacaattagtgggcaattgaccaatcaatgcctttgggtttttgccaattagcgaatcaaaagttgtaattgtttccataattatcatccaatttaatcttgcccatgaatgtgtgcgtgatgaaattctgccaacgaccgctgaacgcctcgccatgggagacgaaaaagcgacggagcaaatccacgcgagagaccatgcaaatctgagagagcgtggagggggtgggggcatccaacgaacggcccttttatttggcaatgtttttgtgtttgttggcattttgttcgtatctttcttcgtcacccgccttctcacgtcaaaaggtttgccttcgttcggttagcaactgaccggaattggacccatccaaaaggtgaaaatgccatcgtagtcgacgtgccacctttgcaggagggcatcgatgttgtgggcaccgtgaagaagcactttgaaagaacgaaggtcaatcggtcgtttcattagctgtttaattgtacgtttaccctgcggcatatttccggcaattagccacggaattggccccgggggcagcaaacgacgcttccaatacaactcgtggaaaacgtacgagccgaagagaagaaacagaaacaaagacgagacattgtatgaggggaggagggcaatgagagatggcagagcgaaaagagagtgagaggactgaacagaacgccaaatagagggaatttaaaatgatagcatacgtacagcaaaaacggatgccaaaacagcaaaagtcaacggggaaagcaccagccaaagagttgcctggacaagaagcgatgggatggatgacgaatgccaccactctaattagggggtaattaacggaggaatgggagtggtgcaatcaaatgcacatgcacgaggggtgtctgaatttacgaaaaatacaagaggggcggggggtatctcgagacacaccttctgcagtattggtgcaattaattaattaattggctaattacctgaaaacgaacttttaatggcgaccatttcttccattattctcataaacataaaaggaagtgccaatggtttcgttcgtctcctttctttctttgtttgctaaatggcaatataatcaaatggttcattccaaccgtccgacagaataagaaaacaaaagttcgggatttctaaatgagtttctccagaacatttgcttatgccatttgaaattgggtgccgaaatgagcaaaaaaaagggaaagggaaagcgaaagacggacaagggaattccctcccccggggaacttcccccactcgccccctgcgcatattcaatctcaaactgccgaaatgggcgtggattcatccaacaccaattcagacggatcaatggcgacgcattttgaaaagaaagaccaaccccgcgccccctttcatccgacggatttgtcgtttgagagcagagacaaatggggggggggggagaggggaatatg

SEQ ID NO: 4197 - DNA, 3545 bp, Heterodera glycines
agggaaggggagaagcagtttcacatcttcctttctttgtagtttgtctttttaatcattttattcgcaatattatcgtaaatattcattcaattgattcgtgtgcatatacaaatggacatttgttttatacaacggaaatggcaaaaaaacccgagaaaaaagttgggaaacaacgaatgattagaaggtggacagatcagagtaagttcagaggggcattcggcggcggaggtgcggaggaagcggcggaaagtgccgaatcggaggaattgggccgagccggggaaaagagcggggaaaagccggcggggaccatctgtgggggagggaacggagaatggcaccaatcaatttgtagattggaaaatgccgaacaaagacacattcactgattcgccccttttggtcgtttcccctccacttgccattacctaagccaaaacccttttttgtgtcaaaaaatggaaaaacacactcactttgacttcgattgaatgtccgttgaccgaatgtttttcaccggcagccaaacaaagttgggcagcattaagcgaatcgaacaccaacgaaccacagccacgggggtaagccaccttaaagaagcgaattgaattgtgagggtaaaacagcgagttgacggcaccgaccatttccagctgttcgatcgtgccaaattggccaaaatgagaacgcaaagtgtccaatgtgtgccattcccaatttagaccagataaatgaagacggcacccaacatcaggctcaatgttctaccaataggggggataagaataattaagggacaaaaaaagaccatgaaaaaggggatggggtcgttgtcgaggatcagattcatcctttcgctggaaagcaaaatatcattaaataacaagttttaaaatggaagaaaaagtaaggaatggactattgtcaattgggaagttaaaattaaaaaatgtgtagagtgaaagtgaagcaattaaaaaagcaatgaaaatatttttgtatgtgtaaaaagcgaaacaatttttcgaaaaagattccattggttgaaatgccattgaaatttaccgaggaacggctcgttttgcgtccaccgctttcccattgattttgtggggccgatgggccatcgcaacgtcggccttaagtcaaaagcaaatttgctaatgaattccaatctctgccgaccatttccgtcgtcgcgtaagtgacgaagccgaacccacgtgagcttcgagttgccgggtctctgatgacaatgcaatcgatcacatggccccattgggagtaatactgacgaagtgcgtcgtcgttcacttggccaaggcctccgataaaaagtttcttggcgaaaaggccaaatttaaacggaatgaacgaatgaatagcagcactcactttgctttgtgattgcgaattctgttggttgtgcagaagaacaaattgcactagcgaagaaccgccattccgagggaaaaccatcgacgaagggccaaggaaggcggcggagtcatcgctgaaaggacaacaaacggcattaaacaagcacaaccggtagttttgaaacaattggttgtagtgcacaatacgcgtccactggacttttacgcgcccataaaaaacggacaaggtgatgtgtgaaaaaagtgtcgtcaaaacattcagatttcaatggttatttgagatctttcaccaagtataggttattcggatggaaacataaattaagttaatgaaattaatgggacgtgtaaaagtccacgtgtattctgctgttgaaccaaaaaattggacagaacaaattttaaacgaacccgcgaaaacactccgttgccgcataatctgccgaagaaaagtaaatgccggaaggaggcacttcagaagacattctaacgaacactcggaaaataatgggcttagaatttaccaaatattcagtagtttattgatgtgaacaaaatagtgacaaaataatttttattttacaaaaaatttttaaatatgattacggtcaaaatgaaactgaagggaatggaagagaaatgggacactcgcctcggagaagtgtaaatgagtaacagaccaacgaagggtgggtcaatcaaaatggacaaacattctgtgcttttctttgctccgctcattgtcagttcggctcgtcgtccgtcctttgccccgcgtcgcttctctctgccgcccctccgccatttccctctgattctccgtcctgctgtctttgcttctgttccgtctgcagagcggccagttttgaagagagtgcggcgccaaaattctcgcggtactgctcgcttaagctgtccaacagctgctcaatggcgtcgtagtaagtgacgtgcatttccaactgaaaagcgaaaactgtcacaaataaaagcaattcccttgcaaatggttggtcaccttttgaatgtctccgttcatacagtcgagacggtcggaactcacccgccagcctcgttgagtgagttccacgcaataactctcatctgaccaaatgcatttgcatattttcagccaaaatatttccaaaatgaaactcactttccaaagtgacaatgttgaggaatatgagctcgggagtgcgggatagtatttcggaaatggcgatggttttgacgtacggcgccatttcgcgtactgcggcaaaagcatccttctcaagttgtgagaaattggtaccgcacgcctcgcaggacactgacggggcaggcgaagagggccttgagaaatcgttgactcatttgtacatttggagtttattacaatatttcttttataactccaacccggtgctgcaattctccgcgtgattgccagagggctcgccattctcatccacagaattattttcatccccctcacttttcgttgtcattgccagccaaaaatttgtcaagcgccaaaaaataatggaaaatcaccgaaattaagtgtaattgtaaaggataataggtaattatttttttaattttattacatatgcatatgtacatatatacatatttctccttataggttttctttaacacagcggctcaattttttattttaactttgcaaaattaaaaaaaattttgggattttcgcgtgcaaaaaggcaagaactagagtgcagcgggaccgggacctggacacagacaactgagtaccaaggtcccggttttgaccggaaattcccggcttttttcccggttttcccagccaaaaagtcccggtttttcaacccaaaaagtcccggtcccggtcttgcccaatttcccggtcccgctgcactctagcaagaaccgatctcgagttacaaaataagttttcaaaaaacaaaagagaattcgataggggacaccctcgtttcggcgccgctcgtttcggcgccagcccagtttttggactataacttttttctttttccaccaaatctaatattattggtatcattcgaaagctctaagtgttctctattagcctgctaagtttcaaaaaatttcgttaatgctcaaaaaaattatgactagaattcaaaa

SEQ ID NO: 4198 - DNA, 2769 bp, Heterodera glycines
  misc_feature (8)..(8): n is a, c, g, or t
atagaggnggttaaattataggtctatgcaaaattctaaaaaatttgcaaataagaaatttttttacaagggcaaaaatttttaatattttaattcttttttttagccaagtgcgcaatttaaggtcaaaacaaacaaaccttagaatattctccagaattttcccttcaaaatggttttggtctattatttacaaagttatatgctaaaaaatgggtcggggtcgttttcgcgccagtcgagtttttgaaccataatctttttcattgtcaaccaaatccaaaaagttatggcaaaaaagactgaaaacctggtttctacttttggccataagcttttcaaaattgacgaatttttttttttgtaattttgcaggctaatagagaatagatattccaataaatatataagtacttaattttttttattgtttgaaatatgtaagtaactcaaaagaaaaacaatggcagatgtttatcagcagagtttcacattatcaaaagagagaaataaattaaattaaattaacgtatataggcagtgagattaaaggcaaattgagacatttaattgtggaatagaagtggtggaaaagatcatctttaggagaatggaatatttatttgaattacatatgtaatatttaattaatgagattgcatggcaaaattgaatgaccaattaaattgaaggcattttaggttttgtgtatcaatggaaaaagcgaggaatgtcaaagaaagataaaaggaatgaaaataaaatgactggcagtgatttcacattaataaaatttaacaacaacacctcacaatcagcaataagtggaaaaattgcaattggtccgactgagcaaaaagtggcgatagttttgtaaaatgcgttggaaggcacacatccgagcacagcgacgttcagtgagcagcggtggcagtgcgactttgaactcacacgaattgggcaccaattggaagctgtgaattttctgatcaccgccagtgatcaaatggagctgaaaggagtcgactgtcacgccatccgcttgaatttgttgtggagcagtgccagaataaatgagcattttgtcacgagtgtcatggaaattagcctaaatatgacagatggaaatattaaaagttcgacacagagaaagtccgaaaggccgcaaaggcgtgtgggataatctactggtccgtgattcgttaatattacctgacaagtcccatcactggtgaacagaatcagtgcatcgggaaatcgatgaaagtcgacgatgtggagcaagttgaactgattgtgactttgagaggagttcggaaaagctgtgccgagtgagctgaacgaattctcctgaatgggcaccgacgaacgcaattccctgtccatgtaaccacgataagagcgcataatggtggcctaaaaggaatttacaaatcagaaacaaataaaagaaaggtgaacttttttgagaagttcgtccgatggacaaccgtcgtcacaattccattcgacaaaattgccaacaaatttttgtgctcgataggtaaagtatcgttgacaataactgcaaaaaactttttgacctacagtaaatgaaaattcttttccagtcggttttgtgtggaattgttaaaataaaggctgcttttcacgatacctcgttgaaagggacgactgatcgttgaatagcaacgaccgagtgccatcacgaaaagtgacgccgaacccatgtttgttggtgaagtcgacccatttgcagacagaagaggccgggagagaggcaggcaaaacgggcacaatgcctatgaaaattatgcaaaaaacagcaaatgaaaatacgtgaaaatgggggaagacaatgaaataatttaatttttttgcgagtgattggagagggaagggggtcgatcccactcttttttcatgtataaatgaattaagacggatcacacacaaaaataacttactgagagaagagaatggactcatgagcaaggtcatcgagttgatgtacttgtccaatgtttggcacataaatctcccgacccatccacccgacagttcgttactgcccatgcccgagtcgtgggcggacgggggctgcttaggcggaggactatttttggagactgtcggttgttgaggataaaaaattaacaatcagaacatttataaatattttttaaatagaaagtaccacagtcttcgctaatgttgtaaattgttgacaagaagcacttcttgagctacaattaatgtaaaatattgagggaaaacaaagcaaaaccccaaacaaacaattgctgcaaattgtttccatcaataaaactgcggttcaaattaggcggattcagtgacgaatgcgccaacatttccccaatggtaagtcgctgtttaggctcacgaattaaggtcctgaaaattaataaataagacaaataatgaaagcaactcgactttttaccgtttgatgaggtcaacagcactctttgaaaggggcggataacgcacgggaaaagagtaatcgcagcgacggatgcgcgagtaagtcgactccaaattggaactgtggaacggagggtagccgaagagcatcgagaagaaagtgcacgccacggcccaactttcggagtggacggaatggcccctgaaaaaagggaatggtaacacaaaaccaggctttcatgtgctaaattctcgggttgctcatcgaatgttctttttacttttagtcaatgacttcggctggcacataatttggcgttccgc

SEQ ID NO: 4199 - DNA, 4278 bp, Heterodera glycines
ctcgtacagacaaagcgcacaaaaattccttgctgacccacccaaaaaactgttcatggttcacagcaaaaaaggcacgccttttgattgacatccaaattcagaaagtaattctaaaaattaatttaaaattgaaaataatttaaaatatttgaaaattaaatcactttcaaattgtcgagtccgaagcgttcaatcagaaggaaacggtcgatcagtggaatttcaacgcaattgatcagatgcgtttcgcagcgcgacttcaacgcggccacctgaaaacggagaagttcgtttattagaaatagcaaattcattagcaagttttgagtcatttgatggcaattaatagtcccaattagcctaccaaattaaaaaattttagttaggtagaaaaggttataaaaacacaaagttggtttacgaaaaatcacagaacggttcgttgtctcattcaaaatactagatttattttttcataaatatttaatatttaaattaaaatgattgtacggtggcggataatgcaaaacttccccagcagcccaattcttataaagtgccaattttgatcagttgtaacttgggcttaaaaaaattacgtaaaatgacattttttcaccactttgtttgttataaaaaatgccaaaatattcgccaaattatcccatttgaaaataaataattttaaccaaaaagaggaaaaacaatttgtttgaaaaataaacaattaatgaaaatgccaaaaaaatcaatatgatcaaagccgataatttaacaaattcatccacaaagtctgacggacaaagcgtacaaaaattctttactgataaaaggcacaaactgttcactgttcgcagtgaaaaaggcacggaatttatcaacattcaaatgcaaaaagtaattctaaaaagtggcaaatcaatcaaaatttaaaataggatttaaagttcaaaaatatttaaataataatcactttcaaattgtcgagtccgaagcgttcaatcagaaggaaacggtcgatcagcggaatttcaacacaattgatcagatgcgtttcacagcgcgacttcaacgcggtcacctcaaaacagaacagttcgtttattagaaacagcaaattcattagcaaatttgggatcatttaatggccattaatttaagtgagcaaatataaacattacaagcaaattaaaattaactttggttaattagtttttggaaagtcaagtaaaaaagtgacaaatattatggtggtttaatttaatatttaaattaaaatgatcagacaaagaaagaagatgtgataaatgatcagaggaactcgcctggaaatagtcggccaatttgagaagcatcagcacatttttggctaaaaattgggaaattgagaagtccaaatttacaaagaaaattaaaattatattttcaacccctcagggggttgaattgaataaatacagtatcatgaattacggtttggcagaaaaggtccgctcattgtcagataattgatggcctccaaaaactgcttgaattggtccatgtccacgcccaattcgtccaaagtgatcattcgctgctgcttctccttcatctccacgctgagcatgcgactgatcaccggggaaacggacgacagccaattggcggacacagcgatctgatcaccaagattaattatcagtgatccgaacaaatttgtcagcgattagaccaagaattatgagtaatatgaccaagttaatcagtgatctgagcatgattaattatcagtgacctgagcaagaaatatcactaatctgacaaaattttcagtacaagaaccagtgatctgatcaaaatcatttgtcagtcatctgaccgggatttactagtgatcagaccaatgttatgggtgacctgatcaaatcttagtggatgaatgccctgtgctctctttctgctgtttcacctgtttgtctccaattttcactgtcaattggtcgtgatcagttgagctgttggaaggcgccgggaataggctccgctttttgagaattcggataacaaatgatgatgaagcattggagccgcaattaatttcactgcccttgttgagtgtaagggtctaaataattggtaaaattgccgaatatggtatcgactcaaaatcgcacaaaaacacttttataggtgtttagaagtaaaactaaatttttttactctggtactgaaatgtccattttcactgggactcagttgcctcagaccaaaaggtcatgaaccccacttttcattcatttattcgaattttaaaccggttcaaaaaccggtttaaatgcttttccgcgcccaaattttaagctgttccatcgttctcagcgcttaagaaaccctataaaaatgcgtttttgtgccattttgagtggataccaaattcggcaatttccaaataatttaattgattaacattttttatttgatcattttcgttaaatttaatttaattaattaaaaattaaatttaaaatttattttgttaaatttcttacttctttgatccgttgtgccccattttggccccaatcccaacggacaatttgtgccaatggctcctcattcgacggattggaagaagaagcattgccaacgtccgtgatttgcaatatgggataatcgcttatcgtaaattcactaaaatatgtaagtgattaatatagaaaaaaaaaatcatgtttgcttaattatatgctatcaatttggttgctttttaatgaaaaaaataattttgtaataataaatttttaaaaaatgaaattacagtgcagcaaattgggtaatttcacaaaatgtaccgatgcatctgtcacagtttaggagatttatactgatcactttttcgtcaacaataataaatccgtcaaagatttccattgaatgtgcttttaatttaattctattaaaaactatttaaatataaacaaatacatattttggcaacaaatattaattgcattggacatttagtgacttatttgtacaaagtcgtaaaaagacaaatttatgaattcatttcgaataaatcacgggtggaccctgataaattttggaaaattttttgtcaaaaatgcaaaatcaaaaaaataaaataaaaaataaaagaattttttgtcaggtgtaaaaatggaaaaaccttagaaaatgtggaaaacatttttagaaagtgcaaatgctacgaccccatgatcaatacatatttttatgtcagaaatcgttgtttattagatgaatttgtttacatgtgtaaaacaacaaagatgtgtaaacaaataaatatttgaataaaaagctaaggaaaattactaataattttatgaaaaataatttattttaatgaaaataaataaaatttggagtgccatggcattttcgagtgtaatgccggcaagggcttttggacagggacctgctgaacaagtgatagtcacttgtggtgccatatccgtacaatattacggcggatatggcaaaacttccccagcccaaccctcaattattttattatagtacatagcatatgctgtgatttattttttaattgaaaataccaaagtattgttcgaaatgttaaaattcgccagtcactaaaatgcgaaaatgaacaccaaaagtgggcaaaaaatgctcagaattaacctttttttattaaaccaaacattttcttttaacccaaataaaaaaattatctaatcgagaaataaagaaaatgttaaaaacatgaaaatgccaaaaaatcaatttgatcaaagccggactcaatcagcagaatttaacaaattcatccacaaagtcggacggacaaagccaacaaaaattctttgctgataacaggaaaaaaccgttgattgttcgcaacgaaaaaggcacggaatttattgacatcgaaatgcaaaaaataattctaaaaattaatttaaaattgaaaataatttaaaatatttgaaaattaaatcactttcaaattgtcgagtccgaagcgttcaatcagaaggaaacggtcgatcagtggaatttcaacacaattgatcagatgcaattcgcaacgcgacttcaacgcggccacctcaaaacagagcaattagtgtccctaataattagcctaatgaatttaaaaatgagtaaaaagtaattttttattgaaaaataagggtgaactctctttgataaaggatattcaaatttaagtatcattttttgaaaacggaataaaattttatgtaatgtctaatattccat

SEQ ID NO: 4200 - DNA, 2204 bp, Heterodera glycines
  misc_feature (17)..(17): n is a, c, g, or t
acacgcacgtccaaaancctatcaaaaaataaagtagtgtaagcattgttatatgctggcgtaaaacctatcggtgggagaaagaaatgcttacatatcggtggttattgttcaattgaaaaatacccttttgccgctgacgccggagatggtcttagcgattttgcactgcagctgaatgtttttaagctcagcactcgtgttgcggagttccaggtttttgagttgtgcttcagcaatttgcttccgaatgtcccagagtttggccttttttgagcgaaggctgttctcgagctgctcatcagtcatgtcaggttctgctgacgcagaacctgttccgtacaagcccttccggattgcggcgtattcgtacgggtgggctttgcgacgacaaatccaacgccggcgcaattcagatggacagatgttgctgtatctccctaggccttaagaaaatgcaatccttagcattttctttaattttattactctgaatttcttctgaacagtcgacaaacgtctgttcggtgatttcaatttccaagtcgtccagcgctgacgcagaaatcgtttcatctggtcgaattcccgccgcttccagtgctgacgcaagccctggcggcggcggattttcctttgcgcgtgaaatggtcttcttaatgtcggcaacccatttattaatcacgcggaaataggcatccaacccaggaagaaccattgtagcaagaatattaagaatcagcaaaaattgagtgaaggagaagctgaaacgggaagaaaacaaaaaattaaatttaaaataagctaaattaatgtggtggagagcaaaatataaaaaattgttatacacacaacaaactgctatgggcatggactgaatgccaaaggagcggcggtatgaaaaaatagtaaagtgttcgggagcttacttgtggagaccccagaatttttttggtgagaccagaattttattttataaaatatttaccaaaagaatgagcacatttttgtgtttgtttgagtggaaaatccggtatatgaaggttctgtttttgtgtgtaagaaaaaatttgttgttttgctgtttatcattattttttttctaaattttgtttttgttaattgatttgattttgatcttaaagcttttgttttgcttatgtaaacgataatggagaattgtttggttaaaaaaatgcattagaatttgtttgaatgaaaaaggtttgttacttaaaaaagttttttgtacttttccttgcttataatatgaaaagaatctgatttggtttttgatatttgttttgaataaaaagcatgttatgatagtaataaaaaatgaaagaaaaagcctttgatggatagaaaaagcaatataaatgctacatcttatgttttgcctgtgttcgagtggaatatttatatgcaattgggatattgacgtgacacttgcggatcaaatttaggtggaaagttttaaacaggtcagttttaatttgaatttatggggtgggggcaataattatacaccatagtgttttgatttatgggttatatttcaatttctggattccttttaaatagttctgtattccgttgctgaggttgagtcccagtgattgaaacgcaggagaattgagtcccagtgattgaaatgcagaagaattgagtcccagtgattgaaatgctggtggattgagtcccgttgatcggaatgttggtggattgagtcccgttgatcggaatgttggtggattgagtccctgcgattgaaatgcttgagggtcgagtcccagtgattgaaacgcaggagaattgagtcccagtgattgaaatgcagaagaattgagtcccagtgattgaaatgctggtggattgagtcccgttgatcggaatgttggtggattgagtcccgttgatcggaatgttggtggattgagtccctgcgattgaaatgcttgagggtcgagtcccagtgattgaaacgcaggagaattgagtcccagtgattgaaatgcagaagaattgagtcccagtgattgaaatgctggtggattgagtcccgttgatcggaatgttggtggattgagtcccgttgatcggaatgttggtggattgagtccctgcgattgaaatgcttgagggtcgagtcccagttatgaaacgcaggagaattgagtccccagtgattaaatgcaggagaa

SEQ ID NO: 4201 - DNA, 2559 bp, Heterodera glycines
ttagtcgcacaacagtggtcactcgctgcaccccattttgttaactcatcccagcgtagcgagtgaccaccattcactgtgtgaccgaccatctgcgtctctgccccgcgagagagtgagttcactgcagcgtctctgcaaagacattgcgctgccctcgtacagacaaaagaagggagcgtggggtcaatgctgattggtcagcattaattgcgcaaggggcggagtcaacgctgattggttaaacactcatcattagggatttgacaaatatttaattaaatattttttgcttatatgcattgaacaaaggaactgaaaaacgactttctgtgttgaaatttttcatttgaatatcagtattggcaaacaacaaatattttctggggtttatggaaaaaaacatttatttcaatattttgaaaattcctattagcatttttggatttgtccatgtaaaatttacaaattctttaacaaaaatgcaattaaattgattttctctctaaatcgagaatgaggaaatttgtaaaaaaacattttatgaaaatgccaaaatcagtttcatcaaagcccggccaatgctcggacagataaagcgcacaaaaattctttgctgataacaggcaaaaactgttcatggttggcattgaaaaaggcacgcaatttatcaacatccaaatgcaaaaaatatttctaaaaattgggaaaacaattaaaatatttgaaaaattaaatcactttcaaattgtcgagtccaaagcgttcaatcagaaggaaacggtcgatcagtgggatttccacgcaattgatcagatgcaattcgcaacgcgacttcaacgcggcaacctcaaaacagagcacttttttcgacatttttgttcacaaaattttacaggctaaagcgagaaaatttagacatcaaatgaggatttgttgataagtgtcaaggcacccacctggaagtagtcggccaatttgagaagcatcagtacatttttggcttaaaattgggaattcattttaaaaaattaaaaatcatattttcaacccataaaaagggtagatttaattttccagaggatatagtagaataaatacgatagcatagaattacggttgggcagaaaaggtccgctcattgtcagataattgatggcctccaaaaactccatgaattggtccatgtccacgcccaattcgtccaaagtgatcattcgctgctgcttctccttcatctccacgctgagcatgcgactgatcaccggggaaacggacatcagccaatgggcggacacagcgatctgatcagaatggattatgagtgatctgtccaagaattatcagtgatctgatcaagaattctcaatgatttaatctcttttcaagaactaaacaataccggactcagcgatttgccaagtttatcagaatttaaaaaaattttggactctccattgtgctctctttctgctgtttcacctgtttgtcgccaattttcactgtcaattggtcgtgatcagttgagctgttggaaggtgcagagaagagactaacggaataaatatttagtgatcggaggagcaataatcaactccgaacgggactagcagtcgtcgatcacaattaagagttccaaaatatcacaaaaatcagatctcagactttcatatttatttgtgatttatcatttcgatcgaataaaacctaaggggttttgttaattgtgatcggacaagacaattcagacgacagagataaacgatagaatacgaaccgaaattttttaactatttagataaaattttaacactttacgtttcattggactttttctcccgctttttgtgaattcggacaacaaatgatgaagcattggtatagatgccgcaattatgttcactgcccttgttgagtgtaagggtctaaaataatatttgttaatcatgtttttttaagtttgatcatttctttaatacttcattgatttgttgtgccccatttttgtcccaatcccaacggacaatttgtgccaatggctcagaattcggcttggaagcattgccaatgtccttgattttcaatatgggaaaatagcttgtcacaaattcactaaaaataagtacatatgtgatttacatagaaaaaagcatgttagctaattacattttaaatattctttttataatttaatttcaaaaaatagaattacagtgcagcaaattgggtcacatcacgaaatgaacagttgcagccgccacactttggggcagagatttcattgatcgctttttcgtcaacaacaataaattcgtcaaagacttccattgattatgtgcttttaattaaaaaaaaatattttattaaaaaactttgacaataaaaaacaaaacaaattttcaaagaaaaagttttaataattaaaaatgtggaaaacattttaaaaagatgcaaatgcaattccatgatcaatatttttaaggtcagaaaaatcgttgtttattcaaatgatttgtttacatgtgaaaagaataaaagacatgaaggaaaatagaaaaa

SEQ ID NO: 4202 - DNA, 1425 bp, Heterodera glycines
  misc_feature (7)..(8): n is a, c, g, or t
  misc_feature (21)..(22): n is a, c, g, or t
cctgcannggtccttcccaanncatgatctgtttggtaataccatcatccttctccaccccgtgtctcagaattgtctgcgatggtataaatcccccctcgaagtaactcgtgacctaaaataagggcataattctccacttgagacctgctagtccacgccccctacttaccactactcggctatcaaatttgcgtccagtcaatgcggcctgagctttctggcattcttctttagattggaattcaacgaataccttaagacaaacaaatatgacaaataaaccaattatcctacttttccaacaccacgctcgtcgtacccaggcctcgggatttccatgctcacaacatttccgaatttgttgcattcaacgcgaatgtcttccgttatgtctaaaaaatagcaagcagtgtgtttttcatccaatgagcaaaattaccttcgtaaacttcgtcctgttgcaattcctcctcagttaccatattcatcagacaaagcacttccgttgggggtccggctcctctggacaagtcaatccccgcgatttgaaccgcagtgctcggatgggtgaccgattgacgtgctccagcagcggctaactgaaccaatagacgactgtcgccgagttgcattccattcagaccaacaactgccttaaaagatttttgcaaaaaagaagtgaaaattgggccgacttggtcagtgagcgactgatccaaatattcgcaaaaggcgtaaccctttgacattccggtggtcgtgtccatcaccaaattgaaggccttcagctgtccaaacgcactcagcagctctttgacttgttccgagttcaaatggttagggagtcccccaatgtataatttgaaaggactgtccacaacaatgttagagactaaaaacggttgacaaatgctttcgttttggccaaaagcaaacctggcattctgccaagcagttcgtaattagtggttggagccacatagtcgcgaggtcgtcgtattttcaattgctgacccataaaatttataccgtcaaatgccatcccagcagttgtctcgtcaatagaacggaattcaatgaacgcgaagtttttgtccaaatttatctgacacgcaatgaccggatttcctggagcctgtgccaaaccacacaaatgcatctgaaacaaattgtctatcacactccaggaatgaattttttcgaattttagcttctctttttcggtacttttattgtttaagggttgtttttcacatgcaccatgtcaaaatgctcacctatttatgggtatcagggcagggacgatcagggggtggggagagcttaccacatcaaagggagtaaaaaatttcttaatcgaaaaataacagacaattagttatttttccagcgggcaccacacaagcctctaaaacacgataa

SEQ ID NO: 4203 - DNA, 4475 bp, Heterodera glycines
  misc_feature (7)..(8): n is a, c, g, or t
  misc_feature (22)..(23): n is a, c, g, or t
cctgcannggtcacaattagtnntatttttccagcgggcaccacacaagcctcttaaacacgataagaccattgcgctaagggagggaggggctttggtaccccctccctttggacagcaccgaatcccatccgttaaaaagtccatggttgacctgttggttaaaaaagtccagcattgcgtcttcatttgaaccgaatggaatgttcccgacgtaaagccgtcgcgcctgacaagtgaccgaagggcccaccaccggaacagacgattggagggtggcccgagggatggcgccggtagctaaaataaaagtggtgaattcaagaaagtgggaatgctattctgcgtttgttgcgaggtgattgtgctcggtcaccctataagctattgggttgggatgaatccaaaaatgcagcaggacaccgttttcccctaaaacctaaaagactttcatatcgattaacatttggcggagtatcttaaatctgaaaaacgacgagacgaccaaattgagtgctaaaagttaaaattccgccaaaatgcttcggaaagcaccgtacagaagacctaaatgctaaaaaatccatcgattcagcacccttgcgcaattctaatggacgaccactactgaaattcaggaaattccagtgaggagccaaagggaaggtgggcccaccttggagttctttgtactccttcgggctcatgtgttcgtagccagcgggtggcacatcccaatatttgttgctcttcactttcgacctcttttcgcccctttccttttctcggcttcgctctctctcgcggtggcgttccttcgaccgcgagcgacttcgtcggcgttcgcgtcttaatgagattcaggaagcaaatcacatgaattggacaatgccagccccttgaaaagtgactaacgatcgtttgcgttcccgcgacttcgaccggcttcggtctcgcgaagtccgcttgctcttcttcttgcgctccctctctctgtcgcttttcctctcgcgctctctctccgcctttggctccgtttcgccatcttccgtttggcgaccaatcgcttcattgagttcggcttttatttcccgtttaatgtccatcagaccaattttttcatcttcgtcctctctcactcgttccatattcgcttgatgagtgttttcgtcgtccattcaaacaaaaatactcaatgttaaacagaaatacggaaaatgtgtaagttagataagtaagccaaaatatgaataatcaataaataaaagaattcgttgtgaaaataaataaattatcatttattggttagaatactgtatgttatgcatgtgaaaatacaaagttatttgccaaagaaagggagaataaataagaaattccttctgataaaaaaaggtgtcaattaaaacgctgaacaagaaaattgttgccatcacaatgaaatccaaatttctcatagaacggaaccaattgttctttgcattccaacgaaagtttgtaaacaccaaaattacgagccaaagaaacctagaaaagaataaagaattattttttgggtttttttgacccgaagagcaaaaaaaggtcttatcaggcaaaaaatggggtcgatcgtaatggaaatgggttctgacccccccccccccccccatggggggggggtcaaagttgatcgtaagacctcttggctgagcccccccccccttgcacaggtatgcctaaaaggaagagacaatgcaaattaaggtcattttctgaattttaatttccgtgaaaaaattctaaatctggcttttgccacttaggataaaaaggtgtcattaattttccaattaacttttattataaccaaccttgtttatgtgcaaaatatttaaaattgattttatatttttttcctttatttcaggcggagaataatgggctctagttcagtataaccaattttttcattgaaaatttgtttggtttcagaaaaattagatccaaaaaaatacttttttgaccataattttttgaatcattagttaatttgttcaacaatcgtaggctaatagagaactctcggtgctaccaaatgataccaagaatgtttaattggattatttattcataacactcctacgtgtatatgacttataattctgagatttcaaattttaggaataaattgattggatgcacaaaagttataccgaatttttcttgtgaaaaaagcaagcgctcataaattatatttttctcttcgtttaatcgcacttgattgcttctgacagtttttgaatagctttgagggacctatgaccgatttaaaaaggggaaatttttgggattatccatgaaaacatggaagaactgcctgaaaaggtcgccgctcagggaagggataaacaatcgtaaaaacccaatcattcctttccataaaaagggaatggtaacaaaaaaaaagaacaaatcaaccaacatcaattggtaaatccaacaaccattaccttgttaaattatgaatcacttaccaaatattcgttgagaatgtggccaaagtgttttcctctctcttcactgtccaccacaacatcttcaatacgtcctcgggctccacaactgtggatgaatttccactccaacaccaaagtcgcagtggccacaattttcttagtactaaaaaataaattcaagcattacaattttttattatttccattcggttacctttccttttcgataacataaatatggtaagcccgtggtttttgttcgtttaattggttgaatcgttctttaaactgttcaacgcttaacggtttaacctgcaaaatgcaatttgttaatcttttaataaaacattttaacgtacaattgggggaacttacagaagtcagttgttccagaagctcaatgaaaccaaaattgacgtcattcaacgacagaggacggagaacgtaatcagaaggaagttgggggagcacaacggaattgggggaattgtgaacggaagaagtcattaagagaattaggtatttaatccttcaaagaacgcacttaaagtcaaatgaatattcggtaatagtcccgatggtatggccacctttttggaaaatagagtaaaattgtttaaggggttttcgattccgacatccatttcgacctaattttaaccccgaacctggattcgaacaaaaagtcgaaagtcaatcttcaaaatcggcttaaacgcatgaaataaaatttgacaataatcatttggatggatagaattgaaacatgcaaccaaaaattattttttaaaaaataattatattattaatcacgatcgccgagacgctattttgaaaaaagggcataaatttttctcccgatatttagtattttttttcctgaaaagtttcaaccgaattacaatacaaataacatttttgagtaattgtttttcgtcaatagattatgatcccattcctataataaatttaatgtgtaagcaaatgcaatgctctttaacttttgttagcttgcacaaaatccatttattaatcaatactatgaatgcgttaatttaaaaggacgaacctttcaatgggaaaaataatttttttgttcaataattaaaaaataaaggcgaagattcagtataaattttttgctaatatttgcgctagaaatttccggaaacgaggaacggtaataaagaaaaggcgggagtgaatggaaaatctcgccaaaataagtgaacaattacagtgacccaaaaaagtcatgcctcaaagaggcaaaaattgggaatattaaattttatcgctgaaagatcaaagaacccaaaaatgagtgcaaaaaaagtcttgcctcaaacctgaaaaaccatcttatacactcacggtcaaacgcaaaagtattgcaccaaaaaaatttttttttcgcaaaaattcgattttctcaaaaaggaatggggtgaaaaagattttatttatgccaaaggaacgttaattaatgcactaatgaatacccaaaaactgtcccgattagtttctttgccgtcgagaaaatcggtcatgactcatgactcaaccaaccccttttttggtggtatgtagttcatttaaaaacctgaaataattcatgcttgtttatcttttgatgctgatcaaaatacgccggtgataagggttgatggtaaaaattattttccgactttttttgaattcaggtcgagggttaggaattgggcaaaatggatgccggattcgtgctcaatgaccccgaaaagctattaaaaggcacttttcgcagaaaaaaaacgccccggattgcggtcgcgctccaccccttgtacctaaattttgtttttctctattaatagagacaatgaaataccgtttttacggtttagaaccctccctattgaggggtgttggaaaatagaaccaccgggggttctaaaacggtaaatatggtaatacgccaaaaagaggttgtttttt

SEQ ID NO: 4204 - DNA, 1275 bp, Heterodera glycines
atttgataaactctattaacctacaaaattgaaatttccataaaatgcggggccaaaaatattgagtttttcgggccataactttttgaaacataatgaaatttttgaaatttggcttaataataaaaaatacatagaactattgaacgacaccaagtttccatgggatggcaaaaaaatttatataaattaccattggattaaaaatattttctggatttatataatctcaagcccgcgcctttcttaattagttcattaataatgatgaattcaattattcactttattcgccccgcctcactttattaaataattaattagttcataattaactcaattaatttatctttgtttgacccgcctctattaataaattgtttattaaatagctttaataattacttaacttattctcttgattcgacccacttcaattaattaattaattttggtttattctctttatttgcccgactctcttaattgattcattaattatttagtaattaactcaattcattctctttatcccttcttcctcttccatagattgtctgggattaattagattcattttatacattttgaacatcgctttaattgcatccgtcaaaatcccccgagggatgtttaatggaaaaatgaaatgatactctttttgctacggcaaaaagttgcattttccatccgtaaactatcaatcggtcgggggaatggcattatggattaattaaatttttaattgattcctaaaatgtctccggacatttttttattgcgttttttaagccctcgaggggctgtcctatttttagttttttttttaaatcaaggtcaccgccataagcttggaaacttgttttctgaaaatgcatatttttaccattaagaaaatcggcattttttttcaaaattttaaattttttattttccgtttttgtataaattataaagttgtgattttctcggatttatatggatattcgcaccattttgaattgtaaaattgagactttttcctaactaaattgttaataaatttcatcaaaaaccaaaagaaaaaaactaaaatttttaatccctccacgggtcgagagccatgaaattcgttaatttttacaataatttgattaatagactgttgtttgttgttcgatgaaattcgacagggcttcttaccattaaattttcttcatttaaaaaaaaatcaaagtttgaaattttcccgaggctctcccctccctctaaaattcgacgattttttaaaaatta

SEQ ID NO: 4205 - DNA, 9021 bp, Heterodera glycines
agtttgaaattttcccgaggctctcccctccctctactcccacaagattttttaaaaattaaatgtttaaaatgtcccccttgaatttgtcaaaagttgtcttcatttctcccccaaatttgtcctcccccattttccaattgccccccataaatcctcccaaatgccttcccaataggtcggtcgtccatcgctttttgtcctttctctcttccgcctcacttgtgcccaaaatcggcgtccatttgggcaccagtgaggcggaagagagaaaggacaaaaagcgttggaggcccgccccccagccttggtctgcgcattttgtcacccctttcgtcctccgaggggagaagcggaggaaatgacagcgattaacgacgaaaatggggggagggggaagaccttggggggagggacaaatggaggaggtaatgagtataagtcaaaatgttgtacatgagcactttttgtgccaatgttgcacagctatgtgatgggtcggggggggggaccgttacaaaaaaggcaatcgatggcatcagcgaaatgccgaaatttttgggttttttcaatcgattatatcagcgaaagtgccgaaaattttgtgtttaatcgatgacacctatgaaaatgtccaaaaatttgtgtttaatcgacggtaccaccgaaaatgccggaaattttgtgtttaatcgatgacaccagcaaaaatgccgaaaattttgtttttttattcattgatgccgaaatattcaatcgatggaatcaaaagataaaaatgaacggatatatatgaaattttttaacaggtggcaacccagatttaaatctccaaaataaatgtaaaaactttctaaaaaatgccaagttatgctaatcccattaatgccccgaaatctcaaaatgccaattcttaagttatctaaaatttgttataaatgccaataattggcttcccaataatccgagcgagtgccaatcataaaatgctaagttttgccgataatttcaaaaaaaaaaaatccgggactgacttggtccgtctgcaaactgcccacaaattggggccggtccagcatcagcggattgcctcgctgggtgcgcaacagtgagcggtcagacgtctccaccggctcggacacattccggcgaaagatcagcgcgtccgttcccgcaaaatcggccactaaaattttttttttttggattttgtgcaaaatttaattgcccgagggcgcgcgggaaaagaaaattgagccaatttaacggggggaggagagaaatttgggacaaaatgatgaaagggaaatcatcacaacatcgtacctgtcattaatttgaatttggtccgtttaatttgggagaaaacgaaaaaaattacggtgcaaattaatggggcaaaaaatacggtagggcatcgaaattgtggagcaaagtacagaaacaaatttgtcgggaataaataatttgactaaacttgttaatctcccgagtcttgttggacttatttaatgcaccaaaaaattttttagatttaaatatgctaattaggcgttaaacatggatctgacggactcgaaaaaatcaaattatgtctcgaatccgagactatttaaattaaatacccaaaaattttggccgaaattcttgaccacaaattcaagcaattcaataatataaaacgagattctgtgtatgaaaattgtttttagcactcttttggcctaataaaataaacaaatccgagcttttgtgcccgtaatcgagactctcgacaaaacttatcttcttagtctcattctctctccctatccctcgttatctcttcccctcgctctcttctctctctctcacactctcttctctctctttctctcttttaccggtggccgtgaagagcaggtcgccttgggccatcaaatatgtgccgttctgcgccggatcaaatggtgccaatccgacggcgccgaactcgctgagtgtgtcgccgccgggcgacagcaggcggcactttggcgcgaaagcgttagtgccgcagatcagcagacgaccgcccgacagacggctgagtacgcgcacaaaattccggcacaaatccttaatggatgatgatgatttttgatcgatcagcagtttttaaagtgatcagtcaggaagcctgtaatccgaaaaaatttcggatgaggaaaaccgacgcttttttttccctaaatttttttttgaagtgtaattttttctaaattataggcgcagaattagcgaacagatagtatttgtaacatatttttgtccctaaaatgccaattttgagcatttttgtgtgaaattttaaaaaaacttaaagaaaatttggtcaggcaccatcgaggaaaattttttgcaaatttttaacgaaatttataaagaaaattgtttaaaaaattcatttcgaaatatgattagcatcaggcaatgctcgggagtgatgaaaaagcccgatcacatgccctgatcagtcacttttctgatcagtttcttttggagagtctgctgatcaccgctttttttgttacctggtccatggatttcattgtgcattctttgtgctccgcctcctccggtgcccatcgatagatgccaacccgttcaaatgtttgcagggaaatgttgtgcaccgcgtcactgaattggggaatcggatcagtttcaaatttgattttggacgggatttgatcagtatttaattaacgattttggagccattcagcactgatcagaaacgaaatcactgttagaccccaagtgatcgagacttagaccaggttcctcgatcgatttgttcaccagaaccattgatcagaacctcatcaatcaggattttaccgggcttttccaatcatatcagaatttttgttttgattgagtagaatgagattgatcaggactggactctgggccagggttgccgcgggccgaaaaaagtctggatatggattcaggcccggattttgaaattttcgggccaggattcggggcaagaaaaatgccttgactcgagcgctaacactgatctggcatatatatttttaatcaaaaactgattgggacccaaattgatcggacaattttttttgcccttccgggaacataaaaaagcgaactcacgctgcgccgatcagcaaatggttgccgtccagctccaacaggcggaagtactgcttggagtcgtcgtcatggttggcactcgcatttaacagcggcgggtaatgatgaagcagaccgagttccaatgctaaaaggcaacaaaattggtcaaaagccgttatacatatttatttgcgtttttggtaaaatgccaatattctcaaccctggcaaaacaatgaaaaaaactggcaaaatttgtcaaaaatccctgcaaataccggacaaaaaacccaagcccagagggtcctcaaaacccggcaaatgccatgttttacaagcaaaacagaactctgaactcatggttcgagtttaaaatgccgcgcccatttttatttcgaatcgctttccaatgccaccgaaggaaccgaattttttttgtttttgccattttaaatgggcgcattagctattagaacgttttttcaaatgtgaaatattttaaattttccaattcatcttccaaattcccctgtcgacggaatgccaaatttttcgcgccttaaattttgttttttttccattttcaaaattcgttccaatccatcaattcattcatctttctccaaatctctcttcccattttcctcacttccagcacataaacacctcaaaagagaagaagagagttgttaaaaagtcgccgaaatgtctttccgcgccgcgagtcggcacagaaagagaagtgcgttttcgcttcgggggacagaccttgaccggagcggagaggacgggacggggggccccggagggcggtgaggggacaaagtgtcccctcgggggcacactaaacgaacgaacgaacgaacgcaccccgtccccgtggtacaaaagtaacaacaacaaacaaggaacaacatgcacttgccactgtcctcctccgtcccgtcgcccgcgcgagcgtgagccgcgcggagcgcccacttaattaattgcccatttttggcggcgctgttcaacaaatcccatctcccgcgcggtaagtcggtcgggagagggagagagataaatgtttgtggtgggtgtccttttggaggacgcggatctgctggtatgtccttacaattagcaaagtccgtccccccccccccccctccggggaaatgccgggatgggcgaggggggaaagggggacaaatgaccccagtcccattcattagcagaggatgaaaaagggtgggatgagtcatgtccattatagactactaaaagcgatggcatcttgaggaattaggtgcgctgcaatttttgggcgaggaaaggttatttgaggtaaattttcccattgtatgtgtgcctagttgtgacctcggactttttttgtgtttagggaattattctttctttttttgcgcgagtgggggtaattagctaaatagtgagtgtttcgagacttaattggctcgagaatgggaaaattttgttgaaaattcgggtggattaacaataaacacattcaaaaaatcagtttttcatgtgatcaccaaaaagtggctgaagtagaggtttttatggacagcaaatccatccatttcttgtggcatttcgattccgttctcaagactctcgagtagaaccgtcgtaaaaaaaggaaaatgggacactttttcagcggggatttatctttttttatacggtccctcttccggataagcctcttttttttagattttttgaaaatttgtcaacaaattttatggttcagtgacgttccacgggtacaaaaaaaaacatgtttttgttgacccatgaataaatatatacacaacacaaataaacgcttcttgaagaggcgcggaaaagcgaaagtgaaacgcgcggcgcccgtttatgttaattgtcccctgcggggccaatttggcggtgattggggcggaaaaggaaaagaagaagcaatggaggagagaagagagagacaaatggggaagcaagagagtgatcagagacgggggggggagagaatgagggtgagagagcgagagaaagaaagaaagaaatgatcaaggaaaatgatccagaaaaataatgaaatttaatcggaaataaaaggtaatcaagaagaatgagtttcaggtggtgatcagattcaaacagggaaatgtcagagagaaaataaatgattgaaaaaactgatcaggaataaaatgagcactaatcagattccgatccgagcgaaaaaaggtataaaacttaatcaaaaatttggtaatggcaatcggcaaaatggctgaaatttaatgggcatttttgggaaaattggcaaaatttgccactgaaaatacacttaccagcaaccgcgtccggatgatccatgtcgcggagattgaatgcccggggctccttggtcggctgatcagacggccacatttgtgccgtcgttgtcgaacggcacagtgccaaaagggcggcggacaaaaaaataattgaaaaacaaaaacagcggcgaaataaaggtgatgatgatggcattggaattgttggattgatcattgatcaacagcagatgacagtaatttgcagaattatggagtagcagaagagaatgatgacggttgagtcattattgttgtttggcattttgccaagaaattagtgctaaatttaaacagatttagcattttcggattgattaaaatgatagtcgattgattaaaattgttaaaatcaagtcaatccggcttaaatttggtcaccaattttggttttgatgccgccgccgtttgatgtaaatttggcatcccaaatgaattctggcactttctttttggcattttgccattgctttttgccatttttgcggtttcagcaaatgaatgaatgagttagtgaatgaatgaaaatgaaaaatgaatgaatggggggaattggacgacgaatgaatgactttcggtggtggcgggggggcggtcgtgggagagattgggggtgggggggcacaaaaacggacgaacggacggacgggggcacaaattggatggaattgtcagcgccatttcggttgacgatttttaaggggacattcagcggacactaggggggggggggtgaagggggactacacaaacaccatatgtgaatggggaggggcatttttgggggggattaacgggaaattttccttacaaattagagttttgtgggaatttttggaataattttgtgacagttttagccattctcgggcaatttcaagaatttcttggagatggggaaaccttatttgttgtgggagacatttttgagagttagtggagcttttgtggttattttttaaaaattgggcggcagcttaagcaatttttgtttgaaaatttggagaatattaaaagagtgggacccgaaattacgttgagacacggcatcgggacgaagcagggatctgttacgagtagtgactcaagattgggactaaggatttggggaaaaacttgcgggattagaaaaaatgaaaaatcccaagactttcacgagtattgactctcgattgggaccaggatttcgggaaaaagcggtcaggggattgtcgtgatcaggaaaaccgaggaatccgatcctctgatctcacaataagcccgacatttctctgttttcggggcgacctgaagcccttgggtcaatacaatcgaaaaatttcatggtatatttgagttttcaggaatttatgaaagttttgcgcgtttttcgggaggttagagtttaatggatcgaatggaaaatgaattttttggagggaggcaaagagtggggaaaaaatcggcgccaaggcggagacaatccgtcccacacgccaaaaaattgttgtgctgcagttactgctgaacaaatacaaaaattcggattatttggagcatcgcccccccccccccccctcccccgccccacttaagccgcttaattaaggggcaacgaaaaaatgggggaaaaattattcaacaattgcgccacttttgccgacggcaaacgatcagaaaaaaaacaattaaaattgcctcagggcacactaatgagtgattgagtgatcagagagcatcaacaagagcaaacagttcatcatcatcattggtgcagattgttaatagtgcagcaataattgtttattaatgaacaaaggggggcactcactcattcactcactaattagtcgccggaggcaatttgttgccggactttaattgcctgaagcaaaatggtggtgtttaggatcttcacaattttttttcatttcagttaaaagtgctcaatcagcagctcacaaatcagcagagaattgtgcaaaaatatgcagattatctataatgagagattattgaatttgtgggagtgagtcataagcaattaatggccgggttccgaaaaatccagggggacaggatcgagaaaactcgagactcggagtcgcgaaattaccgaccatcattcacaaatagcaggagatatggcggaaaattatggacagacaaatggtctaattgtggtgccaaaaaggttggttgcttccttggcattttgtctcctcgactaatttaaaattaaataaatgtatcttttttttattaataattattgaatatacgcttcattgtcattttcaaatagagaaataatgcatttaaaaaaataaaatattttttcgccggagttcttaaaaaggaggaaaaaatacgcaagagtaaatatccccaaatttaatcgttaaaatgattaaatttctcaaagtgattattgttgtgccaattattaaaaatttaataaaaaaaattccagtatatttttaaatttttaaatatttttataaaccaaggggcaaccgcttttgcacttttatttgttgttgctcggtgctaattacttataccatcactcatatttatttatgtgtaatttagtctcatatgtcaaaagttgttgtgtgatgaagaaagaaattggtacgtaaaaaacgctcaaattgcctcgggggagaaaaaaattattattaataaaaataataattttttgcctccctttttttggggggcgggggacggcgatggaaagcgaagaagtgcatcatcatcaccagcatcatcagcagagatcatcacccatttgggtaacacacacacacctttttttttgggggggggggcggagaggttgcgcaaagtaagcacaacagagcaattagccgccggccgccgccgtccgtcgcccccggggggcgggcgatgacgccgaagcgaactcactcactaagtcactgatcggagacggacggacggaggaggcaaatgacgcggaaccggatccatttcaggaggaagggagcggaggagcgccgggagggcggcggggggagtgaacgacgacgacgacgcgacgaataaatggaaatggatgcatcgacacatcccccgaggggggaggggggttgtggcccagagttgggttacgcgctcccgcactccagctgccggaacctggcttttccgaatggtccaaaacaccgaaacgcaacccgtagatctgcgtggaattctctgctctcgacccagaaaattcccgagttttaaatttccaactatcgtttagccggtattaagcaattaaaaaattaaatttgatattgactttggttgaattgctcaggcaagctttcgcgtgatccaaatttgcctgaagcaaaaaatgggttttgccggaggcatttgcattggctttaaataccggtggaaaattttttgttggtgggccaagtaggttttttctgtttaagcactaaacaaacactttggctatgaggagaagcatggtttggttccgcgcaggcacaacaatacctaaggcatcggaaatgttt

SEQ ID NO: 4206 - DNA, 1187 bp, Heterodera glycines
tttgttgggctcaatgaaaataaattagaagcaatgcaattttaagagcataaccgtaaaagtcacaattttatttaaaccgtttgtttttcttttcttcagaaaatttctccattaaggtattcctcctcaaatgtgccccagtttctgaaggaatatgagtataagctatatttttaccgttcaactgtcgtcaaaatattattttaaaaattatcattttattactttaccaatccataaaactactacttttttatcacttcacagtgttctaggcgtaataaaaatatattttttagctgaatttattttgcatacataatatatttcatttaatttatcgttatttttctttgtaaaccaacgctgataaaataattattatttaagcctcatctttgttgggctcaatgaaaataaattagaagcaatgcaattttaagagcataaccgtaaaagtcacaattttatttaaaccgtttgtttttcttttcttccgaaaatttctccattaaggtattcctcctcaaatgtgccccagtttctgaaggaatatgagtataagctatatttttaccgttcaactgtcgtcaaaatattattttaaaaattatcattttattactttatcaatccataaaactactacttttttatcacttcacagtgttcttggcgtaataaaaatatattttttagctgaatttattttgcatacataatatatttcatttaatttatcgttatttttctttgtaaagccaacgctgataaaataattattatttaagcctcatctttgttgggctcaatgaaaataaattagaagcaatgcaattttaagagcataaccgtaaaagtcacaattttatttaaaccgtttgtttttcttttcttcagaaaatttctccattaaggtattccagtagtatatgaccccgaaagcgagcgggttggttgcgggtgtttcccgcacgagcccgtgcctatgggaggggcgcaaccctttgaagttgccgccccatcaaaacccaggaggggaggggggtgtgttccaaaccaaacctaatgtactccctatgaagttgccgcccgtggacatttaccgccaagaaccaaagcctatgggaggggtgaagtcttttgatgttgccgccttgtggattttaatttaccctaaatcc

SEQ ID NO: 4207 - DNA, 2145 bp, Heterodera glycines
  misc_feature (2083)..(2083): n is a, c, g, or t
tgcttttacccctgcttgaaatttaaaccgcaaaatattttcactgggtaaaatgcacgacgattttttcgaaactcgttctttgcaatttcacgtccgaatttaaaggtcgaaacaatattttcaaccgtgtgtccggtgtaagaagcccccggacaccccgagcccttaattatttctataaaatttttaatagcattttcacagtctatcagacttttcgtccccagacatatcattttcccggattcccataataatgccgtggctttgatggggcttatacatttgataaccgcggcattgaattttctagggttatacttaaattcgcattcggtgatcgtcagagagtttagtttaattccggtaccgagattagcgagagcaattatatttacgattatcgggttttgcattttgatacaatgtaccaatcaaattgtcctttcactccctttatataccccttctataaatagcaaccaaaaaaaataaaattaaattgaaaaaatgaactgtccacataaaattaagtgttgtcattactgcccctgtcattacgagttgtgtaacagatgtaaaaaacacagtcttttgcatttcggtacatcattttttgataatttctggctatgccccaaatgcgcgaaacatgttccctatgaaaatataaataggtcaaataaataagatgcattaaaaatcagtaaccgatctttgagaaattttgcaccgcgcggcgtttcatctttcttccctgcgagatacaacaaaacatctctataattactgttttcaatcggcaaattcatgttcgactgtacctttccggccgccgtaattttaaataaatctttgttttccttcacgtacctaaaaagaccgtttaaaagggtcgggtgtataatagttttgatcggaatgggtgtttttaatgtggatgttgtttggcgctccggagttaactcctcaagtgtatcattatatgattcaggatcaggagtttgctctttaagtcttttcctaggaataattattttccgtggttcttcggtctcctgtggtttggattggttcttgaggcccagatatggtgcaacatttggacctggtacatgattctcaatcactaccttctgtggtctatttttaagtatcccctttaccgtacgtctttctttatagagccaatcatgtctcttcgccttgaggtcctcgcttatgccggggtcttgtaaattctgagaaatttttgcgtctaaacttgctttttcattttggagataatcaccactattcatcgcactccgtagagccaaatattccgcctcgggaatcattaacattttctttgcaaatttcatgatgttattttttctaataaatgttgagctaaaacactcagtaccgggaccaagacagctcccagggctataccactcccctgttgtatcctttttcttgccgttttatctgaacgagatttggcaatttccctataaaaatcggcgtattgtgccaaccttcttttttgtttgttcgttagtttaaaactaaaactcaatatatttgcacaaatttcaacgattgccaaactaaattcctcatcagaatttgggtgcatgttaatcatgagatagctaaattgattattggtcgcatcatgatatgcatccatgaaataattcagtctttttgggaacagttgtgaccctagtgtcctcacttgtaattgtcctgaagggttgcgcattaaaaccagataatgggcgttcgctcttgccgttttaatgtcccgaccgtagagactctgggttacaaaaattacgcttacgttccaattatgggagcccctggtaaagagtagatcgaggaaagtattctgcatattaagcattaaatcgtcaagtattaagaaaagggggttttcctgttctttaatcttattcatgtccggaatcccgttaaaagtcttaacgccctccccgattaatcctaaaatactatcattcatctcaccataacaataaagaattttttcaggcgatggttcaattagattcaaaggatgttttaaaanccgtaatagccaacgggtcttatcacggccagtagcccccgagagaattagagtgaacggac

SEQ ID NO: 4208 - DNA, 2183 bp, Heterodera glycines
  misc_feature (2091)..(2091): n is a, c, g, or t
  misc_feature (2121)..(2121): n is a, c, g, or t
tccgtcggcgcggaccccctctctttactgccgcggcttctcccccattccgtcgttcgggcggcgcggaccccctcatttctacggacccccctctctactgccgcggaaccctccccaccattctgtcgtccgtcggcgcggacccccctctctctccgttgtcgcggatctttccccaccattccgccgtccaggcggcgcggaccccgctcttcgacggacccctccccatcattccgccgtcccacaacgctgaccccctctcttccacggaccccctctttgcactgccgcgcgcgagttttgctgcgcaagtctcgggggtgcgctaggtggctgggcgtcgggaaagtaccgcttaaaatggtgtcagagataaaattctttcgtcgttcagcttagggggtggtggattgacggcccataaaatttgaagtcaatcggacaagtggtgcgcgagttttggtgcgcaagtcccggggtgcgcgagtgggcggggcgtcgggaatgtaatggtcaaaatggtgctagagatgaaattcttacgccgttcagcttagtgggtggcggattgactgcccgcaaaatttgaagtcaatcggacaaagggtgcgcgagttttgctgcgcgagtctcgggggtgcgcgagggggcggggcgtcgggaaaactccgctcaaaatggtgccagaggcgaaattctttcgccgttcagcttagggggtggtggaatgacggcctataaaatttgaagtcaatcggacaaggggtgcgcgagttttggtgcgcaagtcttggggtgcgcgagggggcggggcgtcgggaaaactccgcttaaaatggtgcctgaggcgaaattcttttgccgttcagcttatggggatagtggaatgaaggcctataaaatttgaagtgaatcggacaaagggtgcgcaagttttatccttttgaccttgtgctccgacgcggatttttttattttgaagaccccccccccccagcacccctccctcagctccgcactttgcaaaatatttttaataaaaatttataaccataataaaaaaatggaaaaacatacgacatttattttgatcggtcacttctcattgctgattctcggcatattggcgcaagatctcggcctcacgttcagcgcgttgacgaagcgcagcttcgatggcaggggcgcgtctgtgtccaaaaaagaaaacgaatctgaaaaatgtgatgaaattaaaaaaaactatgctaaattgaaaaaaaagcttacaattgttgggtcttcacgccaccaattcaagagcaaatcctcctccgcgtcttcaatttgtgcacgcaactcggtgtcttcatctggttgttgttgatgcggttgttgatctggttgaacattgtcgggttgttgaaagggacggtcagaattttcatttggaggcatttttgtaaaatgaaagatgaaaaaaaaaatgagtcgctttgagaatcctccgccagcatgactcattatcgatttggtcatactgaagagagagagagagttcactgtcagttttctctaatcttgcatcattttgttgcgaaaaatattggtggttgtcgagggatatttttcatctcatgcattactgtctctgcctcgctgggcgttaagtgaccgtgacttttaagccaccgaattaaaacgaaccaaaaaagcaaaaacacaggaaatgcaagaagataatgagaaaaaagtagtacatgtaaaagagtttcattaggctcttctggggaattcaaaatttgtatgtcaggttttgttgtgttggtgttattcattttaacattatataataatatttttcatttttatttatttatattttatccaagctttgagtcggtcacaatgtgccgattataatcaaccataatcatttggtcgaattcacccaagacaatcatctccacgccaccaagtggaattggtgaattgaatgttgctcgtacgtttgtcgtaccgcttctcaacagctcaaatccacagctgtcgtcaagcgttgaagtcaatggaatgacaaaaaaggtccatcctttcttgaactgngtcactgaaatgtcaaatgaacgttccgangtagccattccgagtgcctcatacatgtcaacaaaagcgctgacaaagtgatcatttgaaaa

SEQ ID NO: 4209 - DNA, 1743 bp, Heterodera glycines
  misc_feature (1723)..(1724): n is a, c, g, or t
aaagctcctcggtttcccaaatcaatagtcgagaacgggtgatggattcgcgcattttctccacccttaaagatcttacaacgttcttcgaacccctcgtccgtcgagtcatctcggtttacggtgtaataataccccgttgaacaaagaaaatcgtttcttggcatttattggaaagctcaactcattggtgatatacgctttgaatgggtacagatttccgctatcgtacacttccgtgttgccaaccgtaacttttagttgctggacaaatgtttgccctattccttgaatggcagagacaccagtatccgtgtcctctatcgcaacccatttatcgtttgctcccggtttttcaattgacagttcgagataaaggtagatccgtgataaatctgtccacaaattgtcactgtacagtcgaaataggtaaggcgattcttgcgtgattgttgctagtggaagcacttgacgaaagaatgagcgaacaacggacacgttggtcggtggaactgagaaaatgttcaggccactgttaattgctaggggactgctgtcgctgattttttgtgggcaagtcatttttagtaagttcctagtgagtcaacacgtagacgcttatttttggttttaacaaccattggtggcccgattgacgattgaagtttatttatattttttcgcccaatttttccaattttgggagccgagtcttttttgtatcgcttaaaatcaaaaccttgacccttctgagtgtttatgttgttggccgctttttcaagaagattctttagtcccgacttactctcactaacgagcgactctttgaggtcttttccctccagcacattggtgagtactcgatttccgctttctattccttgacgtccaattgcggagccaatttgctttccaatcggcagcaagtatctcataaggcttcggaacactgcgccaactcccgctccacgctgatagggcaaccctcgataaatgttgtatccaccaaattgcacatactcggacgagaatgtggaccaatccacttgtagaggatcaaaatcaacatgcattttttaaaatttttccaactgtttttgcattatttatattcttttaaaattatggtttttacaaaattgtttacaagagcatctggttgcacctttccatagtgcaaaaagctgacaattttttcaaaggtcattccaacacatcgacagtacaaaaagaaaatgacatgacgcccacacgcacttgagttggcagactgaaggggaagagaattatattgaatttgtttgtagcgtgacaaatgattcacaataagaacactgggtggtggccacatccctaatgagtcataatactccaaacgcaaaggagaagcgcaataaatgcatacccaatgagagccacgcgaggtgctggggtcaagattcaccaccatacagtggggaaatttgacaattgctccggctggtatttggtctgccgcaaaacaaccaatatagtagtggcgagtcacgttgtttcttgccaatgttttgtcaatttccaacgtgttcatttttttaaaaataggacatttttctaaaatgtaaagttaatgtacaagttccgtattggaatggcatcaaacttccgatatttgtaaggatttcaatcagaatttcagaaacttcctttaaccaggtggggtgatattgtatggcaaaaaatnntgttattcaatccacttgg

SEQ ID NO: 4210 - DNA, 1999 bp, Heterodera glycines
tttttgttgatatgaatcattatcgtcagctgggatcctccccgctatattgctggtttccgcacgcttttcccgtgccagaaggccgtgggtcatgatgttgaggtcaaccactgtctcagtatctgtcaacagggcctgtaggagcagctcttcgtcacggacgccccgtttttctttggtctttcgcttaatgtactcttctctggtccaccgacgagccttgtttatcgtaagcatgaaagaattctgagttgagcgtaccttttttgccaacggatcgctgccctcacccaggagtctgtacaaatttttgccaagctcatgggggttggtgacatttgatgatggaagctcaatccgcaccgtatttcccgtttgccactcaacctgaacaaactgttgctccacggtgcctatggaaggccaagagtggggatacacaatcaccgccagacccacctcccattccgaattgaattgtagtttgcgcggtaaacgcactcggaaagaatttgtcctatttccttcaatattggtgttcgacggaacaacaacataaaaagaatttgaaggcatttttgttaaatttattaaatagtgcttttttatatatctttctcgctaattgaatttacgggaatccaactattaaagcgagcgctataccctttccatttcacaagtgcataatccacaccgttctgcctctttttcaccaaaatcttttcaatttcatacattttttgctgtttgtcttctagtgatttgcacaaatcatttgcgtaaaaccaaccactaataatttcattatggtcatcacgcaatcgataaacaactggcgaacgctcagagtgtacctctgccacagtgaagagctcattggtgaagcgtgggagatagcccttttggaacacgtgcttgtacttttcaatgcgcacgcgatctcccacacggtattttggctggcgtcgtacaacattttcagctgcatcatgtaatttttgtctcaacgcttctgcgtttttaaagttcacgtctgctgggcgcattccaatgctcgaatttggcgagtggttaattgcacgaacaatgtcttgcacaacatcaatccatttgtacgtgttacgctccgtaaagtagcgataaaggcgctctttgatgctacgattcgcacgttctgccattccggcatgaaattggggagaagtgagcatacaaaagtgttcaacgtcttttgtgcggaagaactgctgtactgcgcgggcagtgaattcctttccctgatctgttaacaccttccacgggatatattttgatcttttgaatatacgatcaaaggcaatgatcatgttagcgctcgtcttggtctttacgggctcgacaaacacctgtcgactaagggtatcaatacagactaacaagtacttgaagccatgattttgtttatcaagtcggtcaaaaatagccaaatcggcctgccattcagtatgcaagccgggtgccaatgttggcaatcggcggtagcgccgcttggcctggcgatgcagtgtgtatgtacgttggctggtcaaataattttggacatcgtttcgattgatttttggttgacttttccgcgcctctctcagcagcggttcaacgctcgtgaatgcgacaggcgaacttaggtccttgtacaaaaactcgagcaaacgaagctttttcaaatccataatgatggcttaaacttaagtggggtgtttttataaattcctttgccggattgaccttcgggaaataaatgcctactcaagagcggattctgccttgccctttcaacaaattctttgaatgccgttggctctttattttggccacgcttgtccttgttcaacaggtgactaacaatgtcatcaacactgctggttataaatggacgcccaccagctctcaaaacttgcccttcctccgacacccctagagattgggcgtttttataaattaattttaagatttc

SEQ ID NO: 4211 - DNA, 6373 bp, Heterodera glycines
  misc_feature (6308)..(6308): n is a, c, g, or t
  misc_feature (6335)..(6335): n is a, c, g, or t
ggaatcttgtcaactgtaaatgccataaaatcgatttcttccttggtttccaccacaaattgatcgcaattgcaacaaagctataaaatttgcaatgcaagtgagaaaattttgatttttcgctaaattttactaataaatataattggcaattctcgacctatttttagaaacatacactaattacagtgccattattttggttcccacatttaccttatttatcaacatcctcaacaaaagaaaaaacacaattttgtccacagtgtagttctgcggcaatatgttgtttaaacctgagccattagtcatttaaaggttggctttatttttcattttttttcgtaatacggtctatcttttctgcagtaatcaacattcgattgttccattttctagatgtatacaaccaccctttaaaaaggtcaagaatttaactaaacaaagtgaagatcagctcgttaaattgaccattacatactcgtatagaaaattctgaaattttcatatatgctctattttattacaaatttccttctgtctttattggatttttaccggcaaaactgatgttaaataggttttatttttattaattgcagcttttcgtattagaacgcgtttaaaaatagattagaaccgggaatcttgtcaactgtaaatgccataaaatcgatttatttttcttttccacaacaaattgatcgcaattgcaacaaagttataaaatttgcaatacaagtgagaaaattttgatttttcgctaaattttactaataaatataataggcaattctcgacctatttttagaaacatacactaattacagtgccattattttgtttcccacatttaccttaattatcaacatcctcaacaaaagaaaaaacacaattttgtccacagagtagttctgcggcaatatgtagtttaaacctgaaattttaaaaaattaagttttaaatctgaatttggtttgaaactctattcatattttttttaaattgtagttttatgaaataaattctcttttattgattttaaaatacctgtaccataatcgggttctatgtggatcgactgaactttaagcctatccatttgctcatttaataaaattatttttcagccttttttatgcatttattttttaatcattttatcaattttaatataacaatttattttaatatatgatttataataagaaattacataagtgtgataattaaataatgacctcatttgacttttaaagttttaattaatttggcattttgttttatttttttgtgtctttcattttcatttttgtttttttgcatcgccccggacttaatttttgatgtggatttttgtgtggtaattttaatggtgcttttaattgttgtgttgtttaaatttaattgatttggattgctgtggctttaagtgattttaaaagtcttccttctcattcttctccttcgccccgttttggaattcggcaaaagagcagagaaggaccccggcaaaaaggcggctaattttacgacgtggcgctcctggaaaaaggtgacgatcaacgcggtactatccggggaatttgtagactataagtccgacagcgtctccaaaaagtgaaaagtaactcacgagttggaaggagtgtaaaagtgaaatcaaatcacatttggtggagaaaagcggaaagattcgacagttatcagctcggtaaagtaaaaccgtctacaaagctgagttttatcaaaacggtaaagtaattccccgcttcgatatccgacattggcacttcaaattgaatttgggagagaaattgaaaaacggcgaagtaaagccaatgattattgtgagatcgccaaaaaacactcgccagaggacggtgaatcttggggttcagccgttaaatggagacactgaccaacagaggggacaacagatagtggagaatcctgtgaatttggcagcaaatccgaatgtcaacgagggaaataggcgtaattctgtttcttcagcgaacacatcagtactcgacgcaaacgaaattcgacgcagactgaaaatgacggaaaatgccaacaatgcagcggatggacgaaacggacagcagcaagtgcaccgagaagaagtgcttctgaatgaccatggtaacaatttgttggcgaatgcaaatttgggtgaaaatttggagaaaagtttttgttcaaccattggttggtgaccaaccacaacaaatacagcaaaatttcgaaaacgaattgcgacaaaatgtaattgtgggggaacagcgcgtagcgacatcgactccttatgtcgaaatgcaacttttgaggcaacaaaacatagagcggcgtaatgtaagcccactccggtcgccattcgaacaaaattttcgggaaaatgtgattgtaaacccgatccgtaatgaaaatcgaggacccaatcagcattttgcggatggatttggaggacaaccaaatcctaatgcccgtctccaagtttttcgacagcaacacgccgaaatcgatcgacattattcgagtgcttttcatgcaccggtgccgatgcgacaaacctgtcacggacaaattcaacaagctgcgtatatggagcaacacggtgcgcatcagcctatgctgctccagcaacaaaatatgcgaggagtgatgcatcatcagcagccaatggcggggagaaatgaatattttcctgaatattacggcggaagacatttgtatcccgacggcagagaacaaccaaactcggggaataatgaattaaaaatcggtaatatggaatatgtgctgaccatggaccgacttcccgagctaaatggcaatgagggaactgacaaaatgaaaagttttttcaaaaaattttcaaatgtcacggaagaatggccggaaaaaaaacggattaaagcgttggaatccgaagtcaatggacgggcagagcgtgcctttaatgctgcgcttaacacccagccctatcgtttcgattcaattcgacgggcaatgcaacaacagctcgaggacacggattgtcgcgaaatgagcgcattcgacgagttaatgagcggagtaaagcgaaagccaaacgaaagtctggacgcattagccgatcgaattcaaagtcttgtttcccgtgcgtacccgggcttgacgcaaaatttgtgcgatgattatgcaattcggcacctaatcagagcactgtcaaatcccgatctctcattaacgctcgaaatgtcgcgaaggccaggaatgtcgtacgatgaattcgttgcattggccgcacgcgctgagtcaattcagcgtgcaacaaaagtgcaggcgaccgaaaacagaagcaccgacaatcggaaccgaaacttttacacttcgaataacccgattagacagcaaagtggaggatacgaaagtaatccccagcaaacacgaaagggagttgtatgctataattgcaacgaaccaggccatatctcgcgtgaatgtcaaagcgtaaggggtcagcgaaacgtaaacaccggcgcagataggagtaggcaacaatttgcgacgggagcaaataacatttcactgcgaaacaatgcagacaatcagcggaatgccataagaacatatccggctgtaaaatcccaaaatttcctcaaacaaaattgcatagtgatgcaagaggacaaaccccccgatgcattttgccgaggagtgaaattgacatccgaaatttcgagtttcatcgaaaatgaacttggtgaagcaacgcagactgaaatgtctaaaggaaaggaccgggtcggaaaaattttggtgattaacgtagagacatacggcacccaaacggtagcaatgttagatgggggagcccaaatttcactgattggagcaggatttctgtatgaattgatcaaagaacgaggcttagacctcaagaaatcggacttctctcgaacgtcagcacgaattgccgatgtaaatgggcaacaattgaaatgttttggagtggtaacaattccgatcacacgaaaaggttgcagccaaataccgatctgctttcacataacaaccgcacaatttggctacgacttgcttcttggcaccaattcactttcaaaattaggatttcttctgtacgacacagcgaacaaagaaatgattgaatttgaggaaatatcccaaaatgatagcaattctgctcgggttattttttctacaaaaattcaaccccgctcaacccgcctcatcgaaattggtgttggtgatcagtggaatggaaaagatgtggtcatttctccccaaactgtgaaaggaaatgttaaagtggaagaatcagtgggaaaagttgaaaacggcaaagtggtcgcccaaatcacaaatttgtcggcatttttggcacaaatcgatgaaaaaacggaaattgcgaccgtagagtcagcagaaatcgttttcgacagtgaaaattcgattattcaggcggaaatttattcgccaattgcaaaaccgaattcggggaaccgaaatgttggcaatgactttaatgtcggcaaactttcggaaagccaaatgttggaattatcggagctcataagtggccacgccgaaatctttgctttttctgaagaagaactaagccaaaccgacttagtccagcacacgattgaaacgggcgatgcggccccgattaaatcgcaaatgcgacccgtcccttacgcttacagagaaaaaatttctgtgatgatccaggattatctaagtcgcggaataattcagccatcaaattccccttgggcttcaccgatcgtaattgtgcccaaaaaggatgggacacttcgtttctgtgtggattacaggaaactaaattctgtaacggttaaagatgcatttccgttaccgaatattgacaacacactcttggcattgggaggaaggagagtattttcaacattggattttatgtcgggctactggcagatcaaaatggatcataattccattgaaaaaacagctttttccacggaattcggactacacgaatttttggtactccctttcggcctttgtaatgccgttgcgacattccagcgatttatgacgcgccttttctccgattgccttaacaaattcgttttcatctatattgatgacattttgatcgcgtccgaatcatgggaacagcacaacaaacatctgaaagaggtgttcgaacggatccaaaacgctggtttaaaattaaaaaatcagcaaatgtcattttgcgtcaaatgaactcccatttcttgggcacatcctttcaaatgaaggactgaaaatggatatgaccaaagtaaaacccgtccttgaacttccaaacccagcgacgaagaagcaacttcaatcgcttcttggctttcttgcttattatcgtaaatttatctacggatttggcgcaattgccgcccctttatactcgctcttaaaaaaggacatcgattttgccattggcgaggtcgaaaagaaggcgattgacgcattgaaaagtaaaattgtcagtgacgtaatgttacatttcccaaacttcgaagcggccaaaaatgaccccgctagaatgtttattctgttaaccgatgccagcaaaattggagtggctgccgttttgtgccagcccgacgaaaacgcaaatattcgtccgatttacttcgcatcccggcagtgtaagggctatgagagcagatactgtccaacggagttagaagcactagcagtacgattcggcacgaagaaatatagccaatttatcaccatgatgccgacgagggtattcaccgaccaccgcgctttgataccgatgtttaaaagtaaaaaagagactgggaatagccgcgtggataaatggctaatggaaataaatgctaaatttttgttacaagttgagtaccatccggggaagaaaaatgttattgccgacgttttgtcgcgttcacaggcattaaaatgtcctgaagcaccgaaggaattggacaaaatcgtcgctttccaaattcgacagaaagagaatgacccaaaacagcacggaatcgagaacaatcgcgaatgggcgaccaaaacgagagaaagcgaactcggctttctgtacgaatttctgacagaaaaaacgctgccgattgaacctaaagatcgccaaaaacttatgtcaatccttcacaatttcactgttttggacgaccttctctacaaatgtgaaaaagatgagtaaaagtcgtctttttgtcccatccgtatatcgcgaaaaattgatcaacgagcgacactcaggaatttgttcaggccatatngagcgggaagaaaatttttctccattnggctgaagaaatatttttgggctacatgtattccgact

SEQ ID NO: 4212 - DNA, 3828 bp, Heterodera glycines
ctcttcgatgccgaatttgtgctcacacccgaaatccgaggtctaacgagccaccaatgaaaattgttgcaacatccgaaccatttgaattggtttgcctcgacattttgtctatcggacccgcgcattcgtcatgcaaatacatattagtcgcggttgaccacttttcaaaatacctggtagcaacaccaatcccaaacaaaaacgcagacacaattgcgcgcgaatttgtaaaaaatgttgtcttaatttttgggacaccaaagaagattcacagtgatcgcggaaaagagtttgtgaatgaaactcttaacgaaattaccaaaattctacaaatggaaaagaccctcacttcgggatatgatccacaagcgaatggcgtaactgaaagagtgaatcagacaattttgggaatgctaaaacggtcaactgcgtcaaattgggagtgggatgaccgtcttccatttgttgtgttttcatacaatacaactccgtcagaaacgaccaacatttccccataccatcttttgtttggaaaaccggcaaattttccttcaaacatttccttaccagttaatccgttgtacacaattgatgtgaatggatacattcaattgttcagggaaaatatcgcgcatttggtcgaaaaggcgagggaacactccgaaaatgagcgccaaaaaatgaaaagttattatgataaacaggcaaaagtaactgccaacaaattcgtcgttggccaaagagtgatggtcatttttcccgggtccaacaaacgttctccgcaccataaactaatgtggaaccatttcggaccgtttaaaattacggaaattacggattcgacagcgtttgtaatccccgtcgacaagccgaacgatgtgccactgaaagtgccgattgagagaatgattagggtgcctgacggtgtccccgacactagtactcttccaaagggaaaaaacccttacaaaaatcagttgaatacaataatttgcttcgtcagcctaatttgtgaagaaaaagttgacaatggaaaagttggcggggtaggaaaaaaggaaaagttccaagaagttgaacaagaacaacttctggaaaaagaagtggaaaaaaatgccgaagttttcgatcaattcccgaaactaaagtcaaaagttggaggggaactcaattttggagcgaatgtgtgtcaattgaggacaattttttcctcagaaggtgtggaggacatggagatggacaccaccgaatttgccattacgtgggatttgcagtgtggaggacttggcccagaacatcgaaactgtgtgcagctaatcgcggctgatttggaccccgtgttggagagggccggttttggcttgaaggtgcccggagaattcaggacacggaaaaaagggaatcttgggcttaaggtcgttggaactccgttgaaagcacttctcgccacctttctgctgaagtccgatgccatttcttcctctgccgttggaaggaaattggcccaatcagtgatcggttcgcctgtcggatttgagctgattacgttcattggaagccgagaagatcaaatcaaaagcggcagaattccaaccgaagaagacttggagacaatccttcggaaatgggccgactgttgcgccgtgactcgtgccaaattgacaaaaagcggatttgggcgaattcacgtgccaatgccacaatcgatcgaagacttgccggacggtgaacgaaagccctgggctgaactgctcgagaagaccggcttcctgttggagaaagtgaaggcaacgtccgtcatgcgcaagcagcactttgtcacttcgccacgcatcattatgggcgactcaaatgctaagcaattggtagagcgttgaccgacctcacatttcattggcgcggaggacggaactgttggagatgttgtccgagcgtttgatgccgtcgccctctcatcaaaagtcaaagtgggactgatcatgatcggtcgtgatgcgttgatgcgcaatgaaaccgccgacagcatcatggacaaattggggcgactggtgcagatgtgtgccacgttcccccatgtgaccttcttttggcttccgccgccattcgtccgtgatcgacaattcgaacacgaaacactgatcggaaaattgcgcgacttttttggccaaaagacgaagaacatccaattcgtggcaacaacgacgaatggccgttcgcttcttgagatttggcgctacggcaatggttacaacacggaccatgtctcgcctgagggagtgatgaaagagaagggactcaacatgttgaaggcgtggcttttgacgcaagtcaaggaatttccgggtgatcaggagttgggcattgagaagaagaagccggagagtggagagaagggaaaaggagcggggacggcagcagatcgacaacacggccgcaccgagccgcctccattccgacgcgacgggcccgtctttcgccgctcgaacagccgaccgttcgttcagcacccgtactcgcgcaccgccgttgatcgccaccctttccgcccctttcgcacgccgaatttgccgaatcccaatcgccgtcactttgatcgctgaggacatcgctcgttgcaagccgaggatgtgataattaaataatgacctcatttgacttttaaagttttaattaatttggcattttgtttatttttttgtgtctttcattttcattttatgttttttggctctcttcgcccggacttaaaaatttgtgatgcggattgtgtgtggtaattttaatggtacttttaattgttgtgttgtttaaatttaattgattgggattgctgtggctttaagtgattttaaaagtcttccttctcattcttctccttcgccccgttttggaattcggcaaaagagcagaggaggaccccggcaaaaaggcggctaattttacgacgttattttggatttttaaattctgttgaaaaggattaagaaagtcggtatcctttgctaaaaattattccaattccaaaaagcctaattataagtaaaacattaagcataaacaaaaccataatatttttttcacacaaacaatacaaaatcaaaacaacagaacaaaatttgagaaataagaatcatgaaaagtaaatctaaaaatatacagatacaaaagaaaatgctttttgctttacataatcatttacacaaacgaaaactaaattttctttatacaaataacaaaaaataaaatacaaacgaatagcaaataaagtacctttttgagttctttttgcaaaagcataaacaaaatcgaaatgaaaaaaaggcaaaacaaacttcatttttcaaatcattttttaacgcaaaaacaataaaaaacaaaaccaaacatttctatttttcaaatgcatttttaacgcaaaacacaacaaaacgccacgccaattcaaagcatggcggatacacacactcaactttattatataggattgtgatcatttactgtgcgtgcgtgcgtacgtctgacccccctcactctctctctctccgtcccgctctctctctgcccaattaatgatctaattgaacgcccgcccattggacccccacgtccgttctttgatactctccctccagctagacacggcacacagtccaattcctagcaaaaatgtaccaaaagataatccccacctgctgaattgtgatgggagaaaaacaaaaaatgaatgaatgagttgggcggggcggggccaacgccctcacttcactttttaccgcacaatcatcattatttagaacatgttaagatgcatgttcccacaaaata

SEQ ID NO: 4213 - DNA, 3604 bp, Heterodera glycines
atgctgtgcgaacactttgtgtccctttatgactctcccaatgcagcagtgtccattttgccactattttatctcactcatcgtctgctcgcctctccttgtatcagctatttccaaagccaacgcccttttctccctcttttctgtttgttatttctcattgctgctgagatccaatagtcggtgtacaaatttgtcaaacccgccaacatttttaatcaaaatgctttataaaaatttcaatgaatttcttcgccaaattgttattgtgaatttcagaaaaaggaattttctatatcaaaattaaaaatttcgaagcaaaaattcaagaaattttttatttaatttcaatccatttttttaccacatgaattatgaataaatttttgggcctcgaattcactttggaatttaaacaaaataaaaaaatgaaaaaaatcacctcatcatacgttatggattttaagcaccgccgttaggcagcgcagttccaaaatttattccatgccacagatattatgggcaggatacgtcaagtacctcaaacttgggtaattaaaccgaagaaagaggtgcagtggggaagaatgacgcctaaaatgaaggaaatattcgatgctgtgcgaacactttgtgtcccctttatgattctcccaatgcagcagttgtccatttttgccactatttttatctcactcatcgtctgctcgcctctccttgtatcagctattttccaaagccaacgcccttttctccctcttttctgtttgttatttctcattgctgctgagatccaatagttggtgtacaaatttgtcaaacccgccaacatttttaatcaaaatgctttataaaaatttcaatgaatttcttcgccaaattgttattgtgaatttcagaaaaaggaattttctatatcaaaattaaaaatttcgaagcaaaaattcaagaaattttttatttaatttcaatccatttttttaccacatgaattatgaataaatttttgggcctcgaattcactttggaatttaaacaaaataaaaaaatcaaaaaaatcacctcatcatacgttatggattttaagcaccgccgttaggcagcgcagttccaaaatttattccatgccacagatattatgggcaggatacgccaagtacctcaaacttgggtaattaaaccgaagaaagccgtgcagtggggaagaatgacgcctaaaatgaaggaaatattcgatgctgtgcgaactctttgtggcccctctctgactctgcaatgcagcagttgtccatttttaccactatttttatctcactcatcgtctgctcgcctctcctttttatcagctattttccaaagccaacgcccttttctccctcttttctgtttgttatttctcattgctgctgagatccaatagtcggtgtacaaatttgtcaaacccgccaacatttttaatcaaaatgctttataaaaatttcaatgaatttcttcgccaaattgttattgtgaatttcagaaaaaggaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggatacgccaagtacctcaaacttgggtaattaaaccgaagaaagccgtgcagtggggaagaatgacgcctaaaatgaaggaaatattcgatgctgtgcgaacactttgtgtcccctttatgactctcccaatgcagcagttgtccatttttgccactatttttatctcactcatcgtctgctcgcctctcctttttatcagctattttccaaagccaacgcccttttctccctcttttctgtttgttatttctcattgctgctgagatccaatagtcggtgtacaaatttgtcaaacccgccaacatttttaatcaaaatgctttataaaaatttcaatgaatttcttcgccaaattgttattgtgaatttcagaaaaaggaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggatacgccaagtacctcaaacttgggtaattaaaccgaagaaagccgtgcagtggggaagaatgacgcctaaaatgaaggaaatattcgatgctgtgcgaactctttgtggcccctctctgactctgccaatgcagcagttgtccatttttaccactatttttatctcactcatcgtctgctcgcctctcctttttatcagctattttccaaagccaacgcccttttctccctcttttctgtttgttatttctcattgctgctgagatccaatagtcggtgtacaaatttgtcaaacccgccaacatttttaatcaaaatgctttataaaaatttcaatgaatttcttcgccaaattgttattgtgaatttcagaaaaaggaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggatacgccaagtacctcaaacttgggtaattaaaccgaagaaagccgtgcagtggggaagaatgacgcctaaaatgaaggaaatattcgatgctgtgcgaactctttgtggcccctctctgactctgccaatgcagcagttgtccatttttaccactatttttatctcactcatcgtctgctcgcctctcctttttatcagctattttccaaagccaacgcccttttctccctcttttctgtttgttatttctcattgctgctgagatccaatagtcggtgtacaaatttgtcaaacccgccaacatttttaatcaaaatgctttataaaaatttcaatgaatttcttcgccaaattgttattgtgaatttcagaaaaaggaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaattaattccatgcccagatattatgggcaggatacgccagtacctcaaac

SEQ ID NO: 4214 - DNA, 1384 bp, Heterodera glycines
tgcaagacggaacatattttggacatggacatgttcctctacgacacacaaccagctgtacgcaattaagcgaagaaaaagcatcggtttgaccaccccaattattttttaaatttagactttgtccggactgaacgaagaattcatttccggcgctcggctggacaatttggtctccacgtacaccgccatcaaaggacttgtcgaaagtttggaggacaccgaagcttttgatacggacccaaatgtgcgaatggtcgcctgttttgacaacgaagaggtgggtgtagacaagaatcttaatttcgcatcatcgacaccgaaaagttccgtaatttgatttgtctctgataaatgctgcatccggacagagtttgcgggaaaacgacggggtgggacgacctgctccgccgccggttctcccgccgtccccccccccccactcccgggtcgtttcctccccgaaaaactttttaaagaaattttttttaaattttcgtggtgaaacaatgtaggggaaatgaattgcacccgtatccggggaatgggtttggacttggaaaggggcggggtgattggtgggtagagcaacccgtggaagcgaataaattttcctccgtttttaggttggcagtcgcagtgcccagggggcccagtcgcactgtttcgagtggttgctgcgccgcgttttgtcctccgtcgaccacccaaccgcctttgagtgttccatcggccgttccttcatggtcagcgctgaccaagcccactcggtgcatccgaactatgcacacaaacacgaggtcagttagtccatcctctccctttaaaattggttaaatttccaattaaacgtcacgccattcaccaattccaatgggattttgcaataatttcccaaatgttcgactaattatcttgccaaaatatgtagaaagccgatcattagaaaaaattccagaatgctactaatttgtaagggaagaatgaattaaaatatccctctaccttatcaaatttacatatatttgatttaatccaacacaaaaggagcggcacaaaccgtcgttccatcgcggcgtcgtggtcaaagtcaatgccaaccaaaagtcagttttgctcaccctttttggtctaataatttaaaaagctaatcattttttggtttcgcatctcattgtcaattaatgtaattgattactctccaccgtttcccccattgtttttcagttatgccaccactgcggtcactcactctgttctgaaagtgatcgccgactccgtcggtgttcccctgcaggcaatttgcacttaattagtaaaacaattatggtaactggcccacccttttcagaaggtggtcgtccgcaatgactcgcgctgcggc

SEQ ID NO: 4215 - DNA, 1896 bp, Heterodera glycines
  misc_feature (9)..(9): n is a, c, g, or t
taaaaccancaacttctgatttcattatcataatatttgccttaatggtgcgggttatggccattcttttgaaaaaaaacctttttcaaggccattaatcattaatttattacagccattcgaacttccgaatccctccaacgcaatagaaaaagtttttaatttttaaaatattttttcaaaagggaaccataaattattattattaatacaaatgctttaaaatcagttttaaattaattttttaatgtgttctttcgttttttaatacccttttcattcaacaaaatatttgcatttttttgtctcttctgctgctctccctaattggcaattaattctttgtttagggtttcttctccaaattgcccaaagtgctcaagggattgaaaaaggcggagcaatgaaagggcaactgacaaatgagcccaaatgtgcgtaaaggaacggacaaaagtgctttgacaaacaaaaaacggaaccatcccccccccccccccccgaatttcataattattaaattgacaaataaaatgattgttttttcgaatcgacagatgaaaatttcttttctatgcatggacaaatttccaacaaactttgtatggtatgtcccataaataatcaacaattacattacgtctacagtacaaaattaaaaattccaataaaattgcacagacaaagagaaaggcgaagaggcaaaattgtggtcgcgaaatcacttttattttcttaatcagctaaagttgtcagaatgacttggaattttacatagtataaggtctatcagtctgcaaaatttcaaaaagttttgaacacaattttttgaaaatcgctttttttttgtaaaactcgaatatttcatgtaaaaaaaggatttgaattagaaaacagaaaaatgcgatttcagaataattatttgggacaacaattctgaatacaaaatgaaatgagctccaaaaataaatataaagcaaacaaaaatggaaaatcaatgtttttaattgtctatcactaagaattttcggtcgtttgtccgtcggccgtttgtccattcgttcatttgcgcgccttctcgtaattggcctcgaaccattgcacagactccgcaatggcacgttcgaagggtgtgaatttgaagtcgggcagccgggcgcgcagtttggcatttgacgaggtctttttgtactgtccgtccgccttggtcgtgtcgaaaatgacttcgccctgaaaagtggaggaggaaaacataaaacacacacaaataaaaggagtatctccatagcaagggccatacgacggacgattgcgattttaagcagcttttttaagaaaattaaaattttaggaaaaagctacctttagggtttgtaagaaaagtcagtaaatagtcgaaagtcaggccagacccaaaggactcgagaaatttctcgatttaagaaccgagattctcgagcagcaattaattgattacacattatttcaccttaaattgcattgctttgacaatggcggtgaccacatcagtgattgtcacttcgtcggaagggtcaacggacagaatgatgggttccacgtcctgtttttggataaatttaaaaatttgaggtaatttttaggggggtccggcggtgcgacaggttccgacagggaaattggaatttaatgaagccttacaaagaaaataatacaacactccacctcgtattcgcggattgcccacacaaagagacggccgaggtccaacgagtaaatgaattgccgcaacggtttgcccgagccggcaaccaccaaagggccgccgtcgcgcttggccaaaaagcacttgtggatcagtgccgggaccacgtgggctaattgccaatcagggggagatcacattcagtttaaatt

SEQ ID NO: 4216 - DNA, 5431 bp, Heterodera glycines
ctttcgattgtgctcctgagcatatccgcggttgagcacatctgttagtttattggaaattcgacttatttagctgatcatggccaacccaccgatcattcgtggggcgtacgaatagccaaaattgctgtcatgcggcggtccattgtacacctgaaaatgtataacaataagctaaacatttaaaaataaagtatttctgtgtgtataattattccataatgatcactaattaatcataattcattataatgatcatgtagttggcacattgtatggactaaaaattgcaaaaattgccagtcaagtttttttaactttggaacataaagcatataaaatgtttaaatttttcacccacgtatgatttttggaaaatccaacttttccagtcatggttatgagatatatttttatgaggaattttactttgtcaaattccttttagtcgatacaatgcacagccctaattatcagggatttaattgctctttaataaacacatgattatttatttctgcactgtttttcacgtgccattgtctcgtcaattgggtacggcgttttgtcggggaaaatgcacgtggaaaggcacgaaacgcaccgttccacgtcagtctcatggcagcattggagaacattttgacagatcgccttcgggaagacatatggtaattaagatacggttttctgaaatagaacaaacatcccacctatgattgagacatccctttcaaaaaatacagtaaacccaaatggatacggtatgtgggatttctttctttctttttggcactgtctcaccaaattcttgacaaagaattggaggttgtggcgcaagttgtggaacagtccgccgaccattgccgccaaattgaccacgtgcgtcggccgaacgcggcggaaaagcgcccgcgtctgctccaagtcggtcaggtcgcactcgctgctgcccacgaaaaaccactgctcctgcagccgctggggcttctgttgctgctcttcctccgtcaccacctttggcaaattcaaaattcaacgacaaaattaatacggagggcgggggaatggaagtgccctcctcaaccaggcttgtcattttgccatcattgagaggcctggcgtgccatttcggcatccctacaacccgtcgccacgagcacctgttgaattgccgacccgaccagtccggtgccacccgtcacgagcacacgaattgccgccgctgcttcaccgccgctttcgttgtcgccttttttagtcatttactcacacaaaaaaatataaattttctgattgtggattgatcagttaattgctgcaaaatatttaattgtgcctttcagcaattcgaaattcaattcgtaaatcgattggtccgtatgtttgtcaaaaaatttatgttcgttcgttttgtgaatggaaattaaatgaaaagcgaataaatctgggaaaggttgacaacacagaagaacagcaggaggggaggggaaaggacaattccaaaataaatattatattaaatgtttgtttagctgtaacaaaatgtgaaaagggaagaatggaataaagcaaaaaattagaaatattttaatgttggaagggctgccatcgaaaagaaatctcgaccatttacactaattgtctgtcggtcgtttgtccgtcggccgtttgtccattcgttcatttgcgcgccttctcgtaattggcctcgaaccattgcacagactccgcaatggcacgttcgaaggatgtgaatttgaagtcgggcagccgggcgcgcagtttggcatttgacgaggtctttttgtactgtccgtccgccttggtcgtgtcgaaaatgacttcgccctgaaaagtggaggaggaagagatgaaatgtgccaaaatttattgaaaaatgaaaaaaaaagaattctcgagagatgttcgagtaattccaagtgccgtacgattattctcggctctcactttaaattgcattgccttgacaatggcgtcgaccaaatcggcgatggtcacttcgtcggcagggtcaacgcagaaaatgattggtgtcacgtcctgtttggttttgaaaagttaccacaagtaaaattaatagatcattagttgatctattatcctaattaagagatgtgtgacaatttttaggtaataattttgccaaggccgtagccgaaaaaataatttcagaagtgggaatacaattgctctttggtccctcatatccatacgaaatgtgctcattaaagtccagtctcgacattgacgatttaatatattcccaatgattaatcatcatatacaaaaacataacactccacctcgtattcgcggattgcccacacaaagagacggccgaggtccaacgagtaaatgaattgccgcaacggtttgcccgagccggcaaccaccaaagggccgccgtcgcgcttggccaaaaagcacttgtggatcagtgccgggaccacgtgggctaattgccaatcagggggagatcacattcagtttaaatttaaaatattaatgacaaatttaaaacactgaaaattctgccggaatgtaagaaatgttcagaattaaaaaataataattctgtgtacattttttgtctgttttttaccgttctccaaattgtaattgtcacgcggtccaaatatattgcacggcactgccgaagtgtacctttggaaaagcatgtgcccatgcccatttggtttgagcattggaaaaatgtcgagaatcaaaccaattatggtaattattagagagggagtggggagggagagaggatagagagaaaaagagagagagtgcgagtccgataaagaaagaatagatgagccaaaaatgaccgagagagagagagagagagaggagagagagagagagagagcggagagagagggaagagagagaacggaataaagagagagcaaatgaagggagagagagagagggaagagagagaacgggataaagagagtgcaaatgaagggagagagagagagagagagaggagagagagagagagcggagagagagggaagagagagagagcaaatgaagggagagagagagggaagagagagaacggaataaagagagagcaaatgaagggagagagagagagagagagagggaagagagagaacgggataaagagggagcaaatgaagggagagagagagagggaagagagagaacggaataaagagagagcaaatgaagggagagagagagagggggggggaagagagagaaagtttaattattcaattaaaaataaaagacagtaattttttattcgatgcactttcgattgtgctcctgagcatatccgcggttgagcacatctgtttgtttaatgcgaatttgaaggatttcatttagctgatcattgcaactcaccgatcattcgtttggcgtacgaatagccaaaattgctgtcatgcggcggtccattgtacacctgaaaatgtataacaataagctaaacatttaaaaataaagtatttctgtgtgtataattattccataatgatcactaattaatcatcataattcattataatgatcatgtagttggcacattgtatggactaaaaattgcaaaaattgccagtcaagtttttttaactttggaacataaagcatataaaatgtttaaatttttcacccacgtatgatttttggaaatccaacttttccagtcatggttatgagatatatttttatgaggaattttactttgtcaaattccttttagtccatacaatgcacagccctaattatcagggatttaattgctctttaaaaaacacatgattatttatttctgcactgtttttcacgtgccattgtctcgtcaattgggtacggcgttttgtcggggaaaatgcacgtggaaaggcacgaaacgcaccgttccacgtcagtctcatggcagcattggagaacattttgacagatcgccttcgggaagacatatggtaattaagatacagttttctttaatagaacatcccacccatgattgagacatccctttcaaaaaatacagtaaacccaaatggatacggtatgtgggatttctttttctttttggcactgtctcaccaaattcttgacaaagaattggaggttgtggcgcaagttgtggaacagtccgccgaccattgccgccaaattgaccacgtgcgtcggccgaacgcggcggaaaagcgcccgcgtctgctccaagtcggtcaggtcgcactcgctgctgcccacgaaaaaccactgctcctgcaaccgctggggcttctgttgctgctcctcctccgtcaccacctttggcaaattcaaaattcaacgacaaaataaatatgggggggcgggggatggaagtgccatcttcagccaggcttgtcattttgccatcattgagaggcctggcgtgccatttcggcatccctacaacccgtcgccacgagcacctgtcgaattgccgacccgaccagtccggtgccacccgtcacgagcacacgaattgccgccgctgcttcaccgccgctttcgttgttgcttttttctgccatttactcacacaaaaaaatataaattttctgattgtggattgatcagttaattgctgcaaaatatttaattgtgcctttcagcaattcgaaattcaattcgtaaatcgattggtccgtatgtttgtcaaaaaatttatgttcgttcgttttgtgaatggaaattaaatgaaaagcgaataaatctgggaaaggttgacaacacagaagaacagcaggaggggaggggaaaggacaattccaaaataaatattatattaaatgtttgtttagctgtaacaaaatgtgaaaagggaagaatggaataaagcaaaaaattagaaatattttaatgttggaagggctgccatcgaaaagaaatctcgaccatttacactaagtgcctgtcggtggtttgttcgtcgaccgtttgttcttttgttcatattcgcgccttatagtaatggcactaaagccatagcaccgactccgcaatggcgcgttacgaaggatgtgaatatgaagtcgggcagtcggacgcgcagattggcaaagatgaggtgatctagccagggattagaatgaagaaaggaataaaaagtacgtagaatataaagattgataccgcaacataaatgtcgatgttctggcacttgaattaaaaatatttacatatgtttaaagaaatcgtagccataatacttttttgatattttaatggaaattacaaattctttatttctgcactaaaaacatacaactattgggaacagaaaaagattcaaaaatactttaaataaaaatgcaattaataattaatttcttgtttatctacaagaaagtttttattggctcagaaccaagagaattat

SEQ ID NO: 4217 - DNA, 1942 bp, Heterodera glycines
actgaaggcattggtcgattttttatacatttattaaaagagagaaagagcaaagatttaaggaattttatttctctgttttcaattttttaatttcccccctttttttactataaaaatgtttgctttttccatttgcctctcattatttaaaaatatttctaacataattattattgtgcccttttgacgtccttcttcgcaattctaatacggcaaattgtgctaattgccacaaaatgaaccgacggtaatgagttttaaaaattacaaacttcatttaactactgttttcccgcattttcagttggctgtgcagcgacatttggatgaacattctgccgttttttggtcgtcaccaactcggcctcaaattggcactgatttcgccacgtttcgacattttagtggacaaacatttcgatggccaatcacaatggacacttttgcgaccaatcaaaattcgcaaaaacaaaaccatcgcttcgccagaattatgtgtgcttagggctgccaattacgcaaattttccattgccagaatatccgttacccagcaaaattcgctttgattgccttgcgataaagtaattgaaattcaagcattttgtttgacagaagtattcacctcttttcaggtacattgattattctgtgctcgcatttatccgtgccaatcagcaaatttgggacaaaggcaccaagttgcgtttgttgctaccatgtacttcaccaacaacaaatgtcgagccagtttgggataccttcgtcagtcaaatttggcccatttttgcgacaaacattcgccatttgacatttcgaaattctacttatttgaccaaattgcttcatctcatttcgccgatcattctcaccaatctcaccaaattggattcaatcggtgttggttcttttaaaccagaccaaattgatgaagatttcgacgggccaaatgcaactccaactgctggccaagtgttgtccgaatggttgcacgttccgacaaaagatggacgaccgaagcgattgttttgctattttcatccgtcaggaaacactcaatggatcaacagtttcaaagaagtgagttgcccatttccgttggattgattgaaatttgtttttgattgctattcattatccattttttagctatttctccgtgccacttcttctgtctgctacaaaattttcatcagaactaaagcgacatttgagccatttgaattggtgaatgaacggaccaacgaaaagctgacaatgccgaaaccaaaagaagagaaattggccaagcaatggattatgaagagatgtgcaattggggagacggcggcggttcaatgggaggacaatacggacaatttgaacgatgtcacattttgtcttcaaaaagttgaagtttgcattgggtgagcaaaaaagtgcattttttcttttattgaatttgaattttgcgcttaatttaggccagtatctccaccaccgacagaagaagcgggacaaagcgtcgaaaaggagggacaaagcagcgaaaaagagggacaaagcagcgaaaaagggacgtcttctgacaaatgagcgacggacagaacaacaaaaacaacagtgatcagcagaagaagaaaataaatattaattgagaaatgatcgatcattatattcatcagtgaaaattggtaaaatgtacatattttatgaagaaaatgtatgtgttcatggaaataaacgatgtatagtgaaaaaaaatttttaagtgccaaaattagttgttaaacaaacatttaaatttaaaataatcctgttaacaataattgtagtacggaaaccctgtggtttgttccccccatttttgggcaaaattttttaaaacttatatataaaacatgttcccattggttttgaggtcgctgatcatgaatccggcatctattcgacataacgaa

SEQ ID NO: 4218 - DNA, 929 bp, Heterodera glycines
gggggaaaaattgagaattttgatcatatttttagcagattttcattaaaaaattcttaattttgtggttttttggaaaatttaacaaaaaaccacaaaaaacctcaaaatttttcaaaaaaccacaaaaaacctcaaagcctcatttttaaaatttagcctcattgacctaccaaaaaaccacaaaatgaggctaaagcctcacatatgggaaccctgatcttagggctctcgaatgataccaagatcgttggattttgtttacaaagaaaaatgttacgatcaaaaaacatgtactcgtacgaaaacggcctggccccagaattgatctatccaataagcaacttttacaatcctatttcatgaacagaaaaatctttggtaatatatagaaataattaaatgaaaaatggcgattaatatcgtttagaatctcttttgttaattgccagcagtaaaataaaataaatattcttaagatttatctgtatgtaaaaaatattcacaaaaattggcatttttatacaaagtttgttaaaattcaatttgaccaaaatttctcgggcgctacttgcaaagagcgctctttatcaaaaagcaaaaacaaaaggggggacccttttgtttgcaaaattttttaatatttagatatgtgaagttattcactgttgtattggtcggcagatgctttccaatatgtttttcatattctgatcgtgatcacgttgacgcagataaaatttgactagttgagatctttgaatgataacaattttgccatgaattgaatgtggttttggtttgttttggtccaattttgatgttttctaaaaatccaatttcttactaaaatcgcttttttatgactttggaaatgggttttcatgctttttcatcattactacgtaatttttaactgtttcacagca

SEQ ID NO: 4219 - DNA, 5913 bp, Heterodera glycines
tcccgatttccgaaattttttgaggttcggaatgccttccccgccatggacacaaaaagtcatgggacgcgtaaaatgtgatccgaacaatttggtcgaccccgaccccgaacgattttgttaaccccgaccccgaccccgaacttgctgaccccgacaaccccgaaccccgacttttctaaccccgacgttcgggggtgcaaccctaatatgtacataaatatgtaagaaaaatcccaaaatatgtacaaaaaaccccaaaaaatgacataaaaattactttttttagtatttttaggcaaaattttcaaacttattttttctttcaaaatatgtaaaaaaatgaaaatatgtacaaaaatatttgccgaaattttggatttttttttgaggatttccaaaaatttcgtaaaaaatactcaaaatatgtaaaaaaaatgaaaatatatatgaaaaaaatccaaaatatgtacaaatatgtaagaaaatcccgaaatatgttttattttacgacacctattttcaatgttgttgaaaaaaattggtttacaatttttattggaaaataattcattaaccaaataaccgagaccgaaaaccgtgatataatttaaaaaatggaaattttattttatagcattataaaaaagaacatacacaagctcaatgcttttggaaacctgggatgatccaagataagaaataattttatattcacttccattggcccttcgggaagtatttcttataattatataaataaaatgtgaatgtcctcaactgtctgttcttcaaaagtcgagtagtcactctcacataattagacaccattttcgctgttttgccgctggtggagacaaaggcctaaaaattcggcgcaatttgaattacttaaacgaaatcaactgttttttggctattgtaaagtaaagggttttctttgtggatttcttctgatcaactactttaagccctagatcggtttgtctcatcaagagcttcagattgacacctttttgggaattggaatttcgacttccaaattttttcagaaatcggaatttcgacgtccaaagctttttagggggtcgaattccgtgccatccctgttgctcacccagtgcatcgtttggcatcgcaaagcataaagttgacatagtttaaattgttccaatttccttctttttcccactgatccgccaccgtattatccccaattggatatcgcttcattagccctatgatacactgtacatctattttttctgttagcagtgtaagcttttcgtttgtccgttcgttcacaaattcaaatggcaccaatggcgttgactcatatgactcatcaacaaaaaaatgaatttcgtagttggcggaagtggtggcacggataaattgctaattgatggaaaaacggaaattaaagcttatcaaaatcattcgcttaaaaaattatgacccttttccagtttatagctcccgaacatttccaattctgacaatgttcaaatcaattcctaattaagtttaaacaaaggaaaattagaaaacttggattttaactcttttctggaaaaaggcctaaactatggccatacctctttgaaaatgttgacaaattcagtttttgacatataaccaccaccgcaacgcaatcgcttcggttggccatcatttcgcggagtgtgcaaccatttggccaatgcttggccagcagttgcatttggcccatcatcagcgatgccatcgggcaacagatcaccagaattgattgaattcaattggttgagatcggtgagaattgttggcgaaatgcggcgacgcaaattgtccaaatgatcaccatcgcgaaagttaaagcggcgaatgtttggcgcaaaaatcggccaaatttcacaggcaaaaacatcccaaatcggctggacattattgtcgacgaataatgaaaggcaatcatggaagcatgaagaaacagacaaacataaattggtggctttttcaaaaatttgctgattggcacggagaaatgcgagcacagaatggtcggggttcctgaaaaatggtgaaaaaggagtgattttcttccctttatgtttgaattactcaatccgaaggttcctaaaacgaattttgtgggcagcggacggtccggcaaaggaaatgccacccatttgtcatcgatccattcagacagtttcgcttttggtcctttgaacttttgaattgtgatttgtctcaaaattgtcaattcgcttttgccattgaaatgggcgtccactaaaacatcgaaacgtggcgaaatcagtgccaatttgaggccgagttgggcatggtcaaaaaggggcaaaatgtccatccaaacatcgttgcacacccaactgaaacacgcaaaaaaaatggtagagaattacttagctattccggatccggcaggattaatcccgtaaatcctgcaaatcccgctttttcaaaaaatgcgggattgcggactggaacccggcaaaatcctgcgcatgatccggtcctgctccggtctctagttgcaagcgacggaacaacaaacaaaagccatagaaatggcacgattccagattttgaatttatttccgcaattttttttttaatttcttaagcaaactgcaataaatagggatgccaaaaatatggatataaaatcgagaaatatggatataaaattacgaaaatctcaaaatatggagataaaattgcaaaatatggacataaatttttccaaattgaggggtaaattttacaaaatttcttcaaattcattaaatgtaaagtaaaactttcacaaatgcttaaataggtcattaaaaagaagaaaaaacatacgataaagcaaaaatttactcatgttaatgataaatcaacccgtatggcgaatttttcgcttttttgcttatttttgacataaattaaccacttttgagaaaatttaatttgttaagattttcaagaaaattttgctaaaaaattattttttgaaaattttcttgtctttaggggctcaaaaagacgaatttagttgataggggcggttctaatagaggttttttggaaaaatgtcaaaatatggacatagaatatggataataatgccaaaatatggacaaatatggacataaatcgcgaaatatggaaaatatggatatagaaatccatcctagaagcttcaaaccaagctaaaaacatgtttttcatgcgtttcaggcctcccacagtccaggaaaaaaatatggatttccatatacctaattggatttcctaattatgagcagcacattggagaatcactgagcacgtattttggtacttttaaaaccagggttgccagatgaaaatgacaggggaaaagtatattttctgactttttgatgagtaaaaacattaaaaaatatattttctcggtactgaggtcaaataaatttttaaattttgtcaaaaaccaaaaaaatggttattgttttgtgcaaaaaagtggtaacatagatatggaaataaaatttgtaatctctgtggcataagtttttgaattgctcaatctcaaaacttagtttttctatgtaaaacacgcactaattgccacaaaatcgccacttttcaagtttttactgcctcccctccttggcaatttttagttgctttatgttcagtgttaccaatgccgtcgtgttccaaaagatgtttttacaaatgaacccagcgattgctgctgattttcactaatgctagaagagataacggcgccggaaaattcgtttcttttttcgacgggcgatgccattaaaaattaatttccgcctaaaatattttataaaaataattgcgtattttaaagaatttagtgtaaaataggaccctgggtgggtagcataagatcccgcgcggggtcacagacttcaatcccacatttgcattaatccaacaggatatccgtcccagttatttattgttctctccccttctctctcgctatatctctctctctctctcagcagctgtttcgttgttctctccctgtctctcacgttctctatctctcctctctttctctctatgtactctccactcccactgcgccgttctctccccatcatttccaagccaagcgaagaatttcaaccaataataccttcataaaaatgaccacagccttatttattaaaatattatttggttaatttttcttcatgtcatttcaccatggagatttttctatcatttgataaacttattttgactatttaaaatttaaatattttgtggcaaattgcatggcaacaaaaaaaaacgaaagataatccaaagccgactccattaattattttcactgttcctcctactaggactaatgctgttcgagactctcggtctcgagcctagactcgagaaacgtcacgggttttttggtctcggtctcgggttttcagtctcggtcttcgagactagagaccgagactttaacaccctaatgattggctttttgtaaacttaaaattaaaatatatttttaataatttttttgctttatattagagaccggacaagagggtcagtcggtcggtttcggttaaaaaccgaaaaaaaaccgaaaccgaaaaaaaccgaaaaactcaaaaatttgtcggtcggtcggttttggttaaaaaaccgaaaaaaaccgaaccgaaaaaaaccgaagaaaaattttcggtataccgtttcggtttcggtttttttgaatttttttatcttttcccaaaaaaacaataaaccatttttatcaatagaaaaagcgaaagatcacctctgagtaaaattgtagaactattgaagctctatcaatggtgtataagttgggaaaataattgaaaaaggcagccaaaaaacgtttgttagcttcctgattcttcttaaaaattagggttgctccccgacccctggggggggggggcaaaatgtcgggggccggggaccccgattgagtagtgatcaacaaacttttttaacaaaaaaaagaccaaattttctctttatatgctcgaaatcttccttttttcactttaatcatctgattcaaattcattagttggcgccagtaaaagtgcgtccaatttggcattttatacaaggcatcccaggccccaaaattttcagaaatcgaattccgaggctcaattttaacctaaaaaatttgacaattttagtggtgcgctttgtgcttatataactttttgaaaacttggggtgggggaggggggtgtccgacggtgccgataggcgccgcctaaagtttttcggaattttaggaatttttaattaattttattaagaaaattgtacaaatttaaaaattttcaagagtccccaattccccgagttagtgtcggggggtcgggggataaaaagtcggaggtagggggctcggggtcggggagcaaccctattataaacccccaaaataggtgctaaaaatggaaatgagataaatattttaaaaatcaaaaatgtagtcaagtaaataaataaataaattttgaatatgaatttttgataaaattttccatttctcaggggtgtatttttcgtttttgttgcatttttgttaataatttttttcaaaatagcagaaaatattttacaaaaaattcttcaaaatgaaaaagagcacaaaaaagcaataaatttattattattaacaggcgctccattgattcggttttttttcggtttttcataaaagtcggtcggttgtttcggttttttgattatttcggtcggtcggtttcggttaaaaacccgaaaaaaaccgaaccgaaaaagtcaaaaatttctcggtcggtttttttcggtcaaaaaccgaaaccgaaaaataccgaaaaaaacccgaccggtccgatctctaataaa

SEQ ID NO: 4220 - DNA, 6106 bp, Heterodera glycines
actaaaaagtttgataatcagaattcttaggaatcgctcccccgacactaccccaataaagaaggatactaaccacttgcccaccggattacttgttttgtatttgtaaatatttatttatcttatatattattttcatttatataatatattctttgctttattgttatttatatattttttatttacatattttatatgattaatataaaattcatttttaaattttattataaataaatctaattttattaatttccataacgttaattaaataaaaaaaaattcaaaaaacaaaaagtagattttgtatagaatatttttttaaattactctgaagcagtgggactcgaacccactacaaaaggctggcacattaaaaatgtttagattttattctatgttttatgtttattttttatttgtttaatattcaaatttattttaaatttaattaaaaaaattttatttttaaaataaataattattttattttaataaatttaattaattataaaaaaaacaaaaaataaatttaaaaagaaaaaatgacttattgcaactaaataatggataaaaaattatcaaaaaaaatttttttatttaattattttaattaatttaaaaaaacaaatagataataaatttaataagaaaaaatggattattgtcactaaatactggatagaaaattatcagaattaatgggacccgaacccatgacacacatcagaagaaaaggcaggcacactaaccacttaaccaccgggtcgcttaccttcactccatttaacttccttttccctttctttctttttttggaaaaaatcccgaccaaaagtgcttgtaatccctttttagggcactttccagacgcggacccaaacaaccctggtatcattcgaaagccaagagtttgtagattggaggaaattgtttcgttttttgatttgacccattttaagacatgcaaaaagcgttcaaaaataggcaatcccaaaaaagtgctatttttgagtcatttttcgaacacagttcgaacagttctaaaccgatcgaaatggctatagtttttccttatagccattgaaaaactgcgtcgatagaccccactctcgccccgtaaaactcgctagaaagccttaaattagtttttaagtgagttaggggggtagattcttcttatatagggaaccagggccccaaggggccctgtgaaagcgccacgggcgctttcaacaccggggccagctgggaacagttggtggtaagtattttaaaattagccgagtgagtacgttaagcgtttgaataatagaaaaaaggtggtgtgacttaaaactaaaggttaactaagaattacacataaaatttttcagacaaaaatttattaataataaagcaaaaaaagcaaaaatcagcaaaataaattaaaaaataatcaatcaaaaaaatcatcaaaagaactatcaagatcatttggttcttgatcgtgcgcacccgctgcgtgtccattatctcgttccacgtccgggtcattagccacgtccggtactcttgggcccacgtccggtattgctgcgtccgggtcattgtccacgtccatcagtccacgattcggtgtcctcgactgctgcgtctccaagtccaacagttcgtggtaaaccacgttctcgatgtgcgttccgtacccactttggcagaacggcgcgtacaccctgatgccgtccatctgcgtgaccctggacatggcgacgtacacttgtccatgcgaaaagcattgacggccgttgagtacgagcgccatccgctgcagcgtctgtccttgtgcctttaattttttgtgcttatttatttcaatccttaaataatctgtatttcaccttgtttatggtcatagcaaagcaaaggcggacgggaaactgcagacggcggaagcgtagcccacggtggtgtcgtgcgcggccatattcgaattgaatttgtggaatggcgattatgttctgcgcacccgctcgtggtccggtgagaatccggcagaacaggttgttctccgaagtgcgcatcacttgaagtcgtgttccgttgcacagtccctgggtgacgtccaaattgcggatcagcatcacgggcgtacccacctggattaataggttaaaaatgattaaaacaaaaaatagttcactttgatggtcaatttgtgcggcggcattccggatggcatttcgttgtgcaccgcctccatgttgaagtcggtgcggaaattgtgcatctcgtcgtttggctcaagaggctcgtcgatcgataggaattcccttccgcacccgctcattctgccaagcgccacctcattgatgtgctgcacgtcgttgttagtcggacagaggatggcgttgtgtgctattgcgtccgcgttggccagcgggtcgtcgaacattgcttcagggaagcagaaatgtatggtgtggtcgaggtcgtccacgaggagttccggcggaatgcgaagttggttggtgaagccttgggtgtccgtacccacgcggtgtattccattgccgatttcctgtagccagtcgcgcaaagattgttctccctgtgccgtccgcatgttgatcgttaggctaaaacataaatatgtttgtaaaaaacaaagttgacaaattacctgatttttttgaacagacgaaagagcgctcccatcttgatcgacgtacccacttggtcctcacgagttccatgctcgactacgggagtcagttgccgccagtcgccgctcaacaccaccactttgttgccgaacggtgtggcatttgcacaaacgtctcgcaacagccggtcgatgtagtcgagcacggtgttggacaacatactgatctcctaaaattgttatcatgaacgaaaagcaacttatgtttttgtttacatcaatgatgatcagttgtgcgtggcgcagttgctccgcttttgccgactcgaagttcaacatcggcggcgtctcctgcgacacgtcgtttggcacgtagaagtgcctgtgtgccgttcctccgccgatcagcaacagagcggcgatcccggtgctggcggcggcgacaactgtgtcccgctgcagtacttgattgcgtacccactgtgcgttggcgtttccatcaaagggaggtttgcctgcgatgcaccacttgatcagcgtgttgtagaagtacgtcttgcctaaaataatattataaaataaattatatttttaaaaataaataagccgttaccgcatccgcccgcgccttcgaggaagaacaacttctggtcgcacccgccaagaattgatgttgagatcgcgtcaaaggcggcccgttggtctgtgttgaggcgtccaatctgttcaacggcaacttgctggggtggtttgcggcgttgcccagcatcgtccccgtagaagctgtccaagatgttgtcctcctccaggagctgtgcctgatgttgaaagtcgtagcccactggtagtcctttgagcccaacgtccctttaaaatattttaaatatgaaatttattatgccaagtttactcacttggtgttcgttgccatgcagtttaagtaatactcaaggttgagcatcacctcagccgcgcggacttcggcagactttggcacagctcccgggtggtttgcagccgtcggcgggttcatctcgtcgaggaactcgtcgaacagcgcctgagggttggacggatgggcgtgcgcaagcagcatcgcgaagtagtgctgtagccgcttgaggtttgacatttctgcacaggcttcttgcatggctcggcggaagagttcgtcgctcacttgaagacccaagtgttggcacgtacccacgaaagtgccaaatagaacgccatcaatggtgcgaaggtcggcaaagctctttggtcccggacggtggagcagcagtgttctatttgattgttttattaaatgatttcattttaaatttatcacctcaaggcaaaaagttcatgcttgcgcggtgacacggtgtacacacgcacaaacattttcgccttgtccgggtcttcttccagtggacgcacccgcttcttccatgaccgcgacctgaagtcccacctaaatagcacaaaatatttactaatcaaatttataatatttatttcaactcacgagtaacgatatggcactcggtcgtacgtcaggtgcgctgcctcctggtcccttgcgcagagtgcgaagaacgctgtaagccgggtgttctcgcgaaccctccaccgtccttcctcttcatgtccttcttccacaacaatcgtttgtccgagttcgtcgtgcacgctgagtgtgtagatttggtgcgacgtacccacgattttgtatgagttcagtcgaaggtatgcctccatggcggtcatgtatcgcactttgaacgtggcggcaatttcgtcgtagtcgtacacttcgtccgcacccgcagttccatcgtttctgccctgttgcgccgatcttcgtggctgtgcgacacggacataggccttttcaaaccctgaatgttctggaattattgaaaaaaatcaaaattaataaaataacaaccttttaacaggtatttgaagatatacttgcaggccttctgtccaaacacgtactccacattgatgtggcatccgtatttgagcagaagaaacggattgtatgggatgacgcggctgtcgtccatcagaatagcgctccggaccccccttttcttcttgtaatgcgtctggccatgttctcccttaataattatattttaattaagttttaataaaaataactggtacatgctgcctctccggaaggcgcccttgatgtggcatgcgctgatagcgcacttcggcccagtcccgttctgggtcagcagcgggatcgtgatggtcttcgtcatgttggttgtcggatccaccagttcttccaaagaatgcatcactctcgtcgggcggtatgcggacatagttcgtgtaacggacctcttgaaatttttagaaatacatttcatgtttttagatgacaagatggttacccgagagctctgtcctatccgagtatggcttcggaaaatgtttgcggcaccgcgaaccctccagacatgccgcattgcagtcgtgcagcatcattgatgttacgttatgccagaggcgacgctgttggtgtgcctccggagattggtccgaagatggcggaagggcagggatgcgcgcgcagacatattcgtccacgtgctgcggagtgtcgatgcggaccccccgttcaagaatcaggagcatgtgtatgtgtggcatgccttaatttatttttcttttcatataataaaatttaaattttacctcgtttctggtgttccacactgtaacaccatccggcaactttgcccagcacaccacgtttatactgaatagtgtgctatctgcttaggagggaacacgctgaaaagagacgccaatggaagtgtacaggcacgcagggacctctaacatgcaagatgctggggcataagtgcaggcacgcagggacctctaaagacagagagaattcaaaagctatccagacgttaaaatgaaatgcttagctagcatgtaaaaaattccatcaatcaaaataatttaattatttaatcgtaatatgttgcaagttttttcttaaaaaacaaaaatttaaccgtcaccacaattccgcgactcggccaaaggtgcaacgtagtagtttggtacaacatatatttatattgttgcgacgaacgtagggcgtcataactcattattttaagactttctatcgaaaaagaatatagaaaattactcaattaaattatcattgctctgaatagttttttaaatttgtaccaaagttgttagggatttgatgcaaaagttgtgcaggagttgtaaagttgtttaaaaagttgtaaaatttgttcagcttttgatgtcatttttcggaacgcagtagtttggtcagggatgaacttataataccggaatgcatgtagggcgtaataacaccttatttaaagcatttctatcacgaaaaatttctgaaaaattcaaaaaaatttttcaccctcagaatccggcattatg

SEQ ID NO: 4221 - DNA, 2966 bp, Heterodera glycines
  misc_feature (2939)..(2939): n is a, c, g, or t
ataaaaaataattcaaataaggcaaaaataaataaatatctttttactacccataattcatatttcaaaataaataatggcattgataaaaactataaaaaaccatacacaatttaaatacatctaaaggattttaataaacatgtattaaaataagtgtgttaaacttggaaaaaagacacaacaggttccctcctcaagaaattattcaattgtaaaaaaaactaaaaactaaatttttcagatagttgaaggagttttaataaaataaaattttatatatttcccaggaatcataacaaataaatttgaatttcttggaaaaacaaaaaaattttcatcataaaaataaatgttcgacatgaaaaattttaaatagtttaaataaaaataatttattagcaaaaaataaacttgacgcaatacaatattattaacactgcactgctcatgagagaaaaataaataaaaatataaaatcgcataaattcatattttacagaattataaaatttatattgagattgttacgtagtcttttaattaaatataaaatttatttaaagatacaatttaaaaaaataaaaatgaaaatgaaaataatttaatgtaaaatttggttttgaaataataagatatacaaataatgcaacttaatattttttaaacaaaaaggaaaatatttatgcaaaatatttattatgcgtttatgatgtatttgtatatctttatgaaataattaattttctctaatatacatcgatttgtgtagtagatttagcacattttttattagtccatttattttttactattcattttttctcgttactacaaataattagatattttaaattatattattactataaattcaaaaacagctaagataaattgataattcttcccctcccccgttcccgaaagttttggaaaaaagcgccgcaaaaaatcaacttcgatttttcgttctcagaatttcacaaaatgcttatttctaacaaaaaaatgctcaaattgatcatggaaaatcaaaaaaataacatttgaaaattttacgtgttttgaataaattttgtaaaaatgaggcttttttgcctgccaaatgaggcttttgaaaattttaatctgggagccctgcatatgaacaacaaatcataaattaatacggagataaattaattacaacataacaaaataagacagcttataattttttaaaaaggattttgtataaaatttaaagatataaattgcccaaattaacaaatctaattttgatttatgcacaatttaatttattatgcacttttacaattttataatatcaaaaataattatcaaactttacgctttcatttaaaaaacattaaaaaattttagagttttaaagttgattaaaaatattaaaacaaacatgactataacaatatgcataatatactttatctaaattattaggaaacaagcatttaaaaacgtaattaccttctatcttataagaagctggaagctttcttcaggctaaatacggaaattgatcaacaagatttagaatagataataaaaaaattagaattttcttaagtaacaattaaaagagtgtatgggtgcatttcttttgcattcatttattttgccttctatcaaattattcattttaaattttttagtgccattctaatttataaaatagtaaattaataatttgcttttataaaggcaatttaaattttgtccgtaaaaataagccaatatggtaatttttatattaatttcgactgcttaactataattgaaaattgcatattaattttatagtgatttgaaatagttgatgataaacgttaaaatttaaaataaacaaagataatgagcaaaatcaaactcataatttcaaattaaaaccgaactaatttgaattgaaaaaaactaatttttttacacaattcaaataattctataaaaattagttaaaattcttttagtaattcttttattttttatgttgattcgtgttattaattataatgtactacatttatttaggaattattcactcatgatttaacaaaaaattagaataatttgtaaatatccttttaataattataaaataattatggcttttatggcaaaatggtgaataattcttttaaatatctctctttttgtgagctaatctttttatttactaaaccataaactattattgaggcctttttgtgaatcgaatgaaagcatgcttctttatgtaatatttgctaataattgattttgtctttgtaattatttatcgtgaacaaaaaaaattcatataaaatatataaatgaaaattcagcaggagaatttgatacaatcaatgtaccttaataaaagtttatttaagtcgatatttttgaataatgcttttttaaatttatggtatttttatcttttaaaataattgatttaaaatttatttaatattttagaaatatcctaatactttataaagctatagcggaattcattgatttccattaattaattcgtgttttattgatatcgaattgatacttaataattattaaacaaatatatgttacttaccttattaaataaacatttattgtttagctcaaaggttttaatggttccttgttatgtttttatcttctgttttctataatttgcagcattactccatacatttcaattagatacaagcaaatttttcttcatttggaatataatattttattgctttctaattcttatcggtgtttttttgcatatttttttatagtttggaaaaaatatataaatttttaatatgagccattgatattatcattgtttatttacattccattataaaacaaataaaaaattttcgaattcttaagtctaaaatctaattaaagccattaatattttgtttttatttgttacgcangtttttttaatataaaaatatataaaa

SEQ ID NO: 4222 - DNA, 2142 bp, Heterodera glycines
  misc_feature (2120)..(2120): n is a, c, g, or t
ccagttgaataggcttttatattacattaaaagaatcgacattcagcgaaatttggaaagggcacgatcagagaagcagaagcagtggtgaaaatagtgtagaagtgatagaaagaggcaaaaattggcattttttcgggtgtatgcgattgaatatgtaagctatgaggggttgcaaatatagcatgcatagcccaaaagcttcacaattttggcatattgattgaatacattttattgcctcttggcgatttttattggatttggcaatatttctactgatcatcctctcccatcggccataacccatgtttttaaatcttgcataaaattgtggattttataaattgtaggtgatcgaaattttaacaacaacaataagaaaaattaaaatcctacaatttaaatttaatctatcattttttttttatattttggttgtttttgtacatatttctaacacatttcgtgattttttacatacatattttgcgattttcttgcatataatttgccagtcctagctataagttttttttagataattttatttttttttttttttacatataattatcccaacagcaaaaataatcattatgtaatttttattacagataaattattcatctttaacaacaataataaaaattaaaatccctcgtacaatttaaatttttcattttttttgctccaaattctttcacatcaaaacatacatatcatcaactcacttaatacgacatggagtggaaattgatgagaagaagaatgtgagtgatgaatgcatggacaatttgtcaaaattggaaccctccaaaaaagcatttttcggcgcaccaaaagagagagaatttttgggtttggcgcggcggcggcgctgtgtttttgggcttgggtcagggacgagtttaacgccgcaataaataaatttttgtgtctttttctacgcccctcccccctaatttgttgtacaataccaattaaaaaataacattttatattcaatgttatgttatgtttgttatttatttgtcgatgtaactgatgactgaaaaggtttttattattattttttttcatttacccatacatatatttttttctcaaaaatatcatttttaattcaatttaaaaataataattttttatataattaaaactgtttttgttggtgccaaattatttatgatggcatcagatcatgctttttcattgtactaaaacaaaagttgcttttttcaaaaaaataaaaaatttttacgtccggtaaaaaatgtttttattaaaattaactgagttaatcttaaaatatttattgtttttagactttttttagtgaaattggcaatatttttgacttgtgtgtttttttgtcaatttgttttaatttttatattttatttattttttttaaaatttatttatttatttttaataatgagaggagccgtagaatttgtcccatcaattttttgtcaatttcgattaaattttattatatcttttttttgtcaattttccatttactttaaaatatatttttatcaaatgagaggggcccaaaaaattttgtcccttcaaattttttgtcaaatttctttaatttttatttacttctgcatttttttttcttcaaaaaatatttttttaccaatgcgaggagccgaagaattttgtcaatttagtttaaatttatattttttttcgaaaatatattttttaccaatgagaaggttcgaggaatttgtcaaatcgagtttttgtcactttttcactaattttttcatttttttttctcaaaaataaatttttattttattttttttaccaaatgagaggggctgtcgaagaatttgtgtcccgtaaaatttttctctcgcgcaagacgtagaagagtcgcgaccttaaacggatgacgacgatgacaaaactcttcctcacacactcacaaccacaacagcacacagtcacattaaagcactgcttgctgctgccgttgctgtgaaattagggacgaaagaatttttttgggggtccaacgcccaattttcccgtcaatacacagaaaaaaaaattcggttgattttgaccgggggaaggcaattgaatgggatganattttgacggtgcttttgctta

SEQ ID NO: 4223 - DNA, 2972 bp, Heterodera glycines
  misc_feature (62)..(62): n is a, c, g, or t
aatataaagaaaaataaataaaaaattctatttaaaaaatatacttaatttaattttttttngaaaaatattgaatttaaaaatgcttctggcaaacaaaagctgactttcaattctttctagctgttcccatttctgaaaaagttaaaagcacacgataattgtattatgatgagtcctttcaaataaatgcaaaatttaatttaatttgtttattattttaaaaggaattttatttgaataaaatgacaacatccgacaatgattcttatgaatcgtgcattactattgcagaagatccaacagaattagcagcacatgacaatgataaaattaaacaaacaaagcactcagcagaaaatgaggagaacaaatgtttagcaaaattagtgagttttattttttgataaaattaaatttgacgtggggcaaatccccgactcttacgttgaaaatccagtttttggggtttacttgacattttgaagaaccaaggcactaaatgctcgatcccaaatcccaacccaatttctagggtccacaaccaccaaagacttggaacctctcgatttttcgggatttcgtgaattttcctaataattttcccgacggcatttatgaccccggcatgaattcggccccaaaagtattcaacagggacgcacttgaattccttccaaatctcgattttggacctcagaatcccccttttctgtggtcttttcagttaatgaaacactaaatcacctattttccgagggtccacgaccatcaataaatgccttgtaaattcttaattttcttggatttcttgaatttttttataatttcccgacatctctgacccccggaatgcgtgcggcctcactggatcacgagggatgcactcaatttttaatattataattccactctatttttaattattttaattccactccatttttaattattttaatttcactccatttttcattattttaattccactccatttttaattattttaatttcacttcatttttcattattttaatttcactccatttttaattattttaattcattttttttccaattttttaggaaaacgttttgagcaatgccacagcaactgatgagtcagtgtccagctcgtccttcacaaattccatctcggcagcatccatcaattcaaggacagcacttggtgtgaaaaacaacaacaatggcatcaacaccaccaattcaacatcgtcggcattatcatcatcatctgctgctggtggtgctgctactgcttctgttcggcaccaccaacaacgtaatcgtgtcctctcatttcatctaaatggcactgtggtacatcgacggaggccaaatagtgcaagcaaaaatcccattcatgtaataaaaatttttatttgaattttttaacttgtttcggtatcattttaatagcgattagtctgttctctctatttacaaataaaattaaattttttattattcatttataaaaagattgaaaagaaacaaaaaataattttttttttcgtttctgcaccgcgcgaattctttcttttttataattattatttaaatttaaaattaatgaattaaaaaggaatttgaataaattaaattaaattattaaaaatttttattaaaatttatttcttttgcctgccaatttaatacagatgatcaccaatctgttcgcatcaatgatgggaggagaacgagctgcgcgaaagtatggcgtgaaaaggcaaatcttgcagcgaactcggagttcattaaggtgtttaattatacaaattagaattgatccgtcgaaacttaatcactttagtcaaacatcggcgtaattttaagaacgcttttgcgtacatcacgtcattcgtactggcagacccaaaatttactgatattttttatattacaatttttggccaatatttttgcgtatataaaattagcataggagtggcattgccgggtcccattttaccatttttttgataattaacccctaaatggcaaatggtcatttttaataacaaaaaacaacgactacaaatttctgattctcccttcagatttttttttattcggtcaacaaaaaaagactgaatatttttaattttttttgacgcattttttgcttagaagaccccaattggtcagtgttcgttcccgtggctctgtcttccatcaacaaaagcgtcgtgacatgatcaccacggatgacgacgacaaaaacaacaacaataatgatttggtggacacaactcgtgagaatgcttttgacatgttgttacgcttttgtgaaacgccggcggacgttgcctttctcaggagccatcctgatcagtaataatttaaaaaaatataatattgtaatggtagtgaacactgatcagtgggtctgaccaaaaaagagctgaaaatctataaagttttggtcctttttacagattttttccttacgaatttgttggctatagttaattgtagagttgagcgggaccgggacctgaacacggacaactgagtacaactgattaccgaagtcccgggtttgaccgggaccgggactagtcccgggtttttcccggttttcccagccaaaaattcccggtttttcaacccgaaaaggtcccggtcccgggtttgcccaaaattcccggtcccgctcaactctagttaattgtcaattcgatacaaagatcagaaaaaaaattgtgtcacacctctgctggtgatgatcgcgactgatcattccgagtatcgacattgtgatttcgaccattttttgagaggggagggggttggaaatttagggttccagtccatttttttcatatcaacaatttgttcactgttcattttaatgttacttttcttatttaattataatcaataaaataaattaaattttttattagtcttgaacgcctcggcatcccagttgagcagtactcaacaat

SEQ ID NO: 4224 - DNA, 3199 bp, Heterodera glycines
actgcgtgaggcagagcaaagggtccgcgaacggaaccttccacgcgagaaaaaaaagaaatgaaatttttaataattactatttaaatctctactttattattcacattctaaaaattgaaacccaatttttatttttgattaaaaaggctcttagtaagaattgttattatgttaaactattaaggctgattaaaccatttatttgaatttgaaatttgtctttgaatttttaaatacaattgtgttcatggaaataaacgacgcaattgtttttttgaaaaacacaattttctttgaaaaaatctgatttcaaataacattgctattgcaaagaacttggcgttccgtcactccattaatccatttgcagtgagggaggatgcgcgtgaagcatgctttgaaaaaaaaataaaatttaattcttttttaaaatacatttattttactcttggcgccaatttttatttgttttcttaaaatttattttaaaaagtgaatgatttcaaaaaatcaattagaaataatgaaaacattaaaggttttgcattttttgatttcacaaaaccaaaattttgtacggagttaaaaactaattgtttaaattcattttttaaattaaattcaatgtattttgatcattccttacacttcgattggcactcctccctatgcccttttacgattccaataagtgcccaacgcccatcggcaagttgtcgcatcaatggtgcaccagaatcgtccttttgaaattaaaaaataaattatttccgaatttttaaatcatttttttatcatttcaaggtaattattgtgtttaaattgattatttaaggttaattgatgctcaggttggtctaccactgtagtttgtcgcgctttatttgttgtacatatcaaatttgtcgggcatggtttgttgacacggattgtaatgaggtcttcgcgcagggccgttgtttctttcagatggtccgagctgttttcacgagctaaatatcaaaatatgaaaattgcaataacggcatattaacgactgagtttttttgaattaaaagattgaattttcagaataattgggattttgtaattggtccaaaattgcttaattaaattataactgacccccaaaagtgtcgccgtatccggccatgtaagcaacttggccagtccgtggattgtacgtagcgggcatacaaattttgttgattttggtgctcacggacactgggtgttgaagctaagaaatgaacaaatgaattaactcattaatgatctatatctttcttaattacctcgagaatcgaaatgtcgtcgttcagttcgtgctgcctgaaagtttgcagtttgaagaagcgcttgatgccaagctttgacgaattccgaaaatcaccaccgcctaatgttactttaacatacttgttggtgacaaggaaactgaaaattaaaaaatatttatgaaaatatataagttttgattattagtgaaaaatgtaatatttttaaaaatttaaaacaccttgtgccctcgtcaaactctccttgaatttgattgtctttgcatttcatgaatgtttcggcaggcaaataaaggcaatgagcagcggtcaccaaatgcttttccccaattaaaacgccagtacacaattgaagaagctcgatttggtttgtccgcttcgtcacacactccaattggacacttgcgacccatggccattcctcatttggtgactgttgaccgtactccacctgcgagtacagtaattaaaatttaaaaaagttttattattgcacattttttgaatttataatttatttttgtcactggttattaaatgaaaaaatttatgtagttaatttgttaggagtctttttatccagctgtgttaaaataattgtttccattttttcaaaatttgtaataattacggagaaaaaataactgtatccgtagattattattattttttttactctgttcgttgccgtttggccacatctaatcccacgatcgcggcccaaaatctcttcggcctcttcctcattttcaattggcttaaaaatccgcgacgcattggcgatggcgacttcatcgcgcacatctgcatgaaatgcgtgccatgcagtgcttttgtcgttgcgatttatgcccttttgaggcaaaaatgccgacgcaaaaattgaaaggcaaccaaaaataaggaaatgcggtaacagattcatttcttaatttaattttgcaattatttttacataaaaaaagaatttttattaatttaattcgacaattttttattacaattaaaacaataatttttattaatttaattcggtaattatttttacaattaaagtaagattttcactaatgctttaataaaggatacttaattcatttatgtaaatgggcaaaaaattttctgggcatgatgaatattaataatcggacagaaaatgtcaattgttggggatgacgaataattggagcgctaaaatgaatgtcaaatggtgaaataagctgacactttaacttgcatttgtcaactgctgctggtgcttgtttgcaacatttaattataaattatcggcatagttaagtctcgattgaactgtttaagaaaatcgggaaatcatgattgagaattgaatggaatttatcattatttaagcgagaattgaaacagaaaaagctgagagttgcaggaagtggctaactaattaatatgttagactctcgtgagggaaaagtcggggacaattgggacggggcttaaccctaatttaaataaataattttttgttgaaatatatccatatatatttttgttgggtgaatatttaatattaatctgtttggtgaagcagagacagcactaatcagaaagagatttccagcagataatggcgattgattatagccgaatgaatcgctcaaggtaacgtggatggaagatttttagggcttttactgtgtggtgaatgttaaatgatttagggttttagcttctgaagaaaataattttaaatttcttaaccttttttagaaaatttctacaaaaattgcgtctgatcatatcattcaaaaattgccaaaaaaaattatggtttcatctcgataatcatcgccatgattttgtttaccacattgtcgccaggaggaggcatgttcaggatatgagataatgacacctgaaaa

SEQ ID NO: 4225 - DNA, 3884 bp, Heterodera glycines
tttccaggttaattttttttccaattttctttcttttttttttattttcatgcctttcttaattttttcaaaatcaaattcatatccaaaatttataacatttttccaaatcatttcattttcaatgttctttttctcattcatatgcatttctttcaaaaagaatcaaacattgttcttgaccgcttttttccggagctttgaaccgggtttaaccgcttttttagacgggagcttggaacccgtttggttttcagagatttctgaggaattattttgtaaagaagatgaagaacattgaagctcagagggaaataattgtttagttcgaaccattgcaaatctaaaaaataatttttgaatatatttttatagctattgagagcatttcataaaagattaaaaacaccttaaaaaattatgaaattcaaaaaaattatatcaaaaaacgattaaaacaaaaataataatgaattattagaaaaaaaatggacattcacaaaaatgtgataataatttaaaagaaaaatattaatgataaaaagttcctttaaaatgaaggacacacaaaggaaaagaaatccattcggaaggggaaacgtaaaaacaaatgatgaaatcaaaaacgtaaataacaaaataatgaagtgttctcttcccttcatacataatcttttattttatttttctcttcctttaaaacataacgccaagcaaattcaaaaacacaaaaaggggcggagcttcctctcacttagtatagagtaagggataaaattttttcctttggacgtcatttttcgtcactagaaatcacttttttggcgttttgtcactatttttcactatttcgacattttttggaaaatttattaacaaaaatgcaataaaatcaaaaaatacacccctaagaatcgaccaaaaattttttttaaaatacaccactaagaattggaaaatttttcaaaaattcttcccccaaatttttttcttgacaaaatttttgatttaaaaaatgtcaatatttgctaagagaattttataacggaaatgtagctcatttgcagctgcaaccagtgaataaaaattattttttgctcaatttttggctaaaaattatgtcactatttcggacttttttcactattttgtcactttttttggcactttttcgacactattttagttaactatttccggatttttagtcactaaaagtcgcggccctagttattactattgttatttttgataatcattagctcaaaacttatttataatttgctttatttttgttattttgatgaaattatgtgtcacttattttttttaaatttgattattgtacgaaacgcaaaattgaaacgttgtacgaaccggcttttgtacgaaactccattgtacgaactcccatgaccccacgttttttgtaggattcttcaaaggtttcagcgcaatttgcacaaagaacaatcgcaagagagaaaatgtccatttcgttgaaacattcgcaatcactgccattgatcagatcaaaaaacagttataatggaaatttctaaaattcaagaacgcaaaaaaataggtatatgaaaaatgtagtttacttaatcggttttttttgttgccataatgggtttattttttgcttccactgaccattttactcgtttcaccgcatgtgcttttttttaaaacgtatttgccattcacgtacgaattccatcccctgttgtatagccttttttacacatatgaaagagaatatcacacaaaaagaaagaaacataaatgatgacaaacaattaaatggaataataaaacaaatgaacggcaatttgtcagcggagaaagtgctcaaaagggtctttcattggttgccctttgttctgtgctatgccaccatttctcgctgccccttctgtccaatttgtttctgtcctcttcacggtcatcactaattggtcaagggcatcaaatgggtctttcggtgctgtcgatggccgtgtctcaaccattcctaaaatatgaatttgtgctcttccgttagttcgtttctctttgtctgctaatttaattttgccgcttctcccctttacctcttttctgtacgggattagcactgctattcggctgaggaattgttgggaaggcggcaaatgaggccgattgtgaaatgtggggcagttgctgattttgttgttggtcaactgatacggaatgagatgaagttgtgggcaagaattcggagagtaaaagttccatgcgattcgaagcttcgagcgaactctgcggacgttgttgaaccgactggcgggaagagagagaagacagcgaaaaggggtcgaacggagcgtttttcgacgccgtcaatgttttttccatttcgaccacttggccgtttttctctgccacaatgcgccgtttttcatcgagtgaaagtgctccctaaaaagttcgaattaaaaatgaatggcacacaattaggggatgggacaaaatttcgccgccgaaatttcgccgcgacataatttcggataagaataaaaaagagttatatagtcggagcaactcgtttaatcccccgttttttctcatcgtaaggcttttgttgcgtttgaacatcaatccgagtcccccccccccatacctttgccattgtttcgccactgttttctgtcgtcccactgtcccttttgtccgttgttctgttgcagatgccatcatttgccgatgtgccgctcaatgctcgtgccaagtcgcccaaatcgacttcgctctgattggttttgttcatttcattcgattgggcattcagaaagtccgcaaagtcagtgattttccttaaatgaaaacaatcgcttcaataacaaatgcgagtggctcctctccgtccacctttgttcctcctgactggcactcagctgctccaaacaatgcctttgctcggtttcgacccgtcggatcagttgatggaccagttccatgtactggccgaactgttggaggttcagagtgggctcgactgcggtggaaataagataaggtagcacactccgagcaccttggacacaaaatcagctttcatcaattagtaattatatttttgttgatgaaaaataaattttttaaattttcccaattttgccctccctaacattgctctttgttgatcccgaatttggtgttttcgtgaacaattttgtaaatgcccagcactgccatcaaaacactcgggtctttgctggttattttcggtaaagcgggcaacagctgatcagtgaccatccaaggctccatgtggggaagcaatttggccagacaaaccattgtttggacacgaatctaaaataagaaaataatatttctctccccccccccattattgcaaaacaatcaacttataatgtcaaactctttacaagtgattaaaaataaaaagctaatattataaagcattttttcgaagttttgaaagtaaaataaaaacgaaaaatgaattttagaaaaagtaattgcgattttacggaaaggtcctttgactcgagcataagacggatgagtttggggatcaattgagttcgcatttgctctcggtcgacaaatttgacaatgttcggcacttctataagggtcaactcctagaattttgtgggaataaaaaaccaatgttaggtttcttttcaaattgattaactgaaaacctgcctggactctgacattgtcgccggtgagagaattgtaaatcaaagggagcaaatgctgttttacagcatccggggccattttttccagaaagtaaaataacccgttgcataagcaaaagaccaatctgaggggataaatggggtgaaattaagcaaattgggatggatttgggcacc

SEQ ID NO: 4226 - DNA, 1328 bp, Heterodera glycines
ctatctctttttctgctcaacagtaataggaattccaaccgcattctcagaacaattacgccgatactaattgttctggaatttgtttctcggcgcgtttgtttgggagaaatttggaaaattggctatctctttttctgctcaacagtaataggaattccaaccgcattctcagaataattacgccgatactaattgttctggaatttgtttctcggcgcgtttttttgggaaaaatttggaaaattggctatctctttttctgctcaacagtaataggaattccaaccgcattctcagaataattacgccgttctggaatttgtttctcggcgcgtttgtttgggaaaaatttggaaaattggctatctctttttctgctcaacagtaattgttagagaaggaagtaattattgattaggtgtatgaccccacgccacttcgccatcttccccctcccattcccctcattcagttgttattgtgcccaccaatttgacctctccaatttatttctgcatttttatttatttatttcttcggcaaataaacttatttaattttttatcttcggacataacaaattttggcgcagtcagcaattaactgcacatcaccggcaaagcaacaaatccgagctttatctcgtgttgatattgctcgagagggaaaattagaaagctcgtgttgatttctaattttcgcagatcatcaaaaacttttctctccgtgtgagattaaagtctgccgtgtgcagtttttcttcaattggccatggacccgcagcaacttcaacaattgcttaatgcactgcaacaaatggtcacaaatgccgcaccgcaaaacgccgcaccagcaaatttgagcaatgccaatttggcaagctctattgatgctcggctttcagcattccattacaatccggaggtcggcaccacatttgaaagttggttcaaacggtttgggaaattgatcgaggacgacggaagcacactgccggaggcctcaaaagtgcgccttctcctcggcaaactcggagaggaggagtacagcaaatatcgggacacgatcagcccaacccagccggaccaagtgaattggaatgacacgatttcgcacctcaaacagctttttgccgagacacgttcgctgtttgtcccgcgctacgaatgtgtggaatctgccattcgtaattttaaccatttttgtttttcgcctttttgtcccatcccaggccttctggccgtccatcatcctattcatccaaaatttcccttccttttccaattacctatttttatgacatttccccaatctctcttggattc

SEQ ID NO: 4227 - DNA, 4591 bp, Heterodera glycines
  misc_feature (38)..(38): n is a, c, g, or t
  misc_feature (74)..(74): n is a, c, g, or t
  misc_feature (153)..(153): n is a, c, g, or t
gttttccgttatgaaaagctgcaaatgacaaaacgccnaaggaaaaaatatcgacgaaagtgtcacagcgaagncccctcagcaagttcgggagagacaaagtccaaatcggggacaaagcgccgattattcattttgactccatccggggancggcaaaattttacctgtttatgatcgattattggttaaaaaagcatttgatttatagggcccggattggctacacctcttttgagattatcccattccgagactcagtgagaatgccaccttacggagcctcgacatttgcggccccgacatttgcacctatgtccaaaatcggattcgaagtaaaattttttcaagccctgatagccgaaatagcattaaatttaaaacacattaccttctagtttattaggaacattaattcatgatcaaatgatcggatactgtggaatctgccattcgtaattttaaaccatttttgtttttcgcctttttgtcccatcccaggccttctggccgtccatcatcctattcatccaaaatttccttccttttccaattacctatttttatgacatttccccaatctctcttggattcccttcactcacatctcactcacaatttgctatgtaatatccttctgttcgcccctcccaatttgtggcactatttaagcctttgcttctctcattcagcacctttttttccccacacattcccaacttcagacaaatcctaaaagcgatctttttcaactgttaattaatttctttgcatttaatcacatttaacctttcgttttacctttgctttctgacttaaataaactcttttccaaaaacccttggtcaaaggaaaaagggttaagaaccgggaagtccaagtggtttggacacaacaactttttggtgccacgacccgggacccctaaaaaggaatttaggggaagcaaaggccaagagccgaaaaaaggctaagtgccggaaattttgagctggtaagagctgtgtgcttccagccgggctaagtgccaacaaacgagtgaatttgagctggtcaagctgcgtgcttccagccgggctgagtgccaataaaaacaacaggaaaagagctggtaaaagtgtgtctttccagccgggctgtgtgccgtacttttgaaaaaaaagtaaattacgctgtgtgcgcataaaaagtaaaagagagagaaaatgacgacaaatttgcctcaaggcaaagaagctcaaaatagtgggtcagattttgatccgatttacttttcgcctgaggagaaccaaaaatgggcgaatttgctggtcaggatgagagcattcgagcaggctgtgtgccgacaatttcgtcaaattgaaacccaatttgttcaaatttcgagtcaaattcaaatttcaaacactgttgatcgtgtccgagaattagagtcttctctgagggaactcgagaatacaatggaaatggacacatttcagactcaggaaaaaatgattgatgttgaacaagaagttggtaaagtgaatatgagaatggattatcaggaaaggctgactaaagtgcgtttcgggaaaataattgaaaaaatgaaggccgaagtgagcaaagttttagagagtcttgacactctccaggcaagagttcaaattttggaatatgaacaggacgaggaaattggtcgaacaatgtggatggaggatgggcattcagaggaacatgcccaattgccgaccaatcaggaagaaaacggagaaaataatcaagtgcaggaagaatgtgaaataatgatttcagacccatttttgggcgggatatcgccattggaggggtacgacggaaacccaagtgtttcattttcgcgatgggtggcccgttttgaggatatgctaactttgtacccgcagtatacggaaacgcaaaaattaagcagattacggattttgcttaagggccaagcgagggccgaattcgaagcaatggaaccccctcccacgagtttatccgttgctttaggccatttaaagagtaaatttgagaatgagaatacccgctctatagcaagacaggcaatggctagctgtaggcaagcgcccggagagcgcgtttatgagtttgccaatcgcttaagtgaagcggtcagaactgcgttggcgggagaaaaagaggaaataataagaaaacgtctttttgaggaatttttggagaaattaacgccggaattgcaattcgaagtgaaatccggcaggccatcaagctactccaacgcttacgaacttgctcagcattttgagctacttttggccacaaaaagggccaatcacgtctcagttgctgattcagttgccgaattatctcataaagtcgaagcgctgactattcatcagcagccaattcccaacagaaggggtagcgaaagacgcgcctgctattactgtaaacgccccggacacatagtaaaggattgcagagataaaagaagggacgaagagcgcagatatcggggagatcaaagggatggccataaatattttggaggagaaaggcgatggagtcgagagagaaattttagagacaatcgcaattttgcccccaggggaaggggccaaagggatggaaggatccatcgcacacccaccccttatggtgaagaaaatggccagaattttgaaagtgcgagaagacattcgcctgggcggcgagtaagctttggcgggagagttggagccgcaagaattgcgagtccactttttctggcactaattatggtcatatcgctttttggtcgtaattcagcgaccagtcaaatggctagtccaatgatatgccatccggactcaccagcgagtttgtggtctattccggtggacccgatttgtcccacttggtcgccaacagagataccggtcacaatgaaattgtctgtctatcgattgaacacaatacagtataaaactgcggcgacagcttgtaaatgcataaagacaaaaatttctaggagaattggattttttggtgggcgatatgaggaggtggcaacaagcccaattgaaatgcctacggcaacatgccggaaaatgagagaaaatggagaatcgcctgcgggacaattagtacagataaatgggatttttagggcaacccaaaattcgttagaagttgggtggagaaattggccagcggcgatgttttggagatcaacggaagtgagcaattgttatgcatatgaaactgttgtgttcacacgacacggaatggagggacttaacacaccaacaaatgattgtcccacctgtgcttatcagtccggaagttgccgctgtccacaaatcagcttaatttggaaaccggacttaactcaacggtgtgcttatgtaaagattgccgagtggcaaggagaatattcctcacgcatatggacagcggaaagtggggattttgccctaacatttgtaaatatctctgagaaaacggacaccaatggaaatgactttgtgatctctgatcagacattcgctgtacccaaagtggaatttgttgaaatgttaagaaaaagtgaacaggcaaatacaaaactaagaaagaaaaggtcacatgcatttattaatggggttagacgtgaatatgtaataaatgagacggataccactgtaaaatggcttgagccggatcaagaaacaaaggagttggaaaaagttgggctggtgtattcctcgcagctggcagcacagcttacagcgttaagtgtcaaagttacagcaaatacacaaaaattgtttgctgaaacagtgcataaaatatgcactagcctccgatttctcgccgatcagacgttgactttggcggaggcaaatccaacacttttggcccggtttttcctagcaaacccttatttaacggcacgattggtgacaaaagatatgttggaaatcagaccatgttttgcagtaaatgagagggaactgcattttcattggcaaaatggaagatgttttgagagacttccggttacatttcggctttttggaagctatgaaaaaacgaaacatggatttttagacccaaaaacgctaattatacactcaaatgcgagagaaaatagttgcaaagatttccgatacttatatgtgcagacaaaagggacacattctcagtatgaccaaataactggggatgttaaagaaatttcttcggaatcgatacattatctctcacgtcaaggaaaaatcgatttcccagaaatgccaatccaatttttcagaaataaagtgatcgcaaatttgtccgtgttgtactcaccggataattttgcggaaacaattgaggttgctaaaatagcacaagaaattgttcggttgaaccgaccgaatgcatgggaatttatttctgaaaagagtgatcatatggccacaaatattgtctcaaatggacttttctcattcctaaggggaggtttaatttcggccaaccaaatgtgggtgttcatttgttgctgttatgtttcaatcacaataattgtgcagctgatattgccagcaccgctggcacagacaatgcagtatttgggaattggagggatattctcaataaa

SEQ ID NO: 4228 - DNA, 1099 bp, Heterodera glycines
  misc_feature (93)..(93): n is a, c, g, or t
tatgtttacaaaacccatgaagatgttttttccacccatgattatgactcgggggaatgttaaataaatgccctcccattttgacaaattcanatgtgccagagcgggtcaaaccatatcccgtaccggaaaaatacgagaaagagctgaaattgcacatgggaaaatgctcgaagccggcgtaattaaagagagttgtacgccatgggcccacaacgttgtgttagttaaaaaatcgaatggccaattgcgcccatgcgtggattttagaccattaaataaaataacaattccggatccgtatcccattccacgaatggacaaaacaattttaagagttgccggacaaaaatattactcgacattggatttgtcgtcgggtttttggcaaattccgctggattcggaaagttcctataaatgcgggattgtaacgccttgggggctttaccaaatgctaaagctgccctttggcctaagaaatgcaccgagtgttttccagcgaacaatggataaaattttggaaggaatttcgaatgtaacggtttacattgatgatattttagtccatacaaattcaattgaggagcacttgaaaacgttggaattagtttttgcccgtttgcggaaaaatggtctgaaattaaaaatgagcaaatgcatgtttttgaaaaataaatgcacttatttgggccatattttgactgaaaaaggctatagaccttctcttaacaatcaagaggtgattgaagcatttcctgagcctagaaatgcaaaagaagtgaaaagatttctcggaatgatgtcatttttccggaaattcattcccagttttgcttctgtggccagtccaattcaaagtttagtaagaggaaaaagccccgaatttcgatgggaggaaccacagagaaaagcatttttggaattaaaaggcaaattgttaaatgctccgtgcttaagagcaccgaattatgggctcccgttttacctgttcaccgatgcgtcagccgtggcatatgcaggagcgcttatgcaaacccaaaatggggaggatttgcatgcggtggggtattggtcgcggacactttcaaccacagaa

SEQ ID NO: 4229 - DNA, 2848 bp, Heterodera glycines
agtgagagtgagtgatagtgagagtgagtgagcgagagtgagtgagagtgtgagtgagagtgagagtgagagtgagcgagtgagtgtgagtgatagtgagagtgagtgagagtgtgagtgagagtgagagtgagcgagtgagtatgagtgatagtgagagtgagtgactgagagagtgagagtgagtgagagtgtgagtgagagtgtgagtgagtgatagtgtgaatgaatgtgagagtgagagtgagtgagagctagagtgagagtgagtgagtgtgaatgagagtgagagtgagtgagagtgtgagcgagagtgagagtgagtgtgtgaacgagcgtttgatcgagcgtgcgttaagtgtatgagtgcgcgcgttatgcatgtgcgcgtgtgcattaagcgcatgcgcctgtatggccgtgtatccgtgtttgaacttgtatgtgcgaaaatgagctgtccaaataaatcccccgcagcaagaaaataattttttataatttttctgccaatcaatattcttcgtgacaaccgaaaaaatcggtgccacccaaaaaaatcaacgccagcagttaagaaaattaagagactcccatctctctaaattccaccacctaataccctcaaaaactgttgtaaacagcgaaccatttttattttatcgatcaatatgaaaatagtaatagaaaatgagacacatttgttttttaatattgtgatttgtgatcattatattatagatatgcacttagacatctcttctgtttaatgtccctattcttccctagaaatcccttttttttttttgttttcaacatatttttacacatattttcatattaaacggtaataccaacaaattaaatggtcgaaatgtcaacattaaatccgcgtccaaaattaccaattttaaattttcttatcctcctggcattcttttaccagctgtcacccattcccctgcttcccttagtacatcaataaaaattgtcgttcgcccagcggaaaatttaggtcagctgttcattccggatgttagattatatcaacacaacgagaaattaactttttttcaccaaagatattttattatttaatagaaaagaataaacagaacatcggcaactaaattgcaagaaaaatcaaacaaaaaaatttaaaatagtacataatatggtaaattaatcaaggatcgattaggttcaaaattatgctcaaccggctgatgggcgggattagtatttgtaaacaataaagtggaaagatcataagttgaagaggccctacaattataattaatacaacgatatctaatgccacgccgaattcccgtttctttctcgattaatccttcacttctaaaccaaatcccggacaatagtacatactttctcggtatgatgtcattagattcggtgatagtcgggcgacagtttgggtagataggatcgaacccatgcccatagttcaatatgtttttatacttggtgttccataattctgctgctcgagcggtgtcaccatcttcacatttaagcacataaagttttgctagctcaaatgcctctataaatgcatatgtatagacgccagagcatggtttagaatcaattccatatggaatccaagacggtggaccaaaattgtacgcaacagcacaatttaatccctaatatatatcaaaaaattttggctcaaagttttttttctcaccgttgaaaacccaaaatgcacagaacccgggagagttattataccctcaccagcacgctgaacctaataaaatataaacgttttttattataataaaattagggataatattttatatattaaactgatatggttataaaatttctttaaaaaaaataatttccaatcactatgataatgtttttgctagtcacaagcttcgaaaaaatattcaaaaaaaaatgttttagataccaaaaattactaaacactatgtaaaaatatatttttcttaaaatcttatctttattgataactcacagttcggatacatcggatcctattttcacggatgatattagggttcaccaaaattgacttattccgcaaatattccggatcatttgtgaattctttaacaaaaaaggttgagagcagatttttaaatttcaaaaaatctgccgccggaatcgaatacctgaaaatacattgtcataaaaagacccccctcccccactaaaagtaccatatagttatgccaacattgtcagttccgcttgaagggcacaataaattcacactataaaggtcagaattctcagtgtgggcggtaaaatatgagccggcttttcgtaaataaaaatagggcgacgtaattccctcaattggaacaccaagaccaccattatttgtcgataaaaactgtagttctaagatggagcccaaagatggctgccagtctttgtcacccttttgcataggcaattcttgggcatattcaaatattctttgttcttctgttacgccattccaaaaaacgctaaaattttacttctgtaaacattttctatatattttaagagttatgtcagtaaaaatacagggtgccccaaaggttctgagagcctattaaaattgttaaaactttatactcatctgtctgtcagacaaaatttccgggtgcaaactatctttttaactttttattatcctgtttatatgctaacctatatagatgggatggtcatttaaccaaaaaaaaaaaagaaatttaaaagaatttatttcaaactccacaaaacaggggccattgataattccctgcttaaattattagtgaacaaatagaccacaccttcatatagacgatttcca

SEQ ID NO: 4230 - DNA, 2998 bp, Heterodera glycines
gaaattaattttttttccccaaagatttttttttttttaatagaaaaggaataaccagaacttcggcacttaaattgcagaaaaatcaaacaaaaaaatttaaatagtacataatatggtaaataatcaaggatcgattaggttcaaaattatgttcaaccggctgatgggcgggattagtatttgtaaacaataaagtggaaagatcataagttgaagaggccctacaattataattaatacatcgatatctaatgccacgtcgaattcccgtttctttctcgattaatccttcacttctaaaccaaatcccggacaatagtacatactttctcggtatgatgtcatcggattcggtgatagtcgggcgacagtttgggtagataggatcgaacccatgcccatagttcaatatgtttttatacttggtgttccataattctgctgctcgagcggtgtcaccatcttcacatttaagcacataaagttttgctagctcaaatgcctctataaatgcatatgtatagacgccagagcatggtttagaatcaattccatatggaatccaagacggtggaccaacattgtacgcaacagcacaatttaatccctaatatatatcaaaaaattttggctcaaagtttttttttctcaccgttgaaaacccaaaatgcacagaacccgggagagttattataccctcaccagcacgctgaacctaataaaatataaacgttttttattataataaaaatagggataatattttatatattaaacagatatggttataaaatttcttttaaaaaaataattaccaatcactatgataatgttttttgctagtcacaagcttcgaaaaaatatacaaaaaaaaaaatgttttagataccaaaaattactaaacactatgtgaaaatatatttttcttaaaatcttatctttattgataactcacagttcggatacatcggatcccattttcacggatgatattagggttcaccaaaattgacttattccgcaaatattccggatcatttgtgaattctttaacaaaaaaggttgagagcagatttttaaatttcaaaaaatctgccgccggaatcgaatacctgaaaatacattgtcataaaaagaccccccactaaaagtaccatatagttatgccaacattgtcagttccacttgaagggcacaataaattcacactataaaggtcagaattctcagtgtgggcggtaaaatatgagccggcttttcgtaaataaaaatagggcgacgtaattccctcaattggaacaccaagaccaccattatttgtcgataaaaactgtagttctaagatggagcccaaagatggctgccagtctttgtcacccttttgcataggcaattcttgggcatattcaaatattctttgttcttctgttacgccattccaaaaaacgctaaaattttacttctgtaaacattttctatatattttaagagttatgtcagtaaaaatgcagggtgccccaaaagttctgagagcctattaaaattgttaaaactttatactcatctatctgtcagccaaaatttcctggttgcaaactatctttttaactttttattatcctgtttaaatgctaacctatatagctggggttgtcagttaaccaaacaaaaaaaaaatgaattaaaaaactttttttttcaaactccacaaaaaaatgtccattgataatttcctgcttaaaattataagttaacaaatagaccacacttttcatattgatcggtttccagacatggccactgtgtattttgcttgtaatcagcaatcgttttgtactcctctgataaaacgttttgatgataaaatccagaagcgcgcttttttaattggcattgacttaaaaaatataagaaattatttgatattaaaacaaatataagaaattatttggtaataaacaaacataaaaaaatatttgatatttttaagacaaaccgaacaagaacacggtttcggtttgtaattctgcatataggaagttgaaatgattccggtatgcgaaaacgaataacaccgataagtcgcgaccagacatttagcgatatgatgttatcaaaaaaataatcaatatttgagcccaaatcatcagagcttggggtgatcgttttggcgccgacaatagagtcgtaatcacacatttcgagattctaggcgaaaaaaatacaaaaaaaagcaaacaataaattttaccagacaaaaaggaacataaatgaacacacagaacccctaaccccaccagcccccaaccccaagggcttctgcccgccagcagacccctgaccccaccagcccccagccccacgggcacctgcccgccagcagacccctaaccccaccagcccctagccccaagggcttctgcccgccagcagacccctgaccccaccagcccccagccccacgggcacctgcccgccagcagacccctgaccccaccagcccccagccccacgggcacctgcccgccagcagacccctgcccccaccagcccccagccccacgggcatctgcccgccagcagacccctgaccccaccagccctcaccgggttggaagacgccgaaaaatagcaaaatatgggtgttaaactaaaaaccccctaaatatatttatacgggcttaaaagttaatccaaatcaaaaaaaattttttgacgcaaaaagaatttttaggctcctttctcaatagcgtatgagcaaagaaaatatgtaaatccatgcaacgcacaactctcgcgattgttaatccatcaaaaagcgtatgagcaaagaaaatatgtaaatccatacaacgcacaactctcgcgattgttaatccatcaaaaagaagaacgaatttaatccaaatatctatcaattttaaatggtgcagaactaaaaataatcaagaagatattcaaatatttcaagaacaatacaattttagtatatttg

SEQ ID NO: 4231 - DNA, 5758 bp, Heterodera glycines
  misc_feature (68)..(68): n is a, c, g, or t
  misc_feature (121)..(121): n is a, c, g, or t
  misc_feature (134)..(134): n is a, c, g, or t
  misc_feature (183)..(183): n is a, c, g, or t
tttgaagctctatcgactcaatataaaaatttcgaaaatttttaaaattttcgagtttcccttaaacncctctaggatttcggaggccccttggtcgaaaaaaccaggctaaaaaatgttnttcgggggtaatntaggtacctgattatgtttctgacctttatttttcatttgggaagcttntaaactgtttttcaaaaaattcgaaaactctcagtttttggtccctgaaaatttgggcaaatgtttaaaaaaccgtaacataggtttgacaaggtcatttcttgcatttaaatattcaaaaaatgtagaaaaatacagagatttttatgcacattatttgatgtttttatcttaaacaagaaaacaaatattcaaaactttctgaaaatttttcgatttttcagaaaaaaatcagaaatcctttcagaataggaatactggattttttaaagattcaaaaaatccgtaatttttttctcttcaaaaaagtcatttacactttatagctgccatttctttaaaaaaatatataaaataaatagcgaatttgaatttccaaacaaaagggggggaggtttaaccaaatcattttcctaaacttttttcgattcataattatatgtgcattaatcacaaattgataactttcacttggatcaatattttggtatccgcaaaaaaagcgacgcgcgcatcggtccgaaatgtacccgggaataccattaggctgggggttttgcttggccggggtctctttacattttaatcgcttttctttggttttgcaattactctttttctctaattctctcatctctcctatgatgaatgcgcatctctctgcctaggggggggcccagatttttaccctaatactactggggtggcaataattatggcgttttaaattctttggctaataaaaaagcaaatttcactcattttggtcatttccattgaatccttttcatttaattcatttgatgattaaacaaaaaatttcattaattctttacagttaacattaattttttttagcaatttttaaattaaataaatttgctagaataaagccgtgaggtcccattacccagtgctaataggggaattaattccaggagaccttcttacgcgtccgtaattaggcccctcagggcttggaagggaagggatgatgatggatgcctggggacgtctcccaggcggggatcgattggccaagtctcttagatggctcccaactgactcgactgatcccgttggctggctctccattgccttttaagcgcccctcgggatgggaggagttatcggagtaataaatgggcgtgggaaaatgccatttccggtcaaggccttacactaggataacttttaggtagaacccaatctaacattgatgagttaagtccgtcgctttttaaattaatgattctgttttttatacacaaaaacctaattgacctaaaaaatactcaggctaaattcgaaaaaatagtgagatatcccggctggaatcccagcactaaaagactcccggatcgggaccatggcaaaatcgggattggaatccgagcaaaaccggggtattcatcacggaatcctattacggccttctgccaatcccaaatcccgatttttttcaaaattccgggctctatgaccaacaaacatttattttttttgaatttctaatttaaggtgacagaatgaaatataccttttattattttgtcatatttgctgtattttccgatttgcatgtaaaagcattcacgccaaaagatgaagcaggtaaatctgtaaatatttgttgaactttctctaagttcctgttgaaatgtccaacaatttaacaatcattcaaccagggctgtaaatggcgttataaagaatttcctaaaatacgaaaatctgctggctatgccccttagccaattccatgaaatgcttatgtaaatcctcgtcttcaataaatttcgaattttaaggcaccagcaatggacaaattgtcaattcgttggcagaccaaatgaaggaagtgttggacaatggagaatatccggatgttcaatttttggttgggaaggatgacaaaaaggaggcgagtcaaaaaaagcaaaaaccatatcttaatgcccaaggataaacaattacatttttagaacatatttttatgtaaatcttgtaaattctcgaaaaattttctgcaaaatctaaaagcaaatgcaaataaattttgaatatagtttaatgatcaatataagatcaaaatttcaatgttgataagaccaataaatatgcctcggtagctcaatggtcggatgcccacggattgggatttagggtgggttcgattcccacccgagtcctaacatattatcattatttatttgtaggaaaaattactaaattctcaagacttttccgtcagccttttaaattgaatttttgaccttttttaagattgtatcagctcatagagcaattctctccagtgcatccgatgtttttgaagcaatgttccgttataacgtgcaaaattcaaagaattcaattggaaaaggtaataaatttattccaaaatcatcatttctattaaatttaattttaatttaaggtcatgccactaagaaaaacttaattttggtgccagacattgaaattggcgcgttcaaaacgatgctaagatttatttatacgaagagttttgatggattggatgccaataatttgttagaagttttaaaagctggtgaaaatttatgattgggattttaaataaattactatttaattatagctgacaaatataacatcagtggcctggtaaaagaatgtgccaacttttgtgccaaagtttcaattaaaaagttgccaaatgtatttgtggcttttgaacaggctttgttgctgaatatggaggtgaggaaagaattttaattattaaactcattattcatgtatctaaaattattcttcattactgacaaaaaatttacgggtgttcgttttttcaaaaattcaagacaattttcataaattttttgtccagttattttatttttatagagttgtacgcgaccgggacctgatactgaaagaacgtacaactgagtacctacgtcccggttttgaccgggaccgggaaaagtctcgggtttttccctgttttgccagccaaaaattcccggtttttcaacccgaaaagtactggtcccggttttctatggtacgatccccgacgagttaaagtaataattatataattttttataatatttttatttttgggatttttctctccgttgtttgcactacattgatcgaaatatcagtgctttgatcaaatcagaatcctttttgcaaattgatcaaaatttgttgtgtgaaattctcgaaagagatgagctgagaagcagtgaaatcgaaatttggaatgcggtaaattaaatattataaattacaattatttattttctaaaattaaggcactccgttggtccgacgaacagtgccgtcaaaaaggcatcgaatgttccgctgaaaatcgaggcaaaattcttgacccagttttgtccaacattcgttttccactcataccaaaagaggattttacaaaaagcgttggtaatgaataatattttgatgattagagagtttgctatcttgaaaatgcttgaacctggcttggattccttgttggacctggacctgtaatggttccaagtctggattaagggcttttcataattataccgtatttcctcgaataaacccccttcaaaatggggttatactcgagggtggggctttaatgttcaacccttttttacaaaattgcaatgtttttatgcaaatttttccaatagcaaatttttattagtctttgaaataggccaaaatttttgctacaatttaaatcttaacctgaaatttttaaattaaaaagatttttcattttttggcaccttggaaatttaggcgaatgcttgaaaattcataattcacttcgaaatggatcaattaaagtgcaaaaaagcattaaaaatagagaaaaatctggagaatttatactttttttaaggattttctagcttaaaatgaagaagttagctgataataaattttggaaaaattcgtttttcggaaaataattaaatcactgttatgaaaaggtatttttgaaagaaatatacgaaaaaaaatctgcaattttttccactataagattgcctttatttcttatcgaatcggaatcatatttttattttgcactaattataattctaataacctaattccatagacttaaaatttaaaagaccgtatgtcgtttttttaatattacaatgccccaggtcaaggccaaacttaattgatgactcattttatgaatgaattaattgtctaattaattatccatttcaatcaaatttcagttccaactggtgtgttaacaattgaagaagtgatcagcgtgtatcagcattattcccatccaaagtttgatgtccctgggcttatcaaattgaaatttcccacccatcaacgctacaaaaacggagaaaaaattgagatggaaattgaaaaagtgtccgaatttgcggtggaggaggtgggaagtgagcgattcagcgatgccatggatattgggggatttccatggaaaataatggcacaaattgaaacgaaatacaaaagcaatgagaaatggttgggcttttacctttccaacgatggccctaaaaaaggtagaaaaaaagtcattttcgtaaatctgtcagggaaaaacaaaaaaaatattatttcttactcattgttttaagcggaggaatacatttactaaattcttttttccagaggtttttaaatattatttaaatcattcgaactaaataaatgattatgtaaagaattttctacaaaaataaaaattcaaaaattaaaaatgcatgtgaaaaggactagtaaacttaataagtactgctttaaatataatgctaattttattaaatatttatttattgtgcagaaaattggtcttgtaaaagttcggcaacacttcgaattgtttcacaaaagaatggaacggaggatttaattggaacattcattgaccgcatttttaataaggaatgtagcagtcatggattttattatttcattagttttgcggtgagtgggattcaaataaatttaataaacttcctatcttgaaattaaaatttttaaaattttaaaaaagaaagtgacaaaaaaatgaatagaaatttttgaaattttttggttataacttgtaaatttttttctagattttaaaaaattaaataagataggatttgataggatatgtaatgcatcgtttaataccaatttttattaatttaactaaatttaagctaagttatggtttcttattagcaataaaattaaaactaataataaatttaaatgtttctatcattgacacttttgtaactttggctcaccatgattttatattacataattggtttaaaattaaagttataataggaaacattgctgattttcatgtttaaaaaaaattaattacaatatttgtcaaatttttgtatctcaaaataaatcactaaaaattaaggaattgttggatccgggcaaaggattttacgacaaagatgaggacaaagtcacattggccattaatgtcattgtggatgagccaaaaactgagaaaattatttccgatacaaacaaatccaacggcaca

SEQ ID NO: 4232 - DNA, 1870 bp, Heterodera glycines
tcattgcattgtcttcatttcactcataatcatgccccaccccgcggacatggcactagctgttccaacagctaacagacactctcaaaaacattgcaaatcaaaatgcaaatcccaataaacaaaactccgatttattcgctacaattaattcccaattgtccgaattcatctacaacccggaggcggatttggtttttgaaatttggcacgaacgttatgggccatttcttgagacagatggacaatcattgccagatgaaatgaagacacgtctgttggtcggtaagcttggtgcgcaagaatacgcgcggttcacggagagcattctcccgcaaaaaccaacagacctatcatacaatgtcacagtaagcaagttaaagagtctattttgcggcatcaatcaatgaggaccgagccaagaacacggacatcaagtttgagcggctcgtcgaggaatgctgctccattttgtcgctcaggagtgccgccgctgcactcaaacatcctggtcacgggtggcaggccaattcaatttcagttaagccgcagcgtgagaaggagcgacaaggacgacagcgacagttcagcacatcctcgcaatcagggcatttcaatgaaggacggacgcgcagtcaatcagtaaatggccgccaatcatcaaagccgcgtccgccttttccatgcaaaacctgtggaggaaatcattggaacaacgagtgcagaaacaaacgtggaggaagtcagcgcaacaacgaatgtaacaacaaacgatcgcaaaagtgcttcaactgcaatcgagtcggacattttgcacgcgagtgccgaagcaaaaagcaggcaaacagcaatgactcgatgtccgtcatgaatgtgtccgacgacactgacggatggatcaccgtggattgcctcatcaatggcaggctggtttcattggtggcagacacagccgcccgaaaaaccatcatccaaacgcccatttgggagaaattgggaaaacccaaatttaaaacgggcaaaactttcggaaaatcatattcagggcataatttcgaattaattggttcatttgattgtacagttgagttcgcaggcattaaattggagttggaatgttttgtggcaccaacgggagcactcaatctttttggtcttccgtggattcgcgcatttgaattggcactgcaacgtccaatcgccacaacacttcaaattgtccaaccagaaccagcattcatggccatggcgtcgtccgcagacctggccagcaaactcaagcgaaaatttcccgaagttttcagctcagaacttggccattgtaccaaaatgcgtgcgcatttgtacttaaagccggaagcgaagccgattttctgccgccctcgtccggtaccgcatggcgccatcgatgccatcgacacggaattggatcgtttgttggcgattggggccattaaacaaattgattacagccgttgggcagctccgattgtggcgagtgaaaaagaagtcgggcgacgtccgagtctgcattgacttctcaacagggctcaacgacgcgcttgaactcaaccgacacccgttgccacggcccgacgacattttcaatggcgttcgaggagcaaccgattttcgagccaaatcgacttcaaggacgcgtaccttcgaggttgagttggacgatcaatcgaaacagctggttggtttgaatacgcatcgcggtttatttcaatatcggaggttgccgtttggggtcaaatctgccccgtccatttttcagaaattaatggacgagttagtcacaggcattcatggagttttcgtctacctggacgacttcatcgtggcaacaaactcccatggatcagca

SEQ ID NO: 4233 - DNA, 945 bp, Heterodera glycines
gtgatccccgccggcattcgcacgccgtcctgtcgcttgttcacctgcacgtgggcaactgaaaggacagcacccaatcagacaaagtcattaaaattgtgattgattgcaccgaactcaccccaatcggaggaacaataattgtcctttggcggggcccattggcattggcaagcaaaagaaattttggaacattgggagaaaaggaggagaaggagggggaggagagaaaggaagtacgacggaagggaaaaggaagaggaggaggaagaacgaaccatcatcatcagtgctgtaaaggggggggggaagaggaagttggaaggagggggaagaaaaattgatcggaattgaaagtgtaagcgaaggagaaaaggggagaaaaaagggtggaaataaacactttggggtgaaaagaaagggaaggaaatgcgcgaaaaaaatgaaaatggattaaaatgaaaggggggggggagggggcagtgactgacaataaaattcgcccacaaaatgaaagagtgggtaaacccacttcagagcagaggcaattcacttcacttctctttgggccgttgtcctgagccaactgctggcaaatgttcgttttgttttgtcaaagactgaaaaggcggggccaaaattcgttacaattagcaaaataaatattcactgatcagagagaaacaagtgacaaatgattaaccgttcgattggctgatttttataccaaatcactgggaaaagaatggcatttccatccaactctaaaaatggtttcattttcggtgatggtttggcttcatcttcggcggcgattgtttagccagctgatgaacatttgcttcagtgcctttttacccttatccaccaacacccgtcccaacgatgggccctcctccccctcaacaccctctgttggtgccgtccttcctccgtccgtgccgt

SEQ ID NO: 4234 - DNA, 2144 bp, Heterodera glycines
  misc_feature (50)..(51): n is a, c, g, or t
  misc_feature (125)..(125): n is a, c, g, or t
ccctcgtgaatggcacggcaaaagggtcggtgaattgtgcctgagatatnntacaattctctgaacatttattcactatctgatgtcagccggacgttctgatcttctccgcgtccatgtacacncaattttcggcctcgtcaaagtgtaacattccgctgggcggcatcgtggcatgggcgagcactcctcctgaggaatgggacggggaggggacgtcgaactgcaaaaatgccaaggcacctcttttgtcgaaaggccaggggtcgtcatgcattccgctagcaaatttgatgttgatgtccgcctgttgcgacgtgggcacttctctgaagttcagcggagtcactgccccccaaatgccaaaggcctttctgatcgcctcccttgggatgagagaatgaggtgccgtttctgggctgatctgatcagcaccaatttaatagttacctcgctgtatttctgggaagatcgggcgaaaagttgtggaaagtgtctgcaaattggtcaattaattaattaattaggggcggtctcatctctgttgctgtcgcgcctcaccaaatcactcacatgttaagtccgtcttcttccatttaaatgccgctccgccgccctctgtcagcatttccactccgtccggcatgccacagcgcggctccgccattttcttgcgtgttttgatgtccaatacgcccgtgacgggcaaatgcgcaatctcttggaatgctttgactgccatttcgaaaacgttggacagatcgcccgccattccgtccgtcttcacgttcagttgggagggcgttgtgtatccgaatttcgtcagatattcgcctgcgtcgtcctccttcaccggctccatttcgtccagcaaagtgtcctcatgggcagacaaaacattggcatttagcgacaatgccaacagaagaagcgcaaaaagtggtgacaaattgccggggcacattttttggctttgaattgaccgattgacgcaaattgatcaaatcggaacctcagcgaatggacgaagaattcatcttcaacaaaaccacgtctgatcgacaaacggattggtacggagagttgtgatcgttcactttttgtgcgaaatgattgatcggttgcgtggcatccgtccaaattcagcggagagagaggacaatcagtcaaacgaaactcattcattcaacccgcgcatcgaacgtaagtttaggtcgagaagagaagtgggggaattgtttttaatgtcgtaagaaaaaataaaataattgtaaacaattaataaattttattgaaatgggtgaattagatccaaagtccggcccacacattgctggccctacaaacaaagccaaacttcacaaggcccactcttaatttagacaattaacgcacttaatttattgggctccaggacaaggaccaatcagaataatggaaaaagattaacatattatattattattattattgggccatcatgtgcttattccaaacaaataggtgttcttgaaatttaatttcttttgcacccaaggataagtagaagggaagtttcagtctaaagcctgcatttccatcgaatggacattcttccaatgtaggaacatggcccataggtagggcgggtcagctctccgccagaagaagtccgcgcggttgactgttcggggggggggagggctttgggccccgcagtcaaccgcctgtggcactcgtcggactgcttcctccgccgctccgtcctccgtctcgtagtatttgagttataatgaaatttgaaaatcttaaacttttgtcttatacgtcaaactgcttaccattcgcttagaaaaaaatcctccttttcaaaaacttttttaaaaacaaatttgttcagtttagttagaaatgaagagagttatggctgatcaaaataaacaatacaaaaaaggcattaaccaatgcaaattttgaattagtgcgcaaaaaattacgccaattacgctattggcgttatgagcgcaacttaaaaattttatttttgagaattccgatctgatggaggtcaaaaggatcgccttaatatatattgcggcggctctagaataggatgtgaatgttttaagttctgaaaatgccgcaaattcggtgctccccgatgg

SEQ ID NO: 4235 - DNA, 4446 bp, Heterodera glycines
taattgtaattgtttttgtttttggcaattttgacaggaatgaccgagtgttgttcatctgctgtttctgacaatggcactgctccctcctcctcctcttgggctgagttgggtctttctgctgcgactctcaacgctcttggcacaatgaagtcgcgtcgcttctcaatcaacaatttcttaaattacttattttcttcatttagctttccttttccaactccaattcaaaatgctgtgattcctatcgctgttaaattgaaaaaagacataattggagcagccgaaacggttgatatccaattaataccatttgattgaatccaatttgtcaacatttagggcagtgggaagactctcgcatttgccattccgattctcgagcattggctgaccaatgccattgccacaaatgcccaacattctccggccaaaggctcactttttgcgcttataatttcgcccacgagggaattggctgttcaggtggacagttgcatttgtttctctttacaaattgcctttttaacccaattttcccttttttgtcagataaaagaggtgctcattgccctttccgttcaaattgttccacgcgctccgaaaattgttgcaattgttggaggaatgagtgagcagaagcagcaacggttgttgaaggcaaagtatgcgcactttcttcacatttaatgcccttttgttatggcgattgaggccccgttttttgctgtttgagaaaactggcaatttttttatcttgttgaaaaaaagaattttttcccgtggaactagccacaacgtcgggtccctggttttatttcagttttgttcttgaaagcaatatgcataatgaatcaatcgccttttgatctctccgccatttttagaccagaagtgatcgtcgccactcccggccgtttttgggcattgcgtcaaaccgtgcgattttcccattttaagaatttatctcgtctaactaattcctcgcttcgctttattttagtcccaaaatgccttttagggcgaccaacatttggcggatttgtccgcacttcggtttttggttgttgatgagattgaccggatgttggagcaaggccattttgaggagctccgacacattgtccaggacattcacaggccagacaaattgtcttcggaatttaatttaagtgtttatttttcagggataaaaaggagcaaaaaatacggataagcattgcttccgaccaaacggccgacccttccgatggcattgctttgccaccgcttcaaacgctgattttttccgcaacgctcacttttactcatcacattccgttgcggaggggcaaaaaagaggcgcagcaaatggcgacggacccaaagcaaaaagtgaatactatcacattatgtttaagagaaaagtcacttttcggggtctttctaaatttatttaaaagggaatttcaagaaaaagaaagaaatttaagaattttaaaatttatttttttaattgttaaaaatattttcatttttaatcatttaattaacgatctgctaattgtaagcattttgttttggcgttttaatccaattcaatttgtttggtctctcttttgaggtgcgtcggattgccctttcgatgtccatgcgaaagggcgcagcgaatctttctgtgattgatctgacgccaccgcagaaaacgccacagactctgaccgaatgtcgcatgaattgtgccgatttactccaaaaggcacaaaacatttatatttcccaatctcattacaaaaaattcattttgcttattttttatacattttcaggattcaaatttgctgtatttgttgaagcggcacggcgggcgcactttggtatttgccaattcgatttcggccatccggcgaatgcattcgctgctcaaaaaattggcacttccgaacacggcactgctgcacggacggatgaaggaaaaggaacggctgaagagtgtggacaaattcaaaggcaaaggaacacggggacaacagagggaacgacgaattaaaacaaaaataaacacccatttcaaaattaaagaattatcagaaaagagcgtcgtatttcctgatatattttccctccaatttccatgcctttcagcgtcggatgattccgttctcctcgccaccgatgtcgccgcccggggcctggacttttatggagtgcaaaatatcgttcattaccaatgcccaaaaactacggaagtgagaaagaattggatatgttcttttccggtttgatttccttttctgttagagttacatccatcgcagcgggcgaacagcgcgagcgtcgagtgccggactgtccgtgctttttgtcgatccgttggatttgcatcaatatttgaaaatttgccgaaacttgaacaaaggcatccccccccccccctccaatctctacatattagccattttgacccttccccccttgaagaggaagacttggaattgttggccgtggatcagcccaaactgatggagtcgtgtcgctctttggttcaattggcaacggaagcggaagcattggagcattcgctgaaaaaagtgagcaaagggaaagggctgtgggttgattatcacaacgaaacacttgcgcagagaaaggcgcgtgagcaatggtttgaacggatagcgcgggaagcggatttggtgtgggaagagggggaggaaaaagggcgaaagatgggacgacggagtgacacggacgaaggaccgacaaaagagtgggccatttgaacagtcggacaaacggtcgaattggacttacaaaaacccatttcagggaattaatgagacggcggaaaagggccgttgagaaagcattgaaaggaaagctgaagggaaatcagcaaaatggagaacagagagagcggaggattaaccaaagtgcagaggggaggaaggtgaaaattgggaagaggaaagtgaggctggagaagggactgaagaaatgggtaaaacgggcgaagatggacagcggacgatgacgagggaacgcagggggaagagaggaagggaagtgaaagaggaggagagagatgaaaagaaagaggtcaagtggaaaaagagggaggaggaggagagaggaatggaagtgaagagcaaatgaggaaggaagaggggacaagctttgctagtgaaccattttctgtttgtttgtttgttttgtttaatcttaagtttaaacgaattgaacttttctttgcatcattgcttctccctttgcattatttgcataatggtggctcattccttccgtcgttggcaattgtcgaacttcattctctccccatttgtcccttttcccacccccccccccatccgtccgtcctccgccctttgtgccatccatcgcttcgtcctccggcagcccttttctttcaattggccaagcctatctatcgacatctcacgtatattgtcccgaacgagaatgaatgaggggacacaatttctctgaatgccttcccccgaggggattcctctgctttctcttcgtgctctgtcccactcagccctttccctccgtttttccgccttttggttttggaagaaaaataccccttgaatttttcataggaaaaacgaaggcaaaaaatgccatcagtcaatgagagagaaaaggccgtaaggaaacggaagagaaaatggggcggagaaaaaagaaaagttaaaaaacaactaaatttttatgacaaaatttatgaatttattattgccagtttctaaatgaagaagtctttcccccttaattttatcatttttttgttcatttcgcctgcgtttagtccaaattgccctttccttccctcgtcattttcatctttcaattcgtcaaacaatggccattccggcatcttttcccgaacacagtgccttttccaataagcccaaatcgacggaatgcctttgcggtgaaatggaaaagggccaaaatgcccccgggggaagaaagacaaaagtttattttgcggtacgaacaaattgtgcgaggccatgggaacgaatgttcatctgcggaggaaaccgactgctgggaaattggaggccggaaaaggcgttggaaatggccagagaaacggaggacggcgaagagaatcagtcgcagcagaaaacgaacagcggaagaaagtgaaaaaagcggggggggggggcaattagaagaaaaagcagcggggaaagaatgaatggtcaagctgatcagaatgaccgacgaaagaatggggcagctggtgagagaatgctgatcagatacggattaatcgcctaatcagagacggattagttagttggctgatcagtttcatccatctcaattccgcatccctttgttcatatgatcggtgccttatcgctttagacagtcggcttcgtccgtttgtcgtgcttccattgagatgggccctgaggacagtcagcg

SEQ ID NO: 4236 - DNA, 1599 bp, Heterodera glycines
taactttatgaccaaagattttcaattataaatactacccttcatggaatattgaagcatttattgaataaaaaatgtagcaacaccggatacatttaacaaaaaaatacatatgatgaaattattccaggggtgtcttttattcaaaaatttttaaaaaagcaccccgtaattcatttccaaagtcctcccggcatttgacccaattcagaatcgacccggaattccacacgatcgcctgggtgccgtagtgttacggcaggccacagcccactgtttgaatccgcgatgaattgtttattttggccttaaaataaatattacaatcacaaaaaaattatctaacacgcacctagcaaatcaccgttcaaaaaatatgaaaggcaattctctcttttgttgtggaaaactcctattttatctccctttgaaaatggtgctacatattcggattcctttccattgttaaaaatttggcctgttgagtcaactccatatgtgttgtcggcccatcccacagtttggtcctttcgaaggccctttggtgcataccccacacatataggtcttaaaataagaaattcataatatcgaaatactcactaaccctctgctgtttaaaatttgaacttcaaaataagatgaacttttatgtgatttaaacgtttcggctccttaattttataaattatttttgaaaaaaagaaaaatctatactttcatatagtccctcgtgttctaagacacatcctttgcttttacggattgataaataattggggctagaattcattatatctaaatacgattatattttaaaaatcagaatggaagctattgaaacatttaacatgaaactattcattgggtttttggaattacaaaacaataaaatttgagcgagtggtcgctattttatatccagattcataggtgtaatcttatgacgacacaagccataaaaaaagaaaacaatcaaatgtgatagagacacgccctgctaaatgtccttcattttttattttgcataagaaacatgtctttcattttttattttgcataagaaacattggaaatgtttcattccctataaaaatttgctgtcttgagaaattaaaaaacataaaacgcaacctttgtgcggtgtgatattcaataatttttcccttttacgacattttttttaatcgttccccatccgagcacgaaaacggctttgatttttaatacaacaagaattttgcaacagatatttttaatgtgaagagcacaacgattttaaatgtaatttaaaatattgaaaaatattcatgtgattaaaataccatatcaaaagaactctaaaacacccaatgatttcccttcccactgggcatacgcccaatgacttcccttcccactgggcatacgcccaatgaatgttcttccagctgggcttacgctcaatgacattgccaatccgtatgaagcccccttggtattgtttttagtcttggaaatattttcttgattggtttatgatttgcacaggtccgttgtttcacaagaaacgtattaacgtcgtctagtgttatattttggtctacttttctttgcttc

SEQ ID NO: 4237 - DNA, 3815 bp, Heterodera glycines
  misc_feature (3793)..(3793): n is a, c, g, or t
ttttaccccaaaaatttcccttccttcaatggacactgaccctttgggtgtcgcaaaaccagagagtctaaattttaaatgtgatggaaattttttaatgaaacacctgtatcgcaatatagtggtttacacctctccttcctgtagacctgctccatatactcatacagcgttatcctcgcagcacacgtggtccacaaagataaaactatattcgacaccttatgctcctttatgaactccttcttcttttggtacacggcacgcatcacaccctcatttattccacaggccttttcaactcaatcgtatcatttccgataaggtccatccatctttccatgttgctcacgatttctgtcgtagaaagcgtgttccgcatcgaaaacttcccccacaagctgttcaaccccttaatatttatttgttttttgaattttatttgtttttctcaccaattttgctatcattcgaagaccagggttagagacaatcttgtcataattcaaggaaatgttgtactttgcattatacatttcgatgaattctctcttttcctcctcacttttcacttctgctggccacccggatgcctaaacctttatcttcaaaaacatccgcacatatcctttgaacagttgactgtcaaattgctcaaagtgatatgcccgatagaagccaacaaccctatatcctaactccaaggccttccgcagttcaatcgaagtgaacgtccccaaaaatgccctctgctctggtcgatggttacattttttcacgtccttcgtcgtaacaaactcgttcttggcctttctcgcacaaataccacaatttgggaagaggagcatttcatcaatgtgcacagggaggagggggtacagcagttccttcggggggatgaccttcacctttagcagtccatcatagggcacatcgtcgggcaccgtccaattcacattaaaattcctgctcaccacaatttttgggacaccaacgggataaggagtgtcttaagtgaatggcaatattaaaaatgcaagcggatttttaccataattcacaaaggggtacaaactgataatatcaaacatcgaaatctaaactgcttccgtagcctttgcatacaagcaaaaaggcattgttcgtcctcctgcgtaagcatccctcggattaatcggtcccttatccggcacactttcaaagaacctcttcatctccttatttttcttcaattccgctttcacctcacattcctaaatttgttcaatcaataatcaataactgttggaaattggcaaacccaaacttcctccaccgagaagtttttacacatttctctcaatacttccatccgcatctctgtccttctgtaattctcttccatgcataaaccattcggtccaacagcccagggcaaaaaacaatttttgcacccatggtatgcacaccccttaaagaactcacattaacggatgacttttatttttgaaaacctgaaactcaattattcttttctgaccaccaatgacgcaatcaactttgaggtcaccgaatttaatctccccaccattttccgcatgtctgacccttatgccttcccggtgcgccaaccattcaaaatacttcacggcaattttgctctgattatcagccctttcatatcctccctccggcatgatcggaatgtgcctgtccttcaagaatttcgtcctgaatatcctcatcacgaccccagcaattgtgacactgtccttcaacacatccatcccgtcagtaatatccaaaaacaattgccggaacttcagaattgcctccatcagtatttccacatcgttttcacagtaaaccttaagctgttctcctaaaaaaatacaaaattttatttaaaacacactttctctaacctagctcaaattcggtctcaaaattctcgttataccatccttcaaacttctcatattcctcctccttcatagcatttggattgtaatcatcaaaaggcggcaggtgtgacaatctcttcccaaaattctcatttttattgtacttatgaggaaagtacaactttgccgggatgctcagccctaaggtctttggaagatccgccaatttgttttggctgagcaaccagaaatcccgaaagtacacaccctttgcctttatctgatagatcttcagatccgccatcatcagttcggtgttaagccccctttctgtcagcacacgaaggacgaaatgtgagtcgaaccgtccagcataatgagcaaaagcaaccgtttcaaattgtttgaagcccataatccaatcgataaatccgccaataggatcctccacatttgctgccgaccaagtcagcatcctcggttcctcacaaatctcacatttccttttctctccaacgcactcactgcatgtcaacgccgcgcaaacgagattcggtgcatggactccgttatacaatgttgtctcaaggtcatatgcaacaattctgtatttcctcgttgaacgaatttttaacttctggatgaaacagccccgctttggatgataaattttacaaattcggcagaatttctccccacatgtgtgtttgttccttgtgttgtgtgtctctccacacttttcgcattttttgtactccctacaagcagtcttcttgtgagactcaaaacattccgtattgtagaagttgcgattacattccgcgcaataaatcccagcacacacatccgcacatggaaacccgaaccccattctacagcacttcttgcatctttccttacattccaatcgatgtctctccggcctttcgcgtgtcacttcacagctgacacaaaagtttcgaacacagaagaattgcgtaaccgatttcattccgtcccagtggtctccatcttttatcacacatacttcatttttacgaattccttctcccttgaaaataggtttgattcccgatctctggaaaattaaatgttttttcaaagtgcgtaatttttttaccatgtcaaatgccactatgcgaaacatttccgggtattccttgtcccaaaagttctggatgagaccgaggtgttgtagaccaaaagttttttcctccccgcttatcccggccttttccatcaatttgacagccatttctctttgttttttctctgttttcatgagataacgaaacttgtcttccgttatctcctttccaatcaatcggtaatttcgtgcgaattcaagggagtaaaataggcctaaacaaaagttaaagatttgcaaatcttgtgctgaatttaaagtgatttcaaactcactaaatttccccttcggagcggaaaggcgtcccaattccttggtttcaacgagagggcagaaacgagacattttcagcaaaaaaaagttgaagaaaagggaataaatagaagacgaaatgtcaggacaaaaaaacagatagagagaagaagaattgaaaaaggacgaattaaattaggaaattgaagacaataaaaaagaaattagctgggcgagaaggttggttgaaaaagctggctgaatttttgagagagtagaagagtgaatgaaaggacgccaattccagcacaaatgcgaaggggcggagtaattagcggaagagtgtgatcgattttcagtggtgtgtgtggtgaaagaagggaaaagaccggcgaaagaagcaatttgaacgccagcagagaaggatggcacgcgagagaacccaaatttgaattttggctggctacgaaaatgtgattgacaggtgagaaggtgatggcacccgagaggngacgttttttggtgcatgactt

SEQ ID NO: 4238 - DNA, 2384 bp, Heterodera glycines
attgacaggtgagaaggtgaatggcaccccgagaggggacgttttttggtgcatgacttccgccagaagggaaaacgaagcgcatagagtcccgaaagattgaaatttgattgacaggtgagagggaaaacggtacgctagagtcaaatttgaatttggtcggcgacgaaatggaaaaggaagccgtcatattatttcactgctgcgtatttttttggctggcaccaatttttttggttggcacgggcgcaaaatgccgcttttgaattttcacctcttttcaacacttatcatgtggtattccacatgttgcatattatttttcacctgttctgccctttttttcaccggctatgacaatatttttcacctgttctgccctttttttcacctgctatgacaatatttttcacctgttctgcccttttttcacctgctatgacaatatttttcaactgttctgcccttttttcacttgctatgacatttttcacatgttctgaccctttttttcacctgctatgacaatatttttcacctgttctgccctttttttcacctgctttgagttttttttttgagttcttatgttttttcacattgacatgttgactttttcacctgttttgacagcattttcacttaatttcattaccttattatcacaattggtaaacataatatcgtttaattatctcattatacaatgatacagatttcacattttttcatccattttcacccataattcctattactatcatgccttttgagcattacacaaattctcattttttcattacctcgagatatattttcgcctctttttcacagctttcaaatattttctttcctgttttattatcacagcctttggatatttttcatccatttctatgaaggactttcaggtaacttgcataaaattacatccattttatgctcaatcgaaaaaataacaactatttgaccgaaaaacctaccagaaatggtgacttttcattatggtaaacaatttaggtagtttaattttgttagtaatcaatgtatgcattttttcgccgaggcgagacctgctgggcgggagggagtgggggctggttaatgacgaatcgattatacggtggagggaaaaggggattgacgaattatacggtggaaattaaacataaaaaattggatctgtatgtggtatttaaatttgagtacgttatactaatgattcgttcatcattaatctctttgcgcaatcattgcgcagcagcgcggaggcgggaggaaatagccaacaaaaacaataataatttatttgaaagataaagccctatcctaacaacgtttatttaaaatttgtgaaattaaataaaaaatagagtacgataggaaaaaataggttcaaataaaattaaaggaaaattatatgaatcttttttttcgttattattttccgtatttccatgcgtcaaaaaatgggaggggaagagtcaaaaatttgaatcgattaaaccccaaagaatggagggcggcgcgggcaagtggtcggatggcaagggatgttcataaaagggagctcggtaataattggacgggtggggggtttgtctaggaagggccggaattttacaccgagatttgtggacatatactactagcccattcgttattttgtattggaaaaattgaaaattaattcaaaattttcaaaatcaataatagtaattcaaaaaaaaattaataccgtctctattttccgagttcattttgtttgtctgttccatttccgccattttgacatgttcaaattcttcatcagaattggtcgaatgttccaattgtgctttaaaaaacagttaaattttaagccccaaaataaaaatttattttcttattttttatattaatttctttgttttcttttacccttatcaattaaagtaaattcatcaaatgatgaatttaatgaaaaagacattattttattgcctaaataaaaaatcaaaatgaaacaagccgaacattatattaattcatttccaaattaataaaacattcatttaaattaatgctcaattaaattcgttggtctaattggtttcaaaaatcgaaaatcataaaaaaataaaatcaatcattaatttccctttttttatagaaaaaagtaaatgaaaaaagaaaaacgaaaaaatgaccttatgccattgctttgggtcacttatattaattaatggtggggacggcataaaataattcacggcaaaacgatgaccaaaaaagagagaatatacagcagaatcattaaattattaaatgtttttttcattataatttcttgcaattttttttgaacaagataaagagacacgtgcaaaggatgtggaatttta

SEQ ID NO: 4239 - DNA, 8733 bp, Heterodera glycines
  misc_feature (51)..(51): n is a, c, g, or t
  misc_feature (57)..(57): n is a, c, g, or t
  misc_feature (64)..(64): n is a, c, g, or t
  misc_feature (1200)..(1200): n is a, c, g, or t
  misc_feature (4583)..(4583): n is a, c, g, or t
  misc_feature (4602)..(4602): n is a, c, g, or t
tccttattattgttgttaaatgttgatattatatcctctcagatagagagnaatatngatatgnaccagggatggctcttaatttcgcttatttccgaaaaaagtttaggcctcggaattccaaaaaaaaactggagcctcgaaatgccgccatctctgataggtgccttgcccttttgtgtttttttctgagaagctttattcctcaatttcatttacgtttccaaataaaatggttgttatattcatcgaatttttttcaaattgttcgtctacaattgaatttttatgaaaaatttgtccatttttaatttgttagagcaaaaaatcggcgaaaatgggccttttgacgttgggcactccgctgagttggcccagaatagttgagcatctccagtacatcaaggtgagcgaacagagaacggccgagttgacagaatgtgttccccatggattgtaatttgttcccgaacctttctgggccatatttccagaattgttaataatttttgtttggtttttggggttgaaatcatgaatgattttggggttattcccacacattcttggcaaaattttcgtgtttattgcatcgttctgacgctttttaggttgtccatttttcggcgttatccccggtaattttggcttttttagttgtttccccgacaatttggggccattttcggggttagactctcaactcttaatgacaccactcttcatggaatattgaattcgctcttaatgaaattttatttttttaaaattttccaggcccacggcatcgaccagttcattgcgttgtatcatcgtgtcaagggacgcgagcgggaccagttgcgatggggtgatgagattgagtacacaatcgtaaaatttgatgacgaacacaaaaaggttggagggaggggggggggggggtacgattttcgaaaaaatggcatcccccaccaattacacaggtctagggatacaaatttttggtggttttttctgtggcttcgtttttatgttcttttacaattagtccttaccctaatccattttcaaaaaacaaaaatgatgtatggaattggaaaaatttttttttttttgcttgcataaataaacgatcaaattgtgtcttccaaatagcaatagtttggcgcatttgttaactttattcaacgcgacatttgcaaaaaaaaaacacaaatntttgccattaaacaaaaaaatctataaaaatttatgaatttttttttggggggggaccttctccccccttcccccctcatttaaaatgattgcttttcattttcctattctaaaatttaacaattgtggttgatgaactgaactccttgccaaggtccgtgtctcgttgcgtgccaaggacttgctggacgcgctgatggccagtgaggacgtgaaccggtcgttgggcgaggagaaccgcagtctgtggcgcccggaatttgccgcttacatggtggagggcacgcccggcacaccgtacggcggtgagtcatcagagtcggtggtggcgggtgtgaggccattacccaaaaatcgggtgtttttccccttccgaggtccctttccccaaagttttcaaaaaaaaaaaactttttaatttttggtgcgaaaacgaactgttcccatccgaaaacatctctctctctccatattgttgtcggtctcaattttatctttattttcaaatttgggacatttgtagattttgtttcaatattttgaaggggatggataccctttccgagggttgctgaattcagattcaggatttcgaggggtttttgagcctccgggtccgagagcagcttgtccccgaattttttaaaattttgaacatcgtttggttgcaaatacttactaattcatcatgaaatattgagataaatcgctagagagatttttctggtttttttttcttgaaattttcataaaaaaatgattatgaaaaattcctatttcgaaaattttcaaaaaatttctggacctaacaagggaaacttgtgtgatgtgtagtaccccgcttattattaggcatttccccatagaaatttggcatatttttttaaattgtcgttccatggcaaattacacgttgtccctccccattttgtcgtcctgtcccatgcccttctttcatcatcattctgtctgtgtcaggtctgatgtcctgcttcaacattgtggagtacaacatgcgcttgcgctacgacgacgtgtccgcactgttgcggcccaacgagtcgctgctgtccatcagtttcccggcacttggcgcgcccgacttcaccgacccgccggcggtgccgcgcccgactcatccggacagtgtgggccattcagtgttctacccggacgaggccatctacagcgggtcattattactgcttggcggggcggtggaggggacttattattagaaatttgaatatttttctgattaattttgcccaataaaatttgaaaaaacggaggcataaaaatttgaataaatttcgattattctgctaatttagttcatcaattgcagaaatttttggcatgacggatacatttttatataaattttacatttcgaatttggatatttttgagtaaattttcaccggttccaaaaagtatcataaacttacattcagttgtaaataatttcttaaaattttcgaaaattatatttgtttttccatgttcggaaaagcttttaattaatgcttattttaaaaaatttcaaataattttggaattttcaggcacccccgttttcgcaaccttgtcaggaacatccggggccgacgtggcgaaaaagtggccataaatgtgccgatttttcgcgaccagaacacgccatcgccatttaccgtatataatattttgaaaatttgaattaaaacatttaattttaaggcaaaaaaataataatcaaaatttatcgaaaaattgcatttttaaggagacctttgaaaacgccgaagcttcacgggctgcacttcccgaccacatttacatggaccacatgggcttcggaatgggtaaatccttttttcaacttaataatggtggagcaggaccaaatatttttcatggaaatttagcagattgtttcagaacacctagttttcaaaaaggctatttgttggcgacgtttcgccgttttactgaaatttcgtaaagcattttctgattttccggggttttattaaattgacacattgaaaaaacgcgttttttaaatttagtaaatttccgaatttttccaggcctttgctgtctgcagatgacctttcaggcggtcaatgtgatggaggcgcgttggctgtacgaccaattgaccccgattacggtagagtactgttttgtagtggatacaagtgtaaacctgcttatttatactggttattgtattacattttaagcccatcatggtggcgctgagcgcgggtaaaatttttttttattattattaaattttgttacaaaaaaagtccatttccatttttaaaaaaagtttgatttgcattttggacgtgcgaaattcccaggattttgtctcggaggagatatcgccccaaggcgaaattcaaattttcgaaaaataaaactcctttcccttttgccaaaaaatgttatttttaatgtctaaattttttccggtttagttgataaatgataatttactaacaattataaatatgcttatttttctgtccgtttgttcagcaacgcccattttccgctcctatttgtccgatgtggactcgcgttggcccatcatttcagcggttcatttcgaaaaaattccaaaaaaaaaaaatttttttgccagagtgtcgacgaccgtacgccgtttgagcgcggtttggtgtccagcgccagcgatgggtacagcaaattccacgccatcccgaagagtcgctatgacagcaccgactgttacatttacccatgctcggcccagtacaacgacatccaactgcagtatgacgagcagttgtaccagcagctgatcgccggtgggtcccagaaaagcgaagtgatcagggagatcactcactggatcagcgagcattattgtgattgggaatttgctctgatcaaacaaactgatcagagtggacaaatgggaatgaccactggggtcctaacaatttttttaattattcaacgaatttaccattgtatttcatatagttttctgcgaaaattttaattttcctcattctattaagacgtttgtttgaaattttaacaaatttactttgtcgagaaaaatttcaaaaaatttggtcggatagcgttaatttctttttttgccatcatcaatttgacccattttatgggattagaaatttatttcatgatctaattaaatgctttttcaggcagtgttgacgaacacctggcacggttggcttcatttttttgatagggcacgggaaactcgagccgctcctaaccggggacaggacaaaacgtcgccgcgaatttttttaattttagaaaaaaatcacgaaaaactgtctaaaattttagtacttacaattagcataataaaaaaatttaaaaanaattcaaaaaaaatatatntaaaaaattcaaggaaataaaaaaattttgcggcgacgtaatgtcccggcaacgttttggggttcactatgctaaccgccacattttttgaatttgatttttcttttttggcgcattgccaccacttttgtctctctcttacattcattttgccccactgttctgttcagtcacattgcgcacatgttcatccgcgacccgttgcaggtgttcgaggaacgcattgagcaggacgaccaaaagtccacggaacacttcgagaccatccagtcctccaactggatgaacatgcgcttcaaaccgccccctccggacgacccaaacattggctggcgcgtcgaattccgacccaccgaagtacgcgttggtgttgttgcaattttcccggcggcgtctatcggcaccgccggaccacccgtcaccccttccccaaaagttttttggaaaacacgccgcaaaaaaaagtgtggctgaatagcaaaaaaaagtcggagaaagaaaagtttggaccttcgtatgaaaaatcggtcccgagacaccccctctggcccaatcgtccgtcgtacagcccttggtctgagacaccccttgtatatgtatgtctgagattatcagtaacagcaattaatctagaaaacatttgttaaatgtgaaatactatggatttgaaaattccgggaacattttttagggacaaaaaaattttcggcttcttcccctctctcccccttcccgtttttttttgtggggcataggcttgggctttttttttggttcttaatataaaaattgcttttaagctgcatttacaattagtaataaaaaaaattgccaaataaatgtgccgtttagaaaaattttccgcaatttttcttccccgaatttccctcccccccccccaatttcacaggttcaactgacgcattttgagaacgcggcctactgctgcttcctcgtgctgctcacccgcgtgatcgtctcatatcgacgtaattattgctcatttttatcattaccactaatgaatcccaaaatcttcgtttatggtcaaaaacccgggtacaaaatggtggactgaaatttaaaaatttccaaattttttttgagggttttcttctgtttcatttaaattttttcaaatatttaaattttagagtcatttataattgtttataattaagctgttcgttcattaaagcgtatgttttatggcattttcaccaaaaaaaaagccaaaattttcgcaaaaacagtgacaaatgccaaaaaaaatcaatgttcctttcccctctccgcttttcagtcacttttctcatcccaatttcgttggtcaccgagaacatgcagcgcgctgtgcgccgtgatgcgatcagcacgcaaaagttgcacttccgcaaaacgctggcccattgttggcacacgccggagggcaaaccgtgccccgaggggcgcccgccggccgagccggagcccgagccgtacgataacaacgtggccgagatgagcattgacgagattgtgaacggtggggtgggcagttgagttcgggaaatcacgccgcataaattttttttgggaatttggcaatttttctttacctcgcccaattcgacaaaaaaaaaatttttttttgaaatttttccagggctttttcgttttttttttgaaatttggcaaattttgttttgaataacacgcctgggtcttcaaaatttccatattttcttttttgcacagggaacaccgattttcccggcctcgtgccgctgatgcttcagtttctgaactcggccgacgtcgacgtggacactcggtgagtgaatcatctgatgcactacagttccacctgcatcgtttttgaaaaattgaaaaattttttgggggtttttctgtaaaaaataaaaaaagaataactgattttttaaaattctctttcaaaagttgtaaaaaatgaaagatttttaaaaaaaatcttttactaggtaaaactaaaaaattagctttgaattttttttcaattgttggctttttgttgttaactaactcatttttagttgcactgtcagccagtacctgtcatttatccaggtatatatatttgtttacaacattgaaatttatttgaaatttttcatttttttcagaagcgcgctcggggagaaatttggacgaccgccaaatggatgcgtgaatgtaaaatacatcaattaacaaacatgcaattagctaatatattcaattacaaatacttgttttcagttgtccaccagcatccgacgtacaaaaaggactcgcacgtgccggacgagtgcatttacgacatgatgaagacggtgagtgaatgagccgattgtgcaggttgcactgggttatttctcgataactttctctgtattttccctttacctctccctccttccctcactcactccatttctcaacctttttttccctcatccctcctctctctctatctctctctctctttacaattttccttctctctctctctctttacaattttccttctctcactctctctctctttactatcttccttctctctttctctctctctctcttacaattttccttctctcactctctctcttattttttctctctattcctctctccctctgacttatcatgtacctactaacaacacattcagatggacaagatttcgcgcggggagcactgcgagaagttgttaggctgtttcaagacgaagacggaacagcgtatcccatccgctgtgaagcgtgccgaggaggagatgaccatgctgatcgcacggcggaaagcggccgaagcggcagccgcgtcggcagcggtgaagaacaacaacggagacaacgcgggtgcggcggcaggcaccgctggcgcaagtggtggtggcgagcgtgacagcaacgccagcgtcgcggacggtcagctgccgcaaggcgctgctgcaagcggtggaggcggcgagcgcgacagcaacgccagcgtcgcggacggtcagctaccgcaacagtcgccgccggcgccgacaaccggccaatgacgaagcgatcgatcgatgggcttcacattttagtgataattttgacaatgaattaattaattggtgaacaaattgatgatgatgctggctgtggatgaattgaatatcaacagaacgaacatacatatttaagtttcaaagcattgttttattatgacttatctttttttgtgtgtttgaattattatgagtttcaataagttaattaatttgttggaaaattttaatgcgttttgatcagcacagataattactccaaaatggtcaatttttgagcatttgggagataagtacctaaaattaaaattaatcagtgatatggacaccggaaatattttttttaattttaataagttagcagtgaaactttcctcaagatttacccatttaaaaatgtatattttatttgctctccgattattagccccgtcagctgagaaaattttgcaattaattaaacaactatttgacactaattagtttttacatccctcgcacaacaaacatatgttatctctataagcaactgaacaacgcattctctccgtccatgtgaccatttaaaaaaatattttaccaatttatttacttcgttttcattttaatctggaactaataaaagataataatggattaattttaattgcacaagtttgttatccgaaaataagtttttatggttaccgtagtcctttcccaaaactgttgttatttatactgttactatagcccaatcccaaaattggaatagtagcctttattccgaaggtgtgcacacctgtctacctcagttcggccccagccgattttttgactataactttttttctttgccaaccaaatccaacatttttgctatctttcgaaagcttaatgtgtttagaagctttttctaagctattgcttggcaattagacaaatatcaaaaaagttaaaacatgaaaactaaaaaaatcaatattttataatttttcatcataaattttccagggttgaaaatttttttgcaccgagattgtcggatttggttgacaaagaaaaaagttatagatcaaaaaactgcgttgggccgaaccgtg

SEQ ID NO: 4240 - DNA, 1580 bp, Heterodera glycines
  misc_feature (1450)..(1450): n is a, c, g, or t
  misc_feature (1462)..(1462): n is a, c, g, or t
  misc_feature (1509)..(1509): n is a, c, g, or t
  misc_feature (1520)..(1520): n is a, c, g, or t
  misc_feature (1528)..(1528): n is a, c, g, or t
  misc_feature (1530)..(1530): n is a, c, g, or t
ctatagaaattttaaataaattaattgaaatgctaaataaaatgttatatgttcgttatattattcaaaaatgcttagtttttattttttgttactcgtgcttaatacaatgaataacaattatttaaatgaaagatgaatttcataaaaatatatcaatgatatcaagatggcaaatttgttttttgatttttctatctggaaaaacaagcaatattattttcatgaataaatttaaaaaatggctgaacgtggaattcctcgccttttcacgtgttttctctttttgtgggtcagggcttaatcatactcatatgcataacaattgtctctaaaatcctcgaaacttctttcagtagcgattattctaagatggcagatgcatccccgccgtcctgccccaataaggtgggttttgaagaattgcaggatcgttagatttggtcgacacagaaaaaagttgtagtccaaaacttgggctggcaccgaaccgtcctgttccgtgaacggaccaggccgttttcgcgccagcgcagtttttgaactataacttttttcattgtcaaccaaatccaactttcttgctatcattcgatagccctatatttcctctattagcttgcaaaattgcgaaaaatttggttaagcttcaaaaaagttatgggcagaaaacttcaaaaaactggttttcgaaacatttttggccggaacttttttgaaccttaatgaaaattttcacaattttgcaggcaaatataggatatttagggctatcgaatgataccaagaaagttggatttggttgacaatgaaaaaagttatagttcaaaaactgcgctggatcgaaaacgaccccgacccttccgtgaaaattcactattttggcgttctgtcactattttttttcattattttggcattttttggaatttctctataaaaatgcaataaaaacgaaaaacacaccccctaagaatcgacttaaaaaatttcagaaaaatacatccataaaaatcgacccagaatttttcttctctcataaaaaatgaaaaaattttctcaaaaattcattttcttggtaagaattttaatttaaaaattaatttttaggttttttgcccttaaaaatcccagccctattcatagtccgatttatgagaaaagaaactcatataaagggtagagaaagttgacaattattgtcatttttgcaataacaacttacgataaaagtgcgcagataactgccataaaatggagcgacaattaaagaaaatgtgaggaattttcggatttaacatttatcatttaattaatgttttcacgcattcagctggatttgccacgatcttttctaaggcgataaaacgcaaaattttcgaacaattcttgtcgaatccattaccacgctctttccacagactctcgtcagtcgaacattttttgttgngttaattttcanaaaaaaataattttttttaaaatcggtggtgcctttcatcaccgcanaagctgctccnaattctananaataaaaaagaaactttgttaatcgtccacaaaaaattggcttgtctttt

SEQ ID NO: 4241 - DNA, 1421 bp, Heterodera glycines
  misc_feature (24)..(24): n is a, c, g, or t
tcaagtaatttaatttatttaacncgggtaattaaaaaaattcgcatagtaaaatagtcaatatattttttccaaattccattcaatacaatggcacttttggcttcattcatcattagggctggcaaaaagtgaaattcgtgaacaacggcccagaaaacccctcaaaaactcgcgaccatttagcaatcccttgcgtaatcctcgacgaagaggcgcagtcgctcgtagagctcctgagcaggttcgtgagtgaagtttttgtgctggttcgtgcaatagttgatgaccgccttcgtgcatggccgttcttctgatgcgtgcattatttgaagaccaatctaaagacagagggaattcgagtaagccaagcgaatacatccgattatctaaaaaccaatttctcataaaacatcttagcagatggaagaagttagagaatgttttacttgatgcacattgtcctcggaatcattcgtaaatttcaaacgacgaatgtttggcgcaaaaaacgcaaattggtgcctcttttgtcccaaatttgcttattggcacggagaaatcgaggccggaatggtcaatgtatctgaaaaaggaaatatatttgtcattaataaaattcttgaatttgaaattacaaaatctggagccgtttaaagcgaattttgttaggcagcggacggttgggcaatggaaattcaactgatgtgggcccaaggcagattgacaatttcaccactttcgtctcaatgtctttgccaattgtaattcgtttccacagcgtcaattctgatttgccgctagggctaacatttttaggctctaaaactgccaaaataggcactaaaaatggaaaatggcactgaaaaacctcatttttagaggtgtaaaatgacaaaacgtattcaaaacgtggttaatattttcgtcagtaagcattttcgtcagtgaacgatttcgtcagtgattttcgtcagcggataatttcgtcagtgaacgttttcgtcagtgtactatttttatttattttgctgttttccgtttttttcgtcagtgttccaattcgtcagtgaacattttcgtcggtggatgcgtaaaattaaaaatttttcatttttatcaacttctttaatacagtatttatcgctttttgcgtatggtaactctagataaaataagtgattatttgtactttaataaatgatttacgtaaaagaaattgtactttaaaactgttgaatattattagtaaatttacttctcaaacttcttatctcgccgtcgttcccgtgcgttctcgagtgcctgcctatttgcgatatttgtttagtccttatctagtttttgcaatgcgtaaaaatgaacgatatgaaaattcgttcgtttactgcaaccagaaaatggctacttgttcgatttga

SEQ ID NO: 4242 - DNA, 3116 bp, Heterodera glycines
gtcgcgcgagtgccctggagggtttgcaaatccgatttttaggccatgtgatcgttgtacggaatatgggagagcaaattatgcccaattgtgaccatctttgctttgtccgaataaggtccacagtagaaaatgagaacaccccaaaattgaaaattgtataaaatcggaaataaaataaatttataaaattttaatggaattaatttatttggttagcatagtaaatatatttatattataatggaaggcttttttgaatagataaaaattgaaggaatagcctcaaaagtgttcaaattaatttaaaaataataaagcaaatttattttcatttgtgccccccgaagtgatcgcacagcaaaaatatgaaaattaaaaaaaaattttttttctgaagtttagaatttcgaagtattgcatttttgcccccacccctccattttgtccgtccattcgctattttttgctacctttctgttgtcgctggcccttgggttgtcgaatgccgttgacactttcatgctcgtgatgccgtccaatttcccttcgctgaatgttttggggttttataaaccacaattaccgttcggataatcgttcaaaatgccgatcaatctatcaatcaatgaatgtccgtgtgttttattattgattgatcaattgatcgcacttccatcgctgccactctttttacttgtacaatcgcttcgccatgtcccaatggtcgtccaattcgcttcctttctcaaaaaacatcatccatttgcccgactcttctgttgcgtaattgtgatgcgcccttatttggttggcattttctgcatacagatatggcatttgcttctcttccgatggccttttgtccgtgtttatgtacggtttcgatcgattgttcggatgagtgatggacgacacgggcacattggtaattaccaccgctacgccgtcggttcccttcagctggcaaattctctgctgccttggcgttttcggcatttttttttcctgctgcggttaaaaaatgtcaatgtgatcaagatttatgtagtaatgggtaaaggagatgttatgtcccccggatttaaagcttttaagccatttctaattaccattttaaagagatgaatttataataaggaaaagcatttacaaaataatatgtattaaataaaaggggggggggaataagtttgttcaataacaacgacctctgttttggtgggatcagtggaatttgttatttggaaaaggattgttgaccaaaggcatagaacagcactgacaaatgagcagactgaccaccgcagaaatctcgcagcccccgagggggaaagtgggaggaattaaatactggggcataatggggagggactttggataggatgagtgggataatgacggcaaaaacacaaagggaatgatggaggaggaatggatgagatatacaagagatcagtgggtataaatggcacgataaatgagagaagaaggattgattggcttgggattggacgaacggatggacaaatttatgaggggattgactcgtgagaaatagagaaatttaaattatgcacaaaattggaaactttgaatgctgcgaataacagcagaaaatttaaaatcacagaaaatccaaaatttttgaccaatttttttttaatggtagtaaaataaaattaaaaaaaaattaacctatatttaggaattggctgcccaaaactccaatcataagatgtgtatttttttaacggaaaacagaaaaaaacggacaaatcttaacgaaaaaagaatacggaaaacggaattccgccaatgccttgcgaagaatggcattcattgtacaaagattggagaacatatggaataaaataaaaaattggtgaaaaatgtgtcaatgcggggtgatggagaacagcagcagccgaatgtataaaagaaaatgcaaataaaaagcgaaaataaatttaaactgattttgtaatttggactcgaaaaactttgcattttttaattaaaaaagtgtttacctatagtcaaatgttgtacagtagaagctcaaattatttttgtgaaaatggataattatttttttttttttgcaaaattcattttatgtgttaatttttttaggatttaaaccaaactttttctcggagatgtggcgcaacgtacacattagacactggcgaacgacttgaactcggactgctgccggaatgagcagaagcaacaacctcagaatatttccgactgaaactgccttctcgagattccattctcgactctccgtccgtcggttggccaatcgcattggccgaagactttagcacggaaaactgatcagctttttgggtttgaatggcttttcctgcattatggcattcttctgctgatatcttctgactcttttaattgtattggtattaattttattttattgcccatttatttttttaaacttatactgatgtaccgattttctcaagtattctgggcgaagattgatgctgctttcgcttttttcggcttcatttatttgtcgaaactttgttttatcgaaaatgttaattatgtatatgttgaaaagaatgactaattattattaataaattttatatgtccaacttgtgttttttggcattgtttcggcattttttagcagaacaaaaacaatgagagcataaattaaataattagtcggtattatcatttttgtataattttttaatagaaaattatttttttatattatagaatattttttagtgtatacaatttaaggcaaaagcaatgccttatgtatataaatgcaataataaaacacgtaaaattattgaatgaatggttttatttcacccggacatgatgcaataatgtcataaaaattaaaaaatatatttgaaatttaatcgaaatattttttctcaagcaatatgtacagtatgtattattgaaagtttgctgttctgctactttcgcaaattcacatttgtctactctgtctcgacgtctcataagtaaattaagatttttttcgttttaagattttttagtttttatttttgatttcgggaaacgtctcgaaaaaggacacagggacatttgcgggg

SEQ ID NO: 4243 - DNA, 2498 bp, Heterodera glycines
tttatcagagagagaagaaagtgccccccccccccttggtctttgagattcagccgctgctgccgatgtattgcgtaaacaaacaaatggatttatttatttatttggcttttttgatggaaaaggacaaaggcaaaaacatggcatggcaaaacattctcattctcttttcccgtttcattttgttgtcttttttttacttgctgctggtacgaagggaatggcggctcgtagtatacagtttaagacccataaatttttgtattttttttttcatttagcaagcaaaaatataccatatataggtttccgaggtagctcgctgatcacgaatccggcattcatttcgaccaaattctgcattaaatcggttttgggtaataaatgaattttggtgaaaagcaaattttcgactttatgttcgaattcggtcaggggttcgaaatcggtcgaaaggatgccgaattcgtgcttagcgtacatgagcctgggatggcacggcatttccatactcaaaaataaattgaaattcttccattttcctatgggcctctctcctctctaaatttaaatttttagaaaattgaacagcttttaccccaacccttcctccacaaatgcagcacattctctccaaatttgtgccctcctcagtttcgttgcgtccccccgtccgatttgccggcatttccctcccttttggcattgcggagcgtccgaagccggccaaaattcagttgccgcccccgggcaacgaaaaaggccattggcactacgagcgcgaatattcgcgagacactcgctacacaaaaccgcttcgagggggagccttcaatttgatagggtaaaatgcaatcaatgtccatttgcactattaatgttacttgattttttaatgaattctgacctaaaaattgtgaattgttagatctgataagaaattttgcacaaaatttttcgtgaccaaaacaataaattcatttgtaaaataatttctttaaaactaatttaattaaagctattttctcgatgggattgtctcttcctcttaatcaattcacttccacttgaattcccccgtagcattctcctcgagcccatcaaacacaaagaattgtatccgatgttcgcgctgcccattttcgccgtcactttgggctccgttgtcctcctcatcagcgccttcaaaatcgaagtttggctcgaccgaaccggcaaaaattcgtacacgcccccgtgggattgggcacgcgttcgcgacaaatattggaagctgcctacacaaatgtggacatttaaccatttttattttaacacttttctagactttggactttcgagagcagaaagacatgggaaatgcccagcggcacttccgtgctcaaagtttcttgacactattgaccagggcttaactaaaaaagcttcttgccctttaagatttgttaggccaattatcgcttgtcaaaattgtcaggttccaattagtgtttttttgttcgctaccacagtgataaatacccaaaataattccccttcagttttatcaatgccaaattctggccaattgccattcttttgtcttgtgtattagtttgagttcctttaccgtcattggattctgttggggttcccccgccgggcatggaaattgccaaatcgatcggtagggctaaaaatgatgaacattttgcccttcccttaacccatttgaagggttactttgcctctcaaatttgctaattaggtatgacccgaccggtgtgacgcacgaacgccttttggtaatggaacagttggaggacgagttggtggaggcggcgcagaagcgcggcacccgcgacgcccgagggtatccattgccattgcatagccgagggaagggccattcggaagcgaaataaggggacaccaatcacacgaacaccaattaatggacactgtgatgatgatgatgacagtgatgatgcaacataatggtggcaccaccgccgcaattgtgtggcgtgccattcatttttgggacgtccccgttattacatggatttcctactgtaacatctggagtacggtgactttagaccttttgtttaaattcgctgtaaagacaattttagggggcactaattatatggttaatgtggattcccatatttaatttatggttttgtttgatttggcgacattcgctatgaaatgttaatgtattaattaaatttcgctttaaaattgttttttaaaaaattaatagcagaaaaataccggtttcatacacattccgagtactgacatggccctcaaatgggatataagcggcaaaaagtcggaaatgatgatgatggttgccagccggcgttaaatcctaatttaatacatagtttagccaaaaagtgctaaaaatgaagatcattttttaagattttttccttggtaaatttgtgagttacagttaaattgccgactcaataccaagaatcgggaaaaatttacgtcacacc

SEQ ID NO: 4244 - DNA, 3190 bp, Heterodera glycines
agcaggtggtagaatgtggaattcggcctggctttttcagagcctaggtcgaaaaagatgaaaccctgagcttggtcatgttttttccaaagatgcttttgtgaaattatcccttctccgcttgcctgaacccttccgagtaaattgtccgtgcgccgtgctcgccgaactgaatgtccgcgtaccaaagaaacctgagcaagcggttgaaagccgcacggattgagcccaagccggacacaatgggcgtgtcggacagactgagccacgcgggcaccacgcggactttgctccggtccaactcaacctgacaatgagaacacaaattccataaatccattttgaaaagtgtggtttaattcataatgagcttcttgtccatttttgaaaaggaaatttttttttataaatttcagcgatatcattaaatacaaaaattcaatttttaaaaagttcggattcaaattttaaagttggaagatgttcaagggtataataccgggcgactacttttaagaatttgaaaaatttgttaatttctggtttctggcgatgaacattttggaattggattggttttaaaccttgctatgattactctggtttttaaataaaatttcgaggggagggggacagttccatttttcaaattgtaccaattttttggagaacactcccttcgcaatggtcgcacaaattcggttcggctcctttctgtgcacatacattcggagcaaaaacagcgaccggacgcgcagcagcaggaaaaaaatgagcaaagcaatggcacaaaagaatttgccaacgatgccaagctaaaaaggggaggggggagaaatgcccagaaaatgccactgattttcctacaaaaataagaagattccaagagttacataacccaaaaaaaatgcaaaattaattattgtttttataccagaaatttatacaactgttcatggaattgtcattttagtaattgttaaaccaaagaatggcacgctaattgtaaggcttaaaatcattaatttaataaatatcaaaaaatttatgagaatttttggaagaatttgaagagaatttgaaccgaatatgggacgaatttttaaagaagtttttattacttacttgttaaaattttataaatttcttttaaaattccctcgcttccctactgtttgacaatgagtggaggaatagtgtccaaaggtccaaccctaatcagttcgttgtgtgtcactctgagcttttggagtgtgaatttgccgctgcccacgcgcacgaaatcatcgacggcaattaaaaatatcacgcagagaagggcaaacgcataacggccgaccgtgaaaagccatgagccgacccggtaattgtagacgagcagccaatcggacggccgaaggcggtccaaacggtagcgacgagcgacgacgtcggcacggaaattgtcggtgatcagctgaacaacgaaagggaagggagtcaacagggaattatggactaaattgggcaaaaaatgaccgggaaggagaatgcagcaatggcccaatgtattagggattagagtgggcccgtaacaaagggaggggagattcccaccctgggaacgtaaaaataaaaaaattttgagaaaattgatggttttgaaaaattgtcaatttgggtagagggacttagggtaatggaaaccacaaaatttgcaggtttagacataaagtcaagatcaaaacatgcggaatattgaagaaaaatgactcaaaatgttgaaatgaaatcaccgatgaaatccgccgcgcctcgcctctgccaagcgacggattttccgtgcccgagatgggcggtataactgacgaagttggaacaacacgaaattccgccgaaggatcggggggagggggacacggagtcgaaacctttgcccgcctttggtggcagaagaaacgccgaaaatgggaaagtagaaattaacattaataaagttgcataataaaaataaaatgacacaatctgattttccgatctccaaaactccctttcctcaattttttgactgttatttttgtagatttatgggttgttttccattgaaaaaagccagaaacccccaaatccatgggacaaattaaaaacctgctggaaatggtcgagcattgaaaacaactagcaaacgaaccacttgaagaaacaattgaaaaacagcgaatgattatcatcacttatgttttgagtttcaactaaaatacatttttcatcaaaactggctcaaacccacataaaggtacaacagtcacaccacagattttgcaataataatgaataaattgaaaagaatcaacaaaattgttttatcagcgcttaaaaagataacaataacaccaccaaatcgcttaatggtttttcgtgattcaacgacgtcctgcgccagtcggcacaggccccttcacctccaagttgagaccaagtccctgaaaatatgaaaatgcactatgcataggttagaaacaaaaaattgcaaattaatatgacaaaagaaggaatgtcctttcgaatcccttcattgttaatgttaattagtaggtttgttttctcaatttcaaaaaaagaaaaatcccgtagaatatcgcacgcattttctcattaactgaccaaatactcgatcatgtccttcgtctcttggtctgtgctgatcgtctggtgattctgtgcgtcaaggtaggaaatttccggcatgtaattgtcccgacgttcccgctcctcctcctgcaatttgatggaaatgccgcggacagggcctcgctcaatccgcttcatcaaatgggtgataaacctgcaaagtcccaagtgttttacttcaaatcattgaatgaccctacaaaataattttttcaacaaaagaattgagtacctctcgtcctatttttttacaatttgtaataggacaaaaaaatgttagaaatccaatttgttttaagacctaaacaaactattgaatcagactgtacatcaccggatttacaagtatatacattttaagtcataacatttttattttttggtcttccttttaaattgtcaaagccatgaattttactacagcttacattaaacgaaacctgaaccactaaagttcggaaacgaaaacaaacaaaatatttgccgtacccggcaattcgattgcgcttctttttgctcg

SEQ ID NO: 4245 - DNA, 2929 bp, Heterodera glycines
attaattactcagtgtgcgtgtggccaaagaattgtgcagaaattgtactcgcaaaactgatgaagtgcaaaaggattaaaatggaaataatttgacaatttcgttttgcccccccccccatttgccgtcgttgaacccaccgtgtgacaatgcggtaatagttgcgggaccaactctccaaacattcgttgtccccgggagggatgtgcgccagaatgtaggccgactgttcaaatgtccaaattagcaattaaatgaattaattaaggaaggcatcgtccaactcctaattgactattttaagcacgtccaaatcgctttgaagagggaatggcatcgaagtgaatgccaaactctgctcacctcatccgctttctctgctgcccataattggtcgaccagccaactcagcgacccgtccgggtccgtctgattgatgtaaatgaacctgggacagaagagaaagcgagggtcagtgatcgaaaccaaactataaaagaataggagagacgcgagagagcgtggcaaaatgagaggacggacagattgagagcgacgagagatgacgacattccccccccccccctccgttaagtgatggtttgttccccgctaatgggatcgctcgttaatctatcataaattgccgatcactgacaatgagcatacgaccactcacatgttcgtcttttcgcagtatccgttgttcagtgagatcagtcgaattccgggcaaaagtggcaccatataagagccacgactgaaaggttagggaagggggaatttggccatttacacccttttaaaatgtataaaaatagttttattatatatgcgatccatttttattttatttttccatttccaatttcattttctttatttatttttactaaagggcactacgctccgcctcttttggcagtcgcgcggcggtccgttgcaccgcgtcaaccattgcgcgatacatccactggggccggaaccgctccggcacgaaatggggtgcgaatgcattcaccggcacaccctcgtggttgccgagggtccaaaagacgggcacagtgtcaaagtgatgacggagcaacgcggacaattgatccaactgggacaaatggcccacacgggaatactctaacaaaaaaggcagaaattcatggatggaattgccgaaagaaagtaaagtctgagaaggagcccgagaatctcgagcagtcctttggcgcatttaccccagtcgcggtggtccatgtaatcgccggaaaggaaaacaaaatcgatctgaaaatgattgtgaattggccggccggtatatgcagacaaagggttcttatgcttaggaatctcgaggaaagtttcgggaaataaattcccggcttttccttttttggactaaaataaaatataaatgtgagtgcctcgtgagagcgttggatgtgttccagcatattctccactgtgcgcagcttaaaatcacgaaaaaacttttcggaaattcagtttttcttaattcattcccttaccggaatgtcacatttggccaatgtgccccatttgcccgcgggaattcgaacttttgtctgccctaaataccaaagcaaatgcaacatgtcaatttcgttggccgatcactccgaggggtgccaacctggcgatgccctctcagtcccattcacacagcacaccggctcagcacagtccgcctccgtcccggacgcgtacttgcggtcaaagtgcaggtcactcaactgcaaaatgcgcaaaggccgtgccggcggaagcaaattgagggtggtggtgtgattttctgccggcggccgagacaactttttgatgccgttgacttttggcggtaacggcactgtcctttggtgttgaggtgattgattgatcagcttcaatggtccctcttcctcctcggcttagagcaaatatttcgcaatgtttttgatcggataccattgataacgaatatgctcaaccgaattgaaagttggtgggatttacagacacttaattaatcctgtcccggtccatttctgaaatcatgaaccgttagtttttaaaattacagcctatggtgctctttccctcaacaattatggttacggtaggttacagtaatggggttatcactacgtttgtgacaacgtgttccgtccgctgtccgaccgactgactgaccaattcgtgccgaatgggtccaacggtgtgccgcaatcggtgaccaacaaagcgcagagttggccgggactgatcacgagacggcccagcacgtagaggaactcttcccggaactgcgtggtgatgccatggcacacgaacgaatccgagtccgcaaagtgacggcacacaaaatcggcaacactcaaaattcggtcggccgtcgcatttgtctacaaaatggtcattcaaacggaccgatcaaaattcgaaggcgtaaatgagccaattgaacggactgatcactgatcagcgaaaaaaccacctcatataaaagtcgaaggagttcgacaccgccgcgacacccatagcatttccacggaaaggctgcgaatgggagacaaaaacaatttaatgtgcaaataaagccatttgagcatagacaacaccatttactgctgctggtggttggagaagaagtgctgaatttgtgaagagaagcaaaaaagtgccaattcgaagagaaatgccatcgaatgagcgacgaaatgccattttttacaaataataagccgagcgatggagctaattatattttaataataatgtgaacatcaaaaataaagtgaaactgaacagcaaacggaaacgagagttcaatgttttgcttatgcaaaggaatttgtaaccaaattcattaatggtaattattaaataattaacccccagataagaacctaattagtgaaattttgataaaaaaaa

SEQ ID NO: 4246 - DNA, 1477 bp, Heterodera glycines
attgatcaaaataattgaaagattcgtgatcggggaccccaaaaaccccagtggataaatttttatgactatcacaaaaaattttcaaaacaaaagggtccccccttttgaaaaaattttcaaaaactgtcacttttcatatagtgccaaaaaaacaaggaaattacaattgacatccatccatttgctggaagggaaacccaatcactctgtcaaattccaacgctcacaaactcccaattccgatcactaattgcgtaattatgggcggacatcgccccttccgcgactaattaacgccctcctttttattaacccctcggggcgctttgctcacatgtcggactgtggcagcagacaaatgggagagagtaacaaaaacaacactaacaactgacgcctgtcgcatcgcaggccttttttgtcgtttgcaccgcatttagccctcgtgttaaaaaatcaattttataaaccgaatattcatacacaaaaacaggagtaaatatagtcatcagcaaaaaccattgaaaaagattttcaaaatatcatttgcgtccatttggatgtttgtggccctaaagagggccgtttgggattgttttttggttgaagttctcttccgtcaccgttctgctcagccaccaaaaccgtacaaagttcggccctgacgtttcagcgcgtaaacgacatccatcgcagtgactgtcttccgcttcgcgtgctcgcagtaagtaacctaagaaaagaaaaattggtaaaatatgtacttaagttagggtttgctccatcccatccctatttttcgagaaatttagtcacaaaaagcatttcatagaatttccgggattcaaccacactcagacacctaattggaccaatccctaacaaaaaaaagatattcaccgcgtcacggatgacattctccaagaacaccttcagcactgagcgagtctcctcgtagatcaggccggaaatgcgcttgacgcccccacgacgagccaaacggcggatggccggcttggtgatgccctggatgttgtcacggagcacctgagaaaatggggagaccaattagaccttgaaaaacacgcctaaacaaagcaatattaaaaaaattattaattaaaatcacaaaattagtcctaattccgcccactcacttttcggtggcgctttgcgcctcccttcccgagtcctttgcctccctttcctcgtccggacatatttagcacagtttagttgaatggaaagcagacagaaaacgaatgaaagaaggaaagtgaagcgaatgcagcgcttggcgtccgttttatgcaagggaaaaacgcgggaagcgaagtgcaggcacacggcgatgacttttcgtgtcgataataaagcatttgaaaaagggcgctccccgctttttctctaactcatcggttctctctccattcctttctctgcgctccttttcaacttgcttagtgtctgcctt

SEQ ID NO: 4247 - DNA, 5830 bp, Heterodera glycines
cttctttcacacaacaaaatgccaccaaaaccatccggcaaaggggcgaagaaagcggtgaagtccaccaaagcggtgcgaacgggcgacaagaagaggcgtaaggctcgcaaggagtcgtactctgtgagttcggaattcgggggaattttcagtgccgagggtttcttttcaacagcgttttcggaaattatagttaaaaatggagaatataatgtaaaaaaggggaaccgaccacttcggcgcggaccatttcggcgccgattcaaataacttctttcattatcaaccaaattaaatatttttattatcattcgatagctcttgagattctctattagcctgcaaaatttcaaaaaatttcatctgttcacaaaaaagttatggccaaaaaactaactttttcttggctttttcggcgccgcgtgccataacttttttattgttgaatcattaatttctattttggcatgtaaatatagagcacacatagagctttcaaatgatgatggagaatataatgtaaaaaaagtacttacggtattcttgtccccttccaaggtgtacatctaccgcgtgctgaagcaggttcacccggacaccggcatctcctccaaggcgatgtccatcatgaactcgtaagacattttcaaaagttaacgatcactcatgaattttgcttgtcaggttcgtcaacgacgttttcgagcgcattgccgcggaagcctctcgtctggcccactacaacaagcgatcgaccatctcttcgcgcgaaatccaaacggccgtccgtctgattctgcctggcgagttggccaagcacgccgtgtcggaggggaccaaggcggtgacgaagtacacctcgtcaaagtgatgatgcgacggtgctggcgatgaaatgaaacccaaaattatcccaaacggccctctttagggccacaagcacccaaatggacggatatgtttttcgaaaaacttgcttttgcattttcttttgtttgaataaatttggaaattattgaaattcttctttgggtattcctcttgcattttttgagttggggtgggggcgaaggttgttcgaattccaaaactggaaagaccaaaacaaatttgcttatctttgtacgtcttaaggtcgacttcggtgtccggcaagggagctcggcgcgtgaacaatcgaaacgtgtcacagaaagacagcacggttcatgtctctaatcattcgacggaaacgttttccgactcagtggtgacggaagagatctttgaggtcgattgaaaccggtgaccgttgtgtataattttttttcgagtggccattcccaaatttttgtgataatattgtttttcttgtttctttttgaaaaaataaaaataattccgtttaaatatttataatcgagattttcgccactaaaatttgcagcggaccgttaattaatggcactgtgatcttttcattttctcctatcatcgccccgttttcactgttttgttggccgttattcatcaaatcacaacttttccacaattttctcctccccctcttcctcattatttggttttggctccgattgtccacttttaatgcgcaaatgttgttgctttgctgccaaatcgccgatgaaactttccactgtttcgtctgaaaattaaaatttatataataaaggttaataacactgtgcaagctttcttcggtttacccattgtcgagttttggtcgtcgttgaactcctccttcatgtcgtgcagtcggagcagtgtcacaatgtcggcatggcaccgttccaccgccaattccaacgccgtccgtccgttcacattttggtgcgttttctctgcatttcgtttcaacaattgatagacaattctgcaaaaatggaaatgggatttaatgtgtttcgcccttctccgcctttccccctctctaatcacattgtatggccacgttcggcggccaaatgcagcggcgtgttcttcccaccgtccaatccgttaattttggcgccgttcagcaatagaaactcgatcattgttgtttggttctgacagagcgatcgaattacaaaagtttttccaactcaaaattggtatttttggtagttttttttattaataaatcacgtaaatttgttcccgttgtaaacaaaacgaacattttcaacagcaatgtgcagtggtaatgttattgttgttgtcattgtcgtcgtccttattgctgcaattactgctccaccatgttgctgctttggtctattttgctgatggcactgttcaatgttggcatttgttgttgctgtagcatcgtttccgcttcctttggagttgcttcccctctcctctccaccatcttcgtgttgttgcttctgctgctgctgttgttgtgtgtttgcgtgcagttgcaattcctcgttgaggttgagaccatcctggatcatcgccctaagcacctaaattaaaaggggtaaagccttttggcccatttcaaaaagaaaaccacctcctccaagcacccggtgcgcaacgcgttcacaaggcggcggtgctgctgcccaacaacgccgcgggcaaaacaggcggacgcccgttgggcaatcgccgcgcgagcgctttgcaccaaattggagtccgagccgaaggaggaggcacgggagaggcgattttccgctgtaggatttaattgatcattagtaatttgaaaaacaatctgactgatcccgatccaaaaaaggatgaaacacgatcaaagaattggaaaagtgagatttgaaaaatataaaattaatttattcatttatttgtaatacgagaatgaataaactgtttgcatttctgagttttaccataaaagttgtcgtcaaccgacaacgcatcggtaacggcggcgtcgtcaagcagtacggtatgcctcagtttgaccgtagtgcttgttgttgctgctgctgatgatgggttcgtttctgttgagtgttgtgctgttgcacccgtttgtcctccatcactgccgccgccttccctttcatttttattcagtgcagtgaccgagcgagaataagctgaaaaagggggagaaatgaagacagttttatcggggggaggttcactgattgtgagtgatgcgatttttaattagccaatcaaatcatgacaatgggcggaaagggcgatagtgtaagtcccaaaggtgattcttcaaaaccatatcaacacttatccaatgtctgatcagttcggggtacaacagtaatacgatcatccactttaggttctgtcattgtcacttttctaggctatatatttgaaattttaaggattttttgagtgggatattttaagacaaattactgatttctgagtgtctcattgttaagccacttaaataaataattgtagcatccaaatgatcatttcatttcattgtatgtgcatttgacacactcacccatttgatacaatggctgcgatgcgaatttcttctccacgtatttggcgacgatccactgttcacggctttctctggaaaacattagatttctcattggtgggctattaaatgtcactttgccatgctttttccttcacctgttcgtgtgccgactgatgcccattttggcattttcctcggcatttggcaaattgcgcaggaaaatggcgttcactttccgattgccgagttgcaacagaatgttacggtgctccgtctccagcgtgtccatcgtaagagaactgacacattttaaaacaaaataaatttaatagtaaaatttgaatttactatagttgtttgaaacgcaccggactttggagaagtgaactccgagactgcgatggacaccgcagcactcaatgcaaatgatggcctaattgtaaatattatgcaaaataagtgatgaacaatttatttaaataaaaagaaatgggggggggcaaaatgatatgacacaaaaaatacacataagtacccaaaaaaacttactataaactacaaattcgttgcaaaaattcgtcccaaaaaagtaaatcctcaggtgtttgacaaactaagcgcgggactaattaactcttaattgggttctgggttgatcatactcatctgatgcggttgacccaattatatgggaaaacccactccgatgtttaagctggtccatttggcgtccgggcagccgcagtcggcgcatctgtcgttgccggggatggccagcaactgcttgaggaactgcttcatctgctgcttggcgttctgctcgtcgtttgctgtgggctgccggtgcctttgcgtggccaacgacgacgacgaggcactgtccaccgaggaaacggagggcgtcgcaaagggcctcactgacatagcggaggcagaggagtgaggttcagcaacggactgaaacaaaacaaaacagtgaaattttaagaaacgaaacagagtgagggggtgggaagggatgggttcaaaatttcccacaaaaatatagagaatttagagtcaaaaatcagtccatctgttacgcattgttagccacccacttctccgtcggctgcttggcactgtcctttgatggccatgtcgtcctttgtccgtcgttgttcgtcttggcccctttcattatgcacggacgaagaagaggaagcagggaccgcctctgttaaacaaatgcaaaacgatgccttattacgccaatgcaactgaccggtggcagatgtgattgaagtggcagagactgtcgggcggaggccgccgatgaaagatttgcgcgattgggaatacgaaccgtggtcgtcctctgcaaaagtgttccataaatcggtaattgcgggttggatgttagcaattagattaatccgcccaaaagtccgtcttggcgcgaacggaaatcggcaaaaaaacgcaccgtgcaaattttggatggtcctttgcagcgcgcggatccatgcgttgcacaacgactcggaatccgcctgcagcaaatgacttctgcggcaaaaacattggcattatgattttaaaacgacatttagatgccatccctcttggacacactttgtgggagtgaccagctcgaaacagcagtcccggtcgacggtggcgggcgcagggcggacgaggcacagtttcaggttctcctccatcactgtgggcaactccggctcaccgtcgttcgttttgtgcgagtacaactgaaaaccaccaaaacttaaaaaacgataacatcgtgaaaacatgttcccaggagtttttggggtcactgaacacgaatcagcaaccgattctgtaaatcccgaatttcgcactgatttcgtcagactccactgattcggcccattggaaagatttaaatttttaatgcaagattgattgactgaccggcggggcgtcaaaaatcatgaaccccgccccttatcgtgcaaagcagctaatttttatttatttttatttgatttgatttaatttaatttaatttgttttccttatttttaattattttatttttattttattttattttggtttattttattttaatttattttattttaatttattttattttattttattttaatttattttattttatttaaatttaatttattttaatttattttattttatttaaatttaatttattttaattaaatttattttattttattttattttaatttattttaatttattttattttattttattttaatttattttaatttattttattttattttattttattttaatttatttaattttattttattctttattttcagtaacaatttttacggtttccagaattttcagaatctgttctggctgtgtttc

SEQ ID NO: 4248 - DNA, 2031 bp, Heterodera glycines
ccccccccccccccctcccctcggcccctccagaacatcatttcgcaaaaaatttggttgaccccccccccccttttcatgtatgagctcaactccatttgactcatttttcaataatttttccatgcctcctaggttcaagcaattttggttaaaagataccatgtaagtggtgtaaaagttgtccacgttttgtcccatttcaggtccatggtcgcgtgtggagggttcgcccacttctccgaatccgaatattccctttgctaaattggacaataaaccgttattcaatgttgacggccgactaaacccttctctgactatcctcggttccgatgttaatgtgcccagggaaacagtgatactgaacacggtaaattaataataattagcccaacaaattttaagattaaatcgttggaaaattaagtcagctaattttaaggttgtgctgccgtataaggaattgtcggctaattacaagaatcaaattattctctgattcgttttggatggacagagacaccaaaatgataatttatttttctttgttttcatattaatttatagctatatcatttatcatttctttgtttttcacttttttatttgtgtattcgttgggataatattaattacgcaaattgtttacaaatttcgttttggtttttgaccaataaatatttgtttcttattcatactttaaatttttggcttgcattttttgttgtcatgcgtttttgtcaaagatcggttttctctctttcgagtaagttttttccgattttctttcccttttttctctttcgtagggcgtttttacgtgtcctacgcgcaacctcagcagaaagtgcaaagtgaggaaaatgcttggaactcattcatttggccatgatttccacaattagcatataaacgggagaagccgcatttgaacgtcggtacaattggccacgtcgaccatgggaagacgacacttagtgcggccattacgaaaggtggcgcatttgctgaccaattccaatcaatgttttgaatttgagaattgtactttgttttagtaatttgttcgttccttaacattcaccgttttaagtgctctcacggcagaaaaaagcgcgctttgtcagttacgaggacatcgacaagggcgcggaggaaagggcacgcggagtcaccataaacatagcgcacattgaatacggtcagtgggagtcatgggaaacgtacaaaaggcgaatgtcgtgatacccttgcccaatggggcgtaaataatctgacgatgagacaacgaaatactgaattttggccacaaaaacgaagtgccaaacttttgcatgtattttgtgccgtttcttttttgtacgattgctatttttgcctgatcaattgcgccgatcactcccacattttgtttctgttaatgccatcttttcactgtttccagaatccgacaatcgtcattatgcgcacacggactgtcccgggcacatcgatttcatgtaatgttcatagttttaaacataatacggaacttatacagaaagaatatgatcaccggcactgcccaaatggactccgccgttttggtcatcgcagcggacgacggagtgatgccgcagacgcgggaacatttactgttggccaaacaaatcggactgcgcgagatcatcgtgttcgtcaacaaaaccgacttggtggacacggatgtaatggaattagttgaagttagtgtgggcaaaagtgtaaatgcaattgcgataagcgaatgcctttgacagatcgaagctcgcgaactgctcaccgcctacggcttcgatggtctttgattttgcgataatatttatttttcatgacagtttaaattcttttgtattatttattttttaggagagaatgccaaaattgtgtttggttctgcccttcgggcactcgctgatgacgacgacaagtgcattttggagttgatcaatgcgctggacggactggaggagcccgtgcgtacagaggtactgcttggacttcgcatgc

SEQ ID NO: 4249 - DNA, 2959 bp, Heterodera glycines
gacattcacgtggttcggcaaaagcacagcgcaggtggacatggaagacaaaactttcaaataaaaaaacggcttaaaaccccaaaaatggcattttgaaaatcttaacaattcacacccaaaacttcaaatttttcccggcgcgcttatcggcaccgccggcttcctgttcccgaaaaatttttcgaaaaagcgcgttgcaaaaaaaagcatgaaaagcaaaaaatattttgtcaggggcgggcccgtgcccttggccctccgcccaaggcaacttaaattatggtcaacatttcctcctttctcatcgattgtcagagttcggccggtgaacacgtcggtctgctgtgtaagaatctatactatgatccaatttcgcgtggtttttggttgacaaagccgggaacagtgacgccaacgaacattttgaaagtttttaattcctttgaaaaattgtagtgtaaaataactgattaggtggaattcttcatgttgagcgaggcggacggcgggcggaggcagggcattcgtaacggattccaggaaacggtgttctgtactacttggaattcctgcgcaaaattatttttcgactcggaattggtcatgccgggcgaacatgccaccggcacattggtgttcttgaacaacgtactgataagtaagtgcgcttttgaggccatggtttaacataaattcacctttcttctagcaatttttcttttttctcccaatttttagaaaaaggtgccaaattcactcttcgagagtctcgtcagcggacggttggctacggcattgtgtccgaattgtacaagccagttttcatcgacactttcaagaagaaagttttcaactttgagaagataatggaaagagcggaagtgatgacagagggaaatgtaacgccatgacttttcattctttattttattttagattgttttaaaaaattatttatttattggttttatcagtttccgactcattgtcagctgaactttttcttttttaagtgtgtttttgtaaattgtcagtggtatttcgtaaattgccgttataaaaatggcaacgaattcggcatttgaacggttggatgattacatttggggtcgcgctgacgagggcgaatttctgcggggagtggtcgcagatgagcgattagacaccgagaaactgttgtcgcgagtgcaaaacattcaacgggaaatgaactcgcgtcttcgccaaggggtgaaaaaaatagaaaaatcattgaaggaaatgccaatttcaggtggaagagaattacccaagtctattggagcaggtcagcaccatcgaacagttggacagtgcccattcgcacgtccaacgcgaaatggacgcggtggtgaggcgggccgacgcattggccaaaacgatggaggaacaggtcaacaacggagaagcggcaattgggtgggaggaggggagcggagagaagggagggattggtgctatgacatcactcaaaaactaatcaaaatagaaatcccttaaatcttcaaacccaaacatttttgtttttatgcacaggtgggtaaaatccgtaaggatgtgcgtgcaatcgcttctctgacccaactgagtcggatgcaaggcgatgcgatcaggtcaagaaatttttaaaaagatgtgattaatttgtttgatttaaaatgtgggattttaaggtgcgaagaattggtggacgcatggcgcgcggagacggatttgatcagacggacggaacacatcacagaagtgaacgcaattgtgaaggccaacgacaaactcagacatgtgcggtggcattccattgcatttaattgcccaaaaaaccctcagaaaagccgaaataatgggtgcaccccaaaatttcgccgccgaaattttgtcccgtccccgaaataattgctcattgtcacatattttatgtacattttcagttgaaatggctccagtaccgttgtctgttcagtctttccgagatgaactcgcgcactcgtcaggatttggtcgttcagttgcgttccgcgctccgttcgctgaacgcgagcggagtgagtgccgttgtgaaggcattgcaacaacttttgggtgagtcgcgagcgcaatttggcgacattttactttattagtaaacgaattgaatgaatttgtaccattttgtgcgttgtttcaaacaaaaaacttttcgccagacggtgtccacgcgtgtcagaaggaactgaatgctgtgatggacgagtccgtctcggagttggacgcgctgttccttcagttggacgctcactcggcaccggagaagacagccaaactgttgccgcagttgggcaacaaattgcacacgcaattggaacagtttcaattgttgggtgaatattttgaattattgagctgaaatttattaattttaaatttactttatttatttttgcttgttaaggaattgaaaacgcgcagcaatttgcacgacatgtgggaaaagtgatcacttcgagggtaatacaatgtttttggggttcccaatggattgacttcaaaggtgccacccaatgctccgtacgcaatgcgacttgttcagaccgtctacaaatgtgtccaagcacacactgattcagtcgccacagtgattaggtgaaggcatcgggtgggggggcggagatggttggccaaccggacggaagacgatgagggaaagaaagggcacgaacgaacattgattgaccggcatatgccatctacatcagaaacgatcaatcgtttatttcattcagagacgcactcaatccgttgaagacgagcattctgagccaatcattcaaaaatcttaccacatttgtcgaccaaacgtttgagcaggacgaacgcagagacacaattgtagtggagcaagttggtagaacattctaattaatctgttcattgttgaaatttctttctcccctggtttctc

SEQ ID NO: 4250 - DNA, 1684 bp, Heterodera glycines
ctcattgtcacatattttatgtccattttcagttgatttggctccagtaccgttgtctgttcagtctttccgagatgtactcgcgcactcgtcaggatttggtcgttcagttgcgttccgcgctccgttcgctgaacgcgagcggattgtttgccgttgtgaaggcattgcaacaacttttgggtgagtcgcgagcgcaatttggcgacattttactttattagtaaacgaattgaatgaatttgtactattttgtgcgttgtttcaaacaaaaaacttttcgccagacggtgtccacgcgtgtcagaaggaactgaatgctgtgatggacgagtccgtctcggagttggacgcgttgttccttcagttggacgctcactcggcaccggagaagacagccaaactgttgccgcagttgggcaacaaattgcacacgcaattggaacagtttcaattgttgggtgaatattttgaattattgagctgaaatttattaattttaaatttactttatttatttttgcttgttaaggaattgaaaacgcgcagcaatttgcacgacatgtgggaaaagtgatcacttcgagggtaatacaatgtttttggggttcccaatggattgacttcaaaggtgccacctaatgctccgtacgcaatgcgacttgttcagaccgtctacaaatgtgtccaagcacacactgattcggtcgccacagtgattaggtgaaggcatcgagtggggggggggcgaagatggttggccaaccggacggaagacgatgagggaaagaaagggcacgaacgaacattgattgaccggcatatgccatctacatcagaaacgatcaatcgtttatttcattcagagatgcactcaatccgttgaagacgagcattctgagccaatcattcaaaaatcttaccacatttgttgaccaaacgtttgagcaggacgaacgcagagacacaattgtagtggagcaagttggtagaacattctaattaatctgttcattgttgaaatttctttctcccctggtttctctttggatgcgtaatcccctcaccttttttacagcttaacgccactttccgtgccgagttggccagcgtggcttgggacatggcattgcagcgcgaaatggagggcaacgtctccaaggcgttgcaatacgtcggggtgaagttggaacagcaaatgacttttggcgacgacgccctccgtttcaccggtcgcatttcacgtgctcaaactcacaattaccagctgctgaacattgcacacgaactggcgaagtacgtgcatcaaaccaaattggacactcaaatttatcatttgaattcttctatttttagatattggcccggcctttgtggccctcttttttcactcatccaaacggccgtcaacacaattttggagcgaatgcgcaccaccgtttcgcttgttttagactcaatgcatgacgagaatttggcggtcgctttggcacccagtgccacctcatcggaatatgtgaaggagctgtgcggacatctcaagtgagttggcacgggtgggtggcctagcaactggttatatccagaaatgagtaaatgactattttactgtccccttttaagagtgttccgtcagcactgtgtccaggtgaagccattgccgattctgtcgaggctatgcccg

SEQ ID NO: 4251 - DNA, 4210 bp, Heterodera glycines
agacgagcattgaccgttttgtgcgtgactttgactatttgtgccgcaacggactcgaggcgggcattccctcactcaccaagtcgccgaatgtttcatctcttccaggcattcaattgtaagtgcgccaagctgctcaactcacaacaacatctcaaacaaatgcttaaacttttgctggacgcttccgacagaatgaatcatttggctgaagtcgtcgtgcgtttctatttcccatgccgttctctctctcttgtatctgtgcttctttcagaatggcacttcgcccctttcttctgtggtgccccaatggttcgtcgcccatttgttgatttgtgtctgtggcacggaattgcgtctcccacacgactcgtaagtttctgtccttttcctttgtctgctgggcttcgttttgcttataattagtgccgggtggaccattccccaatacgttcattggttcaacacgcattccgaggtggagaaatggcgctttctgcgcaatttattggacgcctacaaacattcggtggttgcgcgtggaggggctgaatttgtgcccaactttccgattctctgtcaaattgtcgatgcgaatcttctcaaaactacggcaccgatggcataatcaattttacataataattttatttatttgttttcccttctggcttctcacatcttaatttattaattcggactaatcatctctttctaaaagtgtaagcggcctttgttgttcccttcctctggactttattatttgaataaataaataagatttactttttgtttttccttttggcttctcgtcttgatttattatattacatgtacagacaaagaatgaacaaattaaaaaagcaaagtgagatcgttagactttccaatgggattgaaaatacattggcttttgtccgtttttttccttcaaaattctgtgccgctaagcacttgttcagaatccagcacatgtccaccgtccgttagtaacgcaacttctccgtttgacctatgaaatggtgtgccatccccgccaacatcactcgagatcgccatcgtcgtcaaatggtcaacaacagcggatcggtgcaaagcatcggtggtcgtttcgaccatttctaaccactgggcgttgtgccagcggaaccgcgcctcgcgtatacgttctcgccaatgtgcattcacttcctgaaacatacaaacattgggtccttagtttactcattaaacaacaaaatatgattgtatccctacacaccgccactctctccaacgtttgctcacacaacgcgcgaatttgcgtgtttttgtcgtgcatcaaattgagcaaaagcagcggaacaaccgccgctgtttccaccgctttctcccttttgcttttgcgtagattaatttcctctttctgttgacaaattcgcttggccatttcgccgccatgcgcgagaagagaaagaaaaacgaaaacgcattgcaacacaatttcgtcgtcgtcttggcggtctaatttagacatgggacggaggctacctaggaatattgggggttcaaatcactcactgttcagtgtcgaaatgatcagtggcaacagatgcttctccacccgttctgccatttcaagggaatgtccggcgaccgtgccacacaattggacgaccttaaattgtttcatcctgctggatggttttgtagtgaataaaatgataatgagtgtgtgtttcgtttctatcgtccaaagttcgatcgcttcgactgtcacctgaagcagcacttcgtcggtgatcgttcccttctttcgctctttgcccttctcctcctctgctcctctttcgtggtgttctcgccctttccttctgtccaaagtgttgtgcattgactttttcgtttcgtccctttcgctttgctgcgatcgcttcaaaatttgggctaaaaatgcgactacactgtgactgtcctccaattgggcccaatttgcgttcggaagcagtgcacaaatggccaaacattcgagcgcaaaaatggacgacgcaaaagatgagggtttgagaggactgttgttgttattgctgtcgtctccttgggccttctcgacggcgttctccaacagttggggcacccatttggtgaacatttcccgggtggggccctcgtgggaggcgatgtttcgtgcgacccaaaaaaatatgaaaaagaattattattccatctaaaattgtgtgtttttatcactttcatcgccaaaacgtcgcccccttcgttttccaatgcgaatgccatcagcgagtccaatccttggccctccgacccgcacaacagttgggcattccgcttctccagcacaatgttcaccaacagcgatttgaccagcagagagcgcttccgccgctgtccatccgccgtttctttttttgggcgtccgtcgccgtcggaaggggggcgactgtcggagaagagcaaacggaggagctgaagaagaacagccaaaggaagaaacatccgggaaacgaacagtccaaaaaacatacggtgggaatgcaatccgtaaaagcgatcatcgctttggcatcgtccacaatgctgagctgatacatcagggccaaggcaacatcattttctgaaattaagcaatggcgattttaattggcttgtccaatccgcgcatttgcatttgcttctcacccgaaatgtgcggggccaacagagagacgagccccgcggcgaccatacagcggcgagaagacggctcgaaggaacagttgaacaaaagggagaaaagggggcccagaaaatcggagggcgaggaggaggacagtggcaaagggctgccgacgccaccacaacattcggatacggcacttttcagagacggtgccaaaagtgaaaccaaacggtcgatggaaccggcggtgttctaagcaatagaaaaacaacgaaaaatgaattaaatttactgcgatttgctgctgattctctgaaaattggctcagcttccacagaaacttcacggccactgtcagcagttggggcgacgaacggtggtcgaggcatttgaaaagggtcggcaaaaggcccttgcgcaacattttgtgctccgtccgcaaatcgtcggccaaattcaacagtatgttaaggaccactaaacacaatcggcattaatttaaattgacattccattctttgtagcgacgctcaaaaatggaattttgcgtcgattagtccggaattgctcaatttttcccagtttacccgcgatcagttggtcctgctttctcatcgcatattcccatttgagtcgctctttctcctccttttcgtgcgtttgctctcgccataattcccaacggcccaactcaaaatcgaccgtttgtacactgagcagcccaatctgacgaaacggagaaatagtagaaaattgaaacagaaaattcacttttaaatgcgaaagtgtgggatgaaaaggcgcaaattgggacagccgacggaaaagttgggccaaatgaattgccaattcgaagtttttgcgcgagtcctttaaatggtttggtgaatttcggtgacggggagaggaaaaaggacaacaaaaaggcaaaaaggacaacgagccaattgtgccatcacctcgcgccaaattcgagtcagtgctcccatcagctgctcattctccacaatttgtgccaattgcgatgcctcgacatggcgtaccaattccgcaagcattgccaccccgcgctgcttgggctccccctcctcgtaaagcaattccatgtaactctgaacacagcaaaattggaagcgaaagcggacgtatgggcctagcctatcgactacctccaaatcgtccatttttgcatgaatttccatgctggccagggaatcggaatctaccaaaaaagcaattattaagttttgtcacagggcataactttcgttagggttgtgccgtttttgcaggtaaaagacgagccgttccaattccgaaattcggtcggaagggaccaacggttggcattggtccaaaacgagtcgcgcgaccgcagccgtgtcactgcgctcgttgagaccattcagttggacgcttaaccaaccaaatgtttaccaggtaatagtagggtttgccccccccccataacaaaaaaaataatttttttgtttgaaattcatcaaaaggaattgcgctggggttttaggggtcgctgatcacgaatagaca

SEQ ID NO: 4252 - DNA, 4166 bp, Heterodera glycines
  misc_feature (42)..(42): n is a, c, g, or t
tccttgagagaacggtaccaaaaattaggccggacaaataantcggtggccaaaaattggagaacttgtccttgttcatcatccaactgaaccccgttcactatggaaaacggccattattttaagaataatcagaaatgagtctaacattcgcgacacggccgaaattaaactcccttccggccacatttcaatacggtccattaatcacttgtacccgctggaaacagcggaggaagcaatgtaccgtatccaccaccgtaattgggccacccaacctccgcttccggcaaaaattacctctgatcgcaatacacttccgaacgctgactttcccagaacattacagcaaaccaatcagcaaaaaccgcaaacagaaattccatccaagattttcccaggcaaggcttgggccccgctccctcctcaaatcaacccccgcccgtgaagggacttccgttacaacaattgtacaaagaccatttcccccccccctcttttttcctttttttttttgttattcattttccttggccaatgttccgtggcgggaaggcggactgatcgcagtgatcagccgatttatgttccacttatcctatttaaacacacaactcccttttttcattaattttttaaaattttactccccacctttttttagcaatgggcaacattttttctcttgaaattttttcgtttaatatcgtccttccttggtggagcccctctcccgaccccaccaacaattgtggcttcttcatttcccttctgattgccattctcatcctcattttcctcctctgcatttgttttttgttttgccgtcggatcaaaacttctgctgcacgttcctctgctggtcggcacccaaatcgtacccggacccaaatcaccaccgtgacaattttggtcatgctcttggtcagcctattccaccacgcttcattggcctcatattttgaggagcagcctgagctttccgccctttttctcactgttttcggctgcttttcccttctcattcttctcattttccttaagcttttttaccttttttgtcccaattgtttccctcgttgtcctcttaacgcctccaccccccacactgatcatgtctcacctatcacctctattgaattagccgaaattcgaaatgccattagcgaattgacccagcaaatcgacccccctcgccaaacttcccattaatgttatacgcaaatttttaatttttctctaattcagaatgagccatatccctaagtccaccccaaaaattgcccccttaatttctcaaatcatttcacacttgaaattgacacccgacaattcccaaattggccccaattccattttggaatccattaatgaccatgacagcgtttccttggcgtccgacacaaacaacaccgaaccctgtcccccgtctcctaaggatgttgaattggcaccggcaccccaggaagaagcacaaacggccgagcctttgactgtcagttcggataaacctgctcagatcccatccaacgacactcctgagttgccccagccgattaaggtcatgatcggaaacaggggaaaagggggtgggccggtcaaaaccatttacattcgcaatgacgacatttggcgttcttcggcccccgggtcccatccccctattttccaacagccgcgccgtctgacgaaacgctccttttactcacgcacattccacgtacctcacacaccacacaaacgaaaacgctatggagtcagcccgatcaagcactatcagaatggtcctcgggtggtacgcaaattcaaccccgaacgtgtgactttcgtggaaaaagaaggaatgaagcggtccaccgcagtgccgattccgttaaatcagatcaagtttccaaatggccctccctgttccccaattttccccaaatcacctttcgcacatgtgccattttttatggcggcgggagtgtcgcgttttacgaaataattaagccttctttccacccctccccccccctacactttacaacgcctcctcgcccggtcaatgatgcctttgcttatccaccctctcccccttcccccacataaagcctttaaaagggattgttccctgctcctttttacttattccctttctgttccctattcgtgcaatttccgctttttccattgcgtcccatcgcttttcaccgttgcatttcttagccaatttaaagagtgatcgagaaatagtgatttgttgaattttcgtgtgaacaatttttgagtcctattcaagagtctggaaaggttaaaatcgcattgggcaaatccccgccaatcgcgacacaacggccgggaaaatacccctaattcccactattttccccttcctttttttgtctattttccgtaaatttgttttcccctaatttgtcttttttttattttgtttttcacgttttccaatgtccgctcatttccgagcccaactgaaattggcgtacaatgactccgaagaattcctcaccgatcaagagtcctttcctgttccccagcaaaatggtcaacccgacatactgtatgccaaatcaattcgttcccaactccaatccctggatgatcataattccgatgtcaaatctgtcttaacgcaactcgaagataattccgatcggtggatgaccctcaggactaatatgactggggctgaaaggacccaagacaatccattatacgatgcatttgtgttagataccccttttcccaaagcaatttctgaccttaaaaaataccttcgtaccctacgtaccgaacggcgagccctggaagctgcactccccgtagctaatgtccaaaatgcatctgccccttccttagtccatttacccaaaacatccctcccaaccttttctggcgattgtaccaattatacgagtttttggaacacatttaaggcaggtgttcatgacctgaacattcccaattccctcaaatttacctatctaaagcaatgtctctctggtcctccccttactttaattaattctctcccgatttccgacgactcttatgattctgctgtttcccttttgtctcaacattatgaaaatcccgaggaggtagcccgagccctccacaattccttgcgcaaacttccccgaattcgacccggtgattatttttgtgaagacctccgggctctccttgaccagttggagtgtatctgtattcaaatgtcccaacaaaatcattcatatgatactgttgctgtccaaatggaggtcgaggaacgactccctcgttttgttctcgatgaaatatttatgtcaaaagaaaatgacgataattggtcatccgacaaattgaaatcacgactttgggccatactcaaacgtaaggaacagattcagaaccttctcccaaaggtgtcctcttcccctaggcctaaatttccaatgtcacctcattcaaaaatgccccctcaattccagccaagtgatccacccttgcccgcactcactttccattcaaaaaagcatacacaatccaacccaaatgcatccggcaaattccatcctaagccaaaattgccatgccttttttgcgaggatcccaaccatttctccaccctttgtaccatttacaatgacccaaagtcccgattggatcgtttaaaagtccttaaacgctgttttaaatgcctgaaatccggccatttctctcgccaatgcccttcccccgcaacctgttcaaattgtaaaggcccccatccccgagctttgtgccaaattccaggtgcattcaatcgttctacgaattatgcccattttcaaacaacttcatccgctcttccgagcccgacccaacctaatccttctcaattttattccccaccaattaacccatctgaatttccgtctgaattacttagtccacgggaagacgccgatgacgcctttcccaagtcccaaaccaataccgcaatttcggtgttccatcgtaagtctcccctcccaatcctactcaagtgtgtcagagttacccttttccacccccaaaaccgaaaaatgacccgtcaaggcatcggattattggatgatgccagcacccattcatatattgatttgcacgaagctcggacattggatttgagtctaaccccaacctcagttaaattgggt

SEQ ID NO: 4253 - DNA, 2247 bp, Heterodera glycines
  misc_feature (2214)..(2214): n is a, c, g, or t
tttgtaatgatttttgggtactttcgggcaattctgtctcggcatttatggggatgatcaaatgtgaaagagggttttggttgggattaagagggcgcaggaaatcgattggccttaggggttaggatccatgggattcgcggaatgaaaagtgatgggacgtgagttgacaatcatttcaatttccgagagggaggtcattaactgagctaagggaactgctcgaggacgaaatgaggtaaatgcccttcgtagatgatgtttgaccagtgagatcaaacgctcataatgcccaccacgccacggtgcgtgtggaacacgaaaattccattgagttggaaattggacagtcaaaaattttgagaggggacaaaagttggggcaattttggtcttcagttaatgaacggacgttctctcataatttcagcaagtgccgttaatacccttactcaacccacttcctacttgcccttctccccgaatttactttcaaatgtcgaattggtcaatgaaatccattctgcttgccccattgtccttctgggggctgacttttattatgaatttgaacccactcctgtccaacgtctcccctccgggtaccatctcattgacacattgttgggccccattgtggcagggggaccccgccgtaaccacccaactctcccagtacaaatcattaatttctcatcccaaaatacggataccgaatcaatggccccaccctcagactttttcactctggaagggataggaattagagacgacctacaacccatttccgttgatgaaattgttcttaaacaattcgatcaatcgatcgaatttgtcaaaaatcgctaccaagttaagttgccctttcgttccgaccccaaaacccttcccctcccttgaaattttggactttgttttggccgattgcgttctgtttttaacacactttcagctaaacccgacctcctccaaaagtacgactctattatacaggaacagaaaaaaatgggtattgttgaaattgtcaaaaatcccttcgaattttcgcctccattacattatttggcacatcacccggttatttcaccccttaaaagcaaagtgcgtattgtctacgacggttccgcacacgtcggaaaagaactatccctaaatgagtgtctttttcccggtcccataatcctgcctgatcttatcggtctcttattacgttttcggattcccccaattgtcattacaactgacattgaaaaagccttcctccaagtcaatgtgcacccggcacatcgtgattgtacccgcttcctgtggctgaaaaatacctctcttcccccatcaaaagcaaatactcaaatcctccgatttacccgtgtttcttttgggctcacatgctccccctttttgcttgcggccacaattctccaccatttatcagcttttccctccaatttgtccacggaaatttcccaaaatatttatgttgacaatatccttatttctgcctcaaattctaccgagggacagaagaaatcaacctccgccatttccttatttcaaaaggccggaatgccattacgtgaattcgccagcaattgtcaggaagccatttcccatcttccaaggcaattaaaactccccggaaccgaacaaaagtttcttggacttaaatggaacactgaaaaggattttttaattgtggaactttcggtccctccgcctgattttgtcccaaccaaacgctctgtcctttcctttattgcatcacattttgaccctcttggcctaatttcccctcttatcctccccttaaaattatttttacagtccctttttgaacttaaactcaattgggatgaacgatttcccacagaaataatcacaaattggcaaaaatcaattgaatcctggaaaaggacggacaaggtaaccatcccacgttcccccatttcgtctcctttatctgctcgtgaataccaattacattgctttacggacgcaagcaccttggcaatgtgcgcagccgttttcctccgagtttcacaccccaaattttcccaggcggaaacctttttaattttctcaaaaacaaaagttaaaccaattcacaaaggcgtcccattaaccatccccaaactcgaactaattgctgtagaaatgggaactcgtgctctgaaatttacccaagcccaatttccctctctaaatttagacccanaatttaaatctttggacagattctgcaatcgtc

SEQ ID NO: 4254 - DNA, 2924 bp, Heterodera glycines
  misc_feature (772)..(772): n is a, c, g, or t
  misc_feature (2894)..(2895): n is a, c, g, or t
  misc_feature (2908)..(2908): n is a, c, g, or t
cccccaattgtcattacaactgacattgaaaaagccttccttaagtcaatgtgcacccggcacatcgtgattgtacccgcttcctgtggctgaaaaatacctctcttcccccatcaaaagcaaatactcaaatcctccgatttacccgtgtttcttttgggctcacatgctccccctttttgcttgcggccacaattctccaccatttatcagcttttccctccaatttgtccacggaaatttcccaaaatatttatgttgacaatatccttatttctgcctcaaattctaccgagggacagaagaaatcaacctccgccatttccttatttcaaaaggccggaatgccattacgtgaattcgccagcaattatcaggaagccatttcccatcttccaaggcaattaaaactccccggaaccgaacaaaagtttcttggacttaaatggaacactgaaaaggattttttaattgtggaactttcggtccctccgcctgattttgtcccaaccaaacgctctgtcctttcctttattgcatcacattttgacccttggcctaaccaattcacaaaggctcccattaaccatccccaaactcgaactaattgctgtagaaatgggaactcgtgctctgaaatttacccaagcccaatttccctctctaaatttagacccaaatttaaatctttggacagattctgcaatcgtcctttcatggcttaattgtcacaaattgcccacggaaatttttgtacaaaaccgacttaagncattaaatccgttgatcatttaactgtccgacatttgcctggcccggaaaaccccgcagacattggtactcgaggaatttcttccgcacctaccctttccgctctctctgcctggtggtcaggccctcaatggctttctctcccggccaaccattggccaaataacccacaaataaaagagtattcatacggaaaatcagaacctataaacgccccttttcaagcaaaccctccccctttgttcacgttttttaccgaacagacacccgaattaacacatttaattgatttggcacgtttttctaggctaccaaaagccctcagggtgttaagttatgtgtttcgtttctcaaatggcacccgaaaaaattcccaatgtaaagcaccgaatccgatttcctttaatgagcaaagaaaggctctacaggaattaattttacgagagcaaaccctaaatccaccctctgatcaggtcacgaaaattttgggcctttactcagacccacagaaaattattcgcgcaaaaggtcgtctcggaaaaagccagctcccaccgtcggcaaaaaaacccaattttcctccctcccaaatcgccattaaccaatttaattgtttacgaaatacacttaaataatgtccatttcgagcccattgttgaccctttcgcgattgcgcagaatttattggattccaaagggacgacaaattgtaaaatcgatcatttcgagatactgtctaacctgtcgacgttttaacacccgaccatttgaccttcccccctttcccccccttccggaagacagggtaaaaccttcgccccccttttcgaaagttggcttagactttactggtcccatttatgttgtcacaaacccccacgtaccaaaaaagcgtaaaatgtcgaaaaaacattggatagtcatttgggtttgccttccgacgcgtgccatttctcttgatttagtcgaagaccagtcggcgcccgtctttaccctcgcttttcgccgtttttcctcaaaatacggcatcccttcgacgatttactgtgataatgcacctacttttgtcgctctttcaaaatttttggcggtccaatttccaaccctatggaattttcgtgttccacacgcaccgtggcgtggcgggcattatgagcgtttgatctcactggtcaaacatcatctacgaagggcatttacctcatttcgtcctcgagcagttcccttagctcagttaatgacctccctctcggaaattgaaatgattgtcaactcacgtcccatcacttttcattccgcgaatcccatggatcctaaccccctaaggccaatcgatttcctgcgccctcttaatcccaaccaaaaccctctttcacatttgatcatccccataaatgccgagacagaattgcccgaaagtacccaaaaatcattacaaaatctatgggaaactgcttcccaacagacagaacgtttttggcaacaatggttcactgattatttaccgtccttgagagaacggtaccaaaaattaggcccgacaaataatcgatggccaaaaattggagaacttgtccttgttcatcatccaactgaaccccgttcactatggaaaacggccattattttaagaataatcagaaatgagtctaacattcccgacacggccgaaattaaactcccttccggccacatttcaatacggtccattaatcacttgtacccgctggaaacagcggaggaaacaatgtaccgtatcccccaccgtaattgggccacccaacctccgcttccggcaaaaattacctctgatcgcaatacacttccgaacgctgactttcccagaacattacagcaaaccaatcagcaaaaaccgcaaacagaaattccatccaagattttcccaggcaaggcctgggccccgctccctcctcaaatcaacccccgcccgtgaagggacttccgttacaacaattgtacaaagaccatttccccccctcttttttcctttttttttgttattcattttccttggccaatgttccgtcgcggggaaggcggactgatcgcagtgatcagccgatttatgttccacttatcctatttaaacacacaactccctnnttttttcattaanttttttttaaatttta

SEQ ID NO: 4255 - DNA, 4423 bp, Heterodera glycines
tcagtttttatgtccacccctcagattggtcacttcattctcccgttgattttctgggggggggcgaccctctccgccctcagatagcttttcctgtgcttcgccgccacttaccatggccaaattctgcgctttcattttggcctcctccgccacttccgccgcttcttttgcattttgactcgcgtctccgaccgcatcttcggcttcctttgtcgtcgcctgcgcctcttcgatttccttttcgatatccgccaaattggtcatttcctcggtagcttctgcgcggctttgttcgattttactatgaaagtctgcaaataaatttttatttgtttgccttttgcaacaattaaaccggaaagcgcgtcgtgcgaatccttcgcatcgttccacgtcttcgtggccaattcgaaagccgtttgggtgcgcgcattaaaagactcggcttcgtcaaaggaattgtccacactctttgggaagagaaggcaataaaaagcattatgcttttcccaccatttgcttctgttgcgcatttcgcaactgttcgcacgcttcctccactaatttatccactttttctaccaattccgcttgcttttccgcctccgaccgtgttttagacagcgcttccaaaccctcttcctgtgcccttttgactttctccatcaactcatcagaaaaaacgttcggcagacggatactgtccactccgctcagaatgaaggcggccccgtcgtgtgtttggtttgtctcgagggactgttccgtcgccatttgttggatggctttcagtcgctgttccaactcgtggacctcggtcaacaaagcagaaatttgcagactggtgcttgaagctgcaataattcgtaagtgattttgaacaatgagctccgatgagtcgctcacctccaaaaattgcttcgttggcgtcgctgagcgattgccgcgactccttccgaatttgctcagccaacgaaaggatctcccggcgacgctgctcctgcgtatcagacaactgcttggattcgccagcgatctccgacaattgctgactcttttccccgtaacggtcgaacgcctcctgcgcttttgccaagtgctgttctccttgtgtttgcacataattcactccaacagacagctctttatgggtggtttctgtaaatgatacggtagggaattgacgcgagaagagaaacaatacgggaggggaaaggtagtgtatccccccgcccccgtgaatacgtcgctggttgtttatttattacccttgtccgtgctaaactgtcccaattgctgttcaatcaccgcagcattcgtgtcgatttgctggagtctgtcgcgaagtcccagcaccaaagtgtccgcttctgcaagttgcgccctcatggaaattgcctggtcgcgaatgtgcgagtcgtccccttctgctggtcgatgtgtaattactctctcattagggacgtagaacttacccatttttttcagtgctctttcatgcagtgactcgacctccactcgcactttttgcacatgcgcgtcaaattcgcgatcgtccactttgatctaaacaaccaaatgaaggttttttcactcacaatcaccgggttattgatgatctcgtccaggttttcgcgcaattcactcatagttccgttgagctcatttttgcgcgattggatcagtgcgtaacagtcgtcacatgcgggacaaccaccgcgcaaattgaaacgattttcggaacattggtcacagcgacggccttccacgttctgtcggcacaaacactgcccactggaaacgtcgcattccaaagtctcagagctaaacaccaaagggtaaaccgataggtttggaatattcctagtcagtctcacccggtcggatcgcagccacattccaagcacccttccgggccgaagccgaaatgccgcgttgcgcactgatcacagcgtctgccggtcaccccctttttgcattggcattggccggtaatcaaatcgcacacgcccccatccaaactgcccaaagggtcacaaccacactgatggcacccatttccggaggaaatattaaagaagccgggggcacattgatcacaacgaaggccaatcacttaacggaccgagtattcagaacattctgccagcgaccccccccccccctccttttttgaccgaccgtttggttggcacgaacactgcccatccgtctgacgacattctcaaagagaagcgttaaaaagccacgaaaatcttaatctgggacagtcgaagaatttcaaccttaccaagcgcctcaaagtcctgacccggcctcaaagtgccttgggtatagcagttacacgacctgcagtctcctgcaacatctcaaaatgaccattataaaacctgtcatcgccacctttcacttccgatagcgcgtccccccaaaatccggccatgcatttgtcacatcgccaccccgtcgtgtgatatatgcaccgtttgcactctccactgatcgtgtcgcactttccaatcgcatttgggtcggtattgctgttgcagtcgcatttctgacagggaatgccctcggccggattcccgaatgactcttccgcacaaatgtcgcatctgtccaaacagaccgccgggttaatccgagccgaatccatctctcccgtctcccggacactcactttcgtcctgcgtatccctctggacattccgtgcataacgtatccccatcgcccatcaaaatacacgggccgttctcaggacagtcgcatctgttaaattctgtgtcaaaactcatccacaaaaatgtagtcgagataaaacatccattgcattttaacaacacactttttgcagtcatcagctgtccccgtcagcgcatcgccataaaaccctcgcgcacatcgttcgcatgtttcgccggcggtgttgtgttggcaaatgcacgagccttaaaaagggagtcccattgaatcaattgagaaaaggtggaaaatgacctgattcggaatcgcagctgtcggaatggccgtgacattcgcagggaatgcatttggctagcggaccgccaaaatgaagcgtgcgcttatagccgggggcacacgattcgcaaaattggccgacgaatgcgtcggggcatttgcactgctcaacccaattggcaggctcggccaagtcgacgttgggcacagaagcagccgaattgacggtgaaattatacaggtaaccgacatctgttcaaaaatggaaagaaagcacataatccattctccgctgctggaaactaaccgcctttggagaaagtgccacgaattttaaaggcgctcacattggagaggacggcgatgaaatctaccaaaatggcattagaagattggcaaggacaaaggctgacccgtctcgcggagagatggactccactgaagcgaaggatggaaatgcacgcggaaacgaaagcgttgctcgcgaacggcaggcaacggattgccctgggcgaagattggcaacaccaactcttgtccattggcaccgacaatgacaatgtccctttagcatttgtaaagcaaaatgaatgcaacatttttttactttttgcttgggccggggtttggaagctgaacgcggagatgaaagtcaatgaaattgttataaatgtgtcgctgatctcccaaaaattgtgacggggcaaaaaaatacaccttaagattggcaattttacacattaagcatttttatttacaggataatcgtctaattgagaaacagcggccgcgcgatcgactgaaaaaaggaaaaacagcaattagagaaagaagcatcgttaaattccatgcccctccacttttctttccctcccccctttttccctctccgcgtttccgcctcttctctgaccttgggcccattggacgtcctccaattgtcgttctgatccgcccgaccagtcttcagtgcctaaaaacgtgcaagttatcgcccataaagtcgtctattaaaacagactatcaaaaaactgtgaagacacattcacagcaaaatatccttcggccgccgaacaaacggacgaatggccgaaacagaaacacggagaacagccgaaagggttggaggaggacaacaggaagaagctgggcttgcacttatcacagcgctgaccctcaacattctaaaaacgaaaaaaggccatgagaaaacagaaaagaagaacaaatggaacaacctctttgcaaacacacgatccggaggaggaggaacaagtcggggtgttgttgaaggagccatttgcatcacaacgacaatctctgagggcagtggggaaaaactaagaaaaatgtcagtgaaacaggtttgagcaactgtgagtagaaagcatgcctttcactgctccctacccccaaatggcgggagcaggtcgtttcccc

SEQ ID NO: 4256 - DNA, 2538 bp, Heterodera glycines
  misc_feature (27)..(27): n is a, c, g, or t
agcacagaagtgggtgcagaatgaaancggaaaaacaaatgaatcaaatttgccgtcagaattctcaacccaaaccgacggaggcattcgttggcttccatggaggtggcgggtcgccacggtctatccacgaagaagggggcgcactgctgacagtccacgccggcggtgttgtgctgacagtcgcacaccaattgttccttgatggcacacgcattgtctttcccttctttgtcctaccatcccatccctaaacctctccccgtcctgtggacttcacgcattggttggcgtgaccattgcatttgcatcgtccgccaaccgcaaagtcggaaattccgtaataatacgagcgaagcacacgactgtctccgaatatttcgtcaccaaatgtgttcattcgaaccaatgaaatgcgtatttgttctgcagccacccattcctaagggatggtaaatacgtgaattattttttgatagggctcgaccctgacatttatgacccagactccgacaaggccgttgtcaaaaatatttcggagggaatccgaagacgtttttcaaaactaagtaaggtaaaatgggggtccggcggtgccgggaaaaatttgaagattttaatatataagaaaattgtgcaaaaaaaatttgagtgtcggggtcgaagttgagaacgtttggacaggaaataaccaacccaaaaaggacaataaaaatcaaaggcattgcctggagcacttcgctctcctcaaaattctcagcagaagggcgtccgtcgagcgtggagaaggcaatatcgcctccagtcagtggagaaatgtcagagaactcacgtgtgcattgcgcaaccgcttcatttcccggcagaatcggcgctttgtcttgcaatttgaaagtggaacggcaggacccgctaaagagcaataaacggaacaattgaaatgctaaaacgcaaactggtcaaaaccacctataatattgccagggaatccagtcgtcttcggctctgttctttttgtaaacgacgaaactctcaggacgaggactggcaaatttcaaccgaatatacgtaatatcgtaacgtttgtgcatgtgcaatgtgagattgactgtctgtggatattgaataccttcctaaaattaaacttcatgcccatatcacccctaaaacagaccgccattgtttcagattgccacctgaagaaaaggtgcattagcgtataataagcgagtttcaattaccatgtttcattgtctttgatgttgaaatcggtcaggtacgaagccgggtgagcaaaagccttaaaagttgtaaggtatgcgccaaattagaaaactgaccggcacgcgcgcatcgcatacatcacacactttcgacgtttggccctttccgatgtgtccagtctgtacacaaaaacgagttggctggcggactccgcaagtattggtaacctaaagaaaatactggcaaatcaagcacaatcgaagtcgacaattttaaaagtggcgaagtccaacctcgacttccaaattgaaggcaacgttaataaagtcaggcacacaccgctggggctgagtacgttcatcgtagcaggaactctgactaggcttataatggtgaggatcaacactgggagttttttcggcaggttgggccgcaaattctgaaggatagtcgaagaaaaacgatgcaaaaaggaggaggatcaagaaatgttgccggaatgggcacctcctgctgtgcgcagtgaacatttcactgtgttaagcagtcaaatttacactcaagccttagcgaaaaggcaaaaaagccaattatataaaatcagtttaaggttaaactttaaagagataaagtaggtttatttatttgaattcaataatagcgctttctggcaaaatattttggctcttttcgatgctcggcttttcacatcaaaagaacgtaaattaaaatggaagaacttttcacattgcatttttacaatgatttggaagaagcgccaatttagatttgattcacgccatttttattaaagtaagaaaagggggttggacaattataaaagtggaagtggaagaatataaaacaggtggtgaagctcttcttcacattttccacatcctcgcataaaagcaaagaaccaatcgcaaaaataaagccgaagaaaaggcattagtttggtagaaataaagggagaaaagcattttggatgatatatattttaactatggaatgaattgaaatgttgtaaaggaaacaaatgtgtaattaatagggctgcaaaaaatatgtacaaaaagtgatccaaatatgtacataaatatgtaagaaaaattccaaaatatgtacaaaaaaaccccaaatatgtaaattttaatggtattttttggcaaagaaattccccgtaaagtatgaaatagccacaaaatgacataaaaattactttttttggtatttttaggcaacattttcaaacttattttttctttataaattttcaaaatatgtaaaataaatgaaaatatgtacaaatat

SEQ ID NO: 4257 - DNA, 2454 bp, Heterodera glycines
taatcaaacacaacatcctcaaattcgtaccaatgcttcttaggcctataacaaaaaatgttttaatgtcaattttttgaatatatttttttaaattttgcctgtattcgcgtaacagccgtttgttacgtaagcctagcactttgccaccttcgccaggaaatgcagttattcctgaaacgtaatttatatatcaaaatagcaaatcctgtatacacaatattcgaatgattaaattcggattttgaattaaatgaatgagaacacaagtgctgcaactcgcctccatgtggtgctgttttgtcgttgggatgaaaacggcgttggtgttctaaaaagttcgaattaggtggctgaatttcgatgtaaaaaaaagaaaatttcaaaattaatccagggcgttttatttcccggtaaaagtcgggaacattggtcccacaaaaaaagtaacaaaaatgctcgttttgagcgattgtgccatgcactcaagggttttcggggtagctgatcacgaatctgacattcatttgcaccaatttcgaaccccgaacccgaattcgaacaagtactgccaatggtcaccccgtttttgggagaaaagttttgttcgaaaaagtcatgaaacatgttttgggggttttatgggtcgctgatcactaatctgacattcattttggaaaatttctatcccggaaccgaactcgaataaaaagtctaaagttgaaatttcaaatttcagttttatgttcgtatctgtacagaatgatcatgttttggttttgcaatggtttctgactaaatttagattgtttctggattagtcagctggggcaactcagctgacagacaaatcagctgatggacaacccagccgtacaataaaaaattatacaataaagcctaggcctaggcccaagcaagcctaagcctaggtctagcctaaagcttagtcctaagcctaagacttaggcctaacctagccattgtacgagttgctcttgtacggttgtctgtgtataagttatcatgactagggctcggatttttaagcgcgaaaaagtccaaaataagtgtttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactaattgcagttagaaatgaagtacatttagaaattttcaggatttaagggtcgattctcaggggcgtatttttccgaaattttttttgtcgattcttaggggtgtatttttcgtttttattacatttttttaataaatttcccaaaaatcgcgagaacgaaaataagcataaaacgctaaaataagtacaaaaacttatttaaagggcgaacctctaaaacatgcatttttaagcacgaaacacaaaataagcatttctaagctcgaataagtgcgttaaaacgcaaaattttcgaacaaaaaatgtgtttttcgtgcatttctcgtcgagttaaaggcgcagaaaaaataagcaaaaacttataaatcccagccctaggcatgacacacgaaagacatgttaaattaaaaaatttaatggtttttcttaactaaaattcattttttgtaaattgtcgtaaagctgagttgtcccttcagccgaattgtcccatcagctgagttttcctcagctgactctagtccttgcgcgtacctattttttctatcgatatgtaaaatttgaagcggatttaacatcaagaaaaaaggttaaaaatatgaagtgaattcggttttctctattaacggagataaaaaaaatagtacgccaaaatggagatgttttgtgctttgcattctctgtttattggtcacctctcattttcttccttgatttgaagcttccagctggataggttctttatcaatattttccaactttcgtgaatacagtatgtccatattgtaacacaaatttatacccgatcattttaaaacgaaaagcacgttttaaaaagattgtttcactcagttggcaaaaaagggcgttgcttttctcgccgttcgtttgtttttctttttccttccttttgcttatccttcccccgcttcgttcgctttgccttcgcttccctttgcccttttttctcccattgctcctcttcgttcacattcatccacattaatcggtgtttgtgaacgggagtggaaatgggggtggggtcatcagcgaaagacgccatccccccactgtttggtatggcgttgtgctcctctgctgctgtgggggcggggtgccccctcctcctcccctctcccgcctccctctctgcctgggcgtaccatccgcggcggtaccatcccccccccccctccgatgacccttatgttatgtctgccgagtcctccccctcctcttccc

SEQ ID NO: 4258 - DNA, 1053 bp, Heterodera glycines
aaagaagtaaattaatattttataattatatattaaattacattaaataaaatgcaaaatttattttttgaaacaaattgatgagttctgcggcacgtgttttcactttttgttccaccaggagatcctattttggtctttttaacatttcttcatattcatttatgtatctattataaatattaaatttagattctatattgtatttttgttattatttatatttattaaacattctaacataactttgtgtatttattctattgctctattctgctcgaagcgcaattgtatttcggaaaaaatttcaccacatctattttatgccatggcttcatctttttttaatatttcaattttctttaataaaaaaattcttattgaaatatttatattttatttataaataatgcatgattttttgtttcaacatcactcaaaactaaaatttctaaccaacttaattatgtattattttaaaaataagttatttatgtccattttaacaatttcaataaaaatttaattttcgtcatttatattatatctttttatcatcatcattatttaatacattggtgtaatataaattatatacaaccacgtaattttataagtttatttaattcaaataatttgttgatttttaaaattatttataacagattatattgaaataaaactgtactcatactaataatttaatggctcaaatttgcatcgccatattataaattacacctttatatatttaagaactcatttattttgtttatttacatttaatttacccattttaaagtgcttggccaagcacaaatttttaactaaactttattaaatattatataaataaatatgaattttcatttaatacttaattcttcgatttcatcaattatttatatttaacttcaaaatgtttaatagtttacaaaatataaatttatctactttcctaaatgtttttgtaaataatcgagtacattggaagatctaacttaatttattcgaccatggttttttatgttttcattaactaaaataattttt

SEQ ID NO: 4259 - DNA, 3535 bp, Heterodera glycines
  misc_feature (3451)..(3451): n is a, c, g, or t
  misc_feature (3459)..(3459): n is a, c, g, or t
  misc_feature (3461)..(3461): n is a, c, g, or t
acagtttgtgtgaggaattgtacgtctgtcaatttctgacactttttgaaggaatagttcggcatggcattcttattccattaagcaactgtaagttattggcgtcaaaatcagtgtccggcttgccggtcgagctattcacagaagtggtgaattgcatgaagggtggtcagaaggattgagatttagtctgcttgatagtggcattattcttggtttttgtttgttatatcttttggcacttgttctggagtttcgtatttatatttatattttatttattttaattgaaagtacggtggtggactttttcacatgttatatctgaaaaaaatggaaatattttaagatttatgaacagacaaattaataatatttatgacttgacgattatattataaaagtccaaaagagatcagtatcgggtcattattgttaattgtgatgatcagagattgtctagcagtcagatcatatatcatatagttgaacaataacggaatgaaacaattatatgcccccccccccctccttacgcatttgcaatacattaataaatagtaaaggaatgaatgcctggattttaaaattgattatagtttttcgttaaattcataaatacaaagtgccagaatgatagaagaatcgataagcttttacaaggatgtaaaaacattgaaagaaagcttaagaaatcataaaaattatgaaaatttcttttagaatatagtaatgcttataaattagatatcaaaaagttaaaaggcaaaatttaattcaagattcaaatgaacaaataaagaaaaaaatgcattaaaatttattccttcctattctcgtaaacaaacatgatccccaatgaacgagttttataacataatgctattaacatttccataaatttttttcttaaataataatataatctctgtcttatttcgtcgtccatagcaaaaacaaaaatttacatcaaaattattattaaattacaataaagccaaataaaatatgtattaattattgagtgatggccactgttttcacatctatagaaaatagaaatttaaatagattatcacaaaaaaatcatatccgcaattaaggaataccgtatttcctcgattatacgcccccccccctcgaatggaagccccccctcgaatataagcctcccttggaggggggttgaaaaatagaagccccccctcgagtagaagcccccttcgaatataagccccactcaaaaaaattttttttcaaaacttttgaagtcagaaacgtgcaaaaactattgaacaatttgttttaataaaacattaacaaaacaaatattaggaaacttctgcatcaatttcttcgtcgctttttatggataattttataatatttatttgttattttaaatacttttaaaacacaaaaattttctgaaaaaaatagtatttttttaaaattcataaaatattttagaaagactgtacaaacgggacccacgcgtttcggcactcgcgtttcggcgccagctctttttccacgatagcttttttctttgacatccaaatacaacattgttggtatcactcgaaagctcttaacatgctctattagccttaccaaaagcgaaaagattttcaagcctggaaaaaattttattttattacaaaaaaacttcaaaaatttcgacttttcgcaattttcatgtataacttttttggaaattgtctaatagcgaagcaatagcttagaaaaaatttctgttaataaattgcactggaaaagattttgatgaaaatcactaaaaaattttcaagcaaatatagaaatattatacccaatatattttttgttttgttaaaaatgggtttttgggccatgggttcaaatccacatgcctgcaacattttaaaaaaattacttttggggtttcgagttcggatcaaggctttggaattgggcaaaatggatgccaagttcttgattagtggtcccaaaaaccctaaaaaacatttttacatgcaagtggatctgaacccatggcccaaaaaatcgctttgcttccatctatgatcccgaattccaaaatcagtttatttttgtactttttttcaaaagtcttataaaaatatagaataaacagaagcttatagaggaagaatttcgtgttgttcaaaaaaccttttcagaacagcgctattaatttttttttctcaaaaaacgaatttttccaaaatttatgtaataacttcttcattttgaagatagaaaattctaaaaaagtataaaatgctccagatttttctctatttttaatgcttttttgcactttaattgattcatttagaagtgaattatgaattttcaaacattcgcctaaatttccaagggccaaaaaatgaaaaatcttttcaattcaaaaatttagattaagatttaaattgtaccattatgcagaaagcaaaaaattttaagaatttatatagggaaaggggttgaacaataaaagcccccccccctcgattggaagccccccctcgaatataagccccctttggaggggggttgaacaatagaagccccggggcttataatcgaggaaatacggtagacagatttgatgaaaattaaacatttagggaagacgattttttattcaaacattaatacatttacaaactgcttcatgcaaatccttaacaaaaataatttccaaagaatccaacccaaatgtaagattatcaacatcgtctcggtttccttcaggcaaaatcaactatttcatatttcccaaaatggcagcgatcactttctgggggatgccggtgacgaatccaacagcaccacaatcagaaatccgaccagtcacagccacaaatttttttacaggcttttgaagagcgagagacataaaagcgatggccgacccaagtccgccgcacggtccgcctttgttggccggtcccttcaaataaaacaagaagtaatttatttcaagtcctaattataaatgagcagaaataggtactagggtgacattttttagacaaataaaactcaggaagtttgaaaatcctgctctttctgttcggtttgtgttgtctgaatattttaaattcggaggaatagcataatatagggctttctatctgtaaaattcaaaatggtttcacacattcaaaactttttacataaattcaaacattttttaaaatatgaacaggaaaaataagcattctgaaacttggtaatttttatttccataaaatgcattgagattcagaaccatgtgaatttgaacaatttttcaaaattttttattttttcattattacagttcaaaataagactaaaaagatgcaataatcgttattatttcatagaatctaataaattcaagcccccctcctttcccagcaagaaccgaccacagatttgatgtccatattaagaaatntagatagntnattttttttggggggataatttttttgaaggtaaagaactgacggggggtggttaagttgaaatgatgatttgg

SEQ ID NO: 4260 - DNA, 3215 bp, Heterodera glycines
ggttggttaagcaatttgggcagccataaaaaaaatttcttcgcctcccccggtgtccgaatcgctgccagttgttttcgataagccaacacaagctccgtaatttgtccgactgtagaggtcagctgctgcggtttcgctttccaattgggcgatctaaatcccgcctttgttatagccttattccatttcttctttaagacattagactaataattgcattctaacaatggtatcatgaattgagcaaaatttcttccatttccccctccccgtccgaaattaaaaatcaaaattttttaaaaatcaatttttaaaatttgaataaaatttaaaaaattcaagcgctttttccaaaataataactactaaaatcttcaaaaaattactcaaaaaattaattgacacaaattcacaaacataaaatttactcataaatttctatgttttttatcaggttgcgaaggggtgccgtggctttgtcggtgccagactgcacaagttgaagttgtgcactcttgcggcagtggaaagatttggcaaaagcactgatttggtcaacctgagtacgggcagcatggacgttggaaaattggcagagctaacggtcacagcggaagactttgaggtaaccttgatatgattatcctcaataaattttggtggaatgagccccttgaaatgaatagagccatttttcaaaaattgtatggtttctccatagcagcattgatcagtggcttggtcccgtaatttcgactttgtgggtcagcgttcctcgcctttaccagtggattaattttttttcttcagttccaaaccaattttaattcatttttcaaaaaatttcggcgcaaaggaatttttcggcggtgccgacagccaccacctgtggctttttcggtgaggaaaaccttggagaagtgctcttcattccccctctccgccctttcctcaccccttccggtcaatttccccctgtcgtttctcccctatttttttattaaatcgaaaagaaattattaagaaaaatttttataaacgttttcataaaaaatttcaagaaaaaattttttggaaaatttatgaatttaaaaaaattcctgaggtgaatgaagtgcacagcggcgtgggtagtggaatgaagtgactacttcaagactttcttcatccaaattttatgaaaatgccatagaagttggttgtcagcaacgtcgagtcattcctttccctgaactttttttttgaaaaacgcaaaaatttttttttaggctgaaaaaggtggaaacgacctgctctggtcttggaggagacaaaaaaagtgaaagctcaacaaaaaaattttccccgaatttagctttaatggaatatgcaacatgtatggaaaaaaggggaggggggtcaaccgatttgcgaaggggtccagccatgcaaattgcttaatttcctttcttgaatgaatttataattttgtaaaaaaaattttgtgcatcggaattgagttaaatggatgtcagattgtggtcaatggtctcaaaaaaaaccccaaaaaataattttaaaaaatttcacaggcaagtggattcgaacccttgacccgaaaacccattttttaccaatcgtgcaactcatttccctgattcccttttgtcgggaatgtgcaattcccgacttttgaggcccttgttaatggaaataattgttctattttaagtcccgcctgtcgtcaatgctagcagcagacaacgaacgaactcacaaggagcatggaccctacgacgaagtaaaatcactttaaaatttgctttctcaattacactatgaaaactccctctccataaatgcaaaatttttcaaaactgaaaaacacaaaaaaattgacgaaattggtgataaaattttgttttttttgagcactttagttcacggacgcagctcgtccccccatcgtatcagtctctcccgattagttttcagaaaaaaaaatttctaagaaaattacaagaaaaagtttagtagttaattttttgaagattttagtagttattattttggaaaaagcgcttgaattttttaaattttattcaaattttaaaaattgattttttaaaaattttgatttttaatttcggacggggagggggaaatggaagaaattttgctcaattcatgataccattgttagaatgcaattattagtctaatgtcttaaagaagaaatggaataaggctataacaaaggcgggatttagatcgcccaattggaaagcgaaaccgcagcagctgacctctacagtcggacaaattacggagcttgtgttggcttatcgaaaacaactggcagcgatttggacaccgggggtggcggcttaatttttttatggctgccaaattgcttaaccaaccaactaagcttcgtgttactgctggaggtggatcgctcgactttcctgccaaatcatcagttcagcttggacacaccgcggcagttctgtaccttcaagaaaattatccgggcaaggaggaggagctgtctggatttcttaatatggacatcaaatctgtggtcggttcttgctgggaaaggaggggggcttgaatttattagattctatgaaataataacgattattgcatctttttagtcttattttgaactgtaataatgaaaaaataaaaaattttgaaaaattgttcaaattcacatggttctgaatctcgatgcattttatggaaataaaaattaccaagtttcagaatgcttatttttcctgttcatattttaaaaaatgtttgaatttatgtaaaaagttttgaatgtgtgaaaccattttgaattttacagatagaaagccctatattatgctattcctccgaatttaaaatattcagacaacacaaaccgaacagaaagagcaggattttcaaacttcctgagttttatttgtctaaaaaatgtcaccctagtacctatttctgctcatttataattaggacttgaaataaattacttcttgttttatttgaagggaccggccaacaaaggcggaccgtgcggcggacttgggtcggccatcgcttttgtgtctctcgctcttcaaaagcctgtaaaaaaatttgtggctgtgactggtcggatttctgattgtggcgctgttgaatacgtcaccggcattccccagaaagtgatcgctgccatttgggaaatatgaaat

SEQ ID NO: 4261 - DNA, 5530 bp, Heterodera glycines
atcagcaactccgaaaaccccaaaaaaagtgtttcttatgacttttgaaaacataaaaaaatttggaaaagggggggggggggacaatctgaactattaccaaaaaaacaaccgccattgctatttttagtatcatatttcgccagagtcatatttttaactttaattggctaatcataatgatgtatttgtatgtacaattgtcactggaacataaaatgaattttgttacatgcatacataggatattggttaaaaacaaatggaagaaaatgcaaaaattaactttgtatagtgccagaaaaaacatatttatgcaccttcataaaatcctaaatgatgaaatcctttaagaatgtgcgcttttatagacgaaaaaatctgacattggaggcaaaagagaaaaaccatttgtcagtgtaaaaatgtgttataaatagcgactgtttccttgttttgcatcattcatttattctcttggccaacaatcaaagcatcgaacacaacaaccaacaactacaacaacaacaatgtcatcagacgacgcggacaaagcggcggcaaaagacggaccggcaccggacactccgagcgatgccaaagtgacggacggcggaccaccaacggcaactgaggacaaaccgaaggaacaaacggaagcgaaagtgcctgatgagccaaccgcgacgaaggaggagccgaaagtgcccgatgagccatcaacgacgaaggaaccaacggcgccagtgacagacggaccgccatcagaggcaaagggagacaaatcggacgagccaaaagtttcggatgagcccgcaaccaaagtgccagatgaaccgcccgcaacggagccaccaaaggattcagcgacgacggaaggatcggatgagccatcaacggacactccaaaggactcggcgacgacggaaggatcggaggacgaagcgcctgcgccggaagaccaaccaaagaaggcggacgagaagaagtcggaggaagcagcgtcagagccaccgaaagcgccggaagaccaaccaaagaaggcggacaagaagaaatcagaggaagccccagcaaaggagccgaagaagaaagcggacaagaaaaagaagtcgaagtcggaagaatcagtggcctccgtcagcgtgcgtcttcagcctcgaaaggtgcccgtcaacagcttcaaggacgtgcgccccaccgtgcagaagagcctcgccgggctcaaatacccgttcatcaagaagctggagaagcaggcggggatggaccgcgagaaggtaaaaacattgtcatcctttcattttttaaacattttctttccattttcagctgttctactctgcactggccgtcctgtccgtctacctgatggtcggccccggcaacactttcctcagcgctttgatcggttggtttggctggggtgggtccaaatgtcacccctttctaatgttcttcattttagtcaaagcctggcccgtctaccaaaccatcctggccgtccacactcagaacagaagtgagtaattgcatttccttttgaaatgaacattctaattttcataattttcagaggatgacacccaatggctcgccttctggtgcgccttcgccgccttctccgtgctcgaccacttcttcgcccccctcgagctgctcttcgggctgtacctgctcttcaagacggctgcgctgctctacctgggtcttccgcaaacgtacggcgcgcacaatctctacgtgaagcacgtgcacccgctggtggaccgtctgggcaagatcaaagtgaaatgaagcgcaggcaacgacaactgatgtgagaagcggccaatcgatcgatcatcccccacccccccccctgtattatatgatatcaatattgtatgtatttgtaaccccggccaatcgttaatgatgcctgatttgttgtcaaatcccgagccctttatgtgacagtgatattgtatgtgctgtgattattgttcgcaatatgattccggaaatgtataagttatattgtattatgcatctgcgagataaacaatttacagtgaataaatttggatctgaggctgaatttcttatttttctcgttataattctttttgaggcaaatatttgctcttttcttgtttttataaattcttgagcctattgggcccataaaagttgaagctaaattggcctttttgacgcctatagactggaaatttagccatttttgaatagctcagaaattttttggaccgcacaaattttgatcacacattttcaaaaatcgtatagcggttgaaggcaaataaatttgggtaattttggaagctcggggaaagggttaaatgtgtgaagaaaattttcgattttgtcattcgtctcgatgaggcaagtcgaatgggagtaaaaatgcactggtaagaattgatttttttggtaaaaataatgatttttcattgaaaaagatttttttatttcaaatttctcctttataaatttttctatatatttttaatttaataaattgattgtcctttaaatttgtgcattaaaaatatttttgtgagtttttaattaaattttcgaattactcccgcccgggactcccgttaaaattggacgggattttaacgggagcgggatttttacgggaataccgttcgtgactcccgtcccggaaaattttgaactcccgatcccgctcccggaaaattttgaactcccgatcccgatcccgctcgtgttaagcattttcctgaaatttgtaacgaattggagaacgacgaatcgctgttctcaaaattgccaacagaaaagaatttttgccaaattaaactataatcggatttatatttttgcataaaatataaatatttcactcattcagttcaataaaaattattcaaattcttcaattcaaaaatctgagggaaaagcgaaagaagcgttttaatcgtgaaaatcaaaatttataaatttcccagcacagagagaatattattcaactaataataacagacagaaaatatgaaaaaacataaaaggctttgtcgaacactcataaaatattaaattttctggaattatcatttcgaacagtcattttttgctgtgatttgtgaatgagcatctaaaaggacatcacaaatgataacgatcttcacatataaacagtttcattgtatacattaaacttttcttatgaaatttttattaattttacacaaaaaaatttttgccgttcttttggcgcataaaataatgatgatacatcatcagtatgtaatgtgttaaaatagtgaattgttttgctcatttggtgggctttgtcatgatgccaaaagcatttgcgtgccgccgcccccgaacccgcggttgtccccgccgttgcacttgtcgattttctcgcgcctcttctgctgctcctgcgcctgttgcttttcctggtcttccatcgccagcagttctgctttgatctgttccgtctgttgctcctcctgcgcgactttgatgaaattgtccacaataattgtgatcggaagggctgaaagagaaaaagcgatgcacattttcatttgctaattgcctattaattggatttaaccaatattaattgattaaaattttcaataaaattccatcgttcgtacccaacacgagaaccccgcacattatggccgcggatgcgatcactttacccacttaatagcgtatttgaacaatcaattggacaatttgtttgttataaatggacccacttgttgttgcaggcacaacgtcgccataacccacctgaatttgacaaatttctttttttgaaaatcaattttcggtttaccgttgtcattgtcacaatgcaccacctgagaaaaagataaataaattaggcaaaaaaaataataatggggcaattagtgagtgaccagtaagccgccggtatgctgacgaacggcgtgctgagctcatccttttccagaaaatagatcattgtggagaagaacacctgcaaaaggtggaatcattttcaaattaaaaatgtgaattaatttaattaaatttaattattggaaaaaaattaattgcaaatgctgaccactccggtcagcaaaacgatggccatcatttgcaattgcttctgactccgctgcaaagtcatgccgaaggtttgcagaccgctggagaagcgacccaactgcgaaggaaaaggaaatgattggacaaaagacaattagcaaatagcgcactttaataatccgaatgacccgcaaaacacggagaattcggacgacgagaaaactgaaaagttaaattatcatttgaaaaattgagacgaaatcaaagcgagaaaaacgaacgcccatcgcaagtcgcgcagctttttgtcatcgacgccgagcaaagtgagcatcagttcaaggtaaaaggggagaatggccaaaatatcgacctgaaacgggggaaaaaggaattaaaaggcatgcaatgccacttcaaattgaattaattcattttcattttcaccaaattgagcggtttcagcgcgaaacggagtttccgtggagccgcgaaaagcctcaggcaatactcgatggtgaagaaggcgatgcaaatgcgttccgtgaacacaaaggcggggtgttccacgcgcaccgcttcgaattcctcgcgctcaatcgaagtgccattcgaagtgatcacacttcgattgcccgtcggaatatattctgtcacctgaaaaatattatgaaagcagaaaaagtaaacaaaggaatagtgtgtgccgtattcgttgtccgttttgagcccaaaggattgattgattaatttatttattttacctgaaagtcgggaatggtgccgaaactgagtccgagcacggagaccatcacgaacagtgttgagcacaattcgaaactaataaggaagagcagaggaagttaagcatggttggatgggacttttaaattattcataaaaataatggtctcaaatttctatattaaattgttattttattaaatatatatttatttttgacaaattctaaacccgggctgaccgttttcgaaaaaagaattctatgggaaaatttttattttttttaagtcttggcttgcagcgaggagcccggtctctccagaaaggtccacattcggcgccgcaatcggccgcaacacaatttgtcgaagctgatttcgtccaccttttcctctttgctcgtctccaacaatcgctccagcggagacaccgactcgtcgcaacacgctccttaaaaacagcacaaaaagattttacaaatatttaatattaaaatagtaatgcccaatcccgtcattttttgcaagtccattaaaatacatttaattaccaatataactggtggaaatgcgccagaattccagttcagccttaatgaaggacaaaattaagcaattattttatccccataatcaacaattacattcaacgccgatggacattcctcgggcggtttgtgcacaacgccggtggcataatatgcaaaacgggttca

SEQ ID NO: 4262 - DNA, 3247 bp, Heterodera glycines
  misc_feature (54)..(54): n is a, c, g, or t
  misc_feature (61)..(61): n is a, c, g, or t
  misc_feature (64)..(65): n is a, c, g, or t
  misc_feature (68)..(68): n is a, c, g, or t
  misc_feature (92)..(92): n is a, c, g, or t
  misc_feature (96)..(96): n is a, c, g, or t
  misc_feature (98)..(98): n is a, c, g, or t
  misc_feature (101)..(101): n is a, c, g, or t
  misc_feature (104)..(104): n is a, c, g, or t
  misc_feature (112)..(112): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (123)..(123): n is a, c, g, or t
  misc_feature (126)..(126): n is a, c, g, or t
  misc_feature (128)..(128): n is a, c, g, or t
  misc_feature (130)..(130): n is a, c, g, or t
  misc_feature (132)..(133): n is a, c, g, or t
  misc_feature (141)..(141): n is a, c, g, or t
  misc_feature (144)..(144): n is a, c, g, or t
  misc_feature (146)..(146): n is a, c, g, or t
  misc_feature (159)..(159): n is a, c, g, or t
  misc_feature (3230)..(3230): n is a, c, g, or t
ctccagaaaggttacattcggcgccgcaatcggccgctcacacagggtcgaagntgttttngtnnatntttgggtcttccttcgaatggaanaatngntgnagnggagaaanagantnggnanaanangnannttaaaaanagnanaaaaagattaatnatttacaaatatttaatattaaaatagtaatgcccaatcccgtcattttttgcaagtccattaaaatacatttaattaccaatataactggtggaaatgcgccagaattccagctcagccttaatgaaggacaaaattaagcaattattttatacccataaacaacaattaccattgaacgccgatggacattcctcgggcggtttgtgcacaacgccggtggcataatattgcaaaacgggttcaaatgctaatggagaccgcttaaaagaaatcaatttaatttataattattgaaaaaaaatttatttggtacctgaaaataataggcacattcggactgcaaataagcatcggctaccttaacaatgcacaaattaattaatttgattaaattttttcaaaattttggatacaaatcccattgataaaatttataggcaaatcgccttttttgtattcggtgatcaaaaattggcaaaattcgcacttttagcctcgtctggtggttaagctgtacaaatctggccaaaaaagtagttgggtcagcccgcagaatggcctcgacaagaatgagaaaggtcgagccgccgatgtttagcctgagcagctcctcgtccacgtcgtccgtcgcgttgtcctcctcctcctcctcctcgtcgtcgtcgtcatcgtcgtgctccattttggccaaaagtccgtcctcctcttcaggcaccttaattaattatatttgttagccttctgctggtgaagctaaagtctaactacctcattgatgtttatgctaatttttatattattttaaatttttattaatcatttataatattttttggaaattttcacaattttttgttataaattttttcaaaactttcaccaacttgctcaagcagagacggaattaaagtggtcgaagatgggaccatcagtaaattttcggcagagtcctttttagaacttgcgcatgagcttctgtgaccgcttgcgaaggtggcgtgacagctgaccaccgaagctttggaacgaattgtctgaacaaaggcaaaggtttttgttgatcgccaaggaattttattttgtttgttaaatcatttaaagcaaaaacaattaaataatgcttatttattttaaatatttctcaattaaattaattattttgccaatttatggcaatttcctcggtcattttccccatttgtcttgccttgctgaatgactgctcgtccccctcgcaccaaatcaggtccaaaatgcgtccgttgtgccgttccgccaaattcattgagtccgtctttcggatggccatctgacggcgctttcggtgctgttgctgggcagcggcgatcatgtttccggacacccttaataacaataacaccaatttgattgatatatatatgtatatatataattgtttttaaagcctattttttattttacctattttttttatttttcgctttttctcttttctctcctcccaaaaaaatttccatttttccaatgcttctccttctcacaattataagctactctctttaattcattcacttatttgcctacggcgaaattatacgctttcggcaaaagctgagcttttttcaattatcagtttgaaagactcaaaaaacgtaaaaaagtgaagaaattgtgaagtaaagaaaacaacaattagcatggttaataaataaattaaaataatgaaaaatagttaataaaagagtcacttaattattttgaaattatttgccatgggccaaacattctgagaatattcgtttgaatgacttacggcctaagcattgaagtggcactgacgccgctcacacagctcattattattttaagtgttatttttaatgaacggaatattagggaattgttaaaactgagaaaaagataacttatcaatttataaagggtaaatttaaaaaatgaaaaattattttaaaaataaattgcactaaatgggaaaaggaaagccgaattgtaaaaatgcattttctcaaaaaggcacaaaaatttgggggaagggggaattatcatttttaaatgtttcagacagaaaaaaatgcgaaaaataaatcattaggaaagaatgtggtgggaaaatttttgacacgggcggcggaataatttttaacgcctcgggggcatttgacaagagaaacaaaaaattccaaagtgccatcaatcatcgattaaaagggataaaagagggagataaagtgagattatccgctgatcagttgaagagagaaaaatgatagtaattgaggcaattaaaagggaaattataaatattcaattaaaatgataaaagccgctaaaattaagcctttataacattgcatttgtttgttttttaacattgcttaattattattaataagtttaaatccaaaaattgacatttgtaattgtacatgaattagaagtaaggcaaaacggggaaattgattaaatgtttttccgtttttgtctatctgtttaatattcctgatgggtttgggaagtccattaatgtgaaaacattgccaaggattggcggcggagagcaaagcggggcaatgaatgccaaggatggcgccgggaattggcacgtaattggcggaataaaagttggtctaatgcactcgctgaattttgcccattttaaaatttcaaaaaatgtccgtcttttaacaatggaaaattttggcggaacttcgcggcgaaaagggcaccggacggtgccaaaattacgccttttctcgcacactttttttgttctgttaaatcgaacaaaaagtgaaggcacacaatagaaaaaagagcaaattgaatgtttaaaatgcacgaaaaatgggaaaaataaattaattaaaaaggaaataattatttaattttttggattaaaaatgcattgggcgacaaatgcaaaaaactgaaaaataatcaacaaattccaaatcaatgcgagcggagaataaattccatgaaatttacttacatttgttaaactctaatgaacgcattgttaaaagaatggaagacaatttcctcatgctttaaattttccttanaaacaagccgaaaatca

SEQ ID NO: 4263 - DNA, 2252 bp, Heterodera glycines
attatgcaaaataatagagcatcagaagggctctcgaatgatactaacaatgttagatttggtgttaaatgaaaaaagttatagtccaaaaactgggctggcgccgaaacgagcggcgccgaaacgagggtgtccctccggcggcgcacgacggcgccgataggcgactccgaggaaattttgcagtttttaatggggtttgttaacagatttttgtccaaaaattaccaattttgcgcaaaaattatattttcatgagtatttttaagaaatcagaataaattgagttccgtttggttgtgcgcgagtaaacggtcgaggaaatggcacaaaaagcgctctcttacggaacacactttttgccactgatcagaagcagttaatagattgattgatcagtagggattccatttaaagcacagctaagaagcacaaaaaaattccccataaaaatttgattctttgaaaacaaaaactggttgggtattggcttttaaaaattttattaaggtttttgccttttttcggtactaatttgcgataattggtgcctgaaaatgagatcaattcaacaaacaaacaaaaaagatacagagaatagtgaatggctgaatggcttgccaacatgatcacgtcatctttcttttgtcgacaatcggccttggcggtacacgacgctaaaattttgaattttttttttactgccttggcatactatcggacacaaaaggcacactttaatctcaaaaattgcacaaaatttatttattttgcgttaaattcgccttcagtttaatacctattagcaaataaagcatatcgaaaaaagcagaattgcgaaacaattcttatagtttgcccgaaatcgggcagtacaacagcgccacgcaccctcttaaatacaaaatgcaatttaaatacaacaaatttattttaagaacaaagcagacatgaaaaaaagaggggcacgggttttagctaacggaagaggcaaaaagtttctgaacacttgactacacaccgtccgaaaaaacgagatgtgtaccaataaatagagagtgccagagaaaaacattatctttttttctctaattttttgtctccttttggcgtactatctaatatttttattattaggaaaaacaacattcacttcgctctatagaactttttttccgccttacagaatttcttcatatttttcatatcgatagagaaaaaaatataggatttttcaatcgcttttttaatgaaaataatcgcttttattttagtctaaaatttaaaacaaaatttagaaagctcatatcatttttccaatgcatccaattgtttagcatttgcttagaaaaagcttctactttccaagagctttcgaatgataccaagatttaccaatttggttggcaaaaagcttcaaaaataattcccaaaattcgtcattttttaatattttggacaaaaataaataaaaatgtacaggagctcatttcccggacgctgtgactaatttttggtgtttgaaaaagagacgactctccaaaaagtagtacaaagtacggaaatgccctccttaatttgataatggcgcggatcattacaagaatgcaatgcatatttaaaattttaacccacggcccttataatccacggaatactcttaactaaggggtcaaggcagttcgtacaatggtgttgcaaataatgccaaccttaggataccagcggctatttacaaggaaatcagaacggaagcactagccatagacaaatcgataaagaatgcggtaagaagcctagcgtgaagcgccacgcatgctaggtgccacgagaatgctacatcccgcaccgtctaaagattaaaaatgaacagcgcatcatctacttccattttgaatgcactacggactccgaacccgaccctgaactcctgcgcttgaggaatcaggtaaataagacacaaaatataccaaaatcaggcatttctttcaggtgaacttctgctacgcgcacgactcttgcacggaatgcattgcaaagggtatctggaaccatccagctggaccaaagctgtgccaatctgtggactgacgaggaacttcgcatgggcaccgctcgagctctacaacaccgaagtggagaccgcctacaatgtggacgaccccctgacgtacttcaccaagcggctcctgccctctgaagcttgatgccctcgcacttgaccctgtcgagaagcgcccctaacggaagcg

SEQ ID NO: 4264 - DNA, 2160 bp, Heterodera glycines
tcaacacattcaacggaaagtagttccgaaccatattcagaattcgtctatctgctgccaaatatttgcaccgttttttctcaggtgacaatccagcgatcgaagaattgtatttgtgatcggcgattttctgttcacgtcgaagaacatcaatgaaatgccacaacgatggatgacgacaattgaacgcgccttgcaaacggtggtgctcagcttctgcgttgttgttcgtcctcgcatctccatccaatgtccgttggtagacgttccactattccggacggaacaacggttgcgaccatgtgccattgggacgaggacgcccaacataattgtccaaaagcctaaaaaattattctaaaattgaaaattttattttctgaccaatcaatgagaggtcgaaaagccgccaaatttccaaattccatgtcaagtgctgtcactgcattcctgacatcacaaagtggaacgaaagcgactgatgtgagcatccgaacactcaaagcaaataccggatcagcacaataacgcttaaattttgaaaaatttaaaaaaattttaaataaggaaaattacctgccataagccttgctgtttcacttttttttgtaagttccgtacaaaatgaaaaaagcaaaaccgaatctggcatccgggaaaaattgtcgtaatgtcatttgacataaccatttcaaaatccacagaaaaagaaatgggagcaaaattttgccacgctgcacgcaaaagtgtgaacattttttcgtacgatgtttgcgattggaagtcatcaaggcatggcacaccgggaaaatccatttttcacgcctaaatatttaatttacaattttaaaaatcgaattaagaccaacagactttgccaagattgtataaatctgagaaaattgcccaggtgctaatgagaaagttccgtcaccgaaacactcattcattctgtccgcaaaacgtcaaatgattcgcgcccaaacaataaaattctgagaaaacatttttttgccatatttttaaaattttgtgcaaaaaccagggttgctcttcattgattttaaaatttatttcctcatttagcaatccattttactataataaatgtttgtgattatacggtatttactagtgaccaatttattctgatttcttaaaaatactcatgaaaatataatttttgcgcaaaattggtactttttggacaaaaatctgttaacaaaccccattaaaaactgcaaaatttcctcggagtcgcctatcggcgccgctcgtttcggcgccagcccagtttttggactataacttttttctttgtcaaccaaatctaacattattggtatcattcgaaagctctaagtgttctctattagcttgctaagtttcaaaaaatttcgttaatgctcaaaaaaattatgactagaagaattcaaaaaaccaggccacatgtgtacttttggccataactttgttcaaaattgatcaaattttttggaattatgcaaaataatagagcatcagaagggctctcgaatgataccaacaatgttagatttggtggaaaaagaaaaaagttatagtccaaaaactgggcgggcgccgaaacgagcggcgccgaaacgaggtggacccccagttcgggggttggggggaggggggtagaggaaatgtgttgaagttcgaatatgatattgctacgtgtcttattcgctgatggtatatcttctcttttacagttttccccgtcttctctcttctcaattgagccgatttttggtgattaccatgacgcttctctgcttgccctgcgctgctttgcttctttacatttcattcacggttcttctccgactcctcggcggtcgcgacatgtcttgctgtcgtgtcgtccgcgggctcctcctgttgttggtgataaagaaattgagcctgcaaaaactgcaacaccatctcgagcacggcggtgccggtcaacaacgggtcgcagtcgccctgaacgccgatgtaacgggcgatacgggcaggtacccatgaagccaaagtcgctgaacgattggtgcacaatgtccctgcgaaaggaaacaaaaatattgttgaaatatgagcgagcaattcgcggaattaaattttcgaatataatgaattttggttaggaaa

SEQ ID NO: 4265 - DNA, 2615 bp, Heterodera glycines
attttagtggctaacttccgaaatagttttttttagtggcgaagctccaaaatagtgattcctagtgatgaatagtggcactaaaaacgaaaaattttcgaaaaagaatgtgtttttcgtgcatttctcgtcgagttaaagccgcagaaaaaatagttaaaaaactaagaatccgatccctactggtgatgccgatgcaaatttacataatttaatattttctattgtttctttggaattttataaatttttagtttccgtgtacctttaggttaaatttaaattatcattataaaaaatactaaaataaatcaatttaaaaattaatttagaatataatattctaatgaaattcgttgtccaaatatctttttttgggtttgtaggcgaaatgaatgattttggttagtaggcgaaatgtatgtacaccagggatgtgccgagccagacaaaatccgattccgattacgttccgatttttttaaaataattttttcccaaaaattttattcataatcaaaatcataaattttaagattgtgatgcaaaaataaaagtttgtccacattctcaggcaataaacgttttctcagatctgtcacaatcaacccagcggtggagaatattcccagatatttgacatttttgctaaataacaaaaaacttgattatatcggggagaattaatccggcactgctttgtgagaaaaatttaatttcagtcattatgttaaaataagattaaaacattcgtttcagaaaacatttttttcaaaattcattggtattctcgctaaaaaaattccttcaaaaggtcaattcttaggggtgtaataatcggatttcaaggcaaaatccgattacgattatccgattccgattcggcacatccctggtacccacctgaaaaccatacttacataataactgtattgtctgtcagaaattttaaatgtgtccatcatttgattgtttgatccgccttaggaaattctgggtcgggcggtgccgttaggcatcgctgagaaaaaaatttttttttttttggaatttttcattaatttgtaatgcgaaattaactaaattttttttttaattaatccctatcttttccgtgagctaagaccacttccgcccggtagggctcaactgcgtctgagacaacgccataatttttttctttgttcgccaaatcaaataacctttatatgtttcgaaagctctctatgtttttagatatatttataagcattttctaagcgaaaaccaaactacacataaaaaagttaaatttcaaaatcttaaaaatccaagttttttgtattttttatttttaactttttaatccttaaatgaatcattacgaattttggttagctgaatagagcttgattttagtattgaatttttaattttttttcactagtaaataccgtataatcacaaactcgagaattttttggctataacttttttaaaagtcaatgaaatttttccaaaatttttaaattgagaaatcttagggctatggaatgatattaattaagtttggctcaattgcattttatgactagaaaattttagaattttttgtccagaccttttttgaaactgaatgaaatttttgaaattttaaagaataatagactaaatagattacttgaaattctaaaaaatttaatctaattgctttttaaaaattataaagcattgaacagcctatgctttttgcaattttttgaaattttggcaccataacttttttataatttcattataaaaattttctaaattaatattcttatagacaacatttaaagctatcttggcagtttttaagaaacgacctagcaccctttggatcgaccgtttttgagataaaaattgtaaatttggatgagctatgttctggtgctcaatgtttggcgctcaatcggcgttttgtccgccaaaattccccaaattttggcttcattttttggtttcgttctcttgcccatcatccgttcgtttcttaaccttatctccaaaatttcaatgttttttttctttgtttaccttgtgacagttaagttttatgcacaaaaatagagaaatatttacaataaacaacaatgaaaaaaagcagttaaatgtgagtaaagtacgaattttgaggtggccgaaatgaggaaaattttgaaaaacattatgtatttattctttggaatggactatcaaaagctttcaaaagataaagcgtaacaataaaaataaaaaacaattttaattaaaaaaaagtaacacgcccatcgtccgttcatttgttcaccattaattaactccaattttccatcccatgtctcaatcaaactaagtatatcgtgaccgtattgatacagtacattgtggaataatctttttatattaattgaccccgtttagaaagtaaaactttttctcacgctcataatcagattcaattcggaagttttggtcagcaaaagttaatgtgagacaaaattcaattcaaataaaaccacggtgaaaagggtgtttaataatccaaaattgctcaattaatgtcattttgattaaagggggatcatcatactgctcatcattcagtgcaaata

SEQ ID NO: 4266 - DNA, 1822 bp, Heterodera glycines
  misc_feature (11)..(11): n is a, c, g, or t
gcgtatttttntgggaaattttactataatttagaagcgatggaattatttataggaatttgttcaaatgagtaccaaatccggtgcagaaagccattttgagaatgcgccactccatggtcagttcgaggcgatagatatcctttggaaaaaatgaaaattgaatgtattttcctgtcatagctaaaaaaatttaaaaaatttgccccaaaaatttcttcggcggtgcctaatcacaccgctggattccaaatttcgtatatttttgccaaaatttggtttcataatgactaaaattttccgctttttcccatggcggcataattcagcaaaattatactggacagaaaatttttgagccggaagcggaaaaaaactccctcccctttggggcccctcccaaaacattttttggttacgggcctggtgggactacgcccttgaaatttctatctgaaaaactaacaatggaaattagtcaccttcacccgctcccaacccgcgtcccatttggccagccgcgcttcgccaaacacgggcacagcaatggaacggaaggaaatttgctggaaataaaatttaaaaaatttacaaaaaatccaaatttttgggggttcaaaaatgaaatacaaattgaatcaacgaattgcaagggaatggaaaatttgggcaatcatcaagaattggtgtcccgacgaaaaaaaatattaaaaattttgcaggtattttttctaggcttgaaaaatgcgcagatcacgaatctgagctcagattttgaaaatcattgatttttatctaagatttttcgtcgactacttgattttttccaaaattttaagaaatttagtcgggcgtaaaaactcatgcgcaggatgagaaggagaccttgggttcgagtccgtttggctgcggtttatttttttatgacacttgatgaaaaatcatagacaaaatgaaggttcatgcataatcagagctcagattcgtgatcagaatattttttaagccaaaattcattgctaaaaattttttaaaaataatttaaaaaattgaaaataatcaagtagttgacgaaaaatcttagataaaaatcaatgattttcaaaatctgagctcagattcgtgatcggcgcattttttaagcctagaaaaaatacctgccaaaattttaacattttttttcgtcgggacaccaattcttgatgattgccaataaatttgagtagaataaatgggttaatgcattaaggcacttagagtggatcaggcattcgataggcaattgccctcaaatattggaggggatgacgatcggcacgcgttgcaaatatttcccgaagattttcatcttgctcaatataaagctgtttgcgtttcattcctttccctctaacgtgacgattgatcaatgggccaaaaaatgcaccagaaatgagtaataaaacttatttctttatgaatgatatgatgtttttcttctcctgaagttacaaaaataataacaaattcatttccatattatttacgcttataaacaacatatggcagattaagataaagatcttttaggccaaaccaaaatttttgtttagtaatttattttgtttattttcatttttatttacaacagtgtccaattttctggtgtccatttttccattggtgtccaattttctagtgtccaattttcggtgtccaattttctggtgtccaatttaccgggagccgaacgagatgctccccatccctcacacattcccaaatagttttttggaaaaatacggcaaaaaaattgttaaaaatctgatttttgattctgaat

SEQ ID NO: 4267 - DNA, 1849 bp, Heterodera glycines
  misc_feature (1833)..(1833): n is a, c, g, or t
tttgccagcgtcaacaaaaaaatttgaggattgatcggcctgttcacttttcgctgtttttattttgtttcttcagcgatcactgcgccgccgatcgttgatcagatgagaatctcaaagtcgcgcagctcttcctccgccggcagagccgcctccacccggctgcgttcgatcagatccgggctgatcagcggcagtccggcacgctcccggcggacgagttcaaagtgcgcctcgcgcagtgcccactctttcgcgctgggccttaacgccgggggaaaggtttagaagggaccgaatttagcattaaattacaaaaatgagacattttgatacaagactctaaccaaaaagtatgggcaaaaatccataacttaaaattgaaaagttaaatggtaaggcattttttgaaattttgagactcatcaaaaactgatgacattttaatatatgcattcattgatcacacatttgtgggtgtaaaaaaccaaaagattaaaaatggcattgtgttgtgccaccatagtcgagttatctaattgttttttaacaatgttttaaatcagaaaatatgaccatggaaaatgaaggcagtgatatccattttgtgcaaaaaaccacgagatcttccgcccatagcccacccctcccccggtgtgatggcagttcgtacaatggagtttcgtacagtttttctcaagaaaaaccaaaaacctaagatattatatgttcaaaaaatttaattaaacttgaaaaatttagtagaaaccttggcaaaaaattttttagaggtttggttttttgaaaaaaattccaagttttaaccgaaaattaaaaaaaataaatacaaaattccattgtacgaactgcccattgagccccccgtcatctgctggtgctcgctgtgctcaccagtcggaattgcagtattgccacacaaaggtcaacatgacaaaacatccggtgccgaagatgggcattgtgccgtgccacttcttccagtctttgtgctcgtcgcgagggatgcatttgaaatagatccattggcgacgctaaacccaatttttttaaaaaggggggaaacgacggatttcagcacaaaaacccgaccatgtgagcgccttggtcagccgcgagtggtcgacgccaaccgtcgttgaaaagccttcaaataaaagcaaaataaaaatggtgtataatccgggaaagcctagtatttcggtggttgctttacgtagcaccttttttgcggtacactttcttcaaaaaatttatggggaattgagaggggtccgactgtgccgaaaaacgctgccagggagagtttttttggaattttaataatttgttagaaatttaggcaaaaaatttaaaatttttttgctgcgaagtgaatggctaccgaaaaaatcccaattctattagtttttttggtgcgtttgtgccagtcaacatttgtcggaaatgtttaaaaatggaagaattgcttattaggaagacggggaaggcacgcagcccttttgctaggccatttgaatggtccagttcaattccggtccaaaaatggatggatgagattaaaaaggagtaaaactgaccaatcaagacggcccttgttcagcattggccatggattttcataagcaaacgaatcggaaccagggctaaaaatagtatcaattagtggaccaaatgaatggctacgaaaaaccaaaagggtaaaaaagaccccaaaagataaaaagtcgtgaaaactatagttgtttggagattttcgggatcactatcacgaatctaacatcgatttattccattttcgaatcactaacctanatttgagcaaaaacgt

SEQ ID NO: 4268 - DNA, 2704 bp, Heterodera glycines
tttgtcattttatggcttaatcttctgatgttccgttttttcttagtcaaaagagccattctctttttcccaattattatgcaatggctgaaaaaacaaatgcccgcgcaaaatgtttctccgttttacacggaatattcacattccgcggttttaaactggatgaaatttgggtcgaaaaaaaggtagaaaacaattattgaaatggttttataaggtttgcagtcagtcgttcacctaatgaggagaaggctaaaggctaacaattcacttttttgtacatccatttagaaattccaaatggacttatcgggagatgcgttttctcctgctaattggcgcattgggacgcaaggacatttgcctcaaagtcgacaaatggaaggacgacgactctcaccgcgtactgccgaatattgcaaatcgaatgggcgggaaagggcaacggatttttccacgacgtttgagagacgagccggaattggaattccattctttgggtattcgttattttgtatataaaagctaaaaaacccggactaaaattcttgttcaacataaatccctggtttcaagaaataacggacccggaacctgagaaaattatttgtaattcgttttaagtcgatcccatttcgtacaaaccaagcaattccgcaccggcatttggcgatgttgtttgtgaggattatcggttcgatataagaacgaaatatcctcaatgcgccgaaataatgtaagataaatgaataaaataaatttaattaatttgccttatgttttcagaagcgaagtccgcgaccaatcggactgccattgctgctatgctgttgccgccgcttctgttctttcggatcgtttttgcattgcaatggcgaaacgaagttggccggtcccaaccgctcgactcggcacatccttcttttctgcggccgatctgatgcaatgcgcacgagatgaaaggacagatgcgtaagagaaacaaaaaacggaaaacccaagtttaagcgggtcaaacaacattctgaatttaaacacatttttccaataaaaagttatccaaatagaaaaaagctctgctttaaggtgtcgtggtggtttctcacacaatgtttggagatttgttcacgacgtcggtgttgtatccggccaccacttcgatcaaggtttttttaaacaattgaatagtgtctgcacctttttgggacgtcttcccggatttacacaagggataaaattaagaaaatttggtgtgattcgttaacacattttattcaaaaatgactatttcgattttgggtcaaatttttgaggaaattccgggtaaaacttaggggtttaatttacatttttcgccgtttcccttcgctacgacccgccccattgcacagctattaggcattcgtcgtaacattttcatagcagaggcagtccttttctcgttttaaggcggttgcaaaccgttcccttttccgccaatgtctttttcgaggcgtttgcctttcgtttaccgcggtaagtgcgaggaaaaatgcgtaggatcacagcacaacggggaagaagaatatagcagtcaaaaaatgaaaagtaaaacactcggggacaatctgtctacaaaatcctttttgtcagcgatcgactggcacactctttcacgaaacgtctgctgggagcaagtgatcaaggaagaactgttctacaacggatcaattcccgtcgatttcattgtgtacaatcatttatttgtctatgatggtggaattctcctacagagaagagtatgttttttaataggggtccaattttgaatttggttgggggtttgggttacaatagattgaatactttcattacgttttcaatttttaggaagacggtgttcaaagaggtgcgcacgtcgttcgactgatcggttacggacgcgtgaactgtacggacggacggcgtgtcaagtactggttgggagtgaattcctggaacacatcttggggagaaaatggcggcttcttccgtatcaaacggggcgaaaatgtgtttggcattgaatcgcgtgacatcagttttgggcgagtcgagttgccatgagacgaagacgaagaggagagagacaaaatacggcacaaatttctagcaaatcccaggctttacgaaaagggaataaaacgggctttttaaaatggggcaaggaattaacgaaaaaataccattaggtggtaaataaactatatttgacaattcctggccctgttaaagcatttaccatctgactaattttccattcccagtcaaatgtttactaaacatgtaaaattcatcgccttcatttttttgtccattacttttgacaaggaaataaacgattttctgtaaaatcagtttttaatattctttttttgtcttctttgtttagtttccactcaaataaacaaaagacggtaatactgtgctttgtcccccccccccctttttcgaatatttttttatgatttcaaaagttattaaaacatttttccgagggttttcggggtctctgatcacgaattcggcacccatttcgactaattcggaatcccggccccgaattcgaacaaaaagacgaaaactcaaatttatcgaatttccgttttaagtctaaaaatggtttaaatgatcttttattgaagcattaattactttaacttccctctcaatgtattcaaacaaa

SEQ ID NO: 4269 - DNA, 3631 bp, Heterodera glycines
ggattccgaattagtcgaaatggattctgaattcgtgatcagagaccccgaaaacccttggaaaaatgttttaatgacttttgaaatcataaaaaaatcttcgaaaaagggggggggcaaagcacagtattacccaaaagacagttttttatataaatttttcaatataaatttctttttccgggagtttgccatttccccgtaagccgatggcctgaaatattttagggcagtcgattaacctaacctggctcattaaaaaggcattttgtattgaattttaaactctctggcagtcattatctttttcggaaaattttccaactcaatagaatttttttttttactgtgtataagtatttaaagttatgtatagcaaaaaactaattgtaataaaaagaaataaatatacaaaagcatccaaccaacaaaaaagcaatgaaaaaggcgattcaattgtgtagcttcaagtggccagtgacttcgtcaatttcttcacgcggtccgaaaatgccgagcactgtgcacgagccggccgggatttgtgtgtgcccggcgtcgtggatgagctgcgcaatcaatccatgctggtgggcctgtttgcataactccgacagttggctggcactgtcggcacggagaacaatctgagtgagaaaaaatgtgtaaaaacaaaaaactgccattcataaaaactaaatcttagcgggactcaaaatgtgacatcgatgatattcatgaccaaagccaagccaccccaaaaaattctgttttagtcgctctgaacagaaaatgatgcttgcaaaaatttgagagcgagatttccgaatcttccagggccgcgctgacattttcaaaggcaatggtttcctggcgcgctctcccaaaaaccggcctttccaaaatgattgatcccggtaaaagccggtctcggctcgctctagtaaaaaaaaaaaaacctaaaagatgaattttgagtgtctcggctgcatttgactgattaaggaaaggttatttttgctgtatctcttcgtactttcatctccccatgctgtgcccaatagtccaacgcgtttcgtccctcctccgacttgagggccgacctgtacagggccaccgcggcgtgtccaaccttaacaaggaaaattcaaaaaaaaattttttgaacaatttttcacgacctgcgccgccattttgccaggccccatcctaagcgaagtattgatgacaaacaccatcttatgaggaacgccacctcccccaatgaatttgaagctggacgtcagcgctgctcccatttgaaatcaatcaacaatcgaatggaaatgtttaaaaaagaaaaaaaagagtaattagaatgccaatgccgcgaaaattatattggaactttggaaaacaattggcaaattccaagaaaataaggtaaaaaacacaaaagagcgcattgattttattcatttttgagacttagaaagcatgagaaactcaacagtagcaaaagcgcaacaattcatgaaaatgatcggaaacaaaaataactaacaaacaaataagaaaacatttatttaaattaaaataggtaactaaataaacaattctacaattgatgaatgactgattgattgtgtttgttcatttgttgtgctttgggccgctttttgaactgaatgacgaggagagaaatgcttggaaaaaagcgacggagagtgaaccgtacattaggcaatcgtttaattttgaaaatggaaaatatttaaatttcagaaaaaaacaaaatccgtctttccgtcgctctccgaaaaacgcaacattgccaaaaaacgaagggagcaaaaagacaattataattataacatattaatttcatcggctgatgatgatgaaagaggacaacaacgaacgaatagacaataataattagaagaatccgtgcagtttttggttgttttttgtcgatctgttctttcatcaaccacacacactctgtttggttgttgtactgctccataactacggcccgtccgtcgtcgtccgttgctccaacgcgtcacagtaccgccacgagtcggacggtgaaccgtcgccgatgcggacaaagaagcgcggttgccactggtgaccgagccgctcacgccccaccttttcgtcccgttggcgttgctcaatgcatcgctttgctgaaaagggaccaaattgtaaattttttaaatttaaatgatgtaattttaaatacataaatatttgctttaagcccacattgggatgcgatttcgatgttgttgctgaacagtgctgcagtgacgtgacgccacaatttgcgactttctctgtcctcctgttccctgaccggcacacattcctataaaaaaaagacatggttgtttgttttttcaagaaatatggtactcatacttcaaaaaataatcaactaactcttaaatatttgagtgtccacgaaattttgtcatagtgatcaacaatttatttaaaaatctcataaaaattcaattaatatagcaattttattaaaaagaggttttttcagattttttccacttgtggcaaacattttttgaaatttcggtataggtgaaaaaatcagcaaatagcggttacaatatgcataataagttttttgcttttgttggatctcgatgcaagtgaacgagtatttgtttgagcgacttttaaagaattatcccgcatcatttacctttcgaacatccggcttttgccgaacatcggtgaacagttggtagtcggtggctccgtcccgcttcaagtaaatttccccgttccattctcccttcagctgcatcaacgcagtctttcgactggtgtgaaagatttggccatggatttggtgggctttgccgcggaagaacggcttggccaggaagtcaatttcggcccgatagcccgtcttctcgcaacggagttcgacctttgaaaaaattgaataattttgttacagacatccaaaaatgaacaatttttgtacctttcccgccagttcaaaccacggcgttgccattattgcgcgtccgtaaccgttggggaaggtggcaatgtatgtttcgtggtgctacaatttaagtgataatatttaaaacaaaaaataaataaatgaaaacgcatttaaattttacgaacaaaatggcatcggcttttgaaaacaaaaaagtttattcacagaacccagcagaccaacaaccttgtgaattcggacggtcgccttgccgaccatttggacgccaatggccaggccgaggaaggacgatttggtgtaaatgtgtgtggtgcatgaaacgccggcctcaggatgttcgacatagaaggcggagacgggcggatggtggctgacctgttcagcgatgaatgacacctgaacagcgcaattcacacatttatggcaaagaaattcgggaatgttagtcgagacgagtattattattattttttagtgcattcgaatttgagcgtggaaaacaattacttatttcaattagaataaatttaattagaaaaccatattattccctccgatttgacctggttggtggccgacccggggaacggaccgcccttcgtacgactgctcggagatggctcagtgccgggcagtgtccaa

SEQ ID NO: 4270 - DNA, 1316 bp, Heterodera glycines
taaagtttgaaatgttgataatttttttagagagcgacggcgaaaatacggatcaggatcaggactacggactaggcatccatacggactacagacttacggactaaacacccggaaaacccttactccgtataagtccgtatgcaggaaaaatacggacccgtatacggatcagggttttttgaaaagttttttaatcaataaaaaccatatttttttactaaaatactaatatagattcattctaaattttattacgaacattaaacaagatttttggagtccggcggtgccgataggcgccggcgggaaattttttaaaatttgattgcaaattcttaacagatttatcgaacaaatttgcgctttttaaccgattatatgaatttttctaacgatttttcataaaaattaggtatctataattttgaaaaaatttacaaatccatcgtaaaaaaagttaagaaatttaaaacgaaattcatttcaaatgaaatttacgaattggaaattaaatagaatttcataaaaaattgaacgaaatgctattcaaaatcgtaaaaattttgagtttttatcacaaaaaacatttttttccaatttcgtaaaatttttcaataattttttgtccttgatgttcttattttgaaaatttttcggtcatacccctgtcctagagccacatccgcttttccacctactaggatcttaattccctcagttagaggatacaattttaaagttcttaattaaaattgaatatattttaaaattttcggttttttcgtttcgtttcgtacgaaaatggttattttttcgttttcgtgtttcgttttcgtccgtcaaaattttttcgtttcgtgtttcgttttcggttttcaaaatttcttttttcgtttcgtgtttcgttttcgtgtcgaatgccctttttcgtttcgttttcgtatacgaaaatttttttttgtgattttcgcacatccctgatcggggatgattagaaagaaatcagcggaaatggaggttcgtaaaccgtggaccctcttacggggaatttattaatctcctctcactccacaacagttttaacggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattacaccttgcctaaccttaggcccatctgaataataaaaaaactcaaattggagacttggacattttgtgggtca

SEQ ID NO: 4271 - DNA, 995 bp, Heterodera glycines
ggatatactatagtcaaccccccggaaaaatggcataatggtataccaatcgattcgtcttgatgaggtatgcacgaaaatgtaggtctccagttgcggaaatgccaaaaaaccggtttttgaactggctaaaactcgaaaaattgagtgaaaaggggggcccctgaccctttaaaacggtcaaattcggacaaatttggatcattcgaaagctcttgatcagctaaggctaaaaaacaaggtataaattcgaaccgatgtcatctaggcactgggacaactgtgtcccagtgaaaatggacacttcagtaccaaaaaataaagttttcttatataattagggctgggatttttatatgctaaaaatcctgaaatatgtaataaaatatgtgctaaaaaacccaaaatatgtgctaaaaaccaaaaaaaaagcctaaatatgtgttaaaaatgcaaaaatatgtgctaaaaattggaaaaaccaagtgtatttacgcaaaaaaatcatatttaatatcagtctttatcaattttcgcccgacctccaatgaaaattttggcgatatcaatcaatttgtaaagtcccgaattaatttttccatcagttgaataagttccttccaggaactttgaaatccagtgacgatttaacacagcgtttgatttggctgctttaggcatttaaatatataaagaaattttctaaatgcttaagaaacgtaaagtaatcaatttttagggtgcattttcagattttcttgtatttttcttacgatttttctcaaaaatgcccaaatatgtgctaaaaaatccaaaatagcccaaatatgtgcgatatgtttttatgtgccaaaacgccaaaatatgtgtttttatgtttttataagtcgctctaaatcaaaaattgttcggagaaaatgctatttttgggcttctctcgccataactaagcagcaaaaaaaatgttaaaacataaatatcacagccctatatat

SEQ ID NO: 4272 - DNA, 3311 bp, Heterodera glycines
  misc_feature (149)..(149): n is a, c, g, or t
  misc_feature (151)..(151): n is a, c, g, or t
  misc_feature (169)..(169): n is a, c, g, or t
  misc_feature (204)..(204): n is a, c, g, or t
aggcaaaggctggcacaagtgacaaggcaaaacatagcagcaaaagggtcgcaagcgtcaagaacgcactcattattgccaggcctgaaaaatttgatgatttttcgaacggaggtttgattttggcattcggaagatgcaacgccatntntatgataaaagcattttntaagcaaaaaatatccttttataaaatacctttanttggttattctaaatttaaaaattttaatttagttttttggattaattgtaggaaatggatattaaactccgaattcaggaaaacaaattaaatacattaatttaaatgactaaattccaaattcttttggtaattttttcatattttataggcccctttttgtttggaatattttgtctatatttagcatgcagaattgagcaaaatttacaaggatattaaaaagtgtagaaaatgcttaacaaaaatttaacacacttatttatctattttaaaaaattatgagagattaaaagttattaaaatacacgaataaaaattgttgtgaattaataaatttaaatgcatttttttctgtgtaccgtaccgagtcgtgtggaaatggtaagtgaaacggccaatgccggcaacaaaatcaggcgcccttcaaacagttctaggcgcgcagaagattctgaggaggcagtgaagaagggtgactgctcaacgaggcttaattcgaaaaaaattaaattcaaaaaataattagaaagttttggaataatttctaattttttaaattgttattaaaactggcaagtaaaaatttagaggaattttttggttcattatatgcggccaattaaaaaataattgcacaatttagaaaatattttatttgttaaaatagattaccaaaaaatttcttaccgtatggaccaaacgaggaaaaggctaaaatgttttttgtttattaatttttaaattaaataaaaatgtccaaattacatacgtctcaattgtgccgagaacaattaatgcactggcaaaaaagcgccaaaatggacaaccggagtgcggaaaaacgttcaaaacaccgcccacaatgcatgggattgcgtaaatccaccagtcaggcacggccgaaaattttgaattaatttaaatgaatttttcaaattaaaaattaggtgaattaattggatatttaaaaatttcataccaaataaaggtataaagcactgatgagcagcactgaactaagaagcaattgcaaagaacgtgcaatgccaatttccattttaaaataattgtttaacttaaaatataattaaaaatttaattttaatttttttataaattttttgttgcttaataaaaaaaaattcaataattttcggaatgttaaatggttttttttttgaaaaaatatttccattaattgacaaaaatttacagcaattttatgtatgaagaggagagcattgtgatgggtgaacataacaccacaacaaattttctgctctctatcctccgtttctttcttcgtccttaactatctctccaaattttatttctctgccacgactttttggcacactattttttcgtggttttcggcttatctatgcccccgattcattttttataatgattattgactctggcgccgccgcctccgccgcaggtgtcccccctattagagagataacgagagaggaacaaaatatgtgggggaaatgtaaaatgtgaatttgtttatgccttattgtaatttaatttgctgcgttaatgaggttcatttgaaaatttttcgagttcaaaaccggcaattggtccagcaaaacagaggagttgctaatagacaaaaattaattagcctcattagaagaccatcattaatgttaaggataatttggtgttaatagacaacaattaattaggcgcctcattataagattatcaattagtgccaagaataattgggtgttaatagacgtaaaattaattaggcttcattaaaagaccatcaattagggccacgcataattggaccatatcaatagcagattaatttaaacaaaaaaattttcctggctgcgcccattggcaccgccggacattggtaattatgaaaaatgtttatttgtaaacccgctggtactaattaatgattatccttttgattataacagagacgctcgaatcgaaaattcttagactcctaaaaattgaaaaaaaccgaatctttctctacgttgaaacgagacgagaatttgtttagttcttatttttacggaaaaatgatcggaccggaacttttaaaatttataaaataaatcgttttcctttaaattaaaaaaagaaaaaaatttaattgtttttatttttggttttattttttatggtaggaaattttcgtaataaaattttaagaataattgtactttttacttactttaagtattctatactgtgtggcgtcgaacaaagcagaaattaaataatttttttggaaattttgacacagtttgctaaaaaaattaaattgaaaattttaatttttagaaaacaaaaaaattggatttctcaacccttataaaattattgattttgtaatttattttttattcaatacataatcattattttacaaaacaaatttttattaaaaaaaaaatttcttattttatattataatacgaaaaatattaaaagcatgttttatttttcacatttgttgttgtttatttgtcggcttcacaggaaatacagttttttaaatcaatttttccacgtattttcgttgggaaatcttataaaaattatttaaaaagataattttatgttttatttaaaaaaaaaagatttttttacaaaatgaacaacattgcattcattgcatttgcattttcagcgcttttcgaattcggtaaaaatttcagtaaaatattttttttttttttaatttaggcctcgctcaaccgaagccgacgcctgaaaatggtttaaataatttttaaatatcttgttttaatttaaacatgattatttattttataaattaaacggactttacgaattttttgtgcactattttcgagttaccaaaagttgagaatccttgaaaaatgtgaattaaattttcctataaagggctttgaaggacgtttaaatcgcaattagtaggccgaccataaagtttgaaatgttagagaagaaatcgaaaatcccgtttctcgaggatataaatttttaattgcttttttcaagaacaaaattttcgcttatgcaatatattgaagaaaaatagaaaaatgttttcatttaatttatacatattcag

SEQ ID NO: 4273 - DNA, 2007 bp, Heterodera glycines
  misc_feature (1909)..(1909): n is a, c, g, or t
cataaagaagcaatcgcttcaccgaagaaaccgagtccaaaaggcgactgggaaagtgcattaagccaaaattttgctaaattttatcaatctccgaaacgaaaaaccgcaatttcgcctgtggcaaaaggtttatagctcaaataaattttcgttttttaaaatgaatttttttagtgaaaaatgttgaaaatacccaatcaccaatggatcagacatctgagattcatcgagaattggccaaaggtgtttaagcaattaaggataaatagccacaataaaaattaatttattaataaattattcaaaaatttaataaaaattaaattaaaatttatttaaaattttagagaaaaataaagaaaatgcacaaacatcaaaggaccagccgacatcggcgggtggtcaaaatgaagcaatcccttcaccaaaaaagccaagccccaaggggaagttgaaaagcgattttcggcctaaacttggccaagagcttttccacggccggttccgaaaggttacaacagtcatagggattaatttataaggatattcatcgagatcctcattctcggttctcgagttaagaaatttcttaggtttttcgtttctctgatccttgccttggctaggctgtcctaacaatttaaccatccctggtattaccagggaatgggttttttggatctagaaaactgtcaaaatatgcaggatttaggactcaaaaagcccttaaaaagaatttaaaaaatcccaattttatgggagggtattaaattggtcagaaaatttttttggcctttatatattattttgtttatttggtacatcatttttcattgaaaatggaatattttagcaaactttctgacgtacgccataataggacaaaattaacgcttcttaaatatttttcgaacctaaaaaactcaaaggtaaaattccaaaaatcctggtcctatttattcattcatccatttgatttaacagaattttattttcaaaacacagtatcattgacgcatttccttatccttatcattcatacgatttaggaaaaaaagttgaaaatacactatcatcaaaggactcggcatctgaagctcacaaagaattggccaaaggtgttcaagcaattaagaataactgtcccaaaaaatgttgttgataaaattatcccaaaaatataaattaattatttttaaaaaattttagagaaaaatgaagaaaatgcacagacctcaaaggtcccgacatcgatggaagggcaaaatgaaccaatcccttcaccaaaaaagccaagccccaaggggaagtccaaaagcgatttcgtcctaaacttggccaaagcttttccacgaccggtgccgaaaggttgcacagtcatgggcattaatttatatgcctctgggtccttttcttgattctcaagtgtagtaatttttctcaggttttttttttctgggtccccgttataggacaaaaaaaattctttaaaatatattttttggacctaaaaagctcaggaataaaagataaaaaggacttaaaattcaggccctatttattcattcatccatttgatttaagagaattttgtttttaaaacacagtatcattgacgcatttccttatccatatcattcatacgataattttagtcattttttgttacttttctttcactattatcaattttaaattaacattttatagcaaaaatgggagaagaagctcagtcttcaaaagatccgacaatgaatggccaaatttgtgcaatttgtttggatgcatcgcttatcactgaccttgaattgagcaaatgccatgtcataaaatgaattatttaaattggtagtatattttttcaaatctttttttagcatcgctttcaccgcgaatgcgttgatgngtggtaattattaactaattaatatttgcgtttaaataattgattgcaaggtttaaaacaatgacacgtgcccttattgtcgtgctgtagttgcaagc

SEQ ID NO: 4274 - DNA, 8092 bp, Heterodera glycines
attttaattatgtcaaccgaaattttgatactgatcaaaaaatcatttacatcaactttgtaaattatgtcataaattttggagaccattatttcgatttgctatttacataagtaaattgttcctattttgcatgtttatgcaaatttttagaactatcaaattttagggtggctttatatattggacacctatagtgtattctttattaaacttaaaaattatatgcattgatatttaataataataatttccatttaaatttaattaattttacattattacacaatttggttttcactttcatgatgtcggatacgcgatttttacatcacatcatgcagattgaattgaaacagaattacatcatattcacgatttttcatcgtatttacgatttttctcccatcttctaaaagatgatcctaaatacgatgagacgtcgtgaaatgatgggaattgaaacaaaattttacacgatatgacgtcatatcggagatatgacgcgaattgaaataggccccaggccgatcagccgaattaaaatgactttgactttttcatttcgtgtaaaataaattcaactttcttcactatattaaatttactcaattcgtttgggaaaatccaatacccgaacgcggtcagccctaaaacaaaatatgatcagctgatttttgaggtgccatgaatttaggccgaaactctcgagcaaaaattgtaaggcaaagaaagtgatcgtaaaatgtctctctaattaattgaccgcatttctgaatcatcggaataattattttcccggacatcacaaaataatcagaccgatttaaaaatgcaatttttgggaaccgttgaaaaacttgggcccggccaaccctaataaaaaaatgatcagttgaatttgcagtgccatgaattcttattgattgatcttctctgaatgatcggaagaattaatttcacggacatcacaaaataatcagaccgatttaaaatggacttcttcttgcgaaaggcttagccttgcttgggttgggcttagtccaaacttaggcttaaatttcccaaaatttttgtttggtacgttttaccgtttatctggtttataaacataacatatttaatatttatttaaattacaaccaaaattccatcccaatgaatcatccatcgttttgtccgatcacttttttcagtttccaaccacagcaaattgctgattatgtaaatatgagttggcattggaatgggctttcgctgggttggttggtacatattccatccccacccttctcatttcatttttccattcattttacattttttccaaaaattttcaaaccattcaaaaactctgaacaatccaatggagtttgcccgtcgtcgtcccatgctttccgcgccgttcggtgcactgctcggcgccgtcgtcgccgtcgccgttttgctgccgtcccattgcaatggtaaggcaaacaaaaactgttaatgtttgagggtggatggttcatggttcagttgaggagggcattcggacatttcagtcccaagccgtaactctttgttcatccatatttctccatttcagaccgaaaaagagtcggtccgggttcaacaccataagtttggtgtgttgcacaaaaaattaaactgcaccaattggtctgatcacacacaccaagggcgtagccagactcttggcttcggagggcgggaggagggggatcttcggcctcatgttttttcgccacgattttccaaaattttcaaattttgaaaattgtatggagattttgggtccggtggggctgataggcgctgccgggggaaattttgagatttttatgagatttcttaaaaattccattttttggatttcgggggggggagtgaaaagtgattgatgggcgacggggaaggaacgacggacgcggcgatgttatcgcattttgagtgttgcgagagactggcggtcgaagactgatgagcatttgctatttgagatggatgttggggaaagattagaaagaattgtgggcagattgccagcagcaaaatacagtggcaccaaaattaatttttaaatttgtgttccttggacaatttcagaaagggcgcggcattggcataatcttaaactttaaagtagatttaacccaatttttggttcaaccaattcaaatctctagagcagtttggttaaagaaacactttcatgattttcaaaattttagaaataactttctacaaaataaatatacattttttatattttctacgagaactagtacactccgagttccttttcggacttttgtttttttaggtgtccgacccattcggtccccatgcaaatgcaatttccttggcccattccgtggcccatttgctcggcattgaccatgacactttggagtgcacttgcgatgagagacatgacagtgtgggaatgtcttcttccccaacaattcgcaacagacaatgcataatgacagaacaacgacaacaacagaggtagccgatcgtaaaactgtgaaattatggtctttttgctgtttacagttccgccgtcgatgttctccctctgcacttttctgcctgttcaatcgctcgtctccactcgctgctgcaccaatcgctttccgatcagttgcaatgtctctttgtccgaccctttcaaacgtcgcgtctttaccagtgcgggaacggagtgttggacggggacgagcagtgcgactgcggacggagagaccaatgcggtgaggtgacgaactgaagggatggaggaagatgaccgtttatttactttccattctgtttcgttttttttacggcgtccgagagtcttgagttggacaactttcaattttcagtctcggaaattgtcactcgaaacaattttaaagttatggcaatggacctcaaactttcttttacagatgatccttgctgtgatccgttgagctgtcagctgaaggcccatgcccaatgtgcatgtaattcctctttttcccactcaaaatgatcgtttcatttctccccagcccatcaaccatgctgcgaacattgccaactccgttcttccggttatgtctgtcgccagtcgaagtccgtttgcgatattgcggaaaagtgcgacggaaaaaacggcgattgctctgccgatggtaatggattcatttaacgggtggtggtaatgaccgaatcaatccatcagagcatttggtggatggcgtcctttgcggactgagcggactttgctggaagggcgaatgtgtagacgcggaaaggcaatgccaggagttgtggggacaaggtgaacagaggggggggggggaagacgttcagttaaaatttgaaagagagggacggaacgaattgcgaaatttgtccctctcccaagcggatttgacagtgaaaaccgaaaatgtccgactattttgaaggtgcaaaacctgcggacgaacagtgctttctgcacaactctcgtggcttggaatacgggcactgtgggagggacgtggagggacggtttgtggagtgtgcgcgggaaaacgcgcggtgcggcgttttgcactgtcgcgggggcggcgcgagtccgctggggacgaacgcgagctcattcaacttgcaatttgctaaggagcaacggcatttgcaatgcaagtgagccaaaaggcggggaggtagaggtaattaccactaattgcaatacaatagtgctatacccaaaggggaagatgactgctcaccatttggcaattgcttgacacacattggccttgcccacctcaaaaagccttttccccttagggtggttgtcaattcagccaacggaatggtcaaagatggcaccagctgcggttcgggtcgcatttgcgtacgttctgtttgtgtaccgttaacgcaagtgtcgccgccagtgccatgtccgagcagtaatttggcactttcttgcagtggtcacggggtatgaaatggacgggaactttttcgccgggttttgtggttccgtcttccttccccaatacggggcctgtactcccccggccttaggactgcaccaccggtgcgcattgcgtgtgttttgacggatggacaggtccctcctgcgccctgcgaattccgtctaccgtttacaataaaaagattggcttgacatccgctgaagacggcagagaatccatcgaatttgtggtgccgccatcaattcgaggtgtttttcaatggctccaaaaaccttcaaaatcccccccccccccggattcagtgaatggtcgtgcgttggacactgccacactgctcggcattctgttgctggtcggcttcctcctcctcttgctgctcatttgtctgctcctcttttacaggtaaaagggaaagaccgagcctggcccggtatctggtttttgccgggcccgtaagccggctcggcaatttttgaaaaaatccggtttgaccggggttttaagaagctggaaccggtcattttttaaaatgacagccgggcccggcagattcggaaatctcggtttataatattttcatggtttttaggcgcaaaagttcggtcagagcgtacggaagagaacagaacggacaggcgaaagtggcagatgaggaggactgtgggaaggacgaagggactgcggggagagcgatcaaatttggacaaatgccgagctatcgggaggagaaaatgaagcggaaagcgaacaaaagtgaggagcaaagcgcgacccttggaataatttggcacagagtgccaaaactgttgttaagcatttaccaattcagaaatatatggtgccttgcagagaattacggaagcgaatgaggtgagaagaagccaaggaagcaaaaaactcagaaattttcaagaaaaaatcttagaaaaatttaaaacagtaattcatcataaaatttaaaaaaaacgtgaaaatttaagattttgtcccatccccggaaaagggggaccttaccatcttccatcataggccgactcactttcactcaaatcgcgcgagtcctcctgcgccggtgccgttctctccgtggacggacgaattcagacagcaaacggacagagcattttggcggaggtgccgtctttgtccccgcaccaaccgatggaacgaaggttaaattcggcaccgccttccattgtgccgaatggagaaataggcacgggttgcagaagtcggccgatcagtgacgacgaaatggggaaaaatgccacagaaatggtcagaagaatgcttaacattgagtcgaacattggcaaatattaccgctctttccaggcacatttcggtgcttttgcccaccacttgagaatgaacaatacatccccttcgtttggccctctcccttctcattttgagggagttggcacttttgctgcaccgcctccccggttgccacacattcaaatgctaatgcgacgattggagggatctatgggcgaagaatttgacgtggatgaggagggacacatttcgtcgaggacaccgtcggtgggcggcaacattccatgccccgcggcatccaccgactcgggccatcctggcagcaactttgacgtgagcggaatggaaagggtcccctaacaatgatgaaactcggtgcttctcgttaagatccgtgccgagtccccgtcactgttctcggacccgtacaaattggacagattggacgcgcccggatgatcggacgaactcaacagtcattccatccccgcctcctctcattcacttgcaatgcgtgattcacattcctcatcacttttaattaatttatttttgtatgtgaagaatctcagcgtctctttccttttttcccgcctcatttattttatattcttttctttttcgttcgtctaattcttttctaataataaaattgccaattaacaattctcctttccgactttttcaccgcccatcgctttttcggttaccggggaaactttgacagttgtgtgttcggccatgccatgggtatcccacccgtcaaatagcgcctcatttttgtttttcactgtcccattgtgttacactccattttcaccctctagctatatttccttctaaatgactgacgaaaaatacgtgcccaatcttgacaaagttgacgcggattcagtgccgccaacagaacgggtaaaagggataccaaaactaaaaatgggggcaattttctgcttgcgtttgtcttcccgtgaaatttcggattcaaatgaaaccaaaacagatcatccatttcaattgtttgtcatttggccaacacatcagaataaaaatgccgttgtaggagatcaaacacaacaatcccggacgccccgacaaagactatgacgaaacaccagtgggaccagcggaaggatatgtgaaggaaaaggagcaggagaagggcggagatggaaaatgatggaacggatagaaaatcggaaaattaaacgaaaaacaattagtgtattttcaggttttttcttgtgatctcgtctcgttctatcgaataattacagtagtacaatacatggcacatgcaataagtgatgcaaatctcaagctgcgggttcatataagtagacttgccactcatttttgctaagacttatttttacgaataaataaataaatcaacggggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgagcgtcaaaaaataaataaataaaaggccaacaattaatagaatgggtgttttttgcaggtgagatcgggtgcagagtttttggcatgcgcttcccatttcgggatcacaataataggataagaacaacagaaacactcactgatacactcatatttagtggtaaaaatttgagtgtgtcataaacagacattagcgcataaatccaaaacgggttcaaactatgttttggttatgttgctggagcagtgccaacatggccggtcaaacgccgctgctccgtacagttccattccgtcaatttgtgcattacagcatttttgcgtcattaaaatgtcatattaatgaggatatgtaccaggcatgacacagaaattccgatctccgactttttgggttcggaaagtggttttccgaaattttcggaatgccaatcttggtgtgtgcaaaagacaatttgcactcaatgacagtacattacagtacattttggctagcatcggttgatggtctcgctactgtaccctgcaattggttgatcagcaaagtcggatggtttgccagaagtgcgttggacactgaacgcgtaatgggaatgatgtgcggttggggcacaaaaatgccataaatgaaaagaaacgttatcacgcacaaaaaaggtgtgtgaatttgtaggaaaacgagggcaaagatcagcgtacgaacatattcataccactggcggcccaattcccgtcctccgcaaccccaaacttctcggtgtcaaattcctcccaccacttacaaagccatttcccgcagcctcctcaactatgccgctccgatttggactgcacaactcgccgactcacattggacaaccctacaacgttgccaaaattccgcccttcgcaccaccacgggttgcgtctccatcaccccggctgatcatctccatgccgaaacttccatcctctgttaaggaccacaacggtctactctcccgtcaatttctactggccacgcacgcgtcaaccagaacatccattctacacaactaccctccaccgcactcaacgtcaaatgaacatacccttgaggaacggttcatcgactctgtccttcgccaatgccgtggcaaagcatccaccgaaaacaaattactccacacacgcgccgttacaaacgccatccgcaacacccaagcaaagcgtgtcctcggctttcctccagcttccattgccatcaacaataattgccttcctcgcgaagttcttcgcacttggttggctcagcttcgctcgggtttctctctccccgcctcaacaa

SEQ ID NO: 4275 - DNA, 1620 bp, Heterodera glycines
  misc_feature (18)..(18): n is a, c, g, or t
  misc_feature (63)..(63): n is a, c, g, or t
gtcaaagagagagtgttnttcttccccaatttttgttcaatgttttgctattatgacaaaacncaaagaaaaaagtgtgtttttggtgtactttgtttcgtaactatggttcggatgaattactttctttcctccgtttttctccaagccctcacaaaatacatttactcaaacattcattcgctgtgtcaagatttgttcgtttttagcccgaaaatgttcaaaacgtacgggccaaggcccgagtcgttcacgcttgacgatggggagcgttattatgtcggtaagtgtgtgtttgaagcggttttatgcgttcggtactctgtttcaattggtttacgagtgttaaattggtctgtgttcaggtgccgacgttggccaatacttgaaataccatcgtggtacgctgtacaaacgctatcctcaactgtggaagcgaatggcatcggtggaggagaagaagaagatccaggagttgggctgtgccacctcctacatcaactcgaacattatgctggtcaaagcgaacgaggtgatgatgatgcgaatttggtttcattttttgaagtgggaaatgaaaattgtatttttaaggaagccttttttaaaacaaatgcctttccaggtggaggacatttttgacgggcaagaggagaaatatcgcgcgtcggtcagcggcggcagtgcgtacggacgcgcggagggtgcgcaaacgctgcgaagtcggggcagtgctccgtggctgaaccagcaggtggcccaaaaaacaaatgtttgtcagggagaatgccaacgcttttttgcactgattttggaaaatctacgcattccaaaaaaaatacagactccttcaattaagcgtattcatatttgaaatcccagttttttttattattcatcccagggacggtcccagggtttttccttggaggtggtaccgccgcactaggcgacgaccttctttttttacttttaaatttgcatgaggaaggtcttggagggcgtaccaataaggaaaatcggaaagttttggtcagaagccgttttgttctttcttaggtgaccagcggttcccaccacctcgagtccgtgccctgctccaccccttcggcgcacgggcgaggccatttcaaaaatcgcgactaccccaaagtgtgatgagtacggcgaaataaagactggatgtgcattcgatctgtagtactgacgcaggtctggttcgtagatgtctgaaaagacggtttctgtggttcaactgcggtgtcgctgtataagctgaaagttgcttaacaatcttaattgttgactagaaggtcatatttcactacatattcaatggtgtcggcgaccaaccgagcaaagtacgaattggagtaacagatcgtgaccttctgtacggcggaagagtaggatactcggacgcctcttctggtgcaattgacttggtttcctatgcaatggaatgtaggtggtggatcgtgatgttctgaggtgattggacaaattccttgtgttgtggaggtttgaacgcccaggaaagtgacgaggatggccatgatcgtggtagtggtgcgaggaatcgcgataagccgagattttcgccgcgcaagaatgccgctg

SEQ ID NO: 4276 - DNA, 2136 bp, Heterodera glycines
catgtgggaccaatgcctggacaacgcggtccgattggagcagcgactgctgccccacgtgatctatgacgacgcagagcacgaagcgcatcataatgacctgtgagtgtggctttttatgagcggaattaatttacgaatatttggactcggaggagtgatacttttaaatccataaaattcctaactagcccgttttcagttaagggtccaaggctgtacgcaatcggattttgaattcgcttaaaccatattgctaaaccaattaatttaattatgaagttggtaaattttccgttaagactttgctggttttcctattcaaatctatattttccagagtttgctcgtgcgatgcatttttgcattatctaatttttttttcattacaaataggattttgtcattaaatgctaaagcgcaattcccaactcagaattgacgtcatccaacacgttgagcccgtccgaatcaccaacagcggactggagccattgaatggcaaactgaccgaattcatcaacaacccattgaacagctcggacaacgaagtcccggtgctgcctcgtgcaatcaccggcattaatcacgtgtaaactaatgttcaggctttattatttttttaatgaaaatgaaaactaagaattttctggagataaaatttcagcacgccttccttcgaccaaatcaaacaaatgattgaggcgatcagaacccagggcgactgtccagcggtggacattttggcaccggccgacaatttgactgtttacggtttgttttggacatcattaacgggggggggggtgcgctaactttggcattttgccattaatttgcctccctttaagacgcctttgtgtgcaaagtgttggcggatgtgctcgacattctgaagcgtcaacgtttctacaccaatttggaactgattgagcgcgacgcgcgtgcccggggggaggcgaaatggcaaaatgccgccgaagccgcaggggcggttgatgcatctgccaccggaagttcagcgacaactactgatggcaaagggacagcagcagccaagggggaggacgacccgttgatgttggctgggccgtcttcattgtccgtcgaacaacataaccttgtggcccatgtgacatccactcatgaaaaggcgggtgtacttcgtttttggaaaaaaatataaaacaataactttgtttgtccctcgtccatttctcattgtgcttttgttttaagtttttggaggccattcaaaagggcgaaatccaagcggagggtgaggacgctgtggcggacggcgaagacttggacgacgaggacgagtcgcattccgaggcgtgcagcgaagactatgtgagacaaatggagtgacaaaaatgagttgatgccatgccattggggacatttttgaatttttttttactgacagggtcaaaaatattttggtaccaccaaaaaaccaaggttcgctcatgagcatagggtgcgaaagggttgaaaatttaaaaaatcctcaaaatttgcattttggccacccaaattatctaaaatattaccattctttgtcaaaccagattgatttggcgtattcgtccagcactgatgcagttactgcttgcgatgcttcggttcagcaacaacatgaacaaatgaaaaaaacgaataatgccgacgaaaatgaggaacgaatggagacggatgaggacggcgtcaactcatcagcacaacaacagcaacagaaacaattggaaccgccgcaaacgacggcattgaccaactccaataatgatgacaacaaccaaaacaacgccagttcgtccgtttccagcgccacagcgatgaaagtacgccttcagcagcatcagttaaacaagctgttctccagcgcggcacgtctccgctcatcgccacgtaaatttttaaaatattttaatttcaaatttaattatgcccctatcaaattttgtagtttcattttaattggggggggggaggctctcggcaaaatttcttaaactttcatccgtttttttattatgatcgtttagcgatgccaccgccatcgccgtcgtcaatgatcaaatcggagaaaatagacctgacattggacgacgacgacagcagccatgagga

SEQ ID NO: 4277 - DNA, 900 bp, Heterodera glycines
ccgatgatgaagattcgatcatttgtctgtcggacggttccccaaaagcgtgcacaatttaatggtgttgttgatcttttacgctgatattccacactttccgccctccctccccccggccaacaaaaaccacacaatttcctgagctctctctctgtacctgtaatttttatgtgcgattgattcgcttttgacctcctctcattgtcagccttttttctgcccccccccccgtttttttgtcttccaatcagtccgcagaatattatactatttttctcatcagatatgtcacacagccaagctttttttgtcactaattcactgaattttatttgagtttctataaaaaaaaataccgaggaatgctgtctaaattattcatttggacattgattaattaattgttatttaatttaattaataaaattttgtgttttcatcatttcatttggtttcacttttgacgccttgccaaaaagcagatgaagatgaaaatttcggacgacaatgtcacgtcgatggtttgtgcaaaaaacttcaccgagaacagtgatcagatcaaccacatcaactacacaccggacgggtgggacccatttttaagttcttaagtgggatgaataatggtcgtgagcggtgggggacatccacttttttttgggtataactccttacattgttgtccgatttggaccaaattataattattcggtagccctgtgtgttctatattagcctgaaaaattcacaaaaatttcgttaggtttcaagtaaattgtgaccataaatgtttggaaatttgaaacctaacgaaatttttgtaattttgcctgctaatagaggacatttagagctatcgaataaattataatttcgtcccaatcgaacaacatgaaa

SEQ ID NO: 4278 - DNA, 1863 bp, Heterodera glycines
aatgacttggttgtctattccgaatttgctctctttctcatgaatctttctaaaaaaaattagaattcgactgggcctgtgtccaggcctgatttttttgtccggaaatacaggtcaaggccaaattgcaaacccagatacactttacctgtccctatttgtttgaaaacaacaatggtttttgaaggagtaacataaatttgggaccgaattccatttcgtgttttatttttcagacacaattcgctacctgtccctgtacgacaacaaatacttgcgctattttggagggcacagcaaaaagtggggccgccatttaaatgccttttattcatatgtttgtttgttcgtccatctgttgttctccagggtggtcactctgtgcatgtctccgttggacgacctgttcctgtccggctccatggacaaaaccattaggctatgggacctgaagagctccaattgtcagggcctcatgcaactcgtgtcccgtcccatcgccgcatttggtcagttttttttttggacggtcggtgaggaatactttgtctcctaattttatttaaatttaaatgtaatttaaaaaagtttttaatgctttttgattttcgaatttttaaaaattctctaattaccttcgtcgaccattgtccacttccccgctgggtttttcttattacgaaaattggattatgtcttacaaattgtggttttacagatccggaaggtctgattttcggcgctggcattggcaacgacgtcatcaaattgtacgacttgcgctcttttgacaaagtgactaacaatggaataataaatatggggattttgaaatttaaatttgtaatttaatatttggaaatttccaggggcctttcaacacattcaaaatcaacgacaccggactgaattgcaattggacaggcatgaaattctcgcccgacggaaagtctattttgatcatgacggacggtggtatgctgcgacttgtggacgcctattacggcaatgtgacgcacacgctgtcccacgaaaacccaaaggtagcgagcggttcaaaaaatgaaaaataacgggagaatctgatcaaattatcattccctctcccccgtttcaaaattggaatattaaatcgaaaaagggactggatttttgcggtagtcacccgcctaactccccaaaaggcgtaaaattattgttttttcgaatttagatttttttaaatttcagttagactaaataccttctaaaaatactcctacttgcactcaagttttcgaaaaaaaattccaattccagtccatgaatttgaccaaaaataacaaatagaagaatgctatgaaaattttccccccctttctctcgaaaacagaatgtgaatttcgtggccactttttcgcccgacgccaaatacattttctgcggctcgagcaacgggaagatcatttgctggtcgacggtgggtgttttgtccgacacaaatttaattatttatttttgttttgaaggaatctggtcgaaaaatccgcgaaattcccacaagtcactccggcaacatcgagcaggtggcgttcaaccccaagtacttcatgttggcatccgcctgcacgcaattggtgagcagaattgggggggggggggcaactgggccccaggctggtttttggggtataactcctttcatagttgtcctaattgaattaatttgatagccctaacaaataagtgttttctactggggcccagtcgtgcccgtccgatgtttggcataccttattcgtttttccaattaacattatgtaatgatgacctgaaatcggatttttattgggtcagaaattcgacgactcgtagatttatgtc

SEQ ID NO: 4279 - DNA, 1229 bp, Heterodera glycines
acgtgcccagcgcaatgcaatacgcgtggaggggaaatatgttgcaaaaattaaaaaaaaaagtggcaaatgttttgagttccctccccctcccaatttgtttttagagttagggccccagaacagaaaaaaccatattgggaaaggcgaaaaacatttttttaaatttatataaacagaaatttttctaactcataagactttttctcataagaaaatttcgttttcttgcgtttttttaattttctaaaaaatttttcaaaatgtaatgcacccccataacacatatgtttttctgtgattgagaagcattcatttctaatagacaaaaaaagagaggcaaacttttgagggaattggaaaacccttgaggggaaattaggtaaaaatgtggggaataaaattatgtgtttatatttgtcatatttaaaacagcaaaaaatgcgcacgtcgcatttcaaagcgtggccccaattcgttcagttccaccgcccctcccttttcgctgtcgattttccaactgtgctggcggaacgaaacgaagtcgtcggtgttggcaaaagtgaccacccgacgcgcgtcccgcttcggcaccgggaaaaggaacttcagaatgttggcgatctgcacaatgggaaaagggaaagaaaagaatgcaaaaactttaattggaaaacgattaaaaaaatttttttttaactttttttgggcgggtttggtggggatttttaatgcaataaatttcaaaaaccaacaaaagtatgttcaatatccccataattgcagtgcattttaatttttatggagcagttagttcccggtcccctttgattattttttaaaaattttcaaacttagaaatttcttaaaaaattgtagaaaatctttttataagaaaatttttaggggtgagaaatgaagtgcacccatttaatccgaaagtggtttcgtcgctttgcttacgcgttgtccgaccggcgacgtcatttgatgaattatcagatgggggtactgctccgtcatgtgctccttctttgttttgctgtcgtgtcgcatcaaaacattgtgcaaacttaaaaattattacctttatttctcttgaatttgataaatggacaattaaattgggcattttattgttcaaaaatggaacattagggccagcaatgtttataaactttgaaaatttgcagggttttacagtaatattatatctcgttccaatccct

SEQ ID NO: 4280 - DNA, 964 bp, Heterodera glycines
  misc_feature (959)..(959): n is a, c, g, or t
gggtacggggttcggcattgatcgaaatggatgtcggattcgtgatcagcgaccccgaaaaccccctaaaacctattttaaacacttttaaaaatttttttttttggaaaaaaggaggtggggataaagtatactattaccgtcaaaacatacatttcaatattttaatgataattttctaattggactacaattagttttgtaaggttttttaaattttgtatttttatcgcaaaatttcaagcaaggagttatgaattgtccgattttagtaaagaattgaaaattcattctcctttgtaccatttccgcggcatccctgcgcagatcggtgggcagcgcactgctcgcctccaacgaatgtttgatgcggtcgcgtctctcctgcgtcgcgctttgtcgcgcctccaaacttttccggtagagaaactcgcgcctttcacgcacttgctttcgcagcattttttaagcttaaaaaggcaggatttaaaagaatttttctgtgagttagggatttttcaaaattattgaattgaaatgaatttttcgaaaaaaaaactaaattttgttttaaattatgtatttggtataacgatttggcgtaatattttaaaatttaaatacaatatttcaaaattttttagaatttttgcaaagaattttacacaaatttattcataaattgatcatggatttgtatctgtacatatttcacataattatatgctcatttaaacatagtaaaactgcacccatttaacatgaaaatcacggcgctagtctaaaagcggtactttttgaaatttttttctacttttttttggtcgaattttttttaaattttttataaataataatgaatattaaacattaacaacataattatggcgagtaaaagtatattcacgaattttttaattagcgtcaaacttcttttaaaaattatttatgcgtaccantatat

SEQ ID NO: 4281 - DNA, 1694 bp, Heterodera glycines
  misc_feature (1689)..(1689): n is a, c, g, or t
ctaaaatgggagaagaactcttaaagctaaaatgttactttctttagagttttcgctctctgctcaggattcaaaagcataccgtccgaattgatcagagaagacaaagccgccgacccattttcccaggaaagactgtaagtggccaacacaaggccaatgacacggaaaatacgggtgacagaagggaaaaactaaacgaatagcataaatggcaaaaggctaacgaaaaagtcaaataggcgcagtcggaaaattttttttgaaaattgctaaatgcaaaaatattcttcggaaagtgatacctgaaagccgagaggcctcccgtaaaaacacgacccgtcaagactctcgatgcctttgaaaagaatattgtattgttggtaatccccttccagcggagggaataacgagccaccatccagccggttgaacaacaaaactacctgaaacacaaagatttaaatttgagggattgtttaggacacgaaaaataattaattcgagttaagatttttgcaatcctttatttatatgcagcgtcccgaaatgataatgatatgccacctgttgatatgccaaaacgagaaaacgaagaattgccgaatatgcctcaatttctttgcaataatacgccaaacgaaacattaaaattccgcgactttcggaacatatgcgaagaactgaaacaagatgaagaaggacaatgtcagtgatacacaccaatgaactgaaaaaagccgtaagtttaatttttaaaatgaattagacgaccgaaaaccatttccaggagtgttttcgtcgtaatcgcatttctgagaagcaaattggagtttgcgaataatttctgaaaggaaatggacgtcactttacattaaaaactaaaaaaatgaaaagagtgaaactgaaatgggaccatcagaattattatttgtattgaaacaggcaatgaaaatcctttggccaacctcgcatgagatcagccgaagcagaaagatcgtcacagcactcggacatgcgcttgccatagacggatgagctgcagttttggcgaaagtatgtgaaattgtcagtggccagcttaaaataaaataaaacatcaaatacatatttacaagtaattatttattacctgcttcaaaagatcaaaaacggcattccgttggacagataatttggaaaccgaagaccgtttagtcgaaggagtgcaattagtgaatttgttgtttattggggttttcatagcaaacagtcaaaataattcccaatctgagtgtaaaaatgaataaaaccaaccgaagcactttcatatgggacaacagacaattttaatgttagggctgtgaagcgactgccttttcatatgaatgaaaaataaacaaataaacggaaggaatgtttctttgaaaacacccttatcttaggtagtcacaaattatcctttttattcactttttgtccttttaaataaatagtggtgattagtagggatcggatttttagtgataaaaatcccaaaataattaactaaatagtgagaaaaaaattccaaaatagtggcaaaaatagtggcgaaaaagttccaaatttaggggtgtaatcttatataataaagttgattgtttgtccggatgtgtccatgttttgaattagtgtggcgttttgttttgagtttgcgttaaaaatganttgaa

SEQ ID NO: 4282 - DNA, 3212 bp, Heterodera glycines
  misc_feature (3164)..(3164): n is a, c, g, or t
ctttttaattttctgtgcttaccaattcaaaaatgtcggacaatccgaaagaagcggagaaagaaatggaaaaagcaatgtaaataattttatttcaatttaatttaatgacaatcattttgcttttcctctttcagcttcatcgctgccgactgttggttggaggtgttcgatttgcttccgccatctcaacttggccttggcattgcgatgattagccgccgttttgactatttcatcgacgaacatttcaaaacgcgcaaatggaaattgggcaaaatgaaaattcgacgcaaaattggacagaatggcgcaaatgaaatgaaaattgtcaattccaatggaaaagcattgcaaatccctcaaaatccgttgccgaaaaaagtcatggcattcaaaagcattgagatcgagtaaaaaagaatttggaaatgatgtaccaatcaaattttctgattttcagcttcatcgaccaaaatgtgatcacttttcttggccattttcaccgttttttcgccgcatgctcaacaacattgtctatcgatactgaaaatgttcgcgtttcggagttcgttgttcgcaccatttggccaatgttcaaggacactatctatgacaccatgttgatccccatcgcttttcgtcgaatgcgccaattggtcccgtcaatgctcaatgattgtcagtctcttcaatttgtgtctttcgatggcgccatttccctcgaatttccgcccgacgacagtgccaatgcgacggatggccaaacggttgccaaatggctgttcacgcctcgtcacgataattttccgaagaagctcatatgctatatgaattcaaccatggaagtggaacaatcaaagcggtgatttgtctaatttaattcgtttttctaaatatttgttttttagccattttccgctgcttcttctcctgtttctttcgacatttatatagacttttcgctgccctcttcactttccttcgttgtgccatttgaattgaccaacgaattcaccgcgggaaaattttaaattgtccaaagaagaggaagaagaatattttgaagatgaagaaaaatattacagtcttttttcccttagtcgttgtccaattgggtccgatgataagaaacagcagaagttcgagaaattggacgaattgtacgaccgttggaaccgaattgacttttacattggagacgacggagtcggcgatgggtgattaacaatttttgttaggcttaaccaatattttgtaacgtaaaaacgcaaaggaaatgactgtgctaacttataacactgggatggatggattaattggtccaaagctgaagaaatagcatcagatttgttgacaccccaaaaatagcaaaaattattaattttcgcatggaaaccccatggcctcgcattttgaggagactcaacgaaggcagaaccagcaaccaaaagctatttggtaccgaattttaatataattccttatacaaatgaactggacaccagagccgttgggcccccgtttttgggccccggggcaaattaagaattcgttcatctgtcgccaaaaactttcgcttttttggtggtggctcctctccggcaatgaatgacgcgtatttgtctgctcacgacgtagcacgtcaatgaagtgaaaaatcgacgggtgtcggcaattgaaggcgccctgtagacgatgatgctcctgttcatcgatcccgtccgtcggtgtgtacgtctgatacgccgggctgattataagctgctcaagatttgcaggaacgacggggggcgcattcacttctcggccaagtggcgagggatccctcaggcttagtttttagaatcttaatttttaaaaaagcacatttttcgatttttgggttggggcccaaacgaccccggggcccaaaaacgggggcccaaacgcgggggcccaaaaacgggggcccaaacgctctggtccctgatttttttatggtcggagatcgaatggtataaaaatacttttttttttttttgctttttccgccaatagatgaaaacagatatttgtgcaaaaaatttaaaacaaaaatggttaatctttatgttattctttttaaatttttatttaaatttaatcgtataatttgattcattgaaccgtttcttcctctaattgtacgggcgcccggaaaatgcgtcagtagaaaatgcgtcagtgaaaattttattgtcataaaaacaagttccttgcgttttcagggacactgaccacgaatccggtatccatttcggccaattccgaaccctgggcccgaactcgaacaaaaagtcgaaaagtcaaaattttcgaaattaggttttttcttaaaaatcggtttaaatacacggaaacaaactgaaagccatctatccttcattaagagatcatttatgccgtttttgaaccaaaaatgctaattttgaaaattttgactttcgtctttttgtttgagttcgcgtccggggtcgaaattgagaacgattttcttatagaagtttacttctatattacaatattaatgccatagaacttcattttaaaatatttgtatcactgacgcattttctactgaccgatttccggtcacgattgtacgtccgcaagtgttccactgcaatttttccatttatttgttctttttaggcggccacattcaggcccttttgataattagtaaaaatacatttaaattaatttaaatttcgaagcaattgcatgtaaaaataaagcacttttaatttcttggcttcaaatatttcggcttcaactattttctttcaaatatgagaatattatttggctggacagatgcttcaacaacttttgcaagcccatggaaaagagaaagttgctgccaattctttggaccagctaaatttacgattagagaagttggaaggtttggtggcatcccttgtcgcacaaacggcaacaaatcctcaaaaaattaatggacacaacaacagcactcccacagttgcaccaaaaattccgtggggctgtcctccgcaatttggtccatcccaaatcgcgcgaatgctcaacaatgccatcgtcgactcggaactgatcaaagaaaagtcgaagcgagcagttgttgaacgcctgccggggcacctcaatgaaaaagacgntgtcaaacaaattgctgaagaatgtggtctgctggacgaaattgacct

SEQ ID NO: 4283 - DNA, 5342 bp, Heterodera glycines
tgagctacgggcgcctcttttagaggttctctcaggtcctttatcccactttctcccacactccgttccttctggcatcacagtttagaaaaaccttttatttattttaaaaattattttttggtattattcaactttttggcattttaagaaaatttctttaaaaaatctatgccaaatacagtgtaaatttcttatttttcttacatatttgctcaaatttcggaatttttttttttgtaagtaatttatcaattatttcgatattttttaataaatctaagtcccagtcctaatcatgattaataattattaacagaaaattaacatttttttttgtatattttgatgatttatttgattttttacttcttcaaaatgaataatgttttgcttatttttaactaatattttttaataaatctttatttgtgtatatttttttcattttatatctaaatcgatagtttgttcaataatacctaatcgaagcgcttgtccacactctaattaatctatttaaatattttttctaatcataaaattatataataaattttaagttaaattaccatttttctcatttttgttttttgtttaagaaaagaagcccagagataactttgtgaattttattaatttctaataaataatttatttatcaaaagccttttctttagaaaattagtgatttattttcatgttttgtatattttaagttaataattttctttaaacctaatacaatcgataaacccttttctctcctccaaaaaatcccaaaaatgcccaaatctaaaagacgacacgacgacgacttggcgaacacttcggcaagttcgtctgagcagcaattcgcggcattctctcaccgaattgacaaccttgaaaagttgcttcaacaacttttgcaagcccatggaaaagagaaagttgctgccaattctttggatcagctaaatttacgcttagaaaagttagaaggtttggtggcaacccttgtcgcacaatcggcaacaaatccccaaattaatggatacaacaacagtactcccacagttacgccaaaaatcccatggggctgtcctccgcaatttggtccatcccaaatcgcccgaatgctcaacagtgccatagtcgactcggaactgatcaaagaaaagtcaaagcgagcagttgttgaacgcctgccggaacacctcaatgagaaggacgttgtcaaacaaattgctgaagaatgtggtctgctgggcgaaattgacctcgacaatgttcacagacatccgcggacggcacgtgaggaaaatgcaaaagagaattgttaaaattcccttttcctcccaaaaatcccgcaatttgttcctttataaattccgctccacacttctcaaaatgcctgtgattcctcataatttgaccgctagacgtgatatgaccataaattaactacaaatattgtatgacctccgaaaaaaggcttttgaggcaaaccaggccgctggcgtgtataaatacatcgtcattgacctggaactcaaaaccttgtccaacccaaaaccactcaggactagggtttcgtaggggtgcgcgagcaaaccgcaaaaaattataaatgaaataaaaggtttgcttttcaatgctcgctcactctctaacaagatcccagacttaaattttgtaattgaaaataagcaaccaaaaattctaatcatttccgagacctggttaaataccagaaattcgatttcatcagatttatctataggtggcaaatatatacccattttagcaaatcgggtaagtaaaagaggtggagggtgtgcaatactaataagtactgatattcctatgcttgaaattttttctgggacaaaatttcaatgtgaaattattcacattaaactttgtttagcaaaagtgattcacatttttgctttgtataagccgcctcaatgttctacaccaaattttaaaaaattattagattatattatggaatttaattataataatattcttatctgtggtgatctgaatttaccgggaattgattggattaattaccgaatagagaacaataatcattcgaaattatttattgattttatagcacaaaaacaattggttcaacatgtaaaacaaataacacgtggtaacaacattttagatttagtgctctcaaatcctaagcaattagtttatgacacgaatgttacagaaagtttttcaacatcagatcaccacatgattgaatttaaaattaatgggagcttttcgatcaccaaaaaagacaaaatttatattagagagtttaaaccaaaaaattttctaaaacttagaaatatgcttcagcaaaaacgcattgacctacatttactgaaattatttaaagttgacgacaaatacaattttctcgttggcgaactttataattcctttgatcaattatttcctaaaaaaatattaagaaaagttctaaaaaccaattatccacaaaaaataaaaaaattatactccgaaaaattaaaaatacacaggcttattagagaataccctgatcatggacaacataaaataaaatacaaaattttaagtaggaatctgaaaagggaattaaaaaatattaatgataagaaagaaagccaacttgttaataaaggcaatttggctatttttaaatacatcggcaacaaatttaattctgacagagaaataagattgcttttcgatgaccaaggcagaatttacactgaggataggcagaaatgtatgctttttggtaaaatatttcaacaaaattttatgcaaagaaattataatacgaattatccaattaaaaataatataaatagcataacagatatcgaattaaatgctgccttggtctggaaggcattaaggaaattacccaacagaaattcaacatccccagacggtttaccttatatattgattaagcaatgcgcagatctattggcacctatcataagtgaactcttccgaatggttttagattatggggaaatcccaaacttatggcgtacttcttttataattccaatttataaaaaaggagacaaatcgaatccaaataattaccgtcccatctctctgacatgtactttatgtagggtttttgagcgactattagtatggaatattgttaaacatcttgaaaaatataagattttaacagatgaacaatttggttttttgaaatccaggtcgaccaccacacagttgttggtctctctggattatttttataaatcaatagaagatggacaaaatattgatataatttttatagattttgaaaaagcatttgattcggtgccaataaatttgttaattgttaaacttcagaacataggtatttctgggaaaatactgaaatttcttcaaaattttctaacgtacagatcatatagagttaaaattggagagtattattccgaaagttttagaacttattccggtgtcccacagggcagtgtcctcgggcctcttctttttttgatttttataaatgaccttactaattatattccgcctgaagtcggaattaaattgtatgccgatgatgttaaaatttacatttcgcatgataatgacgcgaaaagggatttactctctttagcgttggctaacttagccaaatggtctaaagataatggcatagcaatttcgcatgaaaaatgcgcagtattatatttaggaaaaaataatcctaaacatgagtataaaattggcgagaaagtaattttaagcgtagattgtgtccgtgatctgggagttttggttgatcaaaagctctcatttaacaatcatatttcaaaaattttaaaggcggcttatttcaaggcatatcaaattttaaaaatattaaaaacaaggaatatcagtaccttaatcctagcatataaaagctatataagacctcacctcgaatacgcatccgaaatttggaatatctcctcaaaagaacagagtaaaagaatagaaaaggttcaaaaatatttcacatgaatcgtatacaaaaaatgtggcctcaaggcaataccatatgaaaaaagacttgagatttgcaaattggagaaattaagtactcgaaggtcgctcactgatatgaatatgactttcaaaaaaattaggggcttaactcatttagatccaaaaaaatattttgaattttcttcaaggtcgcaacgaaaaacatttaggattcaaaacaaaagatgcagtaataaatctcgaaataatttttttattcgtacaattaatccctggaattgtctacccaaaacggctatggaaatcggaagtttagctaaatttaaaaattttctgagagaattttatttagaaaataagtcctgagtggtaattcatcccttttttattttattttatgtattttactgtattgaccatatcatattttttttttttttaaattgtattcattactttgttttccgctataagtgcaattacatgttgccttgcggtttgctcaaataaataaataaataaataaaaattaattgttattctaacaattttattataaatttaaattgggtttttataaataaattccgatttccctggattctatattctctaaaacatagtaggaaaagcatttacttttgttttcagtttgctaaaaataaaaaaaagattatatttttgaaaatttcaaaaattgtcataaacttaaagaattatgtaacagtattccctgttatcaatgttgattaaagagattaagtcaatggcaactcgtacaaagaatcgtacaataaaaaatttaagcataagctaaagactaaacctaagcctaaagcttagatgcttatggccactgtagtcaaatgtgcgctcgttttagcgctataagcaataccaaacccttaaattttaagggatttttgcgaactttcttcggattttgaaccggtacaaaaggcaattttaatttttggcaaaggatctttttagtcatgtttgggttcatatgagtttgctgggaacaggatttagctgattttattaacaatactttttcctagaatcaatcgagattttcaaattgcaataattttttttttaaatatttttgtgcaggcttttcttacataaaattattaagaataaataattttaaacattcgacaaaataaaattcctttctttctcatataattcccgatccaatatggcttatgcatgtttgcatccatatttatttctattaatctatccttaagtgatttgttatttagtatcacttcgtccactccccaattcagttccgattttctccaaattttgtc

SEQ ID NO: 4284 - DNA, 5250 bp, Heterodera glycines
tccaatgtgagcatttcccattggcatttgctgccatcagtgccaaatgtgtcgctttgaaacaaacaaaaatggcaaaatgtcttccattcttcctcctcttttctgccgttttgtggttgttgttgtcgtcttcgtttcgctctcaccgcactgattgcgctctgtccgcattctgtgcaccaaataatatcagcaaccttcggttgcccatttaattcgactgttttgttggcattgtgcccgtctcggcgaaaatgttgttgccggcggcgggaaagcgcccgcaaaaaacgtcgcttaaatttggggaaatttaaaaaaattctgcgttcgtttttttgaagtttatgagtccgttgtcgtccccaattgagagcagaaccttgaacacattgaaaagtgggacaaaaaggaagcacaattggacaaacgaatggccaagcagttcacggttcagtgccgtaaaattgagagagcctaaaccacgagacaattaaattcaattggcaaaacgtacacaattggagcaacgggattttgaaaaagtcgtgattcaagaaatgttaccaatttttctctgataaaatgagacgggatttgctttttgtaaaaatccgagtagcaaaagcggtcactacaaattgtacatatttgcttaccaattgtcggtttctgcacataaacgggtcgactaccaaacagtcgttcggtgggtctgtaaaatttaagtatttatttgagtttcatctttttttcaaatgtctgatagttttaataagtgaaattggaattttgactttttgctcgaattttgggtcaggggtccggaattggtcgaaataaatgccggattcgtgatcagcgaccctgaaaacccttgaaaatgttttaatcttttggaaaaaaattttttttcgaaaaatggggagggaggttgggataaaccttactactacataaatctgtagccgtttttaaattgccgattttttttttgctatgtgcctgaatcttcgctaccttatcggcccaccctgcgcaagaaacaggcaaaagtggatgaagtcgaccagtcggtgggccgtctgcgccctgctgtaccaaagctttaaagcggatttttcccttttgtggactttttctttattgacaaataaataaataaattttcggaaacctgaattctccgatcgaatggtctcagtttgacaaaaagggcaacaaatgatggcaacaaaaaacagagcacataattgatcaatgctttgaatgttgttggaaaattggtgcgaatttggagcagccgctggccgggactttggcctaaaatttggaagaaaaaaattgaattgaaatcggaaaatttgggttttccggggtcaaagaattaattacacacattcatttcgacccaattcgtatcctgaaccaggatttaaacaaaaattgaaaactcggaaattgtttcaattttcgtgttttgaaattcggcaaatttgggtttcctgggtcgaaggaaactgacaaacacaaaaaaaagaaattcgaaaaattaacaaaattctatggacctgttagaaaatgggataaaaaatagagcggtgcgatgcattcgcgaaagtgttgcttgtatttggagacaatgggcgccaccaatgtccacaatttggtcaatccgcgcttgtatcaatgccaacaaagtgttgtccaacagcgcggcatcaatttgcacagcgcgaagagcgccgaactcattttcgtcgtctttcatcttttcttccattgggaaaatagggaggcttttgaaaaaaaatttttgtttttaattttaacattaaaatcagtttagtcatttatttcaaaattgtttatcaatcaataccaaaattagtgagagtacgtatggtcgcaaacaaaaaaaatatgtatgcagtgaaaaagtgacaaaaattcattcgacacaaaaaatacgcgcaaaaactcatttccatttattcatccaaccatttttttgtttttctgctctcccaaatctcagcctttcttctctctctcacacattgcacgtctgtccatttgttgtccgtccattttgctcctcaaaagaagcgctccacgggcggcggttgcggcgacgcgtagcgatggcgcttcggcggtgtcggcccggcaccaccgcggccaccgcctccgccgtacagcgacgtgttgtagtgaccggcggacgccagtgaagagccgagcggaggcggctgctgttgctgcatcatcccatgaccaccaccaccaccaccgccgtatgacgtgccggcggaagcaccaaaatcgtcgtaaccaccgccgccgctactgcggcgcatatcgtagccaccaccaccgccgccaatgtcacgttccttggacaaagaaaaattgaaaacgaacgaattcaaatatgttttttttacatttatggaggcactgaagatagagtaaaaatgaaaaaaaataaaaccaaagatactgattgtgagtaaattacgtcaaaaaaatttcactcacattttcaaaatcaacgccccaaaatttgcaaatagtaggctatatcagcttggtgaaagctgtgaaacgaatggtaccaagttttttggatttagagtcaacaatgaaaaaggctaaaaattgactgctcctaatcagactgaattggccaaaacggagttggcccccttcttcaaccagtattggtttcgcaattttactatttatttataatgcttaaaaattaccatcccgcgctgctggtggtaacctcctccgccatacttcggctgctgcacctccatgtccatcagttggcgctgactgccacgccacgactccttgcccagcggctgatgttgctgctgctgctgttgttgatgttgcggcataaacggcgacgccatggacatcagcgaggggccgaggacggaatttgcgttgccgccgccaccaccgctacgtgacccaccaccaccactgctgaccatcatgtacgaagattgctgctgctggtgttgctgtggttgttgttgccattggtagtggggcggtgaatggaacggcgcaatgccaccgccgccggcacgaccaccagccataccaggcgtggtgagcacggacgaggcaacctggcgctaaacaatacggggattgggttaaaattgttaatccaatccatacataaaaaaggggggtgggtcggaaaaattttttgcgaaggggggtcggccgcagatgaccttttttgcctttcaaaaaccgtttttttcggcgcgctttttccaaaaaacttttcgggaccaggggggccggcggtgccgttaggcgccgccgggagaaaaatttttgctctttgggtgtgatttgttaacagattttcaccaaaaaatggccaatttttgcgattttgagccaattttttaagaaaaataggaattttggggttcggcggtgccgccaggcgccgccggggaatgttttttggactttttaatgaatttgttaagaaaattttcaaaattgcgaccccccccccaaaaaaaatgtatgtgtgaaacctccggcaggaattattaatttgtctaattaccaattaaccataatttaatgccttttttacagttactcaaaagcacaattatttgaggaaaatggacgggcagcggctgactttggaaaagtcggccagcacgaaaaagcccgcccgcggcttcaagcagcgcacgcccatccgctggagggagcgcagcgttcggtcccttgcctcgcgcatccgccgcaaattttccggcagaaaaaccctttcgacccattctgaaagcagcaggaaatttgaccaaatgaacagaaaaataaaatattttaattatttaatgttgaaatagttgtgtcgtttttccatttcgaaccaaaatttcagattgtaatgatttttggggccttcctcatttatctcccttaccatcttaattccttcttaattgtttcctcagtttcatccttagagaatccgtaattcaactaattattggtcaattagcgaaacaattgttaattaggcatgagtgactgcgtttacaaatttcctctattcttttttgctttacccaccgtggtcatccaaaaattggcgcattataaattgggtggtgcaattcggcaaatggtgcatcataaagcgagtgatcgccgtccgcacgagcggattcggcgagtgaatgaccgccacgcgaaggccgggcaacgaaaaattctgaaaatcgcattttgacattcggcggagttctgaaaatgaaaaggacactgatgaacaacgagattctcgaaagtttcattcagagtctcgacttcttgaatttggcttgtggttggttggctttttgtcctaatgactgttgttagccctttgtcctttttgttggccctttgtccgttttgttggccctttgtccgttttgttggccctttgtccctttttttctcatttttttttctcctccgttcccttttccctttctattttttgcttttgccttgctcagtccccacagccaaatcagcttctgtcggctgcgttcgtcttcgaacagttctaccgcacttcgaaacggacattcgttgtcctcgtcgtaaatggacaaatcgtaaatttcgtccaaaagcacgaacaaattgcgactgtaattgaacgaatggaatgaaaaacaataggcaacaaaacgccaaaatgttcaaaacattgcctcagggcccagtggacgaccggccgaatttcgtccagggaaaagtagccggcctccggattttgcgggttcaccagcataatggccctgacttttccctaaattaaaaaggggcttaacaacgggaaaaaattcatgaattttttatttttaccaaaaataatcaatttgagagatatgttgctctttttagcggttattttggccgctttaaagggtttttttaaatattgccttagaagcttaaaaccaggcataaatgcctttttgccatttccattccatgaggaaaataaaacatgcatttgagtgcatttccatcaccaatttaacaaatttcccattaaaattgggcacttttggctggggagtgggacctgctgttggtgctgcattattaagtggtacacttcttcaaagcgttccgctcgcagttccgtaagggtgccgtcctcggacagtgccggcacacagccaatgt

SEQ ID NO: 4285 - DNA, 1186 bp, Heterodera glycines
aaccctccccccccccccccttttcgctggcccccctttgcggagggagggggggggggggggggggtccaacccccccccccccaaaaaatgtatgatccaatcatagagacggtcatataaaaacacattgaactttgttagaaaatttcatgaaagatttttcagcgattttttttagtaattcatcatcaatgctagaattgttcatgttcccaatgtacaacaaaatcaaaagcccacctgaatgacattgtgaatttgctcaaagacgggcagcacaacaggtgacggctgattacgcttaaatggtagaaaattttacaataccccatccatcgggtgataaattgctctaacgaatcttaccaattcgccaagtgaacgtctgctgggcgcaagcgaaggcggactgctgccaaacaccgtcccgctggacatgggccgggagcgacgctgcgcctgcgaaaactcgcgcactttcttgtcaatgaacgacagcaacggcatttggtgtttctgtaaaattgggagctgcgcgcgataagccaaattcccatttttcgaaaatttttttaattaagacaaaaaatcagcaattttggacgcattttcgaataaccgctttggaattgaattttcggtacttttgcagtttaagggaccgatttcacatacattttcaaatgccaataaatgtattcattttacattgttttttttaagcatggaaactttaaaagaatttaatattcatgatgtatttactctgctgcaaaaaccagacgctgaatttgaagaatggctccgagaatcaaaaaccatggaggacaaagaaacaaaaaaatagtgaaacgggtcagcacaccaatacagttgaaggaggaccttggcagaaattcaaagcggagcacaaaaaaagatatgcaacacacagaagtttattgaattcttatgtggaagagtttttatggcgcaaacgatttcaaggacctgatattttttattatttttggtcgcaagttgctgctatttatgaaatttcgtgaataaatattatgattctgttttattgaggttaaaatacttaaaaaatcaatgtaaaatgaatacatttatttgcatttgaaaatgtatgtgaaatctgtcccttaaactgcaaaagtaccgaattttcaatcccaaa

SEQ ID NO: 4286 - DNA, 2174 bp, Heterodera glycines
  misc_feature (354)..(354): n is a, c, g, or t
attttttgcctggtgaagacctttttttgctcttcgggtcaaacaaatttttcttcagtgttattaaaaattttgaacccctattcattttaagattttcgtttgggggcgggttcccagttcccacccgggcaacaacttttttgcggcgcttttttcaacaaaaaaaaactgagaaaagggggtctggcggtgccgataggcgccaccgggaaaattttggaatttttaatgcgatttgttaacgaattttgtccaaaaacgactaaatttttatatttttggcaaattttcaccaaaaaattaccaattttatgcttttaagccaaattttaaagaaaattatatacgagngggaaaaagttgattttagtcgatcgtaaaaatttggaattttttttaaaaaacggcaaaatttggggatttattacctcctctcctcttacgatcgacaattttcctcacaaattgagtttagtcgatcgtagaaaatttggaatttttaatgaagtttcttaaaaaataaggcaatttttctttataacatttcttttttttcacattaacgatcgacttttcgctgacttttttttctctcactcatttttcttttctctttcttcctcccttcacccctccccccaactttcctcccccgccccccccacctcttacgatcgactaagagaccccccccctccctgtgcacaggtatgcgttatacacatgtaaaacaacaaaatattgaaaaaaaaccccggatttacaggatggacccgggatcaaaaaaatatttatttattttaagatgctttccagggtctgctgcattttttcggaaacattattccaaaaaaaaatttttttcaagatgaagtagttggtacaaatcacaaaaaccccttaaaacaaagggactgtcttcccaatcccttcccaaagtccgtgctattattgtcaaaccctttgctgtgcgtctgcagcttgtgagacggcgcggaatgcctcctccaactccttctgtttctgctgcaccatttccattgttggcagtggatttgccttcaaaaaaatttagtaattttttattgtacaatcccactgtacaaaattaactggccagttcagtcccatcacccagaattagccgaccagttcagtcccatcacccacaactaactggctagttcagtcccatcatcatcccccgaccctcgcccacctcggtggtctcggccaaccaactcttgcgaaactcgtcctccgtgaacttgaagttgctggcaatgtaggtgagcgcggtcagcgaaatggtgccggtcactttcagctccagcacggctttgtccgccgcctttttgctcgccgcttcctcggtggccgccggtggatgttccaccttcacaatttggtcgatctgaaaaggaaacatttttttaaatattaatttcgccactaataatgaacagaatgccacaaaatgtctggcatggccgcgaaaatgcgccgacctcaaaatgatttgcagcgcccgcattcagacggatgaaacagccggtgatcgcctgcgcaaactgtgccctgtcgttcagcgtggccaacttcatcagttgcggacgcgacagagtgcacgggtccaaatccttggcattctgtaaaaagtttaatggataaaaccattgttttgaacaaaaaaaaaaccacaccaaaacagaattaggtatatttttttataaatatgacgcttaaaaaatttatgagcctaactacaaaacattcaatgccattttttggggtttggccttagaaatgagggcattttcgagtctctcaagcatcaataatattgtcacgtgccaatactataaataaaaggtgccatacatacaaaccaagaaaaagtataatacctgtgccggcagtttggcccgtctcgcgcgctcctcttcccgttgccgagcacgttcctgctcctccaggtcgggaacttgttcagcgtcggaaagtgccatctgcagctgtgccgctttgtcacgcacgtgttcaatggttggcaacgtttctttctgcaaaataaaaacaaagaaattatttacacaatttttttgcaacatttaattgcatagctaatactaaattttgcccaaaaaatcattggaagtcttcggtttttc

SEQ ID NO: 4287 - DNA, 2960 bp, Heterodera glycines
agcagtgttttccattaaaggacaatcaaaaacactgaaaagaacgggggaaaatattaaagggaaacggcggggattggctgaaggaaaaaagattgtgttaagagttgctcggaaaagttcaaaagctaaaaaaggtaaaaagttttagaaaaataaaattttaaaaaaaactaaaaatttgtaaaaacagaatacgacaatgatggatcatcatcatcttccaaagattcatcatcgaaagattcctcatcatccaagggatcatcttcgcacaaggattcatcatcaggacattcatcagaatccaaagaatcacattcttccaaagattcatcactgaaaccatgttcaccaaacgaagattcgtcctctgtcaatgaaaagccctcaaattccaaatcatcggacactgtctccacatccgaagcctcaccatcgcatattgaagagtcgtcaacatttgatgatttatcatcagtcacggaagagtcgtcaacatctgaaggtttatcatcagtcacggaagaatcgtcaacatttgatgatttatcatcagtcacggaagagtcgtcaacatctgaagatttatcatcagtcacggaagaatcgtcaacatttgatgatttatcatcagtcacggaagagtcgtcaacatctgaagatttatcatcagtcactgaacagtcgtcaacatttgatgatttatcatcagtcacggaagaatcgtcaacatttgatgatttatcatcagtcacggaagagtcgtcaacatttgatgatttatcatcagtcacggaagaatcgtcaacatttgaagatttatcatcagtcactgaagagtcgtcaacaatttccgagtcttgtgcgtcggtgtgcagtggatttggatggacaaattataatggcaattgttacaaagttatcgaaggactgatgaatcagacgtgagtaaatgggaacttatccaagaaaaaaaaatttccatgagaaaatattagtggaatattttaattactatcctaattatgcttttaattagttcccaataaacgattgtttagtcaagcggtgtccgcttgtactgccgaagacccgcaagcgcaactcgtcagtatttgggatgaggccgaaaatcggcttatttcacaaattattacccggccgcttgcccgttcacttcagacctataatttggcatcaccaattttcaacactttttggtgaattaattatttttaatgggctaatcccacaaattataatgtttttatttttcaggatcggtcttcgccgtgtccttgtcggaaatcgctaccaaagcacatggacaaacggttcggcagcaatatttggcaatgttgtaagtgaaaagctaattaattaataattaaaaaacaaaaacaaacaaatagcccgaaattacaactgctgcgtcaagaaacacatcgccatgggcagcaggacaaccctcgggcaccaacaaatacactgacccaagttgtttgacttattgttacattgaaaaagcttttttaattaataaaaagagaatttttaatagaaaaatcaatttaaatttatttacattttattataattatgtttaattgacttagccggcgcaaaagaggagtgcgtgcacatgctaaatgcagaaggccgatggaacgacgcgcgctgcgaaattcaaatgacaggcgcgatttgcaaaaaagcagctcagtcggttggaagcagcggcacggtcgtgtcgagtgccgtcgttttcccgtcttcggccttcgatttgtgcaatccgagtgtttcgcaatgcaatggttttggatggaccatttccagtggcaaatgctacaaagtgatcgagggactgatgaatgggacgtaagtgacagaaagagaaaagtcaccactccaaagaaaggacaattaacttggccattgaggcgaagattaatccaccacttttggaacgcccatctcgggcccaccttataagcgatggataatcaagccatcggggtaaatcagtcatcactcccatggctagccctcctcctaagccaaccgatgggacggaaatcatacgttaaaaaggaggggggggggggggtcgattgccccaaaaaacttatgagatcaatctacggggttgggacttagccgggccaaatctcgaaacccggcacagcttaactgttgcttgatttggcgtcggcatttccgacggtgaaccctgttccggaacgccatacgatgctgattcaaactttgcctagcggtttccagtttcttctttaaatgcttcccagaactccttctagagaagcatgaaatataattttaaatggaaaaatataaacccaaaagaaaatcaattacatcggttttaagtctcggttttaataaataacttgaattaaatgttatatacaatttttaaaggaaattatgattgggtatgagaactttaatcttttctaatttttttatttttataatttttgatactgtggttttttggcgagaaatatcaaaaccatggacgaaataggggcaaattgccaaatagcagtgaaaattttcgaaaaaccatagcataattaaatatagttcaaaaaaatttattcgcacattgcaactgaaaatgaattaattaatttttcttgaataaatgcaatttttttatcagataaaaaaagttaatttttatctgagaaaacttttgatatttgatagacgatacttacatattaattatgcttttaccattgttattaccttccgatgttttcgacagttgttggttttgacaataatttttataaatgtttactcagatttttagatacggtatttgtcattgaaaatttgaaaaaatacatttgataaataattttttttttctaaatcctggtggagtaaggatacgggtcctaaaaacgaaaatgacccggagt

SEQ ID NO: 4288 - DNA, 3899 bp, Heterodera glycines
agtcaactatttattttttgttttattttttcccccttgaacaaacatcctcgtgagttggaacggattttttttccggaatatatttccccgttttcatctcccatttcaaaacattcgccaaaatcaatatgcacaattttcccgctaagccgatccaacatcaaatttgatgggtgtctaaaagaaactcccccggaccctcccccctcgcccatttcccaaaagttttttggaaaaatgcgccgcaaaaaattcttaaaaatctgattttttgatcccgagtgcactgaaatttacgatttgttaatttcctcaccaaaatttttaaagatgataattggaggcgaaaaatataatatttaatgatttttgattaaattaattgtaaaaataaaagatttgaagcaattttgcaaaatgttctgatttttgaccccaaaatctgattttttgggcccgatgtcctgattttgaaaaattttcgatcgcatccctggctttaagcggtattaaagcattgcatatttcatcagttacattgaccattccgtgatcacatttctccgtgccaacaagcacatttgggacagaagtagcatcaatttggagttgtctattgcaaatgttcagccaatttgggacgcatttgcccgtcaaatttggctcatttttgcggcaaacatttgccatttgaacatttttggtggccatcatttggacaatttgcgtcgtctcatttcatcaacaattctcactgatcttgcttgatcaattgaattcaatcagttccggccacctgtttcccgccgcggtgattgatgatttcgatgatccaaatgcaacttctgctggccaagcgttgtccaaatgggtgcacacgccgacaccaaatggccaaccgaagcgactgttatgccaattatgccgaaatagcgtagaaagaaacgtcgattgggtcaacagtttcaaggaggtgttgtgctgcttacatttttttataaaatatttcaattttcgtttccatttttgtttagaaatttatttgtgccatcacttcttgtgccagctatacaattacgtttgatacttatggtgtgccaaacgtcaattgagccatttgaattggtgaataaacggactaatgagaagctgacactgacaaatgaagacacttgtgggaaattaattggtggattatgcggcgatgcccaattgttggggagacggcggcggtccaacaggggccaatcacaattacgaacgacaaaagataaacgccaaatctgtcgtaatatacgtcgtttgtcgttatctccaatcacaattaaaaaatttgtcgtttgtctcccgaaatttggcgtttgtcgttttgcgttcgtaattgtgattgaaaccaacgacaaacgccaaatttcagacgacaaatgccaaatatttgggggggggggggcgctcaacaccgcccctcaaatttgtcgtctgagaagtgtcccaaaaatccaccaaattattttgattcaaaatttttatttaatattaaaaacatgtttctaagggtaaatgagttcgctgatcatgaatccgatctcagattttcatttctataacttttacctatgatttttcatccatttatttgggtctttcgaatttaggtttatgattagaattagagcaaaataaatgttagattcggaatctacgtacccaaaaacaaacgacaaatttacggtagattttcacacgacagagacaaacggaaaaacggcttcttcaaacgacaaacgacataattttttgtcgtaatgacaaattcggagacaaataccaaatttgtcttttgtcgtccgttttgtcgtttgtcgttcgtaattgtgattggccccagaacatactgtacacattcacaaattctttttctgtgtttcttaatattttatagggtactgtcgaaattaattattgtcgaatcacttgctgtcaaaatcacgcacagacagtgagaaaagtcaaaacagtttactgtcgaaatttttagattgtgtagaatttgggccagggttggaaacggccagaataatgccatattcgtgatcatcgtcctgaaagccccccccccgccacccttagacaaactaatatttcaagggctcccggacaatccgacagtggacaatccgacagtggacaatccgacagttggacaatccgacagtgaggacaatccgacagaagtggacaatccgacagtaaatttctattttaaaaaatattttcaagtcattagaacggattatttcctaaaaatatctcaatcaaatcaatttggttccggcattcgataagcgattgcacgtagataggccaaaaaaggtctgttatgacgatccaagaaaatggcgcgaattgcttgttcgaaatcgaattcaaaacaatggattacaggggaggtcttcaagtttcccacaggaaatgtggaatatgagtgaggtgaaagtggaaatagaattttaagaaacaaaaatttagagttgagcaaaatttaatgaggacaaataacagcattgaggggtgtgaccaaacacggtcacacccaatccaatatgtcacaaaatattggacaagagctacaaaacaatgctctcatttctcaccactttggttttatgggtcactccacatttacttttgcatatttatttatttatggttgtatggatcactatctttaattattttttattttattgtacttttgttaccagcatacgaaactaactttttttaatttggtagcaaatttaagctaaattgatttgattgagatatttttaggaaataatccgttctaatgacttgaaaatatttttttaaatagaaatttactgtcggattgtccactgtcggattgtccacttctgtcggattgtcctcactgtcggattgtccaactgtcggattgtccactgtcgaattgtccactgtcggattgtccagtcacgataaactggacttgagttattattttatgttctcttttatttttctcgcgttgatccgaaaattttttcaattcacttatatgcttttatatacctttattattcttttccaatgattttaaatacctaatttaaatctttagaagtactttataataattttatttattttaaattaattatttattgatcattgaagttataattctaataatctcgtaaaaaataacttaacttataatagcatattaaacttcacttttgttaacattttttaaacatttatttattctaaaatgatcaagatccacgttgttctgcggaagtgggcattttcttattaatttaaaaaatcttcagtgaatgtcatgcgtactgagagtgttgtggattagaaaacagtcaattgaatatatcggaattaataatatgaatcgatataagatttaaaatttgttgtaagaatgtactttatagaaaagataaaattgaaaaatagtgcattattttttaaaaatattaaactttacacaatattacttgttgttattaaagtttgaaaatataattttctttctttgaaaccaggtttgaattttaataacagtttcaattttaaatagttttcatttttttgaaaaaagccattcacatacaaccctgggatgttatatagtcgcacatcattgatcatccgggcagctgattgattatattacaaatatttgaaaaaagaatcaaataattcaatttaaaaataaaatatatcgaaagttaattaattaattaaaaccttaataaatttcatttcttttgaaaataaaactatttttagtccatccttacgcctttgcaccgagagagtgaggaactggtgcaaaataatgaatcaca

SEQ ID NO: 4289 - DNA, 6049 bp, Heterodera glycines
aggtgggggtcggaaacgaacggcacggcacaatcgcaaatccattgaaatttgccccccccccatatcaggaggaatgccaccgccaccgatgggagcttacacactgtaatgttctcatcatactataaaattagcttctaaacatgttacgctttcgaatgttaccaagatttaacatgtttttttcggaaaatgcccaaattggtcaaccgagatttcgaatatgtaagcactgtttttgataatcaaatgcagaattggcgcaattgaatgacattaaattttgaattttagcccagcataatttttcgggtttcccggtttcgctcccggaaaattttggactctcgcgcttccgccaattttctcactaaaagcggaagtaaaaaattcaatgctaattgtaagaatgttggtaaagaaattgacctcagaacgcaaaatttacctatttttatgacaaaattcatttaaaaaaagcccactcaattttctatttccccgccgcgacgccctataaaaggaggcattttccaccgaccgacccacaaatttccctcatttgtcacaagtacatttattgtgcctaattttatttgtgtcgtcggcatttgtacatattacgacagttcgtcgtcgactgctgcatattattatttgttgtcttcaccacacactcgtcaagctgctggttgagcgcaatgtccaagagacggcttcgacaggtgtcactcatttggggatgacgttgtttttcaatttgaaaaagtcattcttggcggcatctcatgaatccaatcaaaatttgcgaatccgatcaaatttttgggtcaacaattaataaacagttccgaattcattggctatgtttttccatatgcaaattttttcggagtttatgcaactgccaaaaacgaaatttttcggaaattgtaattccgagggccaaaaattcgccataaatttgttttttcgagggcccggttcagtaaattgtctgtcactcaatcaatgctaatttcttttttccttttccaggaactccaggacatggtgaagaacccattgcctgagggatgcactgcacggccacttgatcaacggaccatgaccccctggacggttaccatccgaggccgggccggcacaccgtacgaaaacggcaacttccaactgagcatggcatttccgagggactacccgttcaaagcgccgcaagtcacgttcaccacgcgcatcttccacccgaacatcgacacacggggcaaagtgtgtctggacattctgcaaacgcactgggcaccgacgctgaccatcgaaaaaggtggcgtggatttggtggtggatttgatcatgttttaaatggattgatcactttaatgctcgtaacttttttcaggggcattaagatccgctttttttgtgtttgattagcaaattcaaaagatttcattgcgtttcatcagagttagcgaaaaagcgaatttttggaatttatggtcttaatcgggcacgaatttgatggcgttggttttgtgtggtatttgtgcagtttgagtgatcaattttttcacatacaatttttggctgcagaaatcgttaatttgtttctctgtctttacagttgtgatctccatcatcgttctgctgaatgacccgaacccggacaactcgcctatcaatgcgcaagctgccagtttgtaccggactgaccgtgcggagttcaacagacgcgcccgtgagatgacgctcgcctatgcacgatgagatgatcagcacgtctttctgattccactaccaattatgtattactcattcattgtatatattattgtactgtatgttgtaccatatttatttgtgtgccactactgtgtgtctatttttgtgttgtatttgtgtgcattttcaaagccggtaaagaattttgtgctttttctattggcgtatccaaccttcaggaattttttttcgaaaactccttgaaaatgggccctcccgcttgaaattcaccctataaatgagctgatcactgatgaatgtcagtcaactcagattttgtgaaactttcgctaacattaagcattcattacacatgcacaaaattcggtggggattctttcaaaaagatttagcaaattctgcatgagtccaccgctaaaattatgtaattacttaatttcccgtccaattatattcattagtcgcagaaatttgaattgaatgaatgacatgttctcattcattcactgacatataacaatcgattggggtcatctcaaagtgtaaatgtttttgaactatcaaggaggatgtgatgatgatgacgagtgagtgacaattgcaaatgtcacggctcagaaatggccgtgaagcgtggaccaccgacgcctcccccttccccccccttcccccacgcctttcactcaattcaattcaaatcattatccgtccactccctctcattaccgcacaataattggattcaaaaaacattccattttctctcactcaactcatcattccgtgttcgttgagtgaccgttcatttttgtctcatttttgactgggattttccgggaccattttttgtttctgttttgtacttcatattcctgggtttagaattcattttctaacctgttttaacatcatcaccgtataatgaataacaccaccagcagcaggtaaacaccacccgttattttatttaattaaattccttgcatttggtcgggtttcttgaccaacagtaaaatttggttgtatgcaaatatgaatcccgaataggcctaaccaacaacaagtcaaatgccgaaaataaacgttcggtgtcggtctttaaattgattttgaaaattcacaattttctcgttttggcataatgcacgtttaaaaaagcagtttcccaccattctcgaactcattcccatgcataaattgtcccctgctaataccctttggcaaatccataaaaagtgccaaaaaaattattccccaaaatggccccaacgaccaaaaaaatatgtaaacgcctgccaccagagcttttgtatgaaacggttctttacgtatatcccaacccgaatttgtcgaatcttttcaattcttcttggatactcagaaaatttatgagtttccgagtccaaagatgggaggaaatacggaaattattatgttaattcaaatttggaaatgtttaattgtccggcaattttgattaatttttcattaagaaacgagcaattcttgaagcactttatgagtgttgtcgagaacgtaggccatggagaaccttcgaatcgtacacagcagacgaccaaaatgcccaaattttctttgcggcgttgacagaatttttggtgagcacaatttaagaaatgtcatgtttaaatgtttatgtgaatattcagaatccatatgcggaaatcgtgccctgaaactcccccggagcacatttacgacactatttcgtcatctcgtccgccgatgattcccattcgccgcataagaaggtttaaatgggatttttttcaggaaatgcatacttaaatggatatttagttgagcactcccccggggcacatttaccatactgtcatgacgaccacgtccgatggttcgcagctctcttctgtcatttacgacgttcctccgccttcgtcgaccattcctcgcgaatctgttactaccacccctccgccggtgccgcaacacacggttttgttcagggttaatttaggttaaaaatgtgcaatttggctcgcttttctcgaaatttcttcagggggagaactttttggattcaaaattttatttccagcacggaggcgaaaagaatcgaaagaacaacgaaacgccgtcgccggcctcgaaatgctcggacgcgaaaaaaaggtcgtaattttggagatgaactgatttttgaaataaaataaaattgtttttttagcgcaaagagacgccgaagaaggacagcgatggaaagaattgaaggcgttcatccatttaacaactcacaaataacatcatttttttttgttcactttggacgtttaattttttttgttttgttttaatttcggcatttgattcgagtattttgcccttttcatttgcattttatgtttttagttgctgaagataaaaaggctgttttattgtactgatttatgcataccattaaggtttcccaaatgctaaattgctctaaaatctgttacacacggcgagtcaattttggcctcccagtgcaaataagtttattttttatttactaatcataacgccaaaacttttcaaaacttaaaatttattggggattttcccttgtaaaaatggaagagccgatctcgagttaaaaacttaactttcacaaaataaacttggaatcgttagagggggtcaaaatatgggcctatgcaaaattttaagaaaattggtcaataggaaaaaatttttttcaaggataaacatttcaataattttaattcttttttagccaagtccacaatttaaggccaaaccaaataaaatttacaatattctccagaattttcccttcaaaatgagcataaaatggttttatttgctctactattcaccaagttataagctaaaaaaatttcataaaattgtcgatgttgtacgtaaccaacgctttttgaatatgattttttattgccacgaaaacttttattaatgaaaaaataattctgccttcttctgtaaacgaagaaattgaaattaacacacaacataaggaggactcgaacctgagaccccccttttggtgactaacgcacagaccactaagacgaaaaaaccaacttaattgtacttggagcccaaaattgactcgccgtgtatatgaataaacaatcccaatcagcagaaagtaccattttaaataaaatgctaactccaagttctatagagcatagagcgctttgtcaatagacggaccaattcgaaaaataaaaatacacaaataaaatgtaaaaaatctctgattaatctgtccatttccatctctctcccctcatttttcattcatttgtgttgccaaataagcatttgacaatgccacaacggttcgccacggcgatcacttgcaggattgcctccagcgagaaaaagtcgcgcaaccgatacggtaggggtcagtcgcgtctgaccagtagcgtctgagccaagaataaaacataacttttttattgttggtaaaattttataaattttgcatcattcgaaagctctacgtgtttagaagcttttgataagctattgctaagcgattgaacaacatataaaaaagttgcaacatgaacactaccaaaaagtcagaatttttacatattttaatttataacttttttatatgtcggtatgtctttgtgatttttggatagccgatagagcttgttaagagctttcgaatgataccaacattgttggatttggtcaacaaagaaaaaatttatggtgatctaaacttggctcagacgcaactggcccgtttcgcaaccgataggcccgatgaataccccaatcctcattcaaaagttataaaaacattacgccaaaccgcagaaaataaaattttaaaattttgttgccatggaaatgaaaagtcgctaaaacagaatcgcggaaaaattgtttttattttgttttaaaattccatagtcaatcaaataggtaggcggtaaatagacttgacctcttgcaaatgctcttagaagttctctgtatttttcatgaaacgattggacgactcacaaaagtttagtgcatggaaggcaaaccgtaaatattcattgtacgaaaacatgtaaactttcggcacttttggtgtttagggctctcctgaaaacccacaagttttcacgacttgtgacaaaaataaatattcaaaacaaaagccctccaccctttggattttttcggggccctaaacagcataaatgccaaagtttcaaacgatcccgaaatggttggttgcattttgttaacataaaaaaatgttatgaggcaaatttgttcc

SEQ ID NO: 4290 - DNA, 3424 bp, Heterodera glycines
tttttcatcaccttttcagccaccgatccgaactacgggacgcttcagaacttggacgcggaaatttttgtgaagaagtagtgccatcgacaacgggacggatcatcaataagaacgaggaaactatggatatgtcgtcccatgtcacatatgtacaaatattgtattaaagcggaagaatccctcctcatcattgtaataaatgtatgtaacattcgattcgttcagcagttgttcatttacatattggcggtgtgataaataaaaaaacgattctgaaaactttaatttcattttattcgacaaaaactgatgggatttcgaaggtttctgcttatttagatgggtcgaataattaaaatttaaaacatgcttatttttaagattcgtgtttgtgctcacttcttcaatgggggaaaaatttggtacttgttaagtttaggggatagatttcgtatacattttactaggtcgttgcataaaaaagggcgcttttttagaaaaaaaatttatacggaattcgaatgtttattcacgaaatttgataaatagaagcaacttgagtccaaaaataataaaaaatatcaggtccttgaaatcgtttgccaatcaattatgtattatcaactaagttaatccgacttttttctccgttcgttggcaaaaaaaagtctggacgcataaaaatttgattggacgcataatttggtctgtaaaaaaagtcattgcgaagaattttcaaaatttcgacttttttgcaatttcatgttatgaccctccgattgcgagtttggaatacaaaatttttttctagcccgaccggatttgcacgattaatcccaaaacttgcaaaaaaatattgctattttgcggattgggatgccgtaaaatccggcgactgatccggtcccgtgcctatctctacgcacatccattacctatatcacaacccaaaatgaattttacaatggtttatcccaatatcagcaattcattcctcttatttcacattccatattcattttacctgttttgtttgcagatttaatcgacacacaacaatggaattgataaaaatgtctgaactttatttggcattgcagggcgaacaatgttattacacagtgccatccattcataagggattcaacgttaaaaatgtttgttcggtcggggcggggggacaatttcttgcaaaaaagggaattttggacctcgggtcaaaactcggagcaaaaatgaaacttttaaaaaaaactgaaatttttgattttctccaaatagttttggagttcggcattctctgaaatgcatgccattttcctgatccaaaaaactccaatgttttcagattttttgttttaaaaccaacttttatcaccccaaaaatttgccgtttttacgttttaattttaagcttcctttcgagtgtccgtcattttcaattgcacttgaacagcagttgcaacaaattgtggacttctccggctgtgtgaaggcaattgaaacatggaaagcggaacacttgtacaaccgcacggactgcttggactcggtgaagaaggcaatcctggagtcaatcatcgacgcctacaacatttaccagaacgaggctgaccgaatgcgtcgcgaagtttgtgtgaaggccgggaatttgagtaataattgagattttagggattgagttacacacgaaaattcattggcaacctattataagataatgcctcccataaaaaaaatttttttgaaattttttccaaaaatggcggggggggggggggggtaccacttataatataagaaataatcaaccatttttcaattgttttgttgattgttctaggcgttatgccaaattccgggttttcccgggctgatggaaattattgaattggtacgtttccatacctgtcaggttccagaaaactttaaaacttgctcgattaaactaaatcaaatttggtattattgggaagctcaacgagatttgtttaaccatataaaatatcaattttttaaatatgtgctttcgcgctcgaatttcgctcttgaaaactcctcattttttttcgaaaatttatcaatattttaagataaatattttttattcgcatcgcatttttgacactttaaattcaaattgtataccggacactgttcagaatgtgttgcacaagtacagccacagtattgccgatttgtgtgcatttgttcgcacttggcaacaacggctcaaccatttgttgggtttgctgcaaaaatcggacggtctctgtggccttgagatgatgaacgtgttgtttggccagtggacattccagtgctgcatcaacgactggcgttacaggtttcatcaaaatccaaacattttttggtctttgacggtgcggaaagacgccaaaaatttttgattttttttttacgaaattgtcatggaaaagtactacaaattttttcaaaaattggccatcgatcggctttgatattctcccctgaagacaaaaactacaaaatttcaatcttgggggtccgaatttctaataaaaatttaaaaatcggtttccttgggctcgtcgattcgccagcaactccgaaaaaaagaagtttttctagttcctaaaattgccgagtttgccgcttaaaattatgccaatacatattgctcttccgagctaaaaaaatggaaatttggattttcctatactcaagtctccatggctgaaaaatcgtgtcaaaaaacgaaaaatttatttttatttttttaaatttcagaacgattgagactgcgctgcttgccggctccagcgcaatgcaccaactgctggtcagttggctgctcgacgccaaactggcacccgcggcactcacccggtggttcattcggcccaaatttgtgccatcatccgacgacccaaatgagtcccaactgcaacgcccgcgccattcattcaacaactccgtgctgtccgccgcccagctgacaatgaacggcagcgcgaacgcgctcaacatgagcatcgccgccaacaccaccaccaactatcaaaatgaattgtgcctttttgaagcgccgccgccgacggcggatgccgtcatcatggcatcggcaacaacaatgactagaaacagcgcttccttttttggcacaaccaccgctggcagcgatgcggcaagcattggcaccggcacgggcacatttgttgtcgctgctgctggtgctgttgttgaggacagaattggatgggcttcacagcagcagcagcagttgattttgtctgtccagcttgacactgacgtattgccagcaccgttttacggctgcgaggagcttctcaacatggtcagttatttgattttgattatttgcgatccgccattttctgagtgagtcccctcccgtgagaaagtttaaaaaaggtta

SEQ ID NO: 4291 - DNA, 2166 bp, Heterodera glycines
attaatcatctcaccaaaaagttgatttatagtttacacaaaattaggattttcttgaatttttaagtcttataaatcatagctttttggtgagatgattcagcgcttagcttctgcttaatgattacttctaatctcccaataattaagaaaaaattcatccaggtttcattgcctttttatcgaccgaaaattttatttttcggcattttcttctgtaaaactcaaactttgcctcaataagtcaaaaaaatcacgaacaaaagtcgcaaaaactcaaaaaagtcataaaaatccgaaaaagtgtaaaaaaaagtcaaaaaaagtctcaaaaaaatgcatgttagaagtagggatcggatttttagtggcaaaaatcccaaaataattaactaaatagtggcaaaaatagtggcgaaaaagttccaaataattacttttaatagaaaacttttaagctctgatggggttttgaacaagcccaatttcgagaaagaattactcgattgagtaaatttcggcataaatttgaagagaaaaaaaggattttcgatgagagacctattttgattttggcagcaaatgtcgggacgcaaatgtccgaaaatggcccttaagaaatgggccgcaaatgtccgaggcgaaaatgtcgggccgcaaaagacggaccgcaattgtcgtttttggctggtggccgcaaatgtcgtgacacgaaatcaacaacagcaaaaaggaaacagcgaagggggaggagaaggaagagaaaatgggggaaaagagagaaaaagggaggagaaaaaggagcagcaactgaagaagaggaaaaagaaaattgcagctgaacaccagcagaaacaacaacatcagcagaagcaagaacattggaaggaggagagacggaagagaaagagaggaaaatggaggagaaaaaggagcagcaactgaagaagaggaaaaagaaaattgcagctgaacaccatcagaaacaacaacatcagcagaagcaagaacatttagatagcaaaccattttatacacccgatttatttaccgaaattgagagttttttcttcataaaatgcatttgatcacggatgaatatgatcggtcgatcggtcattcttaattaattcatttcttcttcttctgcggctgatcactgtttttgttcttttgtccgtcactcatttgtcagcagaagacggcccttttgtgatgttttgtgccgcttcttctgccggtggcggagacaatggccttaattaagcgcaatttgaattatctaaacactttttttttaattgctcacccaatgcaattattggcgctattataaagccaaatggacacattgttacaactgttgtccaaattttcatttttcttttgctgctgaaccgtcgcggtctccccaataattttgcagcgtttcattatccaacagttgtccaattcattttcatttgctttggccaatgtcagcttttcctttgtccattcgttcaccaattcgaatggcaccatttgtattgacggcacatgaacataaaaatgaatttcgtaactgacggaagaaatggcattggcacgaagaaaatgctaaacaatttgaaaacaaaaaacagtgatttgtcgagattatggccacacctccttgaaattgttgatccaatcaaagtccgtttgttcgttgtaattaccgcaacgcaatcgcttgggttgtccatcttttctcggagagtgcaaccatttggacaatgcttggccagcagaaattgttgaatttggcccatcaaaaccatcatcaatcgcagcgggaaacaaatcaaatgaatggattgaagtcaattggttgagatcgatgagaattgtcggcgaaatttgacgaagcaaatggtccaaatgatcaccatcgtaaaagcgcaagtggcgaatgtttgccgaaaaaattggccaaacaactgtaaatcggtgcctcttttgtcgaaaatttgatgatttgaacgaagaaaagcgatgacggagtgatcaatgtacctaaaaatggaaggaaagcttttattgccataactctgattttaaattactcaatccgaaggtctttaaaacggattttgctgggcaacggacggtcgggcaatggaaatggcacaaatttgtcatcga

SEQ ID NO: 4292 - DNA, 4942 bp, Heterodera glycines
attgactgcgaggatcagaaatggcaatttgagcatttcattaaactggaaaatcattatctggtgaaatcttatattaaataagatcaggtgacaaatctgagttcaggttcgtgatcagcacccttgaaaacccccgtatacaaatttcagctcaaaaaataaatatgggacccccattcttcacgattaccaaaaactgataaatataatgagtttaaaatccgatcaaacattctataagcaattgcgcgcaagtttaccaaaaagaggtaaatttatcgttacattcaacaacctcttccgctttaatcacccttcaactatgctattccgaaaactgagaaacgaagagcgacataaatgaatgtcatatattcgtgatcagtagggaacggatttttaagcgcgaaaaagtccaaaataagtgcttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttagaaatgaagtacatttagaaattttcaggatttaagggtcgattctcaggggcgtatttttccgaaatttttttggccgattcttaggggtgtattttttgaaaatttttaggtcaattctcaggggtgtatttttccgaaattttttgggtcgattcttaggagtgtattttttgaaaatttttaggtcaattctcaggggtgtatttttccgaaatttttttggccgattcttaggggtgtatttatcatttttattgcatttttgctaataaatttccgaaaaatcgcgaaataagaacgaaaataagcataaaacggtaaaataagtacaaaaacttattttaagggcgaacctctaaaataagcatttttaagcacgaaacgccaaaataagcatttctaagttcgaataagtgcgttaaaacacaaaattttcgaacaaaaaatgtgtttttcgtgcatttctcgtcgagttaaagccgcagaaaaaataagcaaaaacttagaaatccgttccctagtcttaatatttgttgactttttaataaaatttttgtcattttacacccctaagttcggaactttttggcacctattttcccatttttagcacctatttttggggttttttagaacctaaaacctacctattttggcagtttttagcacctaaaaatgtaagccctaataataaagagtcaaactaccgtatttctctaattatatgcaagtcaccaataatctacccctttcgaagtaggttgaaaaataatctccccttctctatttatctgcccgggggataaatagaatttatatttttttcgaaaaaataacttcttttctatttttattagagtagagcgggaccgggaattttgggcaaaaccgggaccgggacttgccgggacctgagaagccgggaccgggacctcggtttttgtccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttataataaattaaattaatgaaaattttcaaacaaattttcttcaattatttcaaacaattaatcatttttggactaaatcatcgaatattaatagaaattcagatttgattttcacatcactttttttcggagcgcttttccaaaaaacttttgggaaagaaggggtccggcggtgccgataggcgccgccgggggaaattttgaaaatttgggtgcaatttgttaacagattttcaacaaaaaaaggttggttgtaaagaatatattaatatatttttaaattttttctttttaactccaattttcttcactaatttttcactcagaccccattcttaccagtgcttgtttttcccggttcccggttgccctaccgggaccgggaccgggacctgagcttttcaaaacccgggaccgggaaccgggacctcggatgaccgggaattcccggcccggtcccggtcccggtcccgtggcactctacttctaacatacattttttgtgactttttttgacttttttacccttttttgggatttttatgacttttttgcgtttttgtgactttttcatgactttttacactttttaaggcaaaatttgactttttgtgatgaaaattccgaaaaataagccaatcttagagacggaactgaaatttcttagtcattaggactcaaatgacgaaactgaaaaataaaaaataaaataaaaatctggcggtgtaacaattttgggtacttgtgtgtgttatctgtgggcagattttcaaaaatttttatgtttttcgctataacttttttctttgtcatccaaatccaagattgttggtatcattcgaaagcttaacatgtttcgaatctaattctatgtatcacttcgcgattagacaattaccaaaaaagttatacatgaaaattgcgaaaaggtcgaaattatgaagttttttcttaataaaattttgtaattacaactcgccttttgtccccttctccccttgctgcttttggtgtttttgttgtccctccaattcaccgattcaatcaaaattgccttttcagtaataacttaaattggaacaaatcctattaatatttgacagtaattataataataatgttacggtaggtacagtaattaaccattgctcatttcccttaactatttgacagtaacatccttcgtctgcactttcacatcaatttgtgccatgacatttttctcaagcttttcttatttttcatgttgtcatcattctccttttcggcatcagcgttcgtctgtagcatcttttacggcattttagcaaaaaagaaaatcaaattcaaaatgtgctgatcaatttgcttcattttccttttttctccatggttggacaatgttaatggtataaagcttaaaaataaagaaaatcgggagaattttatttcctgaaattctcgaaatttgttatttttctgaaaaaattcagacccctgttttgaattttaaaatttagaaatttttcaagaaaaaatttttgaaaattctcaggcgattttttcaaatttaatgacgaattctaagaattttcaaaatatttaaaaaaaaaaaatcgcttaattttttaaaaaattttttaatagaattttcaaagaaaaatttttcgcaggctttttcaagaaaaatttctgtttgaaaatttaaaaaaaaattgtttaaagaatttcaacttggaattaattaattattataaaaatagaaaagaagttatttttattgtttattgtttattcataaaaaataaaaaagtcatcagaagggcgaaaaccacttactctgacgactattccggtaaatgtgtcgtagagtaagtgacaaaatatatggatgatcacaggaattaaaaaaagacaaaaatatgtgaaaataaataataaataaattgaggtcaaagtcaaatgaggtcgaaataccaaatcacttagaaatttgttacattctaactttcccggtcttacagattaccctagtgaactttaagttttattttaaatcccccgggcagataaatagagaaggggagattatttttcaacctacttcgaaaggggtagattattggtgacttgcatataattagagaaatacggtagtttgactttattattagggcttacatttttaggtgctaaaaactgccaaaataggtaggttttaggttctaaaaaaccccaaaaataggtgctaaaaatgggaaaataggtgccaaaaagttccgaacttaggggtgtaaaatgacaaaaattttattaaaaagtcaacaaatattaagacaaattgagaaaaataatttttaaaatcaaaaattctcgtaaataggtaaaaatctaaaaatgtaagccctatttattattacgttggtcagttttcaaatttcaaaaaacaaatgcgcgtctaacatttgcaaatgaaagttggataaaaataatccgtcaaattgattttttattgattgatttgggggtaggggctaaaacgcccggcaaatgtcatcattttgcaaaatatattctcctctgttgcgtgcgttccttccattccaaagcactgccattccctttttctgctcgctttttgtcaatgattttcgtctcccattggcatattgtccaacccctcgggcccatttgcaacaatttaaggcaaacaaaattcaaaagttgtttggataaaatgtgattttcgttagaatttttggttttccgcttttctaattatataaaaataaagtttccaacgcaattaattcttctgttatttgtgtgacatcattcggaactcggccaaattgtgctaattgctgccaaaaatgaaccgacggtaattaaattaaaagtcacaaattcgtcgtttatttgactaaactgttttcccatttcagttggatttgcaacgacgtttggatggacattttcccatcctttgaccgtcctcaactcggcctgaaattggcacttctttcgccacgtttcaatgcgttggtggacaaacatttcgatggcaaaagcgaattggcaatttggagaccaatcgaaattcacaagggcaaaggaccagaaccgaaactatctgtgtggatggatgacgaatctaacaatgttgtgccatttccattgcccgaccgtccgttgcccagcaaaatccgttttaaatgccttcggatttagtaattaaaaatcagagagctatgacaataaaagcattccttccatttcacagttacattgat
